(12) United States Patent
Kovalic et al.

(10) Patent No.: US 7,214,786 B2
(45) Date of Patent: May 8, 2007

(54) NUCLEIC ACID MOLECULES AND OTHER MOLECULES ASSOCIATED WITH PLANTS AND USES THEREOF FOR PLANT IMPROVEMENT

(76) Inventors: David K. Kovalic, 7300 Cornell Ave., University City, MO (US) 63130; Scott E. Andersen, 1036 Fashion Sq., St. Louis, MO (US) 63146; Joseph R. Byrum, 4533 Woodland Ave., Unit 1, West Des Moines, IA (US) 50266; Timothy W. Conner, 989 Tara Oaks, Dr., Chesterfield, MO (US) 63005; James D. Masucci, 4 Foxcliff Ct., Ballwin, MO (US) 63011; Yihua Zhou, 1016 Westrun Dr., Ballwin, MO (US) 63017

( * ) Notice: Subject to any disclaimer, the term of this patent is extended or adjusted under 35 U.S.C. 154(b) by 356 days.

(21) Appl. No.: 10/703,032

(22) Filed: Nov. 6, 2003

(65) Prior Publication Data

US 2007/0044171 A1   Feb. 22, 2007

Related U.S. Application Data

(63) Continuation-in-part of application No. 10/020,338, filed on Dec. 12, 2001, now abandoned.

(60) Provisional application No. 60/255,575, filed on Dec. 14, 2000.

(51) Int. Cl.
*C12N 15/29* (2006.01)
*C07K 14/415* (2006.01)

(52) U.S. Cl. ...................................... 536/23.6; 530/324

(58) Field of Classification Search .................... None
See application file for complete search history.

*Primary Examiner*—James Martinell
(74) *Attorney, Agent, or Firm*—Lawrence M. Lavin, Jr.; Matthew L. Madsen; Arnold & Porter LLP

(57) ABSTRACT

Recombinant polynucleotides and recombinant polypeptides useful for improvement of plants are provided. The disclosed recombinant polynucleotides and recombinant polypeptides find use in production of transgenic plants to produce plants having improved properties.

2 Claims, No Drawings

NUCLEIC ACID MOLECULES AND OTHER MOLECULES ASSOCIATED WITH PLANTS AND USES THEREOF FOR PLANT IMPROVEMENT

This application claims the benefit of and is a continuation in part of U.S. application Ser. No. 10/020,338 filed Dec. 12, 2001, now abandoned which claims the benefit of U.S. provisional application No. 60/255,575 filed Dec. 14, 2000, both of which are hereby incorporated by reference in their entirety.

INCORPORATION OF SEQUENCE LISTING

Two copies of the sequence listing (Seq. Listing Copy 1 and Seq. Listing Copy 2) and a computer-readable form of the sequence listing, all on CD-ROMs, each containing the file named pa_00608.rpt, which is 235,202,560 bytes (measured in MS-DOS) and was created on Nov. 3, 2003, are hereby incorporated by reference.

INCORPORATION OF TABLE

Two copies of Table 1 (Table 1 Copy 1 and Table 1 Copy 2) all on CD-ROMs, each containing the file named pa_00608.txt, which is 38,916,096 bytes (measured in MS-DOS) and was created on Nov. 4, 2003, are hereby incorporated by reference.

FIELD OF THE INVENTION

Disclosed herein are inventions in the field of plant biochemistry and genetics. More specifically recombinant polynucleotides and recombinant polypeptides from *Triticum aestivum* for use in plant improvement are provided. Methods of using the recombinant polynucleotides and recombinant polypeptides for production of transgenic plants with improved biological characteristics are disclosed.

BACKGROUND OF THE INVENTION

The ability to develop transgenic plants with improved traits depends in part on the identification of polynucleotides that are useful for the production of transformed plants having desirable qualities. In this regard, the discovery of polynucleotide sequences of genes, and the polypeptides encoded by such genes, is needed. Molecules comprising such polynucleotides may be used, for example, in recombinant DNA constructs useful for imparting unique genetic properties into transgenic plants.

SUMMARY OF THE INVENTION

The present invention provides a recombinant polynucleotide selected from the group consisting of SEQ ID NO: 1 through SEQ ID NO: 105,582. The present invention also provides a recombinant polypeptide selected from the group consisting of SEQ ID NO: 105,583 through SEQ ID NO: 211,164.

The present invention also provides a method of producing a plant having an improved property, wherein said method comprises transforming a plant with a recombinant construct comprising a promoter region functional in a plant cell operably joined to a polynucleotide comprising a coding sequence for a polypeptide associated with said property, and growing said transformed plant.

DETAILED DESCRIPTION OF THE INVENTION

The present invention provides recombinant polynucleotides and recombinant polypeptides from *Triticum aestivum*. The recombinant polynucleotides and recombinant polypeptides of the present invention find a number of uses, for example in recombinant DNA constructs, in physical arrays of molecules, for use as plant breeding markers, and for use in computer based storage and analysis systems.

The recombinant polynucleotides of the present invention also find use in generation of transgenic plants to provide for increased or decreased expression of the polypeptides encoded by the recombinant polynucleotides provided herein. As used herein a "transgenic" organism is one whose genome has been altered by the incorporation of foreign genetic material or additional copies of native genetic material, e.g. by transformation or recombination. As a result of such biotechnological applications, plants, particularly crop plants, having improved properties are obtained. Crop plants of interest in the present invention include, but are not limited to soy, cotton, canola, maize, wheat, sunflower, sorghum, alfalfa, barley, millet, rice, tobacco, fruit and vegetable crops, and turf grass. In one embodiment the disclosed recombinant polynucleotides provide plants having improved yield resulting from improved utilization of key biochemical compounds, such as nitrogen, phosphorous and carbohydrate, or resulting from improved responses to environmental stresses, such as cold, heat, drought, salt, and attack by pests or pathogens. Recombinant polynucleotides of the present invention may be used to provide plants having improved growth and development, and ultimately increased yield, as the result of modified expression of plant growth regulators or modification of cell cycle or photosynthesis pathways. Other traits of interest that may be modified in plants using polynucleotides of the present invention include flavonoid content, seed oil and protein quantity and quality, herbicide tolerance, and rate of homologous recombination.

Polynucleotides

Depending on the intended use, the recombinant polynucleotides of the present invention may be present in the form of DNA, such as cDNA or genomic DNA, or as RNA, for example mRNA. The polynucleotides of the present invention may be single or double stranded and may represent the coding, or sense strand of a gene, or the non-coding, antisense, strand. In one embodiment, the recombinant polynucleotides of this invention represent cDNA sequences from *Triticum aestivum*. DNA sequences representing the recombinant polynucleotides are provided herein as SEQ ID NO: 1 through SEQ ID NO: 105,582.

The term "recombinant polynucleotide" as used herein refers to a polynucleotide produced by recombinant DNA technology. In one embodiment a recombinant polynucleotide may be produced by separation from substantially all other molecules normally associated with it in its native state. A recombinant polynucleotide may be greater than 60% free, greater than 75% free, greater than 90% free, or greater than 95% free from the other molecules (exclusive of solvent) present in the natural mixture. In another embodiment, a recombinant polynucleotide may be separated from nucleic acids which normally flank the polynucleotide in nature. Thus, polynucleotides fused to regulatory or coding sequences with which they are not normally associated, for example as the result of recombinant techniques, are considered recombinant polynucleotides herein. Such molecules are considered recombinant polynucleotides even when present, for example in the chromosome of a host cell, or in a nucleic acid solution. The term recombinant polynucleotide as used herein is not intended to encompass molecules present in their native state.

It is understood that the molecules of the invention may be labeled with reagents that facilitate detection of the molecule. As used herein, a label can be any reagent that facilitates detection, including fluorescent labels, chemical labels, or modified bases, including nucleotides with radioactive elements, e.g. $^{32}P$, $^{33}P$, $^{35}S$ or $^{125}I$ such as $^{32}P$ deoxycytidine-5'-triphosphate ($^{32}PdCTP$).

Recombinant polynucleotides of the present invention are capable of specifically hybridizing to other polynucleotides under certain circumstances. As used herein, two polynucleotides are said to be capable of specifically hybridizing to one another if the two molecules are capable of forming an anti-parallel, double-stranded nucleic acid structure. A polynucleotide is said to be the "complement" of another polynucleotide if the molecules exhibit complete complementarity. As used herein, molecules are said to exhibit "complete complementarity" when every nucleotide in each of the polynucleotides is complementary to the corresponding nucleotide of the other. Two polynucleotides are said to be "minimally complementary" if they can hybridize to one another with sufficient stability to permit them to remain annealed to one another under at least conventional "low-stringency" conditions. Similarly, the polynucleotides are said to be "complementary" if they can hybridize to one another with sufficient stability to permit them to remain annealed to one another under conventional "high-stringency" conditions. Conventional stringency conditions are known to those skilled in the art and can be found, for example in *Molecular Cloning: A Laboratory Manual, 3$^{rd}$ edition Volumes* 1, 2, *and* 3. J. F. Sambrook, D. W. Russell, and N. Irwin, Cold Spring Harbor Laboratory Press, 2000.

Departures from complete complementarity are therefore permissible, as long as such departures do not completely preclude the capacity of the polynucleotides to form a double-stranded structure. Thus, in order for a polynucleotide to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology*, John Wiley & Sons, N.Y. (1989). Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

As used herein "sequence identity" refers to the extent to which two optimally aligned polynucleotides or polypeptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as those in the BLAST suite of sequence analysis programs.

In one embodiment this invention provides recombinant polynucleotides comprising regions that encode polypeptides. The encoded polypeptides may be the complete protein encoded by the gene represented by the polynucleotide, or may be fragments of the encoded protein. In one embodiment, polynucleotides provided herein encode polypeptides constituting a substantial portion of the complete protein. In another embodiment polynucleotides provided herein encode polypeptides constituting a sufficient portion of the complete protein to provide the relevant biological activity.

In one embodiment recombinant polynucleotides of the present invention encode polypeptides involved in one or more important biological function in plants. Such recombinant polynucleotides may be expressed in transgenic plants to produce plants having improved phenotypic properties and/or improved response to stressful environmental conditions. See, for example, Table 1 for a list of SEQ ID numbers representing the recombinant polynucleotides that may be expressed in transgenic plants to impart an improved plant property where improved plant properties are provided for each sequence in the PRODUCT_CAT_DESC column.

Recombinant polynucleotides of the present invention are generally used to impart such improved properties by providing for enhanced protein activity in a transgenic organism, such as a transgenic plant, although in some cases, improved properties are obtained by providing for reduced protein activity in a transgenic plant. Reduced protein activity and enhanced protein activity are measured by reference to a wild type cell or organism and can be determined by direct or indirect measurement. Direct measurement of protein activity might include an analytical assay for the protein, per se, or enzymatic product of protein activity. Indirect assay might include measurement of a property affected by the protein. Enhanced protein activity can be achieved in a number of ways, for example by overproduction of mRNA encoding the protein or by gene shuffling. One skilled in the art will know methods to achieve overproduction of mRNA, for example by providing increased recombinant copies of a gene or by introducing a recombinant construct having a heterologous promoter operably linked to a recombinant polynucleotide encoding a polypeptide into a target cell or organism. Reduced protein activity can be achieved by a variety of mechanisms including antisense, mutation, or knockout. Antisense RNA will reduce the level of expressed protein resulting in reduced protein activity as compared to wild type activity levels. A mutation in the gene encoding a protein may reduce the level of expressed protein and/or interfere with the function of expressed protein to cause reduced protein activity.

In one embodiment, the invention is a fragment of a disclosed recombinant polynucleotide consisting of oligonucleotides of at least 15, at least 16 or 17, at least 18 or 19, or at least 20 or more consecutive nucleotides. Such oligonucleotides are fragments of the larger recombinant polynucleotides having a sequence selected from the group consisting of SEQ ID NO: 1 through SEQ ID NO: 105,582, and find use, for example as probes and primers for detection of the polynucleotides of the present invention.

In one embodiment the present invention is a functional variant of a recombinant polynucleotide provided herein. As used herein, a "functional variant" refers to any second polynucleotide varying from a first polynucleotide sequence in such a way so as not to significantly affect the function when compared to the function of the first polynucleotide.

Such functional variants may be naturally occurring, including homologous polynucleotides from the same or a different species, or may be non-natural functional variants, for example polynucleotides synthesized using chemical synthesis methods, or generated using recombinant DNA techniques. With respect to nucleotide sequences, degeneracy of the genetic code provides the possibility to substitute at least one base of the protein encoding sequence of a gene with a different base without causing the amino acid sequence of the polypeptide produced from the gene to be changed. Hence, in one embodiment, a recombinant polynucleotide of the present invention may have any base sequence that has been changed from SEQ ID NO: 1 through SEQ ID NO: 105,582 by substitution in accordance with degeneracy of the genetic code. See for example, U.S. Pat. No. 5,500,365, which is hereby incorporated by reference.

Polynucleotides of the present invention that are functional variants of the polynucleotides provided herein will generally demonstrate significant identity with the polynucleotides provided herein. Of particular interest are polynucleotide homologs having at least about 60% sequence identity, at least about 70% sequence identity, at least about 80% sequence identity, at least about 85% sequence identity, and at least about 90%, 95% or even greater, such as 98% or 99% sequence identity with polynucleotide sequences described herein.

Polypeptides

In one embodiment this invention also provides recombinant polypeptides. Amino acid sequences of the recombinant polypeptides of the present invention are provided herein as SEQ ID NO: 105,583 through SEQ ID NO: 211,164.

As used herein, the term "polypeptide" refers to an unbranched chain of amino acid residues that are covalently linked by an amide linkage between the carboxyl group of one amino acid and the amino group of another. The term polypeptide can encompass whole proteins (i.e. a functional protein encoded by a particular gene), as well as fragments of proteins. In one embodiment the invention is a recombinant polypeptide which represents a whole protein. In another embodiment the invention is a recombinant polypeptide which represents a sufficient portion of an entire protein to impart the relevant biological activity of the protein. The term "protein" also includes molecules consisting of one or more polypeptide chains. Thus, a recombinant polypeptide of the present invention may also constitute an entire gene product, but only a portion of a functional oligomeric protein having multiple polypeptide chains.

As used herein, the term "recombinant polypeptide" refers to a polypeptide produced as a result of recombinant DNA technology. The term recombinant polypeptide as used herein is not intended to encompass molecules present in their native state.

In one embodiment the invention is a recombinant polypeptide involved in one or more important biological properties in a plant. Such recombinant polypeptide may be produced in transgenic plants to provide plants having improved phenotypic properties and/or improved response to stressful environmental conditions. In some cases, decreased expression of such polypeptide may be desired, such decreased expression being obtained by use of the polynucleotide sequences provided herein, for example in antisense or cosuppression methods. See, Table 1 for a list of improved plant properties and PROTEIN_NUM for the recombinant polypeptide whose expression may be altered in transgenic plants to impart such improvements. A summary of such improved properties and polypeptides of interest for increased or decreased expression is provided below.

Yield/Nitrogen: Yield improvement by improved nitrogen flow, sensing, uptake, storage and/or transport. Polypeptides useful for imparting such properties include those involved in aspartate and glutamate biosynthesis, polypeptides involved in aspartate and glutamate transport, polypeptides associated with the TOR (Target of Rapamycin) pathway, nitrate transporters, ammonium transporters, chlorate transporters and polypeptides involved in tetrapyrrole biosynthesis.

Yield/Carbohydrate: Yield improvement by effects on carbohydrate metabolism, for example by increased sucrose production and/or transport. Polypeptides useful for improved yield by effects on carbohydrate metabolism include polypeptides involved in sucrose or starch metabolism, carbon assimilation or carbohydrate transport, including, for example sucrose transporters or glucose/hexose transporters, enzymes involved in glycolysis/gluconeogenesis, the pentose phosphate cycle, or raffinose biosynthesis, and polypeptides involved in glucose signaling, such as SNF1 complex proteins.

Yield/Photosynthesis: Yield improvement resulting from increased photosynthesis. Polypeptides useful for increasing the rate of photosynthesis include phytochrome, photosystem I and II proteins, electron carriers, ATP synthase, NADH dehydrogenase and cytochrome oxidase.

Yield/Phosphorus: Yield improvement resulting from increased phosphorus uptake, transport or utilization. Polypeptides useful for improving yield in this manner include phosphatases and phosphate transporters.

Yield/Stress tolerance: Yield improvement resulting from improved plant growth and development by helping plants to tolerate stressful growth conditions. Polypeptides useful for improved stress tolerance under a variety of stress conditions include polypeptides involved in gene regulation, such as serine/threonine-protein kinases, MAP kinases, MAP kinase kinases, and MAP kinase kinases; polypeptides that act as receptors for signal transduction and regulation, such as receptor protein kinases; intracellular signaling proteins, such as protein phosphatases, GTP binding proteins, and phospholipid signaling proteins; polypeptides involved in arginine biosynthesis; polypeptides involved in ATP metabolism, including for example ATPase, adenylate transporters, and polypeptides involved in ATP synthesis and transport; polypeptides involved in glycine betaine, jasmonic acid, flavonoid or steroid biosynthesis; and hemoglobin. Enhanced or reduced activity of such polypeptides in transgenic plants will provide changes in the ability of a plant to respond to a variety of environmental stresses, such as chemical stress, drought stress and pest stress.

Cold tolerance: Polypeptides of interest for improving plant tolerance to cold or freezing temperatures include polypeptides involved in biosynthesis of trehalose or raffinose, polypeptides encoded by cold induced genes, fatty acyl desaturases and other polypeptides involved in glycerolipid or membrane lipid biosynthesis, which find use in modification of membrane fatty acid composition, alternative oxidase, calcium-dependent protein kinases, LEA proteins and uncoupling protein.

Heat tolerance: Polypeptides of interest for improving plant tolerance to heat include polypeptides involved in biosynthesis of trehalose, polypeptides involved in glycerolipid biosynthesis or membrane lipid metabolism (for altering membrane fatty acid composition), heat shock proteins and mitochondrial NDK.

Osmotic tolerance: Polypeptides of interest for improving plant tolerance to extreme osmotic conditions include polypeptides involved in proline biosynthesis.

Drought tolerance: Polypeptides of interest for improving plant tolerance to drought conditions include aquaporins, polypeptides involved in biosynthesis of trehalose or wax, LEA proteins and invertase.

Pathogen or pest tolerance: Polypeptides of interest for improving plant tolerance to effects of plant pests or pathogens include proteases, polypeptides involved in anthocyanin biosynthesis, polypeptides involved in cell wall metabolism, including cellulases, glucosidases, pectin methylesterase, pectinase, polygalacturonase, chitinase, chitosanase, and cellulose synthase, and polypeptides involved in biosynthesis of terpenoids or indole for production of bioactive metabolites to provide defense against herbivorous insects.

Cell cycle modification: Polypeptides encoding cell cycle enzymes and regulators of the cell cycle pathway are useful for manipulating growth rate in plants to provide early vigor and accelerated maturation leading to improved yield. Improvements in quality traits, such as seed oil content, may also be obtained by expression of cell cycle enzymes and cell cycle regulators. Polypeptides of interest for modification of cell cycle pathway include cyclins and EIF5alpha pathway proteins, polypeptides involved in polyamine metabolism, polypeptides which act as regulators of the cell cycle pathway, including cyclin-dependent kinases (CDKs), CDK-activating kinases, CDK-inhibitors, Rb and Rb-binding proteins, and transcription factors that activate genes involved in cell proliferation and division, such as the E2F family of transcription factors, proteins involved in degradation of cyclins, such as cullins, and plant homologs of tumor suppressor polypeptides.

Seed protein yield/content: Polypeptides useful for providing increased seed protein quantity and/or quality include polypeptides involved in the metabolism of amino acids in plants, particularly polypeptides involved in biosynthesis of methionine/cysteine and lysine, amino acid transporters, amino acid efflux carriers, seed storage proteins, proteases, and polypeptides involved in phytic acid metabolism.

Seed oil yield/content: Polypeptides useful for providing increased seed oil quantity and/or quality include polypeptides involved in fatty acid and glycerolipid biosynthesis, beta-oxidation enzymes, enzymes involved in biosynthesis of nutritional compounds, such as carotenoids and tocopherols, and polypeptides that increase embryo size or number or thickness of aleurone.

Disease response in plants: Polypeptides useful for imparting improved disease responses to plants include polypeptides encoded by cercosporin induced genes, antifungal proteins and proteins encoded by R-genes or SAR genes. Expression of such polypeptides in transgenic plants will provide an increase in disease resistance ability of plants.

Galactomannanan biosynthesis: Polypeptides involved in production of galactomannans are of interest for providing plants having increased and/or modified reserve polysaccharides for use in food, pharmaceutical, cosmetic, paper and paint industries.

Flavonoid/isoflavonoid metabolism in plants: Polypeptides of interest for modification of flavonoid/isoflavonoid metabolism in plants include cinnamate-4-hydroxylase, chalcone synthase and flavonol synthase. Enhanced or reduced activity of such polypeptides in transgenic plants will provide changes in the quantity and/or speed of flavonoid metabolism in plants and may improve disease resistance by enhancing synthesis of protective secondary metabolites or improving signaling pathways governing disease resistance.

Plant growth regulators: Polypeptides involved in production of substances that regulate the growth of various plant tissues are of interest in the present invention and may be used to provide transgenic plants having altered morphologies and improved plant growth and development profiles leading to improvements in yield and stress response. Of particular interest are polypeptides involved in the biosynthesis of plant growth hormones, such as gibberellins, cytokinins, auxins, ethylene and abscisic acid, and other proteins involved in the activity and/or transport of such polypeptides, including for example, cytokinin oxidase, cytokinin/purine permeases, F-box proteins, G-proteins and phytosulfokines.

Herbicide tolerance: Polypeptides of interest for producing plants having tolerance to plant herbicides include polypeptides involved in the shikimate pathway, which are of interest for providing glyphosate tolerant plants. Such polypeptides include polypeptides involved in biosynthesis of chorismate, phenylalanine, tyrosine and tryptophan.

Transcription factors in plants: Transcription factors play a key role in plant growth and development by controlling the expression of one or more genes in temporal, spatial and physiological specific patterns. Enhanced or reduced activity of such polypeptides in transgenic plants will provide significant changes in gene transcription patterns and provide a variety of beneficial effects in plant growth, development and response to environmental conditions. Transcription factors of interest include, but are not limited to myb transcription factors, including helix-turn-helix proteins, homeodomain transcription factors, leucine zipper transcription factors, MADS transcription factors, transcription factors having AP2 domains, zinc finger transcription factors, CCAAT binding transcription factors, ethylene responsive transcription factors, transcription initiation factors and UV damaged DNA binding proteins.

Homologous recombination: Increasing the rate of homologous recombination in plants is useful for accelerating the introgression of transgenes into breeding varieties by backcrossing, and to enhance the conventional breeding process by allowing rare recombinants between closely linked genes in phase repulsion to be identified more easily. Polypeptides useful for expression in plants to provide increased homologous recombination include polypeptides involved in mitosis and/or meiosis, including for example, resolvases and polypeptide members of the RAD52 epistasis group.

Lignin biosynthesis: Polypeptides involved in lignin biosynthesis are of interest for increasing plants' resistance to lodging and for increasing the usefulness of plant materials as biofuels.

In one embodiment of the invention, the function of a recombinant polypeptide is determined by comparison of the amino acid sequence of the recombinant polypeptide to amino acid sequences of known polypeptides. A variety of homology based search algorithms are available to compare a query sequence to a protein database, including for example, BLAST, FASTA, and Smith-Waterman. In the present application, BLASTX and BLASTP algorithms are used to provide protein function information. A number of values are examined in order to assess the confidence of the function assignment. Useful measurements include "E-value" (also shown as "hit_p"), "percent identity", "percent query coverage", and "percent hit coverage".

In BLAST, E-value, or expectation value, represents the number of different alignments with scores equivalent to or better than the raw alignment score, S, that are expected to occur in a database search by chance. The lower the E value, the more significant the match. Because database size is an element in E-value calculations, E-values obtained by BLASTing against public databases, such as GenBank, have generally increased over time for any given query/entry match. In setting criteria for confidence of polypeptide function prediction, a "high" BLAST match is considered herein as having an E-value for the top BLAST hit provided in Table 1 of less than 1E-30; a medium BLASTX E-value is 1E-30 to 1E-8; and a low BLASTX E-value is greater than 1E-8. The top BLAST hit and corresponding E values are provided in Table 1.

Percent identity refers to the percentage of identically matched amino acid residues that exist along the length of that portion of the sequences which is aligned by the BLAST algorithm. In setting criteria for confidence of polypeptide function prediction, a "high" BLAST match is considered herein as having percent identity for the top BLAST hit provided in Table 1 of at least 70%; a medium percent identity value is 35% to 70%; and a low percent identity is less than 35%.

In one embodiment of the invention, the protein function assignment in the present invention is determined using combinations of E-values, percent identity, query coverage and hit coverage. Query coverage refers to the percent of the query sequence that is represented in the BLAST alignment. Hit coverage refers to the percent of the database entry that is represented in the BLAST alignment. In one embodiment of the invention, function of a query polypeptide is inferred from function of a protein homolog where either (1) hit_p<1e-30 or % identity>35% AND query_coverage>50% AND hit_coverage>50%, or (2) hit_p<1e-8 AND query_coverage>70% AND hit_coverage>70%.

Another aspect of the invention comprises a functional variant which differs in one or more amino acids from those of a recombinant polypeptide provided herein as the result of one or more conservative amino acid substitutions. It is well known in the art that one or more amino acids in a reference sequence can be substituted with at least one other amino acid, the charge and polarity of which are similar to that of the native amino acid, resulting in a silent change. For instance, valine is a conservative substitute for alanine and threonine is a conservative substitute for serine. Conservative substitutions for an amino acid within a polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a polypeptide sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Examples of conservative amino acid substitution groups are: valine-leucine, valine-isoleucine, phenylalanine-tyrosine, lysine-arginine, alanine-valine, aspartic acid-glutamic acid, and asparagine-glutamine. In one embodiment a recombinant polypeptide of the invention may differ in one or more amino acids as the result of deletion or insertion of one or more amino acids in a native sequence. See for example, U.S. Pat. No. 5,500,365, which is hereby incorporated by reference.

One embodiment of the present invention is a variant which has the same function as a recombinant polypeptide provided herein, but with increased or decreased activity or altered specificity. Such variations in protein activity can be achieved by mutagenesis or may exist naturally in polypeptides encoded by related genes, for example in a related polypeptide encoded by a different allele or in a different species. Variant polypeptides may be obtained by well known nucleic acid or protein screening methods using DNA or antibody probes, for example by screening libraries for genes encoding related polypeptides, or in the case of expression libraries, by screening directly for variant polypeptides. Screening methods for obtaining a modified protein or enzymatic activity of interest by mutagenesis are disclosed in U.S. Pat. No. 5,939,250, which is hereby incorporated by reference. An alternative approach to the generation of variants uses random recombination techniques such as "DNA shuffling" as disclosed in U.S. Pat. Nos. 5,605,793; 5,811,238; 5,830,721 and 5,837,458; and International Applications WO 98/31837 and WO 99/65927, all of which are hereby incorporated by reference. An alternative method of molecular evolution involves a staggered extension process (StEP) for in vitro mutagenesis and recombination of nucleic acid molecule sequences, as disclosed in U.S. Pat. No. 5,965,408 and International Application WO 98/42832, both of which are hereby incorporated by reference.

Polypeptides of the present invention that are functional variants of the polypeptides provided herein will generally demonstrate significant identity with the polypeptides provided herein. One embodiment of the invention is a polypeptide having at least about 35% sequence identity, at least about 50% sequence identity, at least about 60% sequence identity, at least about 70% sequence identity, at least about 80% sequence identity, and at least about 85%, 90%, 95% or even greater sequence identity with a recombinant polypeptide sequence described herein. One embodiment of the invention is a polypeptide having an amino acid sequence provided herein (reference polypeptides) and functional variants of such reference polypeptide, wherein such functional variant comprises at least about 50 consecutive amino acids having at least about 90% identity to about a 50 amino acid polypeptide fragment of said reference polypeptide.

Recombinant DNA Constructs

In one embodiment the invention encompasses the use of recombinant polynucleotides in recombinant constructs, i.e. constructs comprising recombinant polynucleotides that are constructed or modified outside of cells and that join nucleic acids that are not found joined in nature. Using methods known to those of ordinary skill in the art, recombinant polynucleotides of the invention can be inserted into recombinant DNA constructs that can then be introduced into a host cell of choice for expression of the encoded polypeptide or to provide for reduction of expression of the encoded polypeptide, for example by antisense or cosuppression methods. Potential host cells include both prokaryotic and eukaryotic cells. One embodiment of the invention uses a recombinant polynucleotide of the present invention for preparation of recombinant constructs for use in plant transformation.

In plant transformation, exogenous genetic material is transferred into a plant cell. As used herein "exogenous" refers to a nucleic acid molecule, for example a recombinant DNA construct comprising a recombinant polynucleotide of the present invention, produced outside the organism, e.g. plant, into which it is introduced. An exogenous nucleic acid molecule can have a naturally occurring or non-naturally occurring nucleic acid sequence. One skilled in the art recognizes that an exogenous nucleic acid molecule can be derived from the same species into which it is introduced or from a different species. Such exogenous genetic material may be transferred into either monocot or dicot plants including, but not limited to, soy, cotton, canola, maize, teosinte, wheat, rice, and *Arabidopsis* plants. Transformed plant cells comprising such exogenous genetic material may be regenerated to produce whole transformed plants.

Exogenous genetic material may be transferred into a plant cell by the use of a recombinant construct, also known as a vector, designed for such a purpose. A recombinant construct can comprise a number of sequence elements, including promoters, encoding regions, and selectable markers. Recombinant constructs are available which have been designed to replicate in both *E. coli* and *A. tumefaciens* and have all of the features required for transferring large inserts of DNA into plant chromosomes. Design of such vectors is generally within the skill of the art.

A recombinant construct will generally include a plant promoter to direct transcription of the protein-encoding region or the antisense sequence of choice. Numerous promoters, which are active in plant cells, have been described in the literature. These include the nopaline synthase (NOS) promoter and octopine synthase (OCS) promoters carried on tumor-inducing plasmids of *Agrobacterium tumefaciens* or caulimovirus promoters such as the Cauliflower Mosaic Virus (CaMV) 19S or 35S promoter (U.S. Pat. No. 5,352, 605), and the Figwort Mosaic Virus (FMV) 35S-promoter (U.S. Pat. No. 5,378,619). These promoters and numerous others have been used to create recombinant vectors for expression in plants. Any promoter known or found to cause transcription of DNA in plant cells can be used in the present invention. Other useful promoters are described, for example, in U.S. Pat. Nos. 5,378,619; 5,391,725; 5,428,147; 5,447,858; 5,608,144; 5,614,399; 5,633,441; and 5,633,435, all of which are hereby incorporated by reference.

In addition, promoter enhancers, such as the CaMV 35S enhancer or a tissue specific enhancer, may be used to enhance gene transcription levels. Enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers which could be used in accordance with the invention include elements from octopine synthase genes, the maize alcohol dehydrogenase gene intron 1, elements from the maize shrunken 1 gene, the sucrose synthase intron, the TMV omega element, and promoters from non-plant eukaryotes.

Recombinant constructs can also contain one or more 5' non-translated leader sequences which serve to enhance polypeptide production from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al. (1996) *Plant Mol. Biol.* 32:393–405).

Recombinant constructs may also include, with the coding region of interest, a nucleic acid sequence that acts, in whole or in part, to terminate transcription of that region. One type of 3' untranslated sequence which may be used is a 3' UTR from the nopaline synthase gene (nos 3') of *Agrobacterium tumefaciens*. Other 3' termination regions of interest include those from a gene encoding the small subunit of a ribulose-1,5-bisphosphate carboxylase-oxygenase (rbcS), and more specifically, from a rice rbcS gene (U.S. Pat. No. 6,426,446), the 3' UTR for the T7 transcript of *Agrobacterium tumefaciens*, the 3' end of the protease inhibitor I or II genes from potato or tomato, and the 3' region isolated from Cauliflower Mosaic Virus. Alternatively, one also could use a gamma coixin, oleosin 3 or other 3' UTRs from the genus *Coix* (PCT Publication WO 99/58659).

Recombinant constructs may also include a selectable marker. Selectable markers may be used to select for plants or plant cells that contain the exogenous genetic material. Useful selectable marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable markers are illustrated in U.S. Pat. Nos. 5,550,318; 5,633,435; 5,780, 708 and 6,118,047, all of which are hereby incorporated by reference.

Recombinant constructs may also include a screenable marker. Screenable markers may be used to monitor transformation. Exemplary screenable markers include genes expressing a colored or fluorescent protein such as a luciferase or green fluorescent protein (GFP), a β-glucuronidase or uidA gene (GUS) which encodes an enzyme for which various chromogenic substrates are known or an R-locus gene, which encodes a product that regulates the production of anthocyanin pigments (red color) in plant tissues. Other possible selectable and/or screenable marker genes will be apparent to those of skill in the art.

Recombinant constructs may also include a transit peptide for targeting of a gene target to a plant organelle, particularly to a chloroplast, leucoplast or other plastid organelle, see for example U.S. Pat. No. 5,188,642, which is hereby incorporated by reference.

For use in *Agrobacterium* mediated transformation methods, recombinant constructs of the present invention may also include T-DNA border regions flanking the DNA to be inserted into the plant genome to provide for transfer of the DNA into the plant host chromosome as discussed in more detail below. An exemplary plasmid that finds use in such transformation methods is pMON18365, a T-DNA vector that can be used to clone exogenous genes and transfer them into plants using *Agrobacterium*-mediated transformation. See published U.S. Patent Application 20030024014, which is hereby incorporated by reference. This vector contains the left border and right border sequences necessary for *Agrobacterium* transformation. The plasmid also has origins of replication for maintaining the plasmid in both *E. coli* and *Agrobacterium tumefaciens* strains.

A candidate gene is prepared for insertion into the T-DNA vector, for example using well-known gene cloning techniques such as PCR. Restriction sites may be introduced onto each end of the gene to facilitate cloning. For example, candidate genes may be amplified by PCR techniques using a set of primers. Both the amplified DNA and the cloning vector are cut with the same restriction enzymes, for example, NotI and PstI. The resulting fragments are gel-purified, ligated together, and transformed into *E. coli*. Plasmid DNA containing the vector with inserted gene may be isolated from *E. coli* cells selected for spectinomycin resistance, and the presence of the desired insert verified by digestion with the appropriate restriction enzymes. Undigested plasmid may then be transformed into *Agrobacterium tumefaciens* using techniques well known to those in the art, and transformed *Agrobacterium* cells containing the vector of interest selected based on spectinomycin resistance. These and other similar recombinant constructs useful for plant transformation may be readily prepared by one skilled in the art.

Transformation Methods and Transgenic Plants

Methods and compositions for transforming bacteria and other microorganisms are known in the art. See for example *Molecular Cloning: A Laboratory Manual*, $3^{rd}$ edition Volumes 1, 2, and 3. J. F. Sambrook, D. W. Russell, and N. Irwin, Cold Spring Harbor Laboratory Press, 2000.

Technology for introduction of DNA into cells is well known to those of skill in the art. Methods and materials for transforming plants by introducing a transgenic DNA construct into a plant genome in the practice of this invention can include any of the well-known and demonstrated methods including electroporation as illustrated in U.S. Pat. No. 5,384,253, microprojectile bombardment as illustrated in U.S. Pat. Nos. 5,015,580; 5,550,318; 5,538,880; 6,160,208; 6,399,861 and 6,403,865, *Agrobacterium*-mediated transformation as illustrated in U.S. Pat. Nos. 5,635,055; 5,824,877; 5,591,616; 5,981,840 and 6,384,301, and protoplast transformation as illustrated in U.S. Pat. No. 5,508,184, all of which are hereby incorporated by reference.

Any of the recombinant polynucleotides of the present invention may be introduced into a plant cell in a permanent or transient manner in combination with other genetic elements such as vectors, promoters enhancers etc. Further any of the recombinant polynucleotides of the present invention may be introduced into a plant cell in a manner that allows for production of the polypeptide or fragment thereof encoded by the recombinant polynucleotide in the plant cell, or in a manner that provides for decreased expression of an endogenous gene and concomitant decreased production of protein.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Expression of the recombinant polynucleotides of the present invention and the concomitant production of polypeptides encoded by the recombinant polynucleotides is of interest for production of transgenic plants having improved properties, particularly, improved properties which result in crop plant yield improvement. Expression of recombinant polypeptides of the present invention in plant cells may be evaluated by specifically identifying the protein products of the introduced genes or evaluating the phenotypic changes brought about by their expression. It is noted that when the polypeptide being produced in a transgenic plant is native to the target plant species, quantitative analyses comparing the transformed plant to wild type plants may be required to demonstrate increased expression of the polypeptide of this invention.

Assays for the production and identification of specific proteins make use of various physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, particularly where the expressed protein is an enzyme capable of catalyzing chemical reactions involving specific substrates and products. These reactions may be measured, for example in plant extracts, by providing and quantifying the loss of substrates or the generation of products of the reactions by physical and/or chemical procedures.

In many cases, the expression of a gene product is determined by evaluating the phenotypic results of its expression. Such evaluations may be simply as visual observations, or may involve assays. Such assays may take many forms including but not limited to analyzing changes in the chemical composition, morphology, or physiological properties of the plant. Chemical composition may be altered by expression of genes encoding enzymes or storage proteins which change amino acid composition and may be detected by amino acid analysis, or by enzymes which change starch quantity which may be analyzed by near infrared reflectance spectrometry. Morphological changes may include greater stature or thicker stalks.

Plants with decreased expression of a gene of interest can also be achieved through the use of polynucleotides of the present invention, for example by expression of antisense nucleic acids, or by identification of plants transformed with sense expression constructs that exhibit cosuppression effects.

Antisense approaches are a way of preventing or reducing gene function by targeting the genetic material as disclosed in U.S. Pat. Nos. 4,801,540; 5,107,065; 5,759,829; 5,910,444; 6,184,439; and 6,198,026, all of which are hereby incorporated by reference. The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches.

The site of inactivation and its developmental effect can be manipulated by the choice of promoter for antisense genes or by the timing of external application or microinjection. Antisense can manipulate its specificity by selecting either unique regions of the target gene or regions where it shares homology to other related genes.

The principle of regulation by antisense RNA is that RNA that is complementary to the target mRNA is introduced into cells, resulting in specific RNA:RNA duplexes being formed by base pairing between the antisense substrate and the target. Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression. An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

As used herein "gene suppression" means any of the well-known methods for suppressing expression of protein from a gene including sense suppression, anti-sense suppression and RNAi suppression. In suppressing genes to provide plants with a desirable phenotype, anti-sense and RNAi gene suppression methods are preferred. For a description of anti-sense regulation of gene expression in plant cells see U.S. Pat. No. 5,107,065. For a description of RNAi gene suppression in plants by transcription of a dsRNA see U.S. Pat. No. 6,506,559, U.S. Patent Application Publication No. 2002/0168707 A1, and U.S. patent application Ser. No. 09/423,143 (see WO 98/53083), Ser. No. 09/127,735 (see WO 99/53050), and Ser. No. 09/084,942 (see WO 99/61631), all of which are hereby incorporated by reference. Suppression of an gene by RNAi can be achieved using a recombinant DNA construct having a promoter operably linked to a DNA element comprising a sense and anti-sense element of a segment of genomic DNA of the gene, e.g., a segment of at least about 23 nucleotides, more preferably about 50 to 200 nucleotides where the sense and anti-sense DNA components can be directly linked or joined by an intron or artificial DNA segment that can form a loop when the transcribed RNA hybridizes to form a hairpin structure. For example, genomic DNA from a polymorphic locus of SEQ ID NO: 1 through SEQ ID NO: 105,582 can be used in a recombinant construct for suppression of a cognate gene by RNAi suppression.

Insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants haying an insertion in the gene encoding the polypeptide of interest.

In one embodiment of the invention, polynucleotides of the present invention may be used in site-directed mutagenesis. Site-directed mutagenesis may be utilized to modify nucleic acid sequences, particularly as it is a technique that allows one or more of the amino acids encoded by a nucleic acid molecule to be altered (e.g., a threonine to be replaced by a methionine). Three basic methods for site-directed mutagenesis are often employed. These are cassette mutagenesis, primer extension, and methods based upon PCR.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones.

Arrays

In one embodiment of the invention, the recombinant polynucleotides or recombinant polypeptides of this invention may be used to prepare arrays of target molecules arranged on a surface of a substrate. The target molecules may be known molecules, e.g. polynucleotides (including oligonucleotides) or polypeptides, which are capable of binding to specific probes, such as complementary nucleic acids or specific antibodies. The target molecules may be immobilized, e.g. by covalent or non-covalent bonding, to the surface in small amounts of substantially purified and isolated molecules in a grid pattern. By immobilized it is meant that the target molecules maintain their position relative to the solid support under hybridization and washing conditions. Target molecules are deposited in small footprint, isolated quantities of "spotted elements" of preferably single-stranded polynucleotide preferably arranged in rectangular grids in a density of about 30 to 100 or more, e.g. up to about 1000, spotted elements per square centimeter. In one embodiment of the invention, the arrays comprise at least about 100 or more, e.g. at least about 1000 to 5000, distinct target polynucleotides per unit substrate. Where detection of transcription for a large number of genes is desired, the economics of arrays favors a high density design criteria provided that the target molecules are sufficiently separated so that the intensity of the indicia of a binding event associated with highly expressed probe molecules does not overwhelm and mask the indicia of neighboring binding events. For high-density microarrays each spotted element may contain up to about $10^7$ or more copies of the target molecule, e.g. single stranded cDNA, on glass substrates or nylon substrates.

Arrays of this invention may be prepared with molecules from a single species, preferably a plant species, or with molecules from other species, particularly other plant species. Arrays with target molecules from a single species can be used with probe molecules from the same species or a different species due to the ability of cross species homologous genes to hybridize. It is generally preferred for high stringency hybridization that the target and probe molecules are from the same species.

In one embodiment of the invention, the organism of interest is a plant and the target molecules are polynucleotides or oligonucleotides with nucleic acid sequences having at least about 80 percent sequence identity to a corresponding sequence of the same length in a recombinant polynucleotide having a sequence selected from the group consisting of SEQ ID NO: 1 through SEQ ID NO: 105,582 or complements thereof. In another embodiment of the invention, at least about 10% of the target molecules on an array have at least about 15 consecutive nucleotides of sequence having at least about 80% and up to about 100% identity with a corresponding sequence of the same length in a recombinant polynucleotide having a sequence selected from the group consisting of SEQ ID NO: 1 through SEQ ID NO: 105,582 or complements or fragments thereof.

Such arrays are useful in a variety of applications, including gene discovery, genomic research, molecular breeding and bioactive compound screening. One use of arrays is in the analysis of differential gene transcription, e.g. transcription profiling where the production of mRNA in different cells, normally a cell of interest and a control, is compared and discrepancies in gene expression are identified. In such assays, the presence of discrepancies indicates a difference in gene expression levels in the cells being compared. Such information is useful for the identification of the types of genes expressed in a particular cell or tissue type in a known environment. Such applications generally involve the following steps: (a) preparation of probe, e.g. attaching a label to a plurality of expressed molecules; (b) contact of probe with the array under conditions sufficient for probe to bind with corresponding target, e.g. by hybridization or specific binding; (c) removal of unbound probe from the array; and (d) detection of bound probe.

A probe may be prepared with RNA extracted from a given cell line or tissue. The probe may be produced by reverse transcription of mRNA or total RNA and labeled with radioactive or fluorescent labeling. A probe is typically a mixture containing many different sequences in various amounts, corresponding to the numbers of copies of the original mRNA species extracted from the sample.

The initial RNA sample for probe preparation will typically be derived from a physiological source. The physiological source may be selected from a variety of organisms, with physiological sources of interest including single celled organisms such as yeast and multicellular organisms, including plants and animals, particularly plants, where the physiological sources from multicellular organisms may be derived from particular organs or tissues of the multicellular organism, or from isolated cells derived from an organ, or tissue of the organism. The physiological sources may also be multicellular organisms at different developmental stages (e.g., 10-day-old seedlings), or organisms grown under different environmental conditions (e.g., drought-stressed plants) or treated with chemicals.

In preparing the RNA probe, the physiological source may be subjected to a number of different processing steps, where such processing steps might include tissue homogenation, cell isolation and cytoplasmic extraction, nucleic acid extraction and the like, where such processing steps are known to the those of skill in the art. Methods of isolating RNA from cells, tissues, organs or whole organisms are well known to those skilled in the art.

Computer Based Systems and Methods

In one embodiment of the invention, the sequence of the molecules of this invention can be provided in a variety of media to facilitate use thereof. Such media may provide a subset thereof in a form that allows a skilled artisan to examine the sequences. In a one embodiment, about 20, about 50, about 100, and about 200 or more of the polynucleotide and/or the polypeptide sequences of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising a computer readable medium having recorded thereon a nucleotide sequence of the present invention.

As used herein, "recorded" refers to a process for storing information on computer readable media. A skilled artisan can readily adopt any of the presently known methods for recording information on computer readable media to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as Word-Perfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain a computer readable medium having recorded thereon the nucleotide sequence information of the present invention.

By providing one or more of polynucleotide or polypeptide sequences of the present invention in a computer readable medium, a skilled artisan can routinely access the sequence information for a variety of purposes. The examples which follow demonstrate how software which implements the BLAST and BLAZE search algorithms on a Sybase system can be used to identify open reading frames (ORFs) within the genome that contain homology to ORFs or polypeptides from other organisms. Such ORFs are polypeptide encoding fragments within the sequences of the present invention and are useful in producing commercially important polypeptides such as enzymes used in amino acid biosynthesis, metabolism, transcription, translation, RNA processing, nucleic acid and a protein degradation, protein modification, and DNA replication, restriction, modification, recombination, and repair.

One embodiment of the invention provides systems, particularly computer-based systems, which contain the sequence information described herein. Such systems are designed to identify commercially important fragments of the nucleic acid molecule of the present invention. As used herein, "a computer-based system" refers to the hardware, software, and memory used to analyze the sequence information of the present invention. A skilled artisan can readily appreciate that any one of the currently available computer-based systems are suitable for use in the present invention.

As indicated above, the computer-based systems of the present invention comprise a database having stored therein a polynucleotide sequence, polypeptide sequence, or both of the present invention and the necessary hardware and software for supporting and implementing a homology search. As used herein, "database" refers to memory system that can store searchable nucleotide sequence information. As used herein "query sequence" is a polynucleotide sequence, or a polypeptide sequence, or a polynucleotide sequence corresponding to a polypeptide sequence, or a polypeptide sequence corresponding to a polynucleotide sequence, that is used to query a collection of polynucleotide or polypeptide sequences. As used herein, "homology search" refers to one or more programs which are implemented on the computer-based system to compare a query sequence, i.e., gene or peptide or a conserved region (motif), with the sequence information stored within the database. Homology searches are used to identify segments and/or regions of the sequence of the present invention that match a particular query sequence. A variety of known searching algorithms are incorporated into commercially available software for conducting homology searches of databases and computer readable media comprising sequences of molecules of the present invention.

Sequence length of a query sequence may be from about 10 to about 100 or more amino acid residues or from about 20 to about 300 or more nucleotide residues. There are a variety of motifs known in the art. Protein motifs include, but are not limited to, enzymatic active sites and signal sequences. An amino acid query is converted to all of the nucleic acid sequences that encode that amino acid sequence by a software program, such as TBLASTN, which is then used to search the database. Nucleic acid query sequences that are motifs include, but are not limited to, promoter sequences, cis elements, hairpin structures and inducible expression elements (protein binding sequences).

One embodiment of the invention, provides an input device for receiving a query sequence, a memory for storing sequences (the query sequences of the present invention and sequences identified using a homology search as described above), and an output device for outputting the identified homologous sequences. A variety of structural formats for the input and output presentations can be used to input and output information in the computer-based systems of the present invention. One format for an output presentation ranks fragments of the sequence of the present invention by varying degrees of homology to the query sequence. Such presentation provides a skilled artisan with a ranking of sequences that contain various amounts of the query sequence and identifies the degree of homology contained in the identified fragment.

Having now generally described the invention, the same will be more readily understood through reference to the following examples which are provided by way of illustration, and are not intended to be limiting of the present invention, unless specified.

EXAMPLE 1

A cDNA library is generated from *Triticum aestivum* tissue. Tissue is harvested and immediately frozen in liquid nitrogen. The harvested tissue is stored at −80° C. until preparation of total RNA. The total RNA is purified using Trizol reagent from Invitrogen Corporation (Invitrogen Corporation, Carlsbad, Calif., U.S.A.), essentially as recommended by the manufacturer. Poly A+ RNA (mRNA) is purified using magnetic oligo dT beads essentially as recommended by the manufacturer (Dynabeads, Dynal Biotech, Oslow, Norway).

Construction of plant cDNA libraries is well known in the art and a number of cloning strategies exist. A number of cDNA library construction kits are commercially available. cDNA libraries are prepared using the Superscript™ Plasmid System for cDNA synthesis and Plasmid Cloning (Invitrogen Corporation, Carlsbad, Calif., U.S.A.), as described in the Superscript II cDNA library synthesis protocol. The cDNA libraries are quality controlled for a good insert: vector ratio.

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Valencia, Calif. U.S.A.).

The template plasmid DNA clones are used for subsequent sequencing. Sequences of recombinant polynucleotides may be obtained by a number of sequencing techniques known in the art, including fluorescence-based sequencing methodologies. These methods have the detection, automation, and instrumentation capability necessary for the analysis of large volumes of sequence data. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed.

EXAMPLE 2

The open reading frame in each recombinant polynucleotide sequence is identified by a combination of predictive and homology based methods. The longest open reading frame (ORF) is determined, and the top BLAST match is identified by BLASTX against NCBI. The top BLAST hit is then compared to the predicted ORF, with the BLAST hit given precedence in the case of discrepancies.

Functions of polypeptides encoded by the polynucleotide sequences of the present invention are determined using a hierarchical classification tool, termed FunCAT, for Functional Categories Annotation Tool. Most categories collected in FunCAT are classified by function, although other criteria are used, for example, cellular localization or temporal process. The assignment of a functional category to a query sequence is based on BLASTX sequence search results, which compare two protein sequences. FunCAT assigns categories by iteratively scanning through all blast hits, starting with the most significant match, and reporting the first category assignment for each FunCAT source classification scheme. In the present invention, function of a query polypeptide is inferred from the function of a protein homolog where either (1) hit_p<1e-30 or % identity>35% AND query_coverage>50% AND hit_coverage>50%, or (2) hit_p<1e-8 AND query_coverage>70% AND hit_coverage>70%.

Functional assignments from five public classification schemes, GO_BP, GO_CC, GO_MF, KEGG, and EC, and one internal Monsanto classification scheme, POI, are provided in Table 1. The column under the heading "CAT_TYPE" indicates the source of the classification. GO_BP=Gene Ontology Consortium—biological process; GO_CC=Gene Ontology Consortium—cellular component; GO_MF=Gene Ontology Consortium—molecular function; KEGG=KEGG functional hierarchy; EC=Enzyme Classification from ENZYME data bank release 25.0; POI=Pathways of Interest. The column under the heading "CAT_DESC" provides the name of the subcategory into which the query sequence was classified. The column under the heading "PRODUCT_HIT_DESC" provides a description of the BLAST hit to the query sequences that led to the specific classification. The column under the heading "HIT_E" provides the e-value for the BLAST hit. It is noted that the e-value in the HIT_E column may differ from the e-value based on the top BLAST hit provided in the E_VALUE column since these calculations were done on different days, and database size is an element in E-value calculations. E-values obtained by BLASTing against public databases, such as GenBank, will generally increase over time for any given query/entry match.

Sequences useful for producing transgenic plants having improved biological properties are identified from their FunCAT annotations and are also provided in Table 1. A biological property of particular interest is plant yield. Plant yield may be improved by alteration of a variety of plant pathways, including those involving nitrogen, carbohydrate, or phosphorus utilization and/or uptake. Plant yield may also be improved by alteration of a plant's photosynthetic capacity or by improving a plant's ability to tolerate a variety of environmental stresses, including cold, heat, drought and osmotic stresses. Other biological properties of interest that may be improved using sequences of the present invention include pathogen or pest tolerance, herbicide tolerance, disease resistance, growth rate (for example by modification of cell cycle, by expression of transcription factors, or expression of growth regulators), seed oil and/or protein yield and quality, rate and control of recombination, and lignin content.

Sequences of recombinant polynucleotides are provided herein as SEQ ID NO: 1 through SEQ ID NO: 105,582 and sequences of recombinant polypeptides are provided as SEQ ID NO: 105,583 through SEQ ID NO: 211,164. Descriptions of each of these recombinant polynucleotide and recombinant polypeptide sequences are provided in Table 1.

Table 1 Column Descriptions

SEQ_NUM provides the SEQ ID NO for the listed recombinant polynucleotide sequences.
CONTIG_ID provides an arbitrary sequence name taken from the name of the clone from which the cDNA sequence was obtained.
PROTEIN_NUM provides the SEQ ID NO for the recombinant polypeptide sequence
NCBI_GI provides the GenBank ID number for the top BLAST hit for the sequence. The top BLAST hit is indicated by the National Center for Biotechnology Information GenBank Identifier number.
NCBI_GI_DESCRIPTION refers to the description of the GenBank top BLAST hit for the sequence.
E_VALUE provides the expectation value for the top BLAST match.
MATCH_LENGTH provides the length of the sequence which is aligned in the top BLAST match
TOP_HIT_PCT_IDENT refers to the percentage of identically matched nucleotides (or residues) that exist along the length of that portion of the sequences which is aligned in the top BLAST match.
CAT_TYPE indicates the classification scheme used to classify the sequence. GO_BP=Gene Ontology Consortium—biological process; GO_CC=Gene Ontology Consortium—cellular component; GO_MF=Gene Ontology Consortium—molecular function; KEGG=KEGG functional hierarchy (KEGG=Kyoto Encyclopedia of Genes and Genomes); EC=Enzyme Classification from ENZYME data bank release 25.0; POI=Pathways of Interest.
CAT_DESC provides the classification scheme subcategory to which the query sequence was assigned.
PRODUCT_CAT_DESC provides the FunCAT annotation category to which the query sequence was assigned.
PRODUCT_HIT_DESC provides the description of the BLAST hit which resulted in assignment of the sequence to the function category provided in the cat_desc column.
HIT_E provides the E value for the BLAST hit in the hit_desc column.
PCT_IDENT refers to the percentage of identically matched nucleotides (or residues) that exist along the length of that portion of the sequences which is aligned in the BLAST match provided in hit_desc.
QRY_RANGE lists the range of the query sequence aligned with the hit.
HIT_RANGE lists the range of the hit sequence aligned with the query.
QRY_CVRG provides the percent of query sequence length that matches to the hit (NCBI) sequence in the BLAST match (% qry cvrg=(match length/query total length)×100).
HIT_CVRG provides the percent of hit sequence length that matches to the query sequence in the match generated using BLAST (% hit cvrg=(match length/hit total length)×100).

All publications and patent applications cited herein are hereby incorporated by reference in their entirely to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (211164 sequences)

SEQ ID NO: 1 - DNA, 1627 bp, Triticum aestivum
  unsure (1)..(1627): unsure at all n locations
  Clone ID: PAT_TA_1
cgtccgcccaactctcgggcaccacctagcacatcatctccaggggggttaaataataggaggtttgatttgagagcaccggcaagccatcaaggacatcaaagaagagatgcccttgctagctcagaccctcccaatccccctctacagtcgggtaatgttattgctcggaagaggcgagttcaagcgcagtttaacgagcttcaagaatactatttgcaaagacggcgtactggagcgcagtctcacaggcaggaggatgctgttacgatgaatagagaaggttatcatgaaggtcttgaagattttcagtctgtgcttacaacattcactcgatatagtcgcttacgtgtaattgcggaacttagacatggagatctgttccactcagcaaatattgtatccagtatcgaatttgaccgtgatgatgagctattcgctactgctggagtctcgaagcgtattaaagtcttcgaattttctacagttgttaatgagccatcagatgtccactgtccagttgttgaaatggctaccagatctaaactcagctgccttagctggaacaagtactcaaaaaatgttatagcaagtagtgattatgaaggcatagttactgtttgggatgttcaaacccgccagagtgtaatggagtatgaagagcatgagaaaagagcatggagtgttgatttttcacgtacagagcccaagatgctagtatctggtagtgatgattgcaaggtcaaagtgtggtgcacaaatcaggaagcaagtgccattaacattgatatgaaggcaaatatttgctctgttaaatataatcctggatcgagctactatgtcgcagtcggatctgctgatcaccatattcattattttgatttacgaaatccaagtgcacctctccatgtttttggtgggcacaagaaagctgtttcttatgtgaaattcttatcaaataatgagcttgcatctgcatcgaccgatagcacgttacggttatgggatgtcaaggacaattgcccactaaggactttcagagggcacaaaaatgagaagaacttcgtaggactatctgtaaataacgaatatattgcttgcgggagtgaaacaaatgaggtttttgtttaccacaaggctatctccaaacctgcttccagccataggtttctgtccacggacccggacgacgccgaagatgatcccgggtcttatttcattagcgctgtctgctggaagagtgatagccctactatgctaactgctaacagccaggggaccattaaagttctcgtgctcgccccttgacgtgatcaggggagatctgtagctagcttgtatatcctatgtatcccgtcgtttcattgttgtgccattatatgtcccaaagtgggagtggaggctgatctccagcctagggcgcgaaatttttgtggaggtaatcgtctgacgtagggttccaagggctcggaatgtgcatagtggtggtgaccctgttgtataggtgcaaagcagtcggcttgtctattatagtactacatctgtaacgtgagaaaataaatcttgaataaagagtccggcttgttttctgagttaaaaaaaagaagagaaagagannaagagnaaa

SEQ ID NO: 2 - DNA, 1096 bp, Triticum aestivum
  Clone ID: PAT_TA_2
ccccgcaagccgccagaactagccaccccctcttccatccccctcctccactcaccagcaccgtagagcagagagctgcgcgggcaatccaaacctttccctattcttgcaaggtctcggaaacggaaaggcccctgctccgctgcgcgtttgcgagtttgggaagaagccttgcctgccggaagggggaaaacgagatggggcgagggcgcagcgagaataaagaggatcgacaaccccacgcagcgccagtccaccttctacaagcgcagggacggcctcttcaagaaggcccgggagctcgccgtcctctgcgacgccgacctcctcctcctcctcttctccgcctccggcaagctctaccagtacctcgcgcccaccgtcccctctgtcaaggagtttgtcgagaggtacgaggctgcaacgcacaccaaagtttggtccgacatccgccaggagaggcgcgccgagctggagaaggtggccaagatgtgcgacctcttggagaaggagctgaggttcatgacggtggacgacggggagcagtacacggtgccgtcgctggcggcgctggagcacaacctggaggcggccatgcacaaggtgcgctccgagaaggaccgcaagatcgggggcgagatgagctacctcgagaacatgatcagggggaaacaagctgagcgctacggcctatgtgacaagctcgctcatgctcagagcctgaaggtcgtggaaggcggatccacctcgctgaacaacggtctggacctcaaacttggattcaactaggaacgggtgaaagcttctggccgtggggttctgctctagtgttgctgttgagctcgagtgttatgtcaggttcaaatattctgcaatttccttcgaagggattgtatgaacttgtaagagaccactgtcttatgagatgtttggcttaggctggactgggctgtgctttgtacctccaataggtggaatgtgataccagtccagtattgcaataatgtagctaacggtcacttcatggcctcctttcatacgttcttcgtcaatgtggacaattcgtgtttttctcgatttctgctggcttattgtg

SEQ ID NO: 3 - DNA, 1319 bp, Triticum aestivum
  unsure (1)..(1319): unsure at all n locations
  Clone ID: PAT_TA_3
ctgtgcggcgctcgggccggccgttcgggcacccacccaggcgcccggcgcagcgcatacgcactgcccacggccgcagagctctcgcgtcgccggccgcccgccccgactcctccgccgccgagacatggccggccacgggcgacgacgccgggatggacgaggtccagaggcgcctcatgttcgacgacgaatgcattttggtagatgaacaggacaacgttgttggccatgaatcaaaatatacctgccatctgatggagaagattgaatctctgaacctgctccacagggctttcagcgtattccttttttaactcaaaacatgagctgctacttcagcaaagatctgcaacgaaggttacgtttcctttagtaatggaaccaaccacctgctgcagccatccttcctgtaatctgtgaatctgagcttattcaggaaaaactttcttggtgtcagaaatgctgctcagaggaagctcctcgatgagctgggcatcccggctgaagatgtgcccgttgaccagttcacccctctcggtcggatgctttacaaggcaccatctgatgggaaatggggcgaacatgagctggactacctgctgttcatcgtgcgcgacgtgaagctggtcccgaacccccggacgaagtggctggacgtgaagtatgtgagccgggagcagctgcgggagctcatccagcaggcggacgccggcgagggcggcgtgaagctgtccccctggttcaggctggtggtggacaacttcctcatgggctggtgggagcacttggagaaaggcacgctcgcggaggccgtggacatggaaaccatccacaagctcaagtgaggacgccatctcttgatagttgttgttgtgtgctgaaaaagaacttatccacaggcagctaggataaaccgtcggcatctcatctggataataaaagaacagttgttacctggcccgatgatggccactttgtattggttattattacctcacatattcacatgtacaataacggcgattcctaccaaatgtggcactttgtaaggttatacctcacatattcacctgtaccataacgacgatgatgataaaatgataatggtggcataattcagctttgattttccccacaaaaacaatccctacgcgttgcaccccccccgcctcttttctctcgtctcgccacctggtaccactatccctnacaatcccttccactgctatacaaagnccacatncctcaattccacnatnaangacccgncgataccgngtttggnccatacnnaatcaaccancccttnttctttc

SEQ ID NO: 4 - DNA, 416 bp, Triticum aestivum
  Clone ID: PAT_TA_4
tcaacctcgatcccgatgatgtggtggccaggctcgagcgcatccttggcagatttgacatccccgacgaagtcgaacatcaccaacgtgatattttgaggatgcaggtgatcgatggaatttgcttccaggccagagacatggaaatggagtggttccgcggagttggcatgcgcgcgattgcacgctgtcaagctcttctggaagaagcccaacagccccaagagcctcccagcgccagcagctccgtaggcggaggcgggtcgggacacttggagtgaatggccgcaagggtgctatgctgatcatggagtgcgagaagaccatcgtcggaaggccgccagctcagccttttagcttatattttagtataattgtatgcatatgtaggtcgtgagtgttctgggccttgccgc

SEQ ID NO: 5 - DNA, 811 bp, Triticum aestivum
  unsure (1)..(811): unsure at all n locations
  Clone ID: PAT_TA_5
ctgtgcggcgctcgaggcggccggctcggataaacctcgcatcgtgcgggggcacctgcagagcagccaggtgctgcggaacggcgggacgagctgctgcatgctggggccgggcaacttcagcggggacgagctgctgtcgtggtgcctaaggcggccgttccgggagcggctgccggcggcgtcctccacgctggtgacgctggagagcacggaggcgttcgggctggaggcggcggacgtcaagtacgtgacgcagcacttccgctacaccttcgccaacgagaaggtgcggcgcagcgcgcgctactactcgcacgggtggcgcacctgggccgccgtcgcggtgcagctcgcgtggcgccgctacaggcaccgcaagacgctcacctcgctctccttcatccgcccacggcggccgctgtccaggtgctcctcgctcggggaggagaagctgcggctctacaccgcgctgctcacctcgcccaagcccaaccaggacgacctgctcctgtaagacggacaaggcccttgctttgtcagagcatcgcacaaatgcaagaaccgaaaatttgggctgaaatccagccgaggtttcaaaggaagaaaggaaaatgctgatgctatttcacacatttgacnaatgtcaattccccagggactggctggaagtatttcgcgagctcncggaaaacgcacggaaataataaggaagaaaataaatgcaacccccgtattcccagaatgacgtgtttttttttctttttaccaggctgatgagattgcttatattcagtaaagagtcaacgcg

SEQ ID NO: 6 - DNA, 609 bp, Triticum aestivum
  Clone ID: PAT_TA_6
gccggccgggttcggaaaaaaaccagctcgaagcaccgaactagctagtcaccgctcacaacaccagtaagccaagccacgttacgatggcgtccttcgccggagctgcccgtttgatggcgctcctccagatcgcgctgttcgtcgtctccgcggtgatcatgagcagctccgtctgccatgcagtcggcggcatccgcgttcgtcctctggaccctaaccatcccgtgtgccacggacagtgcgcacccggcggtggaccctaccgtccgcagccatacccccaccgtccgcggggcacctccgccgtacaatggagggatcggacgaccatgatgcatgccctccgctgtacaatggagggatcggacgaccatgatgcatgccttcctccagcatagcagtacaagctgctgcaacaaccttatactaagcctaagtgtagtaatatccgatcatacgaataacttccgtcttgtactccgaaaaacacagcaagtctggcccccatgttaatgggtatgtgaacctgaaagttcggttcagaactactcctagtaataaagatggatagtgtaagtgtaaaaaaaaaaaaaaaaaaggccccta

SEQ ID NO: 7 - DNA, 922 bp, Triticum aestivum
  Clone ID: PAT_TA_7
cccactcgtccggcttatgcaaataaatctgcccggtgtgagatgggttggtggtgttgaattggaattgattgccatagctacagggggacgtattgttccaagattccaagagttgactcctgataagcttgggcaggctggattggttagagagaagtcatttggaacaacaaaggatcgaatgctttgcattgagaggtgtgcaaattccagagctgtaactatcttcatccgtggcggcaacaaaatgatgattgaggaggccaagcgaagtattcacgacgctctgtgtgtggctagaaatctgatccgcaataactctattgtttatggtggcggctcagctgagatatcttgctctgttgctgtcgaagctgcagcagatcgatatgctggagccgagcagtatgcaatcaggtcgtttgctgatgcgctggatgggattccactagccttggctgaaaacagtggtttgccacctattgatacattgactgcagtaaaatctcagcaaattcaggagaacaatccctactgtggcatcgactgcaatgacgtcgggacaaacgatatgagagagcagcacgtctttgaaaccctgattggcaagcaacaacagatattattggcaacacaggttgtgaagatgattctcaagatcgacgatgttatcacgccgtcagagttctgagtactgatgatgttgcaagcatgggcaactgtgctggataacaagccatcattataccatgcagcattgctgaagcagttggattggccacttgcttgtaccttaggcctatattttgcttgtgacgcttgctgaagaccttggtttctgcgttctcacatcttgttacatgaataatgaacaatctctcttttttctgtattttccgatgcttagtgctttagtctg

SEQ ID NO: 8 - DNA, 860 bp, Triticum aestivum
  Clone ID: PAT_TA_8
gtgcggcccgctcgaggcccggccggtttcgggagatctatactgacaaggaaacaggcaggaaaaagggtgatgcacttgtgacctatctcaaggagccttctgtacctttagcaattcaattattggatggaacatcattccgtcctggtggtaagaccctaatgactgttagcgtggccaaatttcagcagaaaggtgacgtttttttggcaaagaaggcagacaagcagaagaaaaagaaaggcaagaaggttgaagataagatgctgggatggggtggacatgatgataagaaggtgatgattcctactcaggtgattttggcgaatatgttcagtcctgctgaattgagaaatgatgaaacccttcttcctgaacttgaggtagatgttagagaggaatgcgtgaagtttggtccgatcgacaatgtcaaggtttgcgaaaatcatccacaaggggtcgtattggtaaagttcaaagaccggaaagatggtctcaaatgcatagagaagatgaatggaagatggtttggtgggaagcaaatacacgcgagtgaggatgacgggtcgatcaaacacgctctgatccgtgactacgatgctgaggtttcaaggctggagcgctttggagaagagttggaagaatccacataggaagtttttcgatcatccggctggttatggctgttctgtagctgatagcgtgaaatttcaagaacaacaaaacagaaaagagcagtcgggtcatctgttcgtccgatactaactagtgtgactgcacatctgttaggtcccaataaaatagatttcaaccagctaactttgtcctacgtactcccacattacagagattgagca

SEQ ID NO: 9 - DNA, 1197 bp, Triticum aestivum
  unsure (1)..(1197): unsure at all n locations
  Clone ID: PAT_TA_9
gccggccggtgcggggtcgcatgttgaaggttgatctacttccgtcacttccaccaccttgttcctgacttcttgtcagaaactcaatcccatcttccccttttcctttctttcttgtctgttcaagggctgagccttgaacgatcttagtaattaaacatgtcggagaaaaacgacgtgacccagaccgaaaatggggttcctaaatccaagcgcacctgcgcgagacactgcaagcgcttctggtgggtgtatctcatcgtcctctgcatcatcaccgtcattgtggttcctgtgataattcttgttgctgtccccaagattgcacagagcaaaatcaacgaagccgagcttgagatccaaagtgttcaaattctcgaaactgaggagggtgcctatctcatgaagattgactcttccatcaccaccgatggcaagattcatgcatcagttgatccatttgaggccgaaatgtatctcgaggactggccagcacatgtaccattcgcgacagtgaacatgcccgagaccaacagcaacaaacaccaggtcgtgaacgtcactcaacacgtcaaaatcgccgacatggaagagtttactcgattcaacatctggttccacaacaacgaaacgctgcgtgtcactgtcaatggcaagacaaaggtcaagccaagtggtctgacgcgcaagtacggcgtcaccttcaagaagacagttgagctcaagggacttaaccacttcgctggaaccgaggtcacggatggccacattggtttcggcgatggtacggatgagcccaactttaacggtacaaccgttattcccaacgcttctgtcttcacccttgacaacggaaacgttacctttacaaacttcgtcggagacgtagaggttggtactctcacaattccaaacctactcctcaagccaggcaacaacgttgtcaacatcaccgccagcatgaaccaaagcttggttctgaacgccgttcagcaagagccctactgcaagacaggtatccttcccttcaaactgtntgngcaagtcggtcatgaaccatggcgaaaacctcacatatnnttgccgcggcgttgggaagctcanaccagactgtcgaaatcgacattggttccatcctaaagaagggcattnggctatgaggtgaaagtgcaaaaagactagtcgcaaagcattttt

SEQ ID NO: 10 - DNA, 1075 bp, Triticum aestivum
  unsure (1)..(1075): unsure at all n locations
  Clone ID: PAT_TA_10
gccggccgggccgggtagctagcgcgccactgcacgcacacccaccagtcacacagagcacagtacagagagcagagccatgaacaaggagaagcaccacaggaacgagcaccacctccggcgctgctgcggtggcttcgcggcgtgcctcctagcgctggtcgtcgtcgtcgcattcatcgcgctcgtcgtctaccttgcgctccgccccaccaagccttccttctacttgcaggacctgcagctccactccatcaacctcggggacccctccctctctgccaccgcgcaggtcacgctcgcctcccgcaaccccaatgaccgcgtcggcatcttctacaggcgcctcgacgtcttcgtcacctaccgcgacgagcccgtcaccgtgccgatctccctgccgcccatgtaccagggccaccgggacgtcacaatttggtcccccgtgctgtccggggagtccgtgcccgtggccggatacgttgccgaggccatgaagcaggacatcgcctccgggtacgtgtcgctgcaggtcaagatcgacggccgcgtcaagtggaaggtcgggagctggatctccggcagctaccacctcttcgtcagctgccccgccatgctccgccgccggccccggcggcatgccgctccgggggtggccccaacggcaccgggggcgccgtcgcgtcactgaaattcacgcagccgacagggtgcaccgtcggcacgtngatagaatggactctgcatacggtcgcacgtccgtactgtaagttggaaggactacatacgcggtcttccgtgntgtgtttaatggtagtnagtaatatataattgtcctaaactcctaatttccngtatgactccgtttaagaataactgtgtttatcatgtacncattcattttngaattcaatggtccntgccnattncgnacaaggtgacncntttttnccccaagngctgcanaacggaggccttcncngggncaactttgcaananccaacccaatttcccaagntgtccgcntcccctgttcaacaccccnaantggnctccggtataaacacgtcacgg

SEQ ID NO: 11 - DNA, 723 bp, Triticum aestivum
  unsure (1)..(723): unsure at all n locations
  Clone ID: PAT_TA_11
gccggccgggtcggggaagccgtgacattcctccactctcgatcgccggctcgtccagttgccgcctccaaagagaagccatgaatgctgctctcaccgtcgccgtagccgaggaagaaatcgacgaggccgtagccggggaagaaatcgacgaggccgcctctcgggctcaggctgacatgtcggagatcatgtcgtcgctcccacggtgcccggtgtaccttactcgccactaccgcggcttctggatccgcgagttcgtcctcaagggcatggccgccgctcaggcatccttcgagccaaggccaaccgacgtcttcctcgccagctgccccaagtccggcgccacctggctcaaggcgctcgcctttgcgatgctcaaccgcgccacgcacttgccgtccgactccaaccacccgctatgccaccgcaacccgcacgactgcgtcgccttcctcgagaccaggcccgtgcctgagaccatggcgctcccttctccccggctgctcgcaacccacatcccctgctccctcctgcccagccgcataacggaatgcggccgggtcgtctacgtgtgccgggagccaaaggacgctctggtctccttctggatctacaacaacaagatcgtgccgatgctgcgccgngaagtcggcctggagtctccctcgcccacgttcgaggaggcgttcgagctcttctgcgaggggcagagcagcttcc

SEQ ID NO: 12 - DNA, 647 bp, Triticum aestivum
  Clone ID: PAT_TA_12
cccacgcgtcctcctcactccactctcttcaactccccctttcccctccgccgccgaatcgcgcgcgcatccacgagacgccggccgcgcgcgtccacgagccgccggacgcgctcctccgcccaattttgccgcatcaggccctcacctctcctttccacccttgccagtcgccacatctagcccgctcacccgtccctgccgcatcgtcgcacacgtcgcctagcccccaacgtccacgactccgccagccgaccaccgcagcagtctccggcgacccgtgtgcggccgcaggtgacgcacacatcgagcaacatcgaccgggcacgggtgctggatctggtcgccgttcggagagcatgtactaatctccggcgagttccttgcgcagatcagaagaggggtgcctcgatctgccacagcatatggtcaggcttcggcgggattggcaggcctgtggccagggttgcgctctagagccactatgtcgagccttgttgacgtcaaagaccctttcatcaccaccgactacatggtaccggtctcgcctagcttagcttatgagatctaacgtatggtagggtcattttggattcgtgcatggaacacccgtttatattcagtggatccggaccctgagttggatt

SEQ ID NO: 13 - DNA, 967 bp, Triticum aestivum
  Clone ID: PAT_TA_13
gccggccgggccgggcttcacactggactctctacttgacttgttgtccgggtttattttgtggtttactgccttttcaatgcaaacaccaaacccatacaggtacccaattggtaaaaggcgcatgcaacctttgggaatacttgtttttgcttctgttatggcaacacttggtcttcaaattatcctcgaatccacacggtcattggtatcatcgaatggagctgaattccgcttgacaaaagaacaggaaatgtgggttgtgaatattatgctggcagtgacgctggtgaagcttctgctggttatatattgtcgctcattcaccaacgaaattgtgaaggcatatgcacaggatcacttttttgatgtcatcaccaacattattgggcttgtggctgcacttcttgctaactattttgaaggctggatcgacccagttggtgccatcattctagcgatctacacaatcaggacatggtccatgacggtgctggagaacgtgcactccctggtcggccagtcggcctcgccggagttcctccagaagctcacctacctgtgctggaaccaccacaaggccgtcaggcacatcgacacggtgcgggcgtacaccttcggctcccactactttgtcgaggtcgacatcgtcctgccgtgcgacatgcccctgcaggaggcgcacgacatcggcgaggccctgcaggagaagctggagagcctgcccgagatcgagcgcgccttcgtccacctcgactacgagttcacccaccagcccgagcacgcccggtcctacgacacatagcctgaagacctgaaccccggcggcggcgctgtccgtggaaattcagagacggtgagcctgagctgaagctggtgaagtcggcacagtttcaggaatctgggtgtcaaacctgttgtcactcgcagattcagttgtgcaatttgatttttgttaaaaaaaaaa

SEQ ID NO: 14 - DNA, 1090 bp, Triticum aestivum
  unsure (1)..(1090): unsure at all n locations
  Clone ID: PAT_TA_14
ctccgccgagatcgccgcctggtgcgacgccgaccgcagccgcacgctcctcttccacaccttcagcaacgccggctgacccgcgtttgctgccggacttcactggcgccgagcgtcgcgccgctctagttgggcgcgtcaccgcatgtggtccactcccggcgcctcccccacctgttctctcccgaggtcggcgcggcccggttcgccgctgccctggttagtgtatgatgatgaatcgactattaatcttgctgaagatctgttccccacttagagatgagttgatggttagtcttttgaccaacacggcggttgaagattctagtgaaaatttgatcggttttgtattttttaccgcatgtagtgcttgagattgtccttcacctacctgatgtaaaccggaagaggggcaaggtcctctcggttctaagcatccatgtgagcccctgccactcaaactaaatgaactctttgtccgtatgtgatgatcgtgccgtctattcctattgggggatcaacatgcagagatcactggggctgagcgtctcagcacacaattttgtctcgtcgccgcatgtggaccactacaggagcttccctcacctgtactctgccaagatcgacgagttcctgaaggtctgttccccagttagagtatgatgatgaatcgacgattaatcttgctgaagatctgttccccacttatagatgagttgatgattagtcttttgaccaacatggtggttgaagattctagtgaaaatttgatcggttttgtatcttttagcgtacgtagcgtgcgtacggtgtaggatgcttctacatgggtgtttgaagaggggtaatatcgccgcatcgtcaagcatccatgtgggctccatctactcaaactcaagcaactctttgtaggtacgtgatgatcgaactgtctattccttttgggggaattgtattgtccattcttgggataatcttatatgttaagcacaggggcctagttaagcatcttatctactccgcgaggcaagaaaannanaaannangaaaaanaaaaaanaaanaaaaaaanaaaaaaaaagggccccta

SEQ ID NO: 15 - DNA, 1438 bp, Triticum aestivum
  Clone ID: PAT_TA_15
cacactactgtttctgctgttctactggttctttctttcagacaccacgtttgcctcctcgtctgccaaaattcttcttgtgatctccctggctccttacatccatggtgtccttccttcatacgtgttgggtttcacaggagagaaggtaactcctgattgtcttcctgcatcggtgtcatcgttgactgcccagttctccaatatgattcatcatagattgggtttgcaaatgtcatcgactccacctctctatcctgatgcagtatacttcttgtcgcacacaagaacttttaacatttccaaagctagaaggcaacttgggtatgccccaactgtatcattggaggatggaatcatgagaactgctgcatcagtttcggaactacaagataatttgggtatatctaggaaacaaggttcttgtggatcatcgaaagcagataagctgcttgggagtggagtagctgctgacattcttctttggagggatgaaaagaaaaccttctcatatatcacactactgtttctgctgttctactggttctttctttcagacagaacttttgtctcctcgtctgccaaaattcttctagtgatctccctggctctttacatccatggtgtactaccttcaaaagtgtatggttttacagtagagaaggtaactcctgattgttttgaagtatcagactcaacattgaggaatccaatcatgtgcatggcttctctatggaatggaggtatttataaactgagggttctagcagaaggtgatcgctggggtaccttcgtaaaggctgttgcttccttgtcctgtggcaaagtaatgttgcacttccagtttagaacgctgattggtcttgcgctggcatccttgttcattgtcttcattgtctacgaacaatgtgatgaggggattgacgctttagtagctatggcatctgtcaaaatcaaatccctagtggacaaagttgttagagatttgccggcggttcgaaatgtgctggtctcttcgaaggcatcgtatattttacagataatgttggccatgactctttgacgctttgtgggctacactttcttgatttctgctgcagttgtccaagattctcgctccaacaagcttcggtgaagtgtgaagtccagctgactggaattgaggaatgcctgttcatacattggaacattttgtcaatctgtgtagcgtgtatctaatgttttcattcaagaactccagctccctgcttagttgtagcttcttactcggtacttcagttttcgtctcgaaaagatgtctcgttgatcactgacaaaattacagtgcgtccttgaagtgtgtcgctgtactggaaaactcaccggtgtacactcagggcctctttgattcataggattctcaaaaaaaaaaaaaaaaaaagcgcaggaatagagtgtc

SEQ ID NO: 16 - DNA, 1005 bp, Triticum aestivum
  Clone ID: PAT_TA_16
gccggctggtgcgtgtcgtctcgtgtcccatccacgtctctccggcgtgcccgctccaactctcatccaatggcctcgccgcacgccgacccgcagcagcaccacgcgtcggcgccgcccctcctgctcgccgtacgccgcatcccgtacccgggggcccagcggccgcgcgcgctccccgccccggacctcgcccctctcgcgcgccgcctcgacgagctcaccgccgcggcggccgcccacccgctcctgaagccgctcttcgacctccgccaccacctctccaccttctctcagagcaggaggcagaggatggtggcgatgcggcaggcggcgtgcccgctggccggcggcgagggctgcttcgcggcggtgctgggcgggtccgtggccggcatggtggtgtcctacggcgtcaacagtttcctcagcctctacaacaccgtgctcgtcatccgtctcgtcctcacctggttccccaacacgccgcccgccatcgtctcgcccctcagcacggtctgtgacccgtacctcaacatcttccggggcatcatcccgccgctgggagggctggacctgtcccccatcctcgccttcctggtgctcaacgccctcaccggcaccgccgccgcgctcccggccgagctcccctcccagaagaccgcgtccggctcggtgcaccctgacgagtcaccgccaaccagaggaaatggacgcggagattccgcccgggggaaatcgcaggaggcagaggatgctgctcgctagactgctgcaattttcttaccattttcttgcatcaaccggctgtcaaacgcaattttggcgtgctccacaaccatcaaatgtgtactgtcgttcggcatgtcgaattaccactgaggcctgatttttcttcttccgaatgtgtatgtagaggaaccaaactgcttgactgtaatgccattttttgggtctttatgagtttctcaccttgttgattgcttgtggaaatcaaaaaaaaaa

SEQ ID NO: 17 - DNA, 685 bp, Triticum aestivum
  Clone ID: PAT_TA_17
gccggtcgggccgatcctccaccacccccttgcatcacgccgccctcctcccaatcccccatggccgccgcctcccatcaggtgccgccgcaccccactgccggcggatgaccccacaccgctgctccccctctcctctagcgctgtctacctccccgtcgacggccgccccgtcgccgtctggccactcgcctccctcgccggccgccccgtcgccgtccggccactcgcctccctcgcgggccaacgctgccctgtcgacgtccagccactcgccaccctcgccggccagcctcccctcgcgcgccctccaacgatagcggcgccttcatcccagacgatcggcgcccctgccagatttgcagtacagcgccgctgcgatccccatcgaccggcgcttccagcgccgccccatcgacgtccagcagtccccctcgttgttcagccactccagcgcctccgcgtcgaccggcgcgtcctcgtccttcagatccgactcactgcctcgccctctgtttcccttcaagtccagcgcctccaaatcgaccaaaaaagaaggtcacatcaggacggtgtacttctacgaaaggtaagttagaggagtgatagtggttgcaccgcagcccttctccttggcaggacatgagacgccatccccaccgaacttaaagaataatcattataa

SEQ ID NO: 18 - DNA, 1342 bp, Triticum aestivum
  unsure (1)..(1342): unsure at all n locations
  Clone ID: PAT_TA_18
tgaagatggcggctttgaccgaggggtttcgggctacgactgcgtcttccacctggccgctccgctaaacatgctgtgcgctgatcccgaggtcattttacaacgactacaaagaaaagtctgccttcctacaagcctgctattctctccgcacgtagggagtgttaattcagcatcctctttcccaaggaagatatgacaagatattttcaggtcatcattgtgctgaaattgccactccagaggaaccacctcacacgcccgcgttcctgaagcgaggggagcaagcgaataatccttctcttttccacgagaggttcgatcgagtggtggccggcgatgtcggcgggtgaggggaagaggacggcgtgcgtcaccggagggagcggctacatcgcctcagcgctcatcaagctgctgctccagaaaggctacgctgtcaagaccaccgtcagagaccccgatgacatggagaagaattcccacctcaaggacttgcaagcgcttggccccttggagatcatccgtgcccggctggacgaagaaggcagcttcgacgacgcagtttccggctgcgactacgccttcctcgtcgccgctccgatgaacatcggttcagcagatcctgagagagatatgatcgagccggccgtccaaggaacactcaacgtgatgaggtcgtgtgtcagagcggggacggtgaagcgggtgatcctgacgtcgtcggacgccggggtgtccaggaggccgctgcagggcggcggtcacatgctggacgagagctcctggtccgacgtcgagtacctcagagccaacaaaccaccaacttgggaatacgtggtgtccaaggtgcttctggagaaggcggcgaccaaattcgcggaggagaacggcatcagcctcgtcaccgtgctgcccgtgttcaccttgggcacggcgccggtctccaaggccagaaccagcgcccccccttaccctctccctattaactggcgatgagacacagctggacatcctgataggcgtgctgtcggtcaccacctccgtgtcaatatgccacgtggatgacctctgtcgcgcccaggtgttcgtagccgagaatgagtcctcgacgggcaggtacatctgtgaagccacgacaccaccctcgtgcagcttgcctctctcctggccgaaaagtacccacaataccaatgtgaaacttgaacgctttgctgggttcaagagaaacaaagatgtgttatcgtctaaaactcatcggggaaaggttcaantcagcacatganttagtggatcttgacgactcgtgaatacgnagacaaaggatctcctacgatagttt

SEQ ID NO: 19 - DNA, 638 bp, Triticum aestivum
  Clone ID: PAT_TA_19
gccggccgggttccgaggctaaaagctcccgccgcagaagcagcaaccgccactcccactcccgccgccgaagcagcagcagcaaccaccactcccactcccgccgccgctgccggtggctacaaagctctccgcagaagcagcaaccgccactcccactcccgccgccgaagcagcagcaaccaccactcctactcccgctgccggtggctacaaagctcccgccgccgctgccggtggctactaagtctgagctcaccgtacctaacctactacgtacactactactgcacgtacgtatgcacatacgtacgtacgtgactttgggtctgtggcggcccgcgattgtgatcgataatcatcaattcttgcgtccatgcatgcatggcttattaattaattattaattgcgtacagtaatttgtttcggagagagacatcgataatcatctgtaaagcatatatatggatgagcatgatatatatatatatatataggaaaatggattggtactcctaggagtacatatatactaatatatatcatccatctgtaaaacattctttatatatactaatatacacgggctcataattattctgtttatatacaaaaaaaaaaaaaaaaaaggccccta

SEQ ID NO: 20 - DNA, 1231 bp, Triticum aestivum
  unsure (1)..(1231): unsure at all n locations
  Clone ID: PAT_TA_20
gccgggcgcgagagagccaagggacgaccactcagatctcgccgggcgcctccccgcatccgccgagccaaatcgcgcgcgagagagcaaagggaggaagaaagagatctctcccagcgccaccccgaatccgccatggcctcggccgcgccgcccctcctccccaccaccgtcccggccgccgcgcccgcgaccgtcctccccgccgccccggacgccgccgccgccaactccatcgcctccccggacccggccgccacgcgcgccttcctcggccgcctctacgactccgccaagcgctccctctcgggcgcccgcccctggcccgagctcctggaccgcgccgcgctctcgcgcccggattccctctccgacgccaccgcccgcctccgcaagaacctcgcctacttccgcgtcaactacgccgcgttcgttgcgctctccctcgcgttctcccacctcccgcaccccttctccctcgccgccctcctcggcgctcctcggccgcctggctgcttcctctacctcctccgccccgccgacgccgccccgctcaacgccttcggccgcaccttctccgacagggagacgctcgggggcctcatcgccgcctccgtcttcgtcgtcttcctcacgtctgtcggtgggatcatcttctccgcgctggcgctcggcgccgccgtcgtctgcgcgcacggtgccttccgcgtgcctgaggatctgttcctcgacgaggtgcccgaccagggcctcgtaggaaacggcgccaccatcaacctcctctccttcatcaacggcgctgccggaggaggaggacgcgtctgagccagcctcctgtcctcagctctctgatctgctactcggaacagacaagtaaagtcagtggctggttgattcgtttttccagaaacgaagtacttctacttgtttattaagatcatactacgcgttgcctttaagagcgtgaggaggagattagaagaggatgcattggagttatactacacacaggatatacacaaaagaaggaaccttgggatctagttttgtttcattttgcatttgatattgctgtatgatgacaaagttgagcttattagtattgatattcatatgatatgtatcttggtgttactagcatacaggacaaaataaattgctgctcctcgtcttaacataaaaatgaaatatatgatgattaagtaaaaaaaaaaaannnnnnnnnnnnnnn

SEQ ID NO: 21 - DNA, 1604 bp, Triticum aestivum
  Clone ID: PAT_TA_21
gccccgcccggcccagcgcggcgtgcgcccgccccgcccccgccttccgcgggcgccgtgctgggtgcgcctcgccggtggccctcccggcttgcgccacggcccgcggcggccccccgaggcgcgtggccgtcctcggctcccggcgcgccggcgtggcgctcgccggcagcgggggcgtcgccggcctgctctgccgccgccgcgtggtgcacccggtcgtggccgacgcgtacgcccccccgcgcgcccagctgggctccgccgtgcccgttgcgctcaccgccgtccgcgtggcgagcgtgagcgcctccgccgggcctggggaggcgggccgcgtccccctgccgccccgggccggcggcgacgcgtagcaaggcgggcacgacggcggcaggatggtggccgtgaagaggatatggaacgcgaggaagctggaagcgaagttcgacaaggagttcgaggcggaggtgaaggtgctgggcaacatccggcacaacaacatcgtgaggctgctctgctgcatctccagccaggacgtgaagctgctggtctacgagtacatggagaacggcagcctcgaccggtggctgcaccaccttgaccgccagggcgcgccggcgccgctggactggccgacgaggctggccatcgccatcgactcggccaaggggctcagctacatgcaccacgactccgcgcagtccatcgtgcaccgggacgtcaagtccagcaacatcttgctggacccggagttccgcgccaagatcgccgacttcgggctcgcccggatgcttgtcaagtccggcgagctggagtccgtgtcagccatcggcggcacgttcgggtacatggccccagagtatgcgtccaggctgagggtgaacgagaaggtcgacgtctacagcttcggcgtggttctgctggagctgatcaccggcaaggtcgccaaacgacggcggcgccgacgtctgcctggcggagtgggcgtggcggcggtaccagaagggccctccgttcaacgacgtggtcgacgagcacatccgagacccggccaacatggcggacatcctggccgtgttcaccctcggcgtgatctgcacgggggagaaccctccggcgcggccgtccatgaaggaggtcctgcagcacctcagccggtgcgacaggatgtccgctcaggcggaggcgtgccagctggactatggcggcgacggcggcgcgccgctgctcgaggcgaagaaaggcagccggaggagggacgtgtcggactccggcaggtgggacgacgacgaggaggacagcggcaacttcgtggtgcacgcggtctagcagaggcgtacgcccaccaacgagagcagttctgttcaggtgtacactagcactgactgcagagtgcatagctagctagagctcgtcctccgtgcatggagatgcagggctcgtagcactaccgcactagtgcagtaaaaatgcgtagcaataagcgtaagacgtgaaggcgaaggaagaatgtaaccaaccttgtaccataggcgccgatctacggaaagggtagaacaagttcttgggtaacttcaaaaaaaaaaaaaaaaaggccccta

SEQ ID NO: 22 - DNA, 810 bp, Triticum aestivum
  unsure (1)..(810): unsure at all n locations
  Clone ID: PAT_TA_22
tgccggccgcccccggggcatccgcacctgaccttctcccctaccgcgcctcggctcggccagtcaaccatgggggacgccacggcctcggccttggcgagcaccaagacggcggagctggacgcgccgctcagcgccctgggcttcgagatggaggaggtctcgccgtcgcggctcaccggccgcctcctcgtcacggacacctgctgccagccgttcaaggtgctgcacggcggcgtgtcggcgctgatagctgagggcctggcgagcatgggcgcgcacatggcgtcgggataccgccgcgtcgccggcatgcagctcagcatcaaccacttccggagcgccgccgccggcgacaccgtcctcgcgcgggccgtccccgtccacatcggccgctccacccaggtatgggaggtgaagctctggaagatggatgcatccacacagggggaagggcctctaatcgccgaggcaagggtcacgctcctctgtaatctgccggtgccggatgagatgagaagtgcgggagaatcccttagaaaatactctaaattgtaaaactcgggacaaattaagcttgacatgggatgatccattgatatgtgattctgtgaaaatatattcttgtaagcttcttacttttcacttgtgcgaacactgatggatcaactcggcagaaacaagcttcgtgtgtgtggttgatggacctcactatcaagcaattaataatttcgactctaaatcaaaaaaaaatctattcattattccagnatatatatatatggaaaaaaaaaaaaaaaaaagccccta

SEQ ID NO: 23 - DNA, 830 bp, Triticum aestivum
  Clone ID: PAT_TA_23
gccggcttcttggctatctaaccaagcattgacttgtcttcccttcctcttcattcatccagagataccccctagcatctgatttcgcttttgatcttctcttcctccaccgcttcgatccataaacaatacatcaaccaccctggacgacaacatcacaatggctgctactaccgagcacagtgagcagttgagcgagaagcacgatggtctcaatggcaactttgaccctgaggctcagcgtggcgaggcattgagccagttccgaacagcgcagagtgttcagatgagccctgagctattcgagaagctgtacctttcgcctatgaacaaggtcaagggcgatcttcgacagaagtttgctaatccgacaccaattgctcttgttggtttcttgctggcctttacgcccctgacttgtgatctcatgggttggcgaggtgccggcggcagtggtgctgcttcaaacgccgtgtacatgtttatgggcggccttctcatgattatcggtggtgttctcgaatgggttctcggcaacagtttcccagcttgtgtcttttgctctttcggtggtttctggttttcgtatggtggcactctcatcccggcctttggtacatacgctgcatatgctcccgccgatgccaaatcctctgccgaaggccttgctacccaaggtttcaacgctagtcttggattctggctcttgtttatgggcctcttgtctttcatcttcttcttgtgcgccctccgaactaacgttgtttttgtcatgatcttcttcagcttgacattctgtttcttgcttatcactgctgctttctgggctc

SEQ ID NO: 24 - DNA, 1401 bp, Triticum aestivum
  unsure (1)..(1401): unsure at all n locations
  Clone ID: PAT_TA_24
cgcaccaccctcacacgaacgcaagacgctccccccctctccctcccgctcccgccgccggcggcggcgcgcgaacgcgcggcgccggccggccgcagaggcactttccacgctccgacagacgtcagaaccctgagcccgaggccgcctgccccgcgcagcttcaccaagatgagcaagatggcgatcagggttcccaagaacatgcgcgccaagcgcgagctcctcaagcacgcgcccaaagctcgttgagaatggcaagaagatgcttattctacatggtacaaagactagcgcagttttgaactctgtgctggcagatcttttccacctgaagcgtgatcatgctgtcaagtacaccaagaagaacgacaacatcaggccatttgagagcgggggtgaaacttccctggagttcttctcccttaaatctgactgcagcctcttagtgtatggttcccgcctcattagtgcacggttcccagtcaaaggaagaggcccaacaatcttgttttgggaaggacttacgatcaccacatatactgaccttgttgaagtaggagttgagaactacaaatccatagaatcctaaagcctttctttgctttcattggggagcactttgagagtgttgaagagctgaagcatttgaaggaaatgctgcttgatcatttcaaaggagaggtggtagagaatctgaaccttgctggtgtagatcggatattcgtgtgcacagcaatttctcctactactgtctacatgatgcactgcgctctccgtctaaaaaggtcaggcacatctattcctaggatggagcttgttgaagttgggccttcaatggacctggtacttaggcggcaccgacaagcagcggaaagtttacagaaagaagctatgaaggctcctggtcatgctaagtttgcggaaagtggctcgaatggccccggggcaggctagcagggcgggatctgcatcccagaccccgagggttcgcaagtggccctggctcgccactccaggcctcgggggcgggagcgccgtgacgccaagaaaaacaaggagcagtcgaagaagcaaaaggtggccgaaaaccctgagtgaccgccggagaaggctagtatctgtaactggtcagtttaaggactttcggtccataggttgagtggtaaatagtccagtaccatcttttaaggctagcttccctgggtacgggccccggcccctctttcggggctgcctctcctgcggacggacgcaggcatctgtggcgaggcagccgctccatctgtcttgtgcttctgatgttggcgccccctatgctacaagtattttttttaccggtggtgttcccccctgagttgagccaatcagagacgactgttgnnatnacagngttaagtt

SEQ ID NO: 25 - DNA, 920 bp, Triticum aestivum
  Clone ID: PAT_TA_25
gccggccggttcggaacagaaaaaaggcgcttcccgacctctcgcgtgaggaagtagggtccataatacaaaggcaggaaaacgaacgtgcgcagcgcaagggtcgccggcggtgcggcgagggcttgctgcgaccttggttcaacgagcggacttgcgatgccgctcgccggcggcggatgctggctgctgcaagccggacggcgagtgcggcgggcggctgttcgtgcgtgccaacggcgaggatgctgcgtcgttcgcgccgcgggcggtgcttccacggagaggggagacgagcatgatccgtcacacgacgacggcgtacgggcgtcgcatctgacggccgcggagctggcagcccttcggcgcctcccgccaggacaggctcccgccgcgcgccgcacaccgacggccacctcggtggtcgacggccagccgccgcgtgctcccgtcgggtccaaccgccgcggccttcacacgcccaggaccaggtgcggcgaagactgttgctcccgcctcaactacgatcaaaacgtggccgcggggacggccaaggagcctacgtccgccgccgccgccaaaactacggcacatatgctgctgctgggttggatagcgattgcagccgcgtccaagaactgagtcgccaataccgccacatacgtccgaccgggtgggacgacgacgatggttatcgcggcgcccgcatatcggatcggtcgacaataccacaacttcgagcggccgcccgggcaggtcaacggccggcgcgcccgcttatccgagaaccaacaccatgacaaatatgcgactacataggatggcgatggctcttgtatccgtgtattcaaaagtgctattgtcaaagtattgaatttgagagcatgatgttaatttgtacctcggccgcgaccacgcta

SEQ ID NO: 26 - DNA, 604 bp, Triticum aestivum
  Clone ID: PAT_TA_26
gccgggggaacaagcgcttgggcggcggcttggcccgcggccagccggaggccaggctcaaggggaacgggcgcttcggcggccgcggcggcggcggccagccgccggccaagcgccaggcggccgggaaggacggccccgccgaggaaaccgacgacggcatcgtcatcgcgcacatgcgcaagttctacaaaaaggacgtgaagagcctccccaccaaggaaggggtcgacatgcgcgagttctacgaaaaggaccgcaagagcctcccgacccgcaaaggtatatcgctttcaatggatcagtggaagatactgagggacaacatcgaagctatagacgaggccatcaaggagaatacttgatcggaaaagcggctaaggagatattgctgggcaaagtttcgctcatttgctgcttaagtatgctggtagtctagtgctgtttttagtcacaccttacctggaatgttgcacttatggtggactgtaactattgttgtcgcgaagctgacctaatgctaatggtagaatgaaattaggggatacacccggacactgaccgggtgcgtcggcggacgtttgaggggtcagatttgtgcatc

SEQ ID NO: 27 - DNA, 792 bp, Triticum aestivum
  unsure (1)..(792): unsure at all n locations
  Clone ID: PAT_TA_27
cctcgcccctccttgctcaccaattctcatctgcggagccgcctaaagagaacgagcggccgctccggccaccggctagatctgcagcaccatcactccaccagcccacccccgtgatctacctgctgtcgccggccctctctccctctgcagcaccaccaactgaggtggagttcaacagctcacattcctacatctttggaaatgcatccccatctaaccctacacaggcatcctatgtgtgctgagattattgaagaattccagaagtgccatgtggatcaccccatcaaaaaattctttggtgaatgcacagatcttaagattaagcttgatcggtgcttccggcaggagaaagctgtgaagagaaaggcaaactttgaagagagcaagaaatttaaagaaaggttgcaggcttctcgtgccgaattcgccgcgagagaaaatgaatcatagcttcgaacggaggacaaggacattcactgaatgctatttggctgcaatcctgtggcttcaactttgtgaaacgaagttccggacttgtctttacttcatgtttacatcacatatctaccgttataagattacagctgaggtcatattatctatttagaagttcaaatttccctctctggctgttgctattcatggttagtctattccccatcatatatatagacaataaatcttgctccaagttggtgttgtactgtaaaaacttctatatgaaatctttttttcttttcgaaacttctgtacgaaatcttcacaactaaaaaaaaaaaaaaacna

SEQ ID NO: 28 - DNA, 401 bp, Triticum aestivum
  Clone ID: PAT_TA_28
cccacgcgtccgggtgtatcacgtacatctctgccggttgggaatattttttcctgcgtccattcccttgctcgctctcatccgatgcagatggagggagatccacttttcgaaaagagaaaaagctggctcggtgtgtttgcttttcgatggcagagtgcaagggatgttgaagtcgatcgtcggaggcggagggcctgtgtggattcctacgctcgcagcgatgattggggtctccttcctgctcacgttgacgaggagccggaggggcatgctgcagcggcgagtgcccctgtagcacaaagctgtgagccctcccaacaagacacggcggcagggccacgcatgaagatgcagggcggcagggccaccatgaacaagacacggctaacccttggcga

SEQ ID NO: 29 - DNA, 699 bp, Triticum aestivum
  unsure (1)..(699): unsure at all n locations
  Clone ID: PAT_TA_29
gccggccggcccgacgtagaaacccattttccactccccacagccgcaaaagctcatcgtcacaatggcttctcgcatcgtctctcgccgtttcctctccaccactgctcgccgtttccaggagcaccagaagtctgagctcaagaaggagtcccaacgcaaccccgagattctgattctcggtggtgttatggttgctgctcttggcggtgctggttactaccttggccgatcgcccactggcgctacctccgagtctcccgttaccatcgctactcacccctgggagagtggcagctctggcaagtaccagtaccaccccggcggtgacctcagccaggcccccaaggacgctcccagcgccctcaacgttgtcgttgttcccaacgtcacccttccttccgagcttcacgacaagtacaacaagtggggcaaggacggatacccttaaatcgacattattgaacgtagttaaagctggttacatgtgtaagcacatgttgtagggaatgggcggggagagttctgggttggatcagtcagttctcgcgccctgtgtagaaagaaggacagagtgggctcaagtttagcaaccacccatagttcacttatgacgcttcgcgatctttacttgctatgagtcaaactataatttgtctttgttggtccaaaaaaaaaaaaaaaaaaggcccctannnn

SEQ ID NO: 30 - DNA, 741 bp, Triticum aestivum
  Clone ID: PAT_TA_30
cgcagccccagcacgagcgcgacctcgaatggcgtcgccctcgagatcgggagcagcagcagctgcagcgcgaccacgaatggcgtcgacctcgagcttggatttggggaagatcgtgccgccggccggcttcctcctccaccgctgcaccgccgtcctcagcgcccctgttctccgggggaggagcgcgagcgggcggtgcggccttgccgtctcggtctcgtcctccaatggtgcagctgggctctccccactgagtgactcggagaagaaaggccctgtggtgatggagatcccgctggaagatatccggaggccgctaatgcaaacgcgtgctaatgatcctgacaaggtgcaggagctcatggacagcatccgtgtcatcggcctccaagtacctatcgacgtgctggaggttgacggagtctactacggattctctggatgccatcgctacgaggctcaccagcgcctaggactcccaaccatccgctgcaaagtccgccgagggacaaaagaaacactgcggcaccatatgcgatgaatcggtggttagcgatgaatggatgatccatggactgcttcagccacgaagtgtcatctgttatgtctagtgctaaaaaaaaactttctcctcctgtaatcatatatacgtgtagatgttacccaatccaatgtgtaaaatagcacttgttcagctggcgattctgctccttcaaaaaaaaaaaaaaaaggccccta

SEQ ID NO: 31 - DNA, 899 bp, Triticum aestivum
  Clone ID: PAT_TA_31
tcgcgatctagaactagggagacgaaggattccaggtatccggctcagacaatgcggatggtagctcgccggccgcacttgcagattcagatgatggatacaagaactcacagtctggcaatgaggacgctagttcatcgtcagaggctactgaaccagaagatgaggagtatccagctgaagccatattcactgcagaagatctggctttcatgatatcccttggctggagtaaagatgaaaaggtgcaacctttgggtttggaagaaattgccgactatgtgaggcgccataaggggctggagcagaggcttttctccatggaagccaacgccgacatcaagataattctcctttatctttgcggtcagagctaaatgaaaggttgaaggagcctagagtacagaaaacagacgctttaaaaggcaggtacttagggactatggaagccacagtttgcaaaatgcaatggctagtcacaccttttgatgctgagaactgatagcaaagagtccttggcatgagttttgtctagattaacaagtcgagatttttttccctgatgactctcgtctatcaacttggggaggtggttcacaagtagttctgacaatttttggcatgttggaaaaatgaggttaggatttatcatattttccccaggagtaccaaatgaagaaaaaaaaaaaaaaaggcccctaaaataggttgcttttccccctcgtcaggtcttatctttattttcgaaaaggataaggtggtattttcaaccatggaaaaggtggatatgattacactcgtctcagaaaaagtttctttaactcgatgtcctcttttatttcctgtgagattgattcgctatttgatggctaaaaaaaaaaaaaaaaaaaactcgagac

SEQ ID NO: 32 - DNA, 839 bp, Triticum aestivum
  Clone ID: PAT_TA_32
ccggaatcaagctggagatcccttaaggtgcgttgggatgagtcgtcaactattccacggccagatagagtctctccttgggaaatagagcctgcctcatcacctcctgttaacccgcttcctctttctcggcccaaacgatctagaccaaatgttcctccagcttctcctgaatcgtctgttcgtacaaaagaaggtgcaactagggctgatatggattgtgctcaagcacaacgaaaatcaaaataacactgccctgccaggtcaagaacagaggagcaataagctaactgacattaatgactttgatgccactgttcagaagcctatgatgtggtcaccacccccaccacccaacattggaaaaaacaactcactaacgtttcagcagaggccctctgtgcataattcgattcagttgggaaggcgtgaaactgactttaaggacgccagttctggtgctcaaccttttggtgattccctaggcttcttcatgcagacaacctttgatgaggctccaaatcgtcttggttcattcaagaaccagtttcaggatcacagttatgctcgtcagttcgcagacccatacttatttatgcatcagcaaccttccttgactgttgaatcaagtagaaagatgcacacagagaacaatgatttacatttctggaatgggccgagcaccgtgtacggcaattcaatagaccaagcacaagatttcaggtttaaagaacacccatcaaattggttaagcccgcagttctcccgggcagaacagccacgagtgatcaggcctcacgcatcaatagctcttattgagctggagataacaacagaag

SEQ ID NO: 33 - DNA, 639 bp, Triticum aestivum
  Clone ID: PAT_TA_33
cgacgaactcacagctgagctagacaggatgtttgaatttgatggtgaactgatgtcttcgaccaaggattggcagattgtgtatactgatccggagggtgacatgatgctggtgggagatgatccatgggaggagttctgcaacatagtgcgcaagatcttcatctacaccaaggaggaggtccagaagatgaactcgaaatcatctaccccaagaaaggaggaaggttccgcggatgccgatggcgcaaacgagaaggcccgtcccgccacgtcaagccatttagataactagccaactaggttgcgttaagccgatttgaggcatgaggtgaggtatcgcacggggagctttgtcctgccctcgctcgggtcccagccagccagccagccagccaatgaagtaactcctgatgtcttttggtgatcgccccctcccccttgtgatgcagcaacgacaacccaacccaaccctttggatttagctatttacttgctaggtaatgtagagagagagagactttgctgcgctgcgcgattgtttatccgctggtttgcttgcttgctcttggcagtttaagatttttagggccaagatttatgattattcgtgcccccctgcttgaatgcatgcttgat

SEQ ID NO: 34 - DNA, 3415 bp, Triticum aestivum
  Clone ID: PAT_TA_34
cgtccgtgaccaattgtggcctgaatcaaactggagatctcttaaggtgcgttgggatgagccgtcaactattccgcggccggatagagtctctccttggaaaatagagccagcttcatcacctcctgttaacccgcttcctctttctcgggtcaaaagacctagaccaaatgttcctccagtttctcctgaatcatctgttcttacaaaagaaggtgcaactaagattgatatggattctgctcaagcacaacaaagaaatcaaaatagcatggtcttgcaaggtcaagagcatatgaccttgaggaccaacaaccttactggcagcaatgaattgcccggacgcgcggccgctgctggtcgtctccatgcccccggacgcccgtcacctcgcgcgtccccgcgcccgcctctcccaccccacccgcctcctcatcgccggcctcccgcggtcgcgagggtccccccccccgcgccaccacccagtctcagccaacaacgcagcccgcggccatgaggctccagtggagaagccgccgcagccgatccgctctacgccgacctcgcaggcgcctgcgccggcccgcacgtcaccgactggcgccgagtgcaccacggtttgcagcttcccgcatgggcacatccagcacggggggggcctcatgaacctgtacgtggccaagtcgggtccagcgctaggatttgccctccaggctgctctgccgagtcattaacgtcgagctcaaaggcggcggcggaaaccgacgaggtctagcgcgcaagtcaggttcagtgcctgagccggagcaaaatgagatggaggtggacaagtccacctcaccgacgggcgacacactggcgaggctggaagtacggtccttctgcatgaccctgaccgagtccgacaccagtacgcatgctgatctcgacgtggtgcgcagcctcgcgggcgagtacctacctgccgtgttctggaccctatcgccaacgacactcatctttgccaaggaggaggtgcagaggatggactcgaaatcccccaacctcagaaagggggaacctaggaagcatctccttcagggcgaagggagtgcgtttcccgcgttgcaaaagccatgtagctagggatcccatctattttccgattagagcgagttggaggcatcaagttgatgtaacgcgacctaggagctaggtctctaacgtggcttcggtaccaagctctcgtcaaagcatgcacctgagagaccttgtgattgcatggcatggccatcaacaccaaaatgcattgtcactgtctactacaaacctagcacgaggcctttagcgattattttaccatatgatctagagagagagtctcttagaagcgatgctcgaatgtttatccgctggtttgctagcttgctcttggaagttgaacaatattagaggcatgatgtaagattatgcgttgctgaccttcttgaccaattgcttgatccttagcactgcctcctgtttctcccgatcagcactgtatgttaaggtttccctcccccgcaccatctggtgaaaatgagtaatcagccaagtaccatgagtccctttatcgcacaacctgcatgcagctgggaagaatgtgatgcaaggtccgggtggttaatcttttagcatattcccataggcatcttcattgcacgacctttgatgaggctccttaatcgtcatggctcattcaacaaaacagtacgaggatcacaggttctgcgcgtcagttctcgagaaccgtcaacatagctgcagacagaggctaatgtgtttcatttcaggaatagctaaagcagcctgtaccgtaatccaagaggtcagacacatgcattcagatttgaagagagcccctcaaattggttatggcagcagcaggagttctcctcagttgaacaaccccgagcgatccttccgcacgcaccaatagttcctgttgccttagataaaacaaggcaacgcagcggcttcgctccttcagggcccaagttcgatgctaccatcttccgctctaaccatttgagctccacaatggctgcttgccacgaggctcagtgacgatcccatccatccccgtcgtaaactcttatgcagcaagcaaacgctgattttatacctgtgctgattgtaagcactgctagcaatacggataaggcaaaaagcattcagcaagctcctcacagttcgaaagacgtccaaagcaagtcccatggtgcttccacaaggagttgcacaaaggttcacaagcaaggtgttgcacttggtagatcagtggatctatcaaagtttggtgactatgacgaactcacagctgagctagacaggatgtttgagtttgatggtgaactgatgtcttcaaacaaagattggcagattgtgtatactgatcctgagggtgacatgatgctggtgggagatgatccatgggaggagttctgcaacatagtgcgcaagatctttatctacaccaaggaggaggtccagaagatgaactcgaaatcatctgccccaagaaaggaagaaggttctggagatgctgatggcgcaaacgagaaggctcatctcgccacgtcaagccatttagataactaggcaactaggttgcgttaagccgatttgaggcatgaggtgaggtatcggacggggagctttgtcctgccctcgctcggtcccagccagccagccagccaatgaagtaactcctgatgtcttttgatgatcgccccctcccccttgtgatgcagcaacgacaacccaacccaaccctttggatttagttattacttgctaggtaatgtagagagagagaagagactttgctgcgctgcgcgattgtttatccgctggtttgcttgctcttggcagtaagatttagggccaagatttattattgtcgctgccccctgcttgaaatgcatgcttgatctttagccctccctcctctctcccccccgaccaacctccatgtaaatattgatctacctcgccagctcccgttaggtaagtacgtaacaaaccaacccaacccttttggccgtagctatttacttgctaggtaatgtagagagagagagactttgctgcactgcgcgattgtttatccgctggtttgcttgctcttggcagtaagatttagggccaagatttattattaccgttgcccccctgcttgaatgcatgcttgatcctcagccctccctctttcctccccaccaccctgatgtaaatatttatctaccttgctagctagcgttagtaagtacgccggtaccctccattatttaaccgacccgcagtagctgttccgggagtagtaaaacacgggcaaagacgatggtatatgtacgtctcaccctgtttaatgtactattaatggcccaattcaaaa

SEQ ID NO: 35 - DNA, 806 bp, Triticum aestivum
  Clone ID: PAT_TA_35
gccggccgccggccgatctttagtactcgtttcctcaaccagctgcgacatcaacacaatttcatcatcgcattaccaacaccaaatcgcccaccatggcttcgtcatcaactccatcgactccccttctctactcatgtatcgcccacaacaccaccatcctctcagaatgcacaacttcagcttcatcgcagacctcatctctcgcctccctcatcctccctaaaatcgaacacacgaacccccaaaagcttacctacacccacggccagcaccagatccactacgtcgccgagtcgccctccgagcaccgagactacccatccgccggcggtctcaccttcctcgtcatcgccgactcgtcgctcggccgtcgcgtgccctttggctacctcttcgagatccgcaagcgcttcctgcagcagttccccgagagcaccgacttctccgacatgcccaactacggcgccgcctcgttcaactcggagctcaagaatctcatggttgactacggcaccacgaccggcggccgtgacgacgccattgggaacgccaagcgagaaatcgacgacgtgaggggcatcatgacgaagaacatcgagagcttactcgagcgcggcgagcgcctggacttgctggtcgacaagaccgatcggctgggcggtagcgcgcgagagtttcgcgtgcgcagtcgcggcctgaagcgcaagatgtggtggaagaatgtcaagctcatgggactactggctctcgtgatattcctcatcatcatggcgattgtcattgctgtccagaatggatcctaa

SEQ ID NO: 36 - DNA, 774 bp, Triticum aestivum
  Clone ID: PAT_TA_36
gctgggcggcgctcagtcggccctctctctagtcttgagcaatcatcacttttctcttcctcttcctttttgccccatctctgtcataatctctccctctccctcccgatcctcaattccaacttcattgttgcagcccacttgagcttgtctacagtgaattgattcaaaaaggaataagccgacactcgccagctcattccatcttaccttttctccgttcctcatcaaatcttcataattcagaatgtccgccaagtcgattctcgaggccgacggcaaggccatcctcaactaccacctcacccgcgcccccgttatcaaggccagccctcttcctgcgcctaccactcacaaccctcccagcagactcgcctcgctgcacttccctgaagatgccaacgttgccgatatcctgaaccaggctgaggtcacctacccttggctcctccagcccgacgccaagttcgtcgccaagcccgatcagctcatcaagcgacgaggaaagagcggtcttctggccttgaacaagtcctggcctgaggctaaggcttgggttgctgagcgagccggtaaggagcagcaggttgagcacaccactggtgttttgaggcaattcctcgtcgagcctttcgtgccccatccccaagacactgagtactacatcaacatcaactcagtccgcgatggcgactggatcctcttcaccacgaggtggatgttgtgtcccctgatgttgtcgccaaggctgagaagctcttgattcccgtcgac

SEQ ID NO: 37 - DNA, 484 bp, Triticum aestivum
  Clone ID: PAT_TA_37
gccggccgggctgcggtatccttaggcacacagcaaagaaataagctattatccgtctctttgccatggcacccaagagcaatgcgacccggatggttgcggttttcgtggttcttatgatcatgtcttccaccctatcatcatcgtcctgctatgcacgtacaattgaagatggagctccagtgtgctcccgtgtggaaaagtgccaagaccgttgccagaccgcatgcagtatcagtggcaagccctcgactggagcctactgcaataacgatcagtgctgttgcgcctagcatgatgcttctgttcttgctcgagcaataattttatcacagcttctttcaaatgtagtattggttatcaaaaaattatacaattgagcttttaaaaaaaaaaaaaaaaaaggcccctatttggcgaggagactgctaattgatcgcatgtcacaaatatcttcaaaaaaaaaaaaaaaaaaaaaaaaaaa

SEQ ID NO: 38 - DNA, 705 bp, Triticum aestivum
  Clone ID: PAT_TA_38
gccggccggttcgggaattccgctaagaaacccaattccccttatcttcttccgctcgctcgccgcggcagcccccgctgccttcgccctcgctacctcggctgctctccccggcgttcctcaacccccagaagcttgcccttgaggcgcttctcgtgttcgcccgccacggccgcagtcgtggccgccgcccccggtcctatcccccgccgtccatgaccgtgttcctcagcgccggcaggtcatcttttggcgcagctcgtcttctcgttacgtctctatacgccggcgctccgtccacgaccaccgtccagctcgcccgccgtccacacctgtaggctgcatcttggcacatgcggctggactgacctgagtctgcaaagaagacaaccccaacagtgatgaccaaggggtagatctttccaatgatttgagctgctgatgttgccagtgatgaccaaggataaatgtgccaaaggaagaaactttgtagtttgtacaaaattctgtagtttgctcatcttgtcagtgatttgagttgctattttttgtagttggcacatcttgccagtgatttgagatgttgttgtgtaaaataatttaatgtacactgtgaatagaagttcctggtattgagcaaaagagattttttggaagtggagaatacaaaggattgatgcaaaaaaaaaaaaaaaaaggccccta

SEQ ID NO: 39 - DNA, 874 bp, Triticum aestivum
  unsure (1)..(874): unsure at all n locations
  Clone ID: PAT_TA_39
gccggccgggttgcaaccccgcaccccgcgccacagcaagatcgagtcagtcaagagggcgaggcgtgcactgctggtcctcctcctcccgcgcatggtgccccgtccccgccggccggcgccgacacatgttgcatgagcggcacgcaccaccctccgcgtccgacgacgaggacgatgccctaggggccaacgacgaggagggcactctggtgaccaccaccgccagcaccaccaacaccaccttccacgacgtcgacgaggtgatcgaggtgcgcgaggtccaccccctgtcgccgccgcacccgcccttcacgccgcccacgcgcaccctgtccgccgcctccaccgcctgggacagcgccaggcacgccaccgctgcgtcacccccgaggagcattgataacgatcaccgccgggtcaccgccatggtcgccgccggcgccggcaccggggcggcaacaacaacccaacactgtcaacacggcaacagaacaccaccccaacgccgccactacgacggcccccccgaccagctgaccagcatgggcgaggacgagctggcggagcaagccgcccaaccgcgcctacgcgacagcggacgccccttcgccacgccgcccagcggtcgcgccgccccccgcgcccgagcggccgcagaagcgggctgcgtcgcacaagggggcgcgcccgcacgggtgtgacccgccgccggcccggtgcagcntcagttanaagagagtggaacaagttcgnttgaaaggggnatccaagtaaaacgntaacggagagnggatacggtgaanggnagcaagcncctgncaaattaagaattgaanacccagggtgaaacaaanattcaggcgaaggggga

SEQ ID NO: 40 - DNA, 416 bp, Triticum aestivum
  Clone ID: PAT_TA_40
gcagtttgaggcagacaaggagcaggtgataaaggaagtatcagcactgtaaaaaaatcgaagaagcttgcttcgatttgtgactagtatgttcacaacctcagctggtttgtttttatttgcagcgaatagcttgaacacatgaaaagattctatctgaatatttttgctcgagtcccttaaaagattcatcagaatcataagattatcttttgaactaacatatcgcatcatgactgcagaatttgatctatcaagcagcatgtctcccaacagcttgatagcctgcctttttgttatgtagttgcttgatgacagcagccaaagttgtgatactagttgtgcacctgtgccatagctcacaccaactcagtacgaatgatctgaatctgcaatgacgaagatttgtatgcgtc

SEQ ID NO: 41 - DNA, 646 bp, Triticum aestivum
  Clone ID: PAT_TA_41
acatgaaaggatccaggtgtcttaaaataaggccaggaccccaaacataaggtaaaacgcctgtcccaatttcggaccatccacaaaactatataaatagcatcacaccttcatagtagcatcagctatatgattcatgccgttgcttgactccaacataataatgcacagaagactattattacacaaacagcttcgctaataaacatcacggtggatccatgcaagagcctttcgtggtgcgttagatacagtaatccacgagaggccactttaagcaagggctaacttgtaatcttccgcaagctacatcagggaagttacagtgctgatatctcctttatcacctgctccttgtctgcctcaaactgctcatcctctttgtcagttttgaatccggcaaaaaatcgaagaagcttgcttcgatttgtgactagtatgttcacaacctcagctggtttgtttttatttgcagcgaatagcttgaacacatgaaaagattctatctgaatatttttgctcgagtcccttaaaagattcatcagaatcataagattatcttttgaactaacatatcgcatcatgactgcagaatttgatctatcaagcagcatgtctcccaacagcttgatagcctgcctttttg

SEQ ID NO: 42 - DNA, 832 bp, Triticum aestivum
  unsure (1)..(832): unsure at all n locations
  Clone ID: PAT_TA_42
gcaccgcccccggaactcgcccaccgtcccctcctcctgaccactcactggaatactgcacgcggcggggagatgagggccgccaaaacagccctccttgccccctcccgccgcacgagtgcccgcaccgaggacgcgacgggaacggcgggggccgcgccgaggacagcgctcccggaaccacctccgcgtgcgggtagggcgccctgcggtcgcagggggaagcgtccccgtcgccaggctcctgtcttcaacctcggaggggggagaagggctcgttcctcgacaaggacgaggtcgtcgaccgcgtacgtctccgtcatcaagaatttccagcagttcgagccctccaaggtgacccctaactgcgcattaccatgaagagacctcgcggcgtggcacaggcctgggacactgttcgaagatcgtgtataggccatttgcaggaagaatttcagcttcggaagattccccgacaatgaggcaagagaagatcgattccatcaagtcggcagtcgacttcattgcctcgcatcctcaagcaaagtaagatttgcttgcagcggtttcttggttcccccctttgacacacattgtctccagaaggaatgctccccgaaaaggacctgtcttttcccagtaggtgaatgatcctagtttgctccgttgatttttgtgctctctggtagcaagtctttgttctctccttccgtctgttgcaataaataatgatacaccagttggttgtggatctatgattctattagctggggatgacagcagccaaagttatgataacaagagaaaaaatgaggaatanaaaaaaaaaaaa

SEQ ID NO: 43 - DNA, 651 bp, Triticum aestivum
  Clone ID: PAT_TA_43
cacccccataacagattttgagattgaaaagccggctatccaagtaaatgaagtcgcagtggtggacaaaacagtcatcaaagagcagctgagggaggagggcagcaaggcctcaaatgttatgcaagaaacatttgatgacgacatagacgattggttagacgaggaggccgatctcgctgggcacaccgccattctcataggcgatgaggaagatgtgtcattcagtgatttggaggatgacgatgatacgaaatgatcatcatccaaaatccaagccaacctcagcctgaaaaccgggacccggtcaaaattgattgttctttaatagaaagaagggaagttgtacaatgaaaagggagcaaattcagggccaacttcaacctgaatgaaaactggaaagcggttgaaattgcttgtttgttaatagaacggaagttttgtgtacaatgaaaggggagcggctccattttggttttaagctgctcggttggatgcaacggtaatatatatatacagtgggtgggggtgccgtatggtttgtaattttattggtaatcttgtgtacataagcattattttaaaagtcacagcaataaaagttccattcgttggttgattgttcaaaaaaaaaaaaaaaaaaggccccta

SEQ ID NO: 44 - DNA, 1780 bp, Triticum aestivum
  Clone ID: PAT_TA_44
ggaagactttaaccatccagagagcctaaagtgcatgaggccggttggtcaactcgggcaacataactgggatcagttctttgccaatgaggtgactgagatgagaggccacctcctcaagtaccctgtaagtgttgaccgtaaaggcaaggtgaaacccttgccaggatgtgcgacattcccagacatgggcggaaacatttgtggctccttcacggccatccaggaaaacctcacaatatgaattctgcttatgcaagaatgcaattgttggcttcttgggtattctggacagcaccgatcccgtacgagcaccgtcttcctgctcatggtacattcaaaaggtatgattgtagatgatgaatatgtgatcattggatcagctaatatcaaccagaggtcgatggaagggatcagagatactgagattgcaatgggagcatatcaaccacagtatacatgggcaaataaaatttctgctccccgtggacagatttatggctacagaatgtccctctgggctgagcatattggaattatcgaggaagactttaaccatccagagagcctagagtgcatgaggcgggttcgtcaactcgggcaacataactgggatcagttctttgcaaatgaggtgactgagatgagaggccacctcctcaagtaccctgtaagtgttgaccgtaaaggcaaggtgaaacccttgccaggatgtgcgacattcccagacatgggcggaaacatttgtggctccttcacggccatccaggaaaacctcacaatatgaattctgcttatgcaagcatgcaattgttggtgacttcttgggtattatggacaacagagatgccgaagtagcactttctggttcctgataacataggtagggagagaatttcgcaagccaatatgtaggtagcaggcaagtagggcaagttggaaacaaggaaaaaaaaatcaagtcatttctgccttttgggttgttcccatcttaactaatcatgttccttttacatgtattcggtccctgtatatgtaagatgattacatgctggatccctctgaagggaacctggcgtttgtagcaagtgacaaccaccaagagaaatagtagtatgttatatgtaatttgatgaaacaaagtttctagtgcaaaactgtaaatgcatccttcacactattctgaagcaatgttgggccttggtttgctcctcttgtcatcaatggaaattggtgggtggatgtggcaaccggttccatttttttaccgaagtattgttgcttgaaccaccatcatgcctttgggacataagttttccttcttattttacagtgcagagaaatgcatgttaaagggatgtatgggtttcataataatcaacaaacaggcactaaaagactatgcctagagaataagtggaaaaaccaaattaatctgttctaaaccaggtcccccaaatacaatattatgccatgaattacatgcaaatttggctccgtgaaatatcatttcctccatctctcggcctgaatctttatgcccatatacctgccgagcatcatgacggtggcctgcgggttggtgccgggggagtacctgaaggtggagctgtcgatcaccctgagccccctcaccccgaacacccggtagttgtcgtcgacgacggcgccgacgtggcatccgccgtggtagtgccccatggtcatcccggtccccctgcagtactgctccggcgagcgggagtcgttgacgtgccgcggcagcaggttgacgcggacg

SEQ ID NO: 45 - DNA, 983 bp, Triticum aestivum
  Clone ID: PAT_TA_45
cccacgcgtccggcaggctgaagctgctagcctattgtacaagtcaaatctcaacggagggagcgtgctggagtacgctcttgctttcacaagtgctgccctggatagacattacagcaaatggagtgcaactccaaagacaggtttcattgacataaccacatcgaaggacttctatcgtgtttttagtggtcttcagtatagctacttggaagatagcatgaccaatccttcaaagaaacgagaaatgttgggcgactctgtagcatgggctggctgtactatcatgtacttgctggggcagcagctgcatttcgagctattcgatttctcctaccaatttctcaacgtggcagaaatagaaaccgcgacagtttcactttaccaacctgcggataggagcaaaagcccaaatatcttccagggctacgaggtgatccttgaagcgatgaggaaggctaggaggctgaacaaccacgtgttctccatgttgagagcgcggtgccccctcgaggacaaggttgcgtgtgccatcaagccgagtggggcgccccttcaccgtatgaagtttagcaacacagtttctgcattcgagacattgccacagagagcgaactcgtagttaccaggcggatgtgtgtgtgttttttctttctttccggtcttatctcgtatgtaggtgacctcatgtatttgtgtcgttatcgacctacggttgatgtacttctatgcaactgttgtcattgacgccgaaccccgacgatttagtaaatagtgtatcttaggagcgagggggctttttctttctttttagtcttatttggtaggtatgtgagctcatgtatttgtgtggttatggccctaatgtatatatacttttatgtaactgtagtcattaacgttgaacccagactgtttagtaaaatagtgttttttatggatccaaattgcaatttgagcctaataatagctgttgatttcct

SEQ ID NO: 46 - DNA, 728 bp, Triticum aestivum
  Clone ID: PAT_TA_46
gccggccgggctgcagaatcaaaccttaaccctttcattcatcaccatcaaccacgcaaacacgcaaacacacaaacaccaccaaccacacaaacacagtcaacatgcctgaactcaaggtcggcgccgacttccccgagggtgtcttctttagctacgtccagcccactcccgagatcgctgagttctctacctgtggtgctcccaccaactacaacgccagccaggagttcaagagcaagaaggtcgtcctcatctctgtccccggtgctttcactcctacttgcagtgcctctcacgttccttcttacgtcgagaacattgagcagatcaaggccaagggcgttgaccaggtcatcgtcgttgctgtcaacgacgcatttgtcatgcacggttgggccaaggctaatggcatcaccgatgacaagattctcttcatgtccgaccacaacgccaagttctccaccagcatcggctggaacctgggcgagcgaactggtcgtttcgccgtggttatcgaccacggcaagatcacctatgcctctagtgatgagcctggaagcatcgagaagtctggtgcccttggtgtccttcctcacttgtaatccaatcaactcgcacaagagattctaaagacagaatatagacgagggtatgagacaacgatagaatagagacaaactacatgaataccattgaacacaatctaaaaaaaaaaaaggccccta

SEQ ID NO: 47 - DNA, 434 bp, Triticum aestivum
  Clone ID: PAT_TA_47
ctcctcaggatgacatgcccgaggacagtagagatgctgatgacttattgggggagtctgcggctggttttgatgggggtggggccaacgatgcatatgctggtgcttatatgcacgaccctgacgattttggaagggacatatatccagtagaagattatgaatatgctccggctgattttgaaatccagtctcatcatgaaagagagctattcaacggaatgggtgagcaaggaccgatcggacaaatgtatgatggctatgacaggaaacgtcgtagaacatcttctgagaggaacttggacagacctttctattcagaaaggaggtctcggcagagagagactggccctgttgagatagatggatcagatttacgtcaccggctccggatgagaaaaataaatgggtctccaagcatcaacccggaacgc

SEQ ID NO: 48 - DNA, 644 bp, Triticum aestivum
  unsure (1)..(644): unsure at all n locations
  Clone ID: PAT_TA_48
gctgcaggnaattcggcacgagggtccttcgcctganccgctcgacccgaaccgagccattttcactctctaaaccctacgccctcctccgccgccgcatccggccacccttcgccgccgcatccggccatgggtagcaggctgggccgccgcgtgctccacttcgccaacctccccatcaagctcatgctccccccggcccccctatcctccgtccaggagttcgctgtcaggaccgtcccctccgcctccaaggtcgacatccgccgctgcctcgagtccgtctacggcttcaacatcgccgaagtccgcaccctcaacatggagggcaagaagcaccgccgggggcccttcctcgccgccaagccagactacaagaaggcctacgtcactcttcaggccccgctctccgtttcccccgacatcttccccatcggcgcgatcctcggggagagggagcggaaggccagcgcagccgcggcgaggaggaaggttgtggaaggggcagaggtcgagggggagagggaggggaaggggaaacattggatggaggacgagagggagggcttctccagggccggatgcggcaagatcgtgtatgggaacccttggaggctggggaacangnnnnnnnnnncgtgcca

SEQ ID NO: 49 - DNA, 817 bp, Triticum aestivum
  Clone ID: PAT_TA_49
ttctgtgagggggggcgtgtgacactgtgccgcgtactatttgactacctacgcatctaaccacatctaacacggcagtgcagaggcaagtacaggctgggcagcttatattcatcactcggaccaggcctcttctgctcaccccccacaacaccttggcggactcagaggctcgttccctcgtctgtgaaggacagacagacagaacaaaatggtgcaacccaagaagaagttccgtggagtcaggcagcgccactggggctcctgggtctctgagatcagacaccccctccttaaaaggagggtgtggcttggtacctttgaaaccgctgaagaggctgcacgggcctacgacgaggccgccgttctgatgagcggccgcaatgccaagaccaacttccccgtgcagaggagcagcaccggcgatcctgccccagctgcaacccgggacgtccgtggcggcagctcctcctcctcgacgagcaacctgtcccaggttctcagtgccaagcttcgcaagtgctgcaaagcgccgtctccgtccctgacctgccttcgcctcgacaccgagaagtcccacattggcgtctgggcaaaaagcgcgcaggggcccgcgcccactccaactgggtcatgaccgtggagctcaacaaaggggccgggccatccggcgatgcggtggcagcgcagtccacaagtgtcagcaaccacgggcttcttcaccgggcgagtacaatggatgacgaggagaggctcacgctgcagatgattgaggagctgctgagcagtagcggtccagcttcgccatcgcatggag

SEQ ID NO: 50 - DNA, 1140 bp, Triticum aestivum
  Clone ID: PAT_TA_50
cgaccatgcgtccgggtgctgtagctgtgaaactgtggagccaagaatggagagagggaaattgatatgtattgcttgatgatggtgccaactctgcctggagtgccttgactctgcagtaatggatacaaatgagtgtcaccctctttatctcgaaatttatgaaggtctcaatatgaatcaatatgaacaggttcctctgcgttcctctgcttcttgtagaaagacaggctttaaatggggagagaaaactggacaccactgccttcctgaaacttcctgaatgtgcctatttgaagagcagactagaagcacgatattgagaagaccaagaatgactggaatcaaaagtatggaaatgataacagagctatataggttgacaacggcggtgcgaagtgactaagtgactgcaattctcattctatatggtctcccaagattgttgacaggttcaattttaggatgtgagatgatgcattgctggttaaagcttacaggataccgcaccctcactctagatatagaagagggcatatgccaagtcctcgcgtggatgtggatcgagtctgagatcatggtgggatcaggcagcaacgccgcttcgacatcctcgtcatcttcgtcgtccacatcgtcgaagaagggcgggaggtctcagttcgagcggaaggtcggtgacttcttcaagcaccagatcgagtcggacacctccgttgcctacggggacggtttcagagctgggaaccgggttgttcagcagtacggcctgaagcgcaccctcgagcacatccggctgacagggaccttgccgttctgagaatgccagagatccaccttttcaccggaagctatataccgatttgtcatcgagagtccatttacaggaagaaagaaaagaaaatgaattttgaaatgcacaaattgtacaaacgtctggttgatattttttcttggaagggctgagcacagtatattattagagatgcattgaggtggcttgccctgaccaatctgttgtattgagggagatcaaaaatggaaatggaaacagtggtatttcttatgcgaccataaagttaataaggaaaagtacactccgtatataaaaaaaaaaaaaaaaaaaaaaaaaaaaaactc

SEQ ID NO: 51 - DNA, 832 bp, Triticum aestivum
  unsure (1)..(832): unsure at all n locations
  Clone ID: PAT_TA_51
gagcaagcaccgccgccgacgcatctcagactctgagcatttcgagcaagcaccgccgccgacgcatctcgagtagtttccagctcgccggaggaggagaaagatggcaggaaggaagggcggcgacaggaagaaggcggttacccgctccgtgaaggccgggctccagttccccgtgggccgcatcgggcgctacctcaagaagggccgctacgcccagcgcgtcggctccggcgcccccgtctacctcgccgccgtcctcgagtacctcgccgccgaggtcctggagcttgcaggcaacgctgccaaagacaacaagaagacacgcatcatcccccgccacctgcttctcgccgtccgcaacgaccaggagctcggcaggctgctcgctggcgtgaccatcgcccacggcggcgtgatccccaacatcaactccgtgctgctccccaagaagtccgccgccgccgagaaggaggccaagtcgcccaagaagaaggccgccacaaagtcccccaagaagaaggccgtcgccaccaaggagtaggcgccccgtagcctagcctgctccttgattcagggagaagatgatgagacttttgattgattggatcatgtgtatctaattgcctatagtctagtggctcttccatcacttcgatgagcaagccagtaatggctctgttgtaccagattaatgtcgagaatggctgaagatgcaatccttcaccatcatgtgctctactgaatgtttgttgcgctgcttttgcttcagaaagtgtgcatctatccccttgtaccttnctgtcagtttataagacgnataacagaacta

SEQ ID NO: 52 - DNA, 701 bp, Triticum aestivum
  unsure (1)..(701): unsure at all n locations
  Clone ID: PAT_TA_52
gtgcggcgctcgaggcggccgggttccctcactcgcagctagctcacacgcctctcatctcatggtgctccagaccgctcagcaagaaccatccctcacgcgtccgcctcactgcagcgccgccagcgcgcgctcgcctgcggccatggacaccagccctgcaactcccctgctcctccagcctcccgctcccagcattgacccgttcgccgccaaggcggccgtcaacaagaacggcggcgcggccaccgcggtgtacgacctccggagggagccgaagatccccgccccgtttgtgtggccccacgccgaggtgcgccccaccacggccgaggagctggccgtgccggtggtggacgtgggcgtgctgcgcaatggcgacgccgcagggctccgccgcgctgtggcgcaggtggccgcggcgtgcgccacgcacgggttcttccaggtgtccgggcacggcgtggacgacgccctggcgcgcgcggcgctggacggcgcgagcggcttcttcgggctgccgctggccgagaagcagcgcgcgcggcgcgtcccggngaccgtgtccgggtacacgagcgcgcacgcggaccggttcgcctccaagctcccctggaaggagaacctctccttcggtttccacgaccgcgcccgggccgcgcccgtcgtggtggactacttccccaccaacctccgacccg

SEQ ID NO: 53 - DNA, 531 bp, Triticum aestivum
  Clone ID: PAT_TA_53
ggtcgacccacgcgtccaagaagctgtccctttcgctctcctctcttcttccgttaccactcaccctcccgctcctcgccctttaaggcatcctcccctccaatcctccttgaaccttagagagagagagaccaagaatggctcgtgagatgaatggctacttcagccaccctccgcctccgcctccggttccggcgccgtaccaggaggaggcggccgcggacgtggacgacgcggaggacggcagcggcgggcaggggaagctctgctccaggggccactggaggcccgccgaggacgccaggctcaaggaactcgtcggccagtacggcccccagaactggaacctcatcgccgagaagctcgacggcagatcagggaaaagctgccgtctgcggtggttcaaccagctggacccgcggatcaaccgccgggcgttcacggaggaggaggaggaccggctgatggcggcgcaccgcgcctacggcaacaagtgggccctcatcggccgcctcttccccggccgcaccg

SEQ ID NO: 54 - DNA, 782 bp, Triticum aestivum
  unsure (1)..(782): unsure at all n locations
  Clone ID: PAT_TA_54
gtgcggcgctcaggcggcgggctcggaaattcatgggattagacaacgtgcttcggcaaaagaaaatcaaacgataagcttatcccctcccgcgtcgctcccgcgggcgacggggaggacgaccgcaccatcgccgccagcacacccctcctcccgcttcctcctcgccgccgccggtggcgggcccctctggtttcagtcgggggctgcaggcaggctggggctggtcgtgatggatgtgtgccggatggatctggcgcttttttcgggcgggcaacgcaggttggggcagcggcccggtgtgcggctgctccggctgtgggcggcggcggcgaggtggctcgtctctcttggtgtggcggcttcctttcgctgtgtccgcatcacggcagtttggcaggtcggctgcggcgccggcttgtttttcggcggcccgtttcgaccttcagtccctctcctcgtcgtcgggtcgctaccctcgtcgaaggttcggccctcccccggctacgatctatcgctcgtctcacgctcggctgcaggaccgagctcgtctcgcgcccggcagcaggacgagtcgatggaggcattgggggcagcccgggggtgcgaaaggcgggtcctttctgcccacatctttggtgggggtagcggtgggtctcaagtgaggtgnggtccgggtcttggatgtcgcggcggcggcccctggtggttggtttcgcggtgctcatgggcagagcctgtggctaggtgctgcccggtggccatggtcggtggagcggcgc

SEQ ID NO: 55 - DNA, 733 bp, Triticum aestivum
  unsure (1)..(733): unsure at all n locations
  Clone ID: PAT_TA_55
ctccaactgcccagacatggccagtcacggcgcttgccctcgcctcccacaatggcgtccctctcgctccactccgggaggatctcggcggtggctatcggcggcggtctccgcccccacaaggcgggccccatgggggcctccgcctccccgtttctccggagctcattcatctcctcttcctccacctcctccgcccccacctcctcgctctcggctgcggtctcggcgtcgctcgccttcacgtccgcctcctcgttcggcggttcatctttgggaattgagttcagctacaacagattaacaacacgcagacctcgcggtctacagattagggccggaaaggctgccctctgcctgaccaagaggtcaagatccaggaagtcacttgcccgtgtgcatggtttccgaaggcggatgcggactactgctggaagaaaggttctgaagcgtaggcgtgacagaggaaggaagattctgtgcacaaagtcgaactcacccactgggacaaagtactgattacagcgcaatgtgaggcgttatgtattccagctgtaagttttactctttttgcaccccatgttctcagccatgttcatctgtaacaattgctgcacatcttttccctgttactctggttgataaacttgatatctgaactaaattccaaaaccggtacaatttatcccaaaagagggggcgccttaccnccccaaagggcgtcntttaaact

SEQ ID NO: 56 - DNA, 762 bp, Triticum aestivum
  Clone ID: PAT_TA_56
gccggccgggctgggacacctccttcctccttcctcccaaccaaccgagcaacaaggagggagctagacggacaccaaccgagcctggaaatggaggacttctactacttccccagctccctggagacctctgaaattgtccacagagggttcctccccgtcgtgcactcctccccccgcaaccggagctcgccgtcgccgaggccccggcgcgggtcccgtgacgacgccggcgagctcgggcaccactacctcgacgcctgcttccggtgcgggcggacaatcgctggaaacaaggacatcttcatgtacagaggcgacaccccgttctgcagcgaggagtgccggcagcagcagatcgacaccgacgaggcggcggagaagagatccaagaagtccgcggccgcgacgacgacggagcagcagtcgcagcggcagagcccgcacagagtgcccgtctgggctcggtagaagcgtccatggatcaaatggcctactgtgctcgacactcctccgtccatataggcttcaggattgtggatgtatgcggaccgacgtgatatgagcagcttgagggagctggttatattccatattggaatacagttcttggaggcaaaagaagatcgtctcgtctggaaacgctcattatatgtgtgattaacatgctttcttccttgtgtgcgatccccatgtagtccaaaattttggcatggaagaaataagatcaccgaggctcccatccatggcgattgtgtcaaa

SEQ ID NO: 57 - DNA, 1036 bp, Triticum aestivum
  unsure (1)..(1036): unsure at all n locations
  Clone ID: PAT_TA_57
gcctggttgggctagcaccaggcccgcttgaccagtccaccgagaaatcaacaagaacagcctcttcttcttcttcttcttcttcttcttcttcttcttcttcttcttcttcttagcaggattttgctatttgtttctggctttggtccagaagaatggagcgcggcgagtgaagcgggcatcgattgagtctactgaattagaaatcagctggatcgagggagggaatcaattgtcaccgatggaggtcatgactggaaaaggcggcgccaagcccgtccccaactatcttcggccatcgaccgggtcgtgccacgatgcgtgcaagcacggcggccatcacgcgttcgtggagaaacaggaagctccaaggacccaacccaaaccccggaagaagcagcagccatcagcttcggatgaccagaaccaaaagagaaggctggtcaaggtacggtcggtgtcacgtaggcgtgtcgtagatttcagcaaacccgacaaggccgatacgccggccggtgggagcgagattgttgttgagtggaaggacatcgtggcctatgacgcagtgccagctcctgctcctgccgatggaccatctcatcaacaacctgatgggaggaagaagaagagtgatgtgatgaaggggaaaacaccatttgccaagaccacccatccggagactccttcaagaacccaaccgaatcactgaacaagaggctggctaagaccgtcaggtcgacgctcaccgggaaggcctccatcaagaagcctcaagccgccgctaacattcaccttctgacaagaagggggctgggcaagcctccgaaagccaagaaatccgcgacattgcccgtccaaaaacaaggaattgtccagggtggcgcaactaatgatgttttaacangggaagtactcctacctccccgaccaagaagacatgtgtccaatgctgatcaagcangccatcccngacatcggagggccaagacatgatntcacagcgttngtgcgctttcgttnanccganaacgaacaa

SEQ ID NO: 58 - DNA, 488 bp, Triticum aestivum
  Clone ID: PAT_TA_58
cactcacacgcaacaaaacacgagtcccccggtgtatatgggttccgtctcctacgtcctggcggcggccgtcctggcggcgctggtctccggcggcgcgtgcatccccagggtgccgccgggccccaacatcaccaccaactacaacaaccagtggctctccgccaaggccacctggtacggcaggcccaccggctccggccccaaagacaacggcggcgcgtgcgggatcaaggacgtgaacctggctccctacaacggcatgatcgcctgcggcaacgtccccatcttcaaggacggcaagggatgcggctcctgctacgagatcaagtgccagaagccgtcgccgtgctccgacaagcccatcaccatcttcatcaccgacaagaactacgagcccatcgcgccgtaccacatctacctctccggcacggtcttcggcgccatggccacgcccgggaaggagcagacgcttcggtcgttcgggg

SEQ ID NO: 59 - DNA, 2371 bp, Triticum aestivum
  Clone ID: PAT_TA_59
gttcggccccagttcccgctccctacccggagcactcccaagtcagaacaaacacgatcgacacggtcgatatgggttccgtctcctacgtccttgcggctgccgtcctggcggcgcttggctccggcggcgcatgcggcggagaaaatccaacaaaaacgattaacaaaatgttatggattacaaaacaccaccaggacaaagggaaaaaagaatgggcagaccaggaatggcattgcccaaacatccatctcgatttgttgctgacgctgtagattctatgtcattagataaacatgaaagctttctggaactatgctagctacaacgcgctgcagacgcaccgaccagcctccgaagagtagcaaaagaaggcagaacacgaacgccattgtccaaacctctcatctccatatggagatgcaacacaagcttttatggacattacataaccctcgctacctctttgcccgcggtgccatctcccagcccgctgaggagcgcaccggagagtgtccgcgcgaataggcggagggaaggtaaaattccccccagccctcatcggccaggtaggcaaccaacgggaaaagaggactagtccccgaggagatatgaaagagtcccctctcagcaggttctgatcttattgtaatgttcatagagcccaccgtccaaggcaaccacggcttccttggcatcgggctgccgccccgtggcaccctgccatgcccgagctgcctcaggatgccatatatgccagcagcggccaagcgtgcgcccccgctgagcaacgaaggaacatatttgacgaggctgctgtccttcttcgtagtgcgcatagagaccaccgtccatagcctctaccgtacttcccagcgggctagccgcctgtgatccatttggccccgtggcagacatatctggtgccctttatgccagcagcggccaagcgtgcgccgcgctctgcaacgatgtcacatatgtgacgagtaatgtatcttacttccagggaagtatccgcaaccccaacgatatcctttagcttacttcccagaattttaaggtcatgtgatgcatcttggtgcatggcagacatatctggggtcctaagtacgaatggcagttccagcttagctggaacaacatcccctaaataatgcagcatcatgagccagtttcagtaagattcttcgcacaatctctccaagatacatgccggaaatcaacttttcatatatctgttctccagggttcaaactttcgaagtccaatgctttgtcgtattctgaaagtggaagcttgtccgatttaaagcttccccattccgtgttgattaccatatttccggattttggcagtagtccagtccacttaggaattgcattagcatgctcaacatatgctgcgtttgtaccagtgcccaatattacagcagcaaccacatcattatccatatatctcccaccagccaatgtgccgactgtgtcattaaccagtgctgaaactttcatatccagcccctgcctctccatggccttgctcaactcagccacaacatcctcaccaaccgcgccgttgattgaaaagccctttgtccacttgatgagtgttcctgatgatatcgataattggtttaccggaaaggaaaaggtgaaacccagctctctctgcctccccattgggaggtggaactcgtcaccttcagtttcaacaaatttggccaatacagcagcaatgaaatcaaatagttccaaggaagttccaaccatcaggtgtggtggaatagagacttcctgatactgttgcttggcaacacgtttctcccttcctccaagctggactcgcagaacacggaagttggtacctccaagatccaatgcataaaacaagccatgttcgtccccggtggggaggttgtcgacgtagctgatgagcatcttgagctgggagtgcatgtccccgcgcagtccgcgctccatctcgaggacgagcgcgtcggagatgccccgcagcagggccgtgggcgtggcgagcgtgcgctcgacgtcctcgatgacggccgccaccttcttcttgcgctcggcctcggcggcgccgagcagctccgcgtccctgcggcgccggcgccggccgagcacgaccgccgtgcccaccgccgcgcacaccaccaccgccgtccccaccgccgccgccttccccatcctcgcgcctggactactggatcggtcggctccgctctggatccgggggctggcttgtgaagggggcggaggggtggctgcgcccccgggcgcgccccgggcgcgggcggaggggggggggggggggggggggccccgcccctggccggccgttttaaccgctatacgac

SEQ ID NO: 60 - DNA, 768 bp, Triticum aestivum
  Clone ID: PAT_TA_60
ggcttgatttcaaaaactcggtgaatggcgattccttgcttgcgacgcgctccgtacggcgtttcgtcctttggggggttgctttgaagaccggtgatcctttcccgtgcttcctttgggctggccgtgcacggtgtctcgattggcaggtgcccaaccggtgattcgagtggttggcgttgcgactcgtgtggcgacaacgatggtgaagtgtggagctgggtcgcggcttgtccttttgatgtcggcggttcagttcgcctttgggtgtgtctatgcttgtttctcactgtgacagagaagtcgaagctgcgtgcggcagggcccatgcggcaacgatgactccatgagggtggtttcggcggacggtgctctccgcaggtcgcgttggataggtcgatgcgaggcttgcaactttcttctgtgaagctcatcaacaaaatcggagctgccggtcctcgacgtctgcggccgattgtttggcttcggctgacgaggtcctcgagtgccgttcgttcggaggggtcttgatggtcgtcagcgaggaaatcggagtcgcctgctcgcggagaggcgatgacgatgacattgttggtagggtgacggtgtcctctcctcggcgttgtgtggggtcttgtaagtgccaggtcggtcggattgccctgttcgatgggcgagttgtaacggttttcgcccggttttccgttaattaaccggacaactctcttcttcttaatcaatgaaaatagcaaatcttttgcctcgttt

SEQ ID NO: 61 - DNA, 521 bp, Triticum aestivum
  unsure (1)..(521): unsure at all n locations
  Clone ID: PAT_TA_61
gccggccggtttccggaaaaaaaaaaaaaaaaaaaaaaaaatccacggcttccatcccatccccgaatctcactccgcacttcgaaaacaaaacgcccccatctcccccttctcctccaggccaggtgctccgcgccggccgccgccgcgcgtaggtcagcccgtcgcccgatccgcggattccattccggctacggcgctgctgcaaggtcgcggtcgcaggatggtggtcggtttccgccgcacgatctcgttccccgcgcccaagtccgcgccggcggcggggtcgaacgggaagtccgcggccggctaccgcgtccgctcggccagcctgccctgccggttccacccgctggtgctccagctcgacgaagacgtcgcggccctgcgcgatctggcggggggcctggcgtcggccgcgactggggcgctcgatcacggaaggccgnggttgaaattggggcnggtcctnggggccccnctccngaagttgnccaacnacccgnaaggcccaagaaccc

SEQ ID NO: 62 - DNA, 816 bp, Triticum aestivum
  Clone ID: PAT_TA_62
gccggccgggtcggggtgaagcggcggcggaagggaggggatcgaccaagaaccctaacccgattacaacaagatctaatataaaataccggtaataattcaccgttcggcgagcgaggatccgaagaaatcaagcgaaccaatccatggccacggcgattcgacacgcggcgaggattctccagcgatcgcaggcggccgagcgccggctgttccagacaaagttgccgaggcgcctaacgggcgatgagaaaaaggttgctgccgctcagttggctgagattcaagtcaagaaagaggagctctacgataagattgctgggtgggaggcaaggtacactctccatggcagctcaggcctgaaaaatgtccagctgctcaggcatctttctgtacaagttgaacctagacacagcgacccccgctggcgctcgtatcggcgatgggcgtacattcatgactgcttgaaagttgcggggtgcctttttattggcaaaacggctggagattccttgatttctttgtaccaagagaagcatcaaggaaaataagatggccgtggagggatcaaccagcttgctttgctgtcaacaagtgaatcaatctctgcctcttaccaagaaccaaactagctagcttctaatcatactactgtatatcataagaagaatgtttaaatgtgaggaatctattttctatgtactgttcaagaagtttaaatgtgcgactattatctattgttgatcagtctgtctttactttgttcagaaaaaaaaaaaaaaaaactcgagactagacctcggccgcgaccacgct

SEQ ID NO: 63 - DNA, 1486 bp, Triticum aestivum
  Clone ID: PAT_TA_63
ccacgcgtccgatgcgcatggtgcttcgagacctgcagaaggtactgttgatgatgaatcagatatgctgggtctctctcgtcacacaggtcaaaaatactatggaaaatctgcatctgctgaaccgaaacaagttccaagcaagaagcagagagctgatcccatcttaccagcttctaaatggaatcgagaggatgatggcagcggcgatgaagatagaaaagatggtcaaggattgggattgagctattcatctggaagtgatattgctggtgatcccgggaaagctgatgcaacagaaattagtactgatcacgcaattcatcatccagatacaattgttgatgaagagcataggcagaagctgaggcagattgagatcggtgtcatgcagtatcgtgaatctcttgaggagaagggtttgtggaacatggaggagcttgagaggaaggttgccagccaccgtaggcgtcttcagtctgaatatgggttgtcttcttctgtagatggggcaaacaacaggcgctcttccgagagaataccatcggaccggaaaggaaggtatgatgatgcacgcgattcttccaagaagcggcctcacagcccaagtaggagccatagtccttcaaggaaatcatcactggatagagaccgagagcacaatcgcagcagccacagattgcattccttagcggcgaggccacacagggcacgcgaaaaaagttcaggccgagagaaggatgatcaccatgatagaagcagagaaagagaaaaggacaggagaaaggggaggtgactgagggtatgtttggttccagccctaccaaatttggttgaccttttggttgcccatgagttggccaacatcggcaaggaaaacgagctagagtaaccaaaaaggcattggcatgccaaatactcctagttggcaaccatgcaaacaaaggccagtgttttggacatgaccaaaatattggtagggtaagtttagctgccataacatacatacataccctgatacttgaagatctccctgttgtgcacttggttcttcggctgaataagtgcatcttgagaaaggaaatatttgagctgggctgcatccgccaatacccgccgcatgtaaatgggtgcgcatggcctgctcaaggaccagtctgtagcggatttgaggatttaggctgtgctcctaatggcggacctgtttttgtagtatcaaggaacagtagtttgtgaaacataagtactttgatcaagcaacactgaatgaaatgctgtcagttcgtggcatgggctgccactaataaactttgacaagttgctatggatttgctctggcaatcttgttgtttaacccctgtaggattcagcttagaattagcatggtgctactgctgcctcaactcctccatttgacatttcggttaatctggatgaagggcccggcatggcaggttgtttaacttgctggtgcattcttctgcgc

SEQ ID NO: 64 - DNA, 868 bp, Triticum aestivum
  Clone ID: PAT_TA_64
gccggccgggcttacggagcaaggagacagtggcgccacccgccgctttcccagccctctcctcctcccctccgccccgctccaaaaaccaccgcgccgcgccgcgcttcgccgtcgtcagcggccatggacgtcgcccccggcgaggagcccccagcggcgccctctggcatatattaccacagaaaaaggaagccttctgaccccatcagtggcatttcacttcctagtgcaaagatggttggcaattggggatttggcagtgttaccaaggactgggaaagtatgcatgctcgaaagctcgaatttatgaatttcctttctactctgcgtaagcccactcagagttatgtggcgagtgctgaagctaatatgattaatagctctgtcgagcacacagaagagaagaacagtgaagtgctaataattcttgattcggataatgaagatgaaagcatggcagcatacaaacaactgacacctgcgaagaacaaacagctcccatctgagaaaaacaagcagctgataccatcagaacaggctggtactctcccagcatgtgtggcaacccaaggaattgccgacgtaaatgaccaaaacagtcatattgttccatatggtcaaagtgcaactttaatgaatcagtatcatttaccccactatcaaccatcagttcagtttgagagagttgtattgcagaaaagacctgaggaggaacgtatgcatgatctggctgttgcaagctatgcggagaaatggcagaaacacttgttttccctgctcctaaggagagaaaacacggaatatgaccaagttccagacagacgagatgctgagctgggccaaaaaaaaaaaaaaaggcccctag

SEQ ID NO: 65 - DNA, 792 bp, Triticum aestivum
  Clone ID: PAT_TA_65
gccggccgggttggggagggggagcgagccagcagcggcctgattgttcctcggcccttcatcaactggggttgttgaattctttaggcaggggcctgcccatggccgaggatcaatctggcccgccggcagcggacggggtggtggtggcgatgaagggccatccggggtcaggcaagtctacggtggctcgtgccatcgcctccgcgctccgatgcccgctccttgacaaggacgacgtgcgggactgcaccctgcacctcgagcacgctgccgccggcagcggcatcctcaacgacctctcctacgccgtgctctggaggttggccgagaggcagctccggcttggcctgtccatcgtcgtcgactccccactgtcgcgtcgagcccatctcgatgctctggcccgcttgcctgctgcacttgctatcgttgtggaatgccggccaggcaaccaagatgaatggcgccgcaggctggaggagcgtggaggtgtcttggccgatgatggatggcataagcccaagacgtgggccgacctagaaaggcttgtggaagggtaccaaggttgcacaaactatgacattggggatgtgccgaggatcgttgtggatacaacggacccaacggtcagcacagaggcaatcgctgtcaggggttgtggattttattaggcctcttctagcccgtgcgcattagatatgttataatagctgtccaccaacgttttggtggagacagggtcaaatgttttctgtcacagcaaaataagggataagttagtttcagatt

SEQ ID NO: 66 - DNA, 891 bp, Triticum aestivum
  Clone ID: PAT_TA_66
agcatctttactgaatattaccaatcaagcttgtcaacttttcaatgaagatgaggttcatttgctagagtggacagatgatttggagggttttgtgcttaaaggttatggtgagtcaataaactataaaatgggactgccattgctcaaggatgttgtccagtcaatggaagaagcaatcatagctaaagaagaggacttccctgatggtacgtatgagaaggcaaggctccgatttgcacatgcagaaactcttgttcctttcacatgtctactcggcctttttcttgaaggatcagattttgagaagatacagcgggaggaaccattggatctacctccgatgccaccacagagaagaaattggaagggggctcttgtagcaccttttgctagcaacaatatgttggctttataccaatgccctggcaaaactgatggcaaaaaaacatctcaggaccaaaaaagctcatattttgtgcaagttctacacaatgaagccccagtttcgatgccgggctgcggcaacaaggatttatgcccattcgaggagttcaaggaaaagatagtgaagccgcacctgaagcacgactacaatatgctgtgcaagaagccggtggcggcagcagaggaggagccatcctctttcagctccaagctcaacttcttcctggatctgctctcgcggaaaggttaccgtatcaagggacaagacgtgaagacggagctgtaagtagagcgccttgtgccgcgacgaccttgaacgggactgacatgtggacactaaccttgggtgtttttgtacctaggcttggtgactggtggtttttacgagagactttcttcagtgaaacttccgtgttcccgtgtatcgtctttgaactgttagtt

SEQ ID NO: 67 - DNA, 1910 bp, Triticum aestivum
  unsure (1)..(1910): unsure at all n locations
  Clone ID: PAT_TA_67
accaatccgcgccccgccatggctcctccggccacgcctctccccgtcctcgtcctccgccccccgcgcctcgctctcgcacgcctccagcttccgacggtccagggggagcaacagctcgttcgccccccccgccacctcccgagagtaacctggaagggcgctcttgtagcgcccaatactagggactctatgtcggctttataccaatgccctagcgtaactgatggcaaaaaagtagctcgggaccagaaaagctcatatattgtgaaagttctacacaatgtagctccagtttcgatgccggggggcggcaacgtggatgtagccccacacggggaggtcaaggataagataatgaagccgcatctgtagctcgactgcgatgtgccatgcaggaagccggcggcggcagcggaggaggagccatcctctttcagctccaagctcaacttcttcctggatctgctctcgcggaaaggttaccgtatcaaggggcaagacgttcagacggacctgtactcaataagagcaacccaggttcctcgagcatcagctagtgcagtagcatttggtttggggctactttctgggaaaggaaagcttggagcaggaaataaccgtgccttctctgttctgagtgagagtcgtgcaagtgatatttgtctgcgattctttgatagctgtaaaacatacaaggactacaggaaaagaaaggaacctgatgttgacaagcaaaaggaaccaattctagaacatgtcacatctgctttagtcagccgttatcacctcaagtttacaacacaggatgtttcttccctctggttcctctgcaaacaggaagcatctttactgaatattaccaatcaagcttgtcaacttttcaatgaagatgaggttcatttgctagagtggacagatgatttggagggtttggcgcttaaaggttatggtgagtcaataaactacaaaatgggactgccattgctcaaggatgttgtccaatcaatggaagaagcaatcatagctaaagaagagaacttccctgatggtacgtatgagaaggcaaggctccgatttgcacacgcagaaactcttgttctttttcttgaaggatcagattttgagaagattcaacgggattttgagaagatacagcgggaggagccattggatctacctccattggaaccacagacttgtagtaccttttgctagcaacaatatgttggctttataccaattctctggcaaaaatgatggcaaaaaaacatctctggcacaaaaaagctcatattttttgcaagttctacacaatgacaaccccttttcgatgccgggccgcatccacaggggtttttggccattcggggagttcaacggaaaaggatagtgaagccgcacatagtaagcacgcatacaatatgctatgccagtagcctggggtaggcagcagtggaggagccatcctctttcagctccaagctcaacttcttccttgatctgctctcgcggtgctcttaccgttttaaggggcaagaaaggggcaagatgttaagacggaactgtagagtacaggcgccttgtgccgcgacgaccttggatcaggactgacatgtggacactaaccttgggtgtttttgtgcctaggcttggtgactggtgagcgaggtttgctggatgtttcttggttgccgccgggggcgtgcctggctgaatcgccccggttcccgtctctcttctttaagctgttcgtttttcggaaaaaaatcggtgtactgtctcccgagtacttatagagcggccgcgggcccatcgattttncacccgggtggggtaccaggtaagtgtacccaattcgccctatagtgagtcgnattacaattcactggcccgcgntttacaacgtn

SEQ ID NO: 68 - DNA, 637 bp, Triticum aestivum
  unsure (1)..(637): unsure at all n locations
  Clone ID: PAT_TA_68
gccggccgggttgcgtcttttctcttactgccgctgcttcggcgcgcaagtgcacaaacatcacagtcccagtgacaatcacctctgagaatgccatctttagcattgaggcgcctgtcactgagattgacgttacaaaccttgctatcaatcttgctcgacagggtggcaccccatatccccaaacgatccagatgggtaaagccaacatcaccggtacttatgacctcgcagctacatactgcgaaccggatgctggtcctggagagcaactccagatcatgacgcatggcattggcttcgacaggagctactgggactttcccttcaacaactacaactacagctacgtcgcccgcgcggtagacgagcacggctactcaaccctgacatgggaccgtctcggtatcggcgcttcatccaagggcgaccccgtcaacgagatccaagtcttccttgagatcgcagctctcaaagncctcaccacacacgcccgtcaaggatccctccccggcgtcggctgcggcggatactccaaggttgtgcatctaggtcactccttcggctctgttattacgtacgccctcgccaacgaaagccccgagctcagtgacgccattgtccttactggcttctc

SEQ ID NO: 69 - DNA, 568 bp, Triticum aestivum
  Clone ID: PAT_TA_69
gccggccgggcctgcgaagctcactccaacacagccatacaagactatctctcagaagtcaaaacctcccagttaattagcaatggcaaagagtctcgcagtggccctcctgctactggtggtgctcgcgcactgcgatgggagggagctgagcgccaacgaccgcgcacttgcaggttccggtgccggtggcgtccaagagtccaaggcgtcggggtcgccaggcttgccgattgtgggaacaacacctacgggcaccagtaccattaacggaccgctggtggtcattcctggggtcccagttcacccatgatcattccggcgctggctgacaagcaagctgaagctcggcctgtgcctttacttttctagcttacacctcacagaacaacggcgtttttctctcacctccatgcatatgttcgttataatgagcgtatgtatcaactatctcgtcgtgtgtatgtatttattttcagttcatgcgaaaaaaaaaaaaaaaaaaggcccctatacatgtaccattgcagatttcaatacttaccgtgcacgggatgttctacatgta

SEQ ID NO: 70 - DNA, 674 bp, Triticum aestivum
  Clone ID: PAT_TA_70
atctcccccctcctgctgctgctgtgttgcccgtgttgccgccccgaccgccgcctccaccacccacccacccacaccgcgccggcctcttccccctgtcccgtctcccccatggcctccgccgccgcatccgccgtctccttcgccaggcccgtcaaggcaatcaatgccaactcggtctccttctctgctccaaggaaaggcaatgtatccttccgtcttcagccagttccccagagatcttctgtttcctgtgctgccaaaaaggagacagtagaaaaggtttgtgatattgtgaagagccagcttgcgcttgctgacgacactgtagtttctggctcctctacgtttgctgatcttggtgccgattccttggacacggttgagattgtcatgggcctcgaggaggctttcgggatcagcgtggaggagtcgagtgcgcagaccatcgcaacggtggaagacgccgccaacctcatcgacagccttgttgcaaactaaacatatttctttgcaataatgggctacccactgcaatcgttgctgctggagatgatcccgtttgacgtgctagattttactgtggagagtcggtgacatctgtatcagtgtttttgcctgtcttgccatattaagacattatttattaagcgaatgttgaaggaattttttct

SEQ ID NO: 71 - DNA, 908 bp, Triticum aestivum
  unsure (1)..(908): unsure at all n locations
  Clone ID: PAT_TA_71
ccgctccagggcccgccgctgctgtgttgcccgtgttgccgccccgaccgccgcctcccccacccccccacccacaccgccccggcatcttcccccagtgcgccggcctctcccccctgtcccgtctccctcatggcctcctccgccgcgtccgccgtctccttcgccaggcccgtcaagccaatcaatgccaactcggtctcgttctctgctccaaggaaagacaatgtatccttccgtcttcagcctgtttcccagagattttctgttcgctgtgctgccaaaaaggagacagtagaaaaggtttgtgatattgtgaagagccagcttgcgcttgctgatgacactgtagtttctggctcctctacgtttgctgatcttggtgccgattccttggacacggttgagattgtcatgggcctcgaggaggctttcggaatcagcgtggaggagtcgagcgcgcagaccatcgcaacggtggaagacgccgccaacctcatcgacagccttgttgcaaactaaacatatttcctggcaataatgtgctacccactgcaatcgttgctgctggagatggatcccatttgacgtgctagattttactgtggagagtcggtgacatctgtatcagtgtttttgcctgtcttgcgatattacgacattatttattaagcggttgttgaaggaattttttcttgttgaagctgtgttggagactgatttcagagggtctgaacatgatgtgctggaagtaactactcccatcttttttggttcaaatctacaaattaaaattaagagcgagggggggcgcccgcgccgcattcgccctnaagtgatcctatatcgccncaangncgtccntttannctccttactgggaaacccggggtaccaattaacgcctt

SEQ ID NO: 72 - DNA, 722 bp, Triticum aestivum
  Clone ID: PAT_TA_72
cgcctccccacctccacagcgctgcgccgcccgccttccgacccgcacccttcaaccttgaaagcaccttacccaaaaaaatccatggctgccaagatcacctcatgctttactttcctaaaggaagcgctgatcctgcccacgctaaaccccaagctgttcgcacccgtgctcctcctctttgccgtcaccgccttccttgactccttggaagatgtcgtgttcgtccagcctctcgtcgacgacatgggcagccgtctcatcacggtcaacagcaccgaccccttgggcgccgagtacaccaagctcacggaggagacagagccaggcggtacagagctcctcctcatcgccgtctccgaggtgatcgtcgccctggcggtcggcttcgtcaagaagatcctcgccctcttcgcggcctccacgacctactccggtggccgctactcctagcagcgctcctgcgtgagctggtcaacgggaggataagcctgaagggtccttccatcaccatcgccgtcgtcgacgcgtttgacttcgcatcggcggtcctcgccgcgctgattcccactcccgccctgatgggcgggctctcgagggtgctctccgtccagggtctcgtctcccacctcgcgaacacgtctccctctgcttcaccgtcgtcgcgctggtgggcgtcgccgtgtcggcggccgaccggaggtgccggggcatgcgcgcgc

SEQ ID NO: 73 - DNA, 631 bp, Triticum aestivum
  Clone ID: PAT_TA_73
gggagcctcttcctggggcgtggctgctagcggtttgcctcggagggtctgcctctgcctgtgtcggccggcggccggcgccgaagctgtcctgccggtgtccgaggacgaaagcgactccagacgatgtcgacagagagaagcctgcccaagcggaagaagcggcacgagttcggcctccagagggggaagaaggccaaggaggagcaggccaagaagctgcaggccaagaagtcccaagatgaagattgatggaagcgataagaagaagaagggcagcagcttcaaggtcggcaagaagaaggtgaagacaaagctctcagcactgggaaaagccaaggccgcacaagccatggagctcgacaactgactgattcccatggcctaaaactgttgcaccaatgccggtcattttgttgtaatcgtcggagaaatgaagttcatttgctctgcccaggtccatgtagtcgagcggcgttagatagatatataagagttttggtacttctccagtcagatcttgcggttcctgatcgtgtatgttccaccccttgaaacattttatatgcttcagatgccaaaaaaaaaaaaaaacccgggcccgaccccacgattcactattgaattctcc

SEQ ID NO: 74 - DNA, 652 bp, Triticum aestivum
  Clone ID: PAT_TA_74
aatgatgggagctaaggttacatggactgacacctagtgtaactgttactggcccaccgcgttcagccctttggaaggaaacacttaaaaggctgtcgatgtcaacatgaacaaaatgccagatgtcgcgatgactctagccgttgttgccctgtttgccgatggtccaaccgctatcagagatgttgcctcctggagagtgaaggaaactgaaagaatggtcgcgatccggaccgagctgacgaagctgggagcaacggtggaggaaggcccggactactgcatcatcacgccgccggagaagctgaacatcacggcgatcgacacctacgatgaccaccggatggcgatggccttctccctggcggcctgtgctgaggtgccagtcaccatcagggaccctggatgcacccgaaagaccttccccaactacttcgacgtgctaagcaccttcgtcaagaactagattggagaatctatggcgaattgcgcttgtacttttgtagcctgtccatggtctggaatttttgtctttttcgtcttgtcgcgagatggtgtatgagtctgtaatattagttttgtagtgcgcgaggtaaaatgaaatgtattgcacactgtattcgttttttgaataagaaataaattatgatct

SEQ ID NO: 75 - DNA, 2495 bp, Triticum aestivum
  unsure (1)..(2495): unsure at all n locations
  Clone ID: PAT_TA_75
ctccccttctcccccccccctctccaaccggcccgctcgaggccggcccggcccgccgcgcggcggtgcggctgtgggggccccgcggcgccgcggcgcgcgcgacgtccgtggcggcgcccgcggccccctcgggcgccgaggaggtcgtgctgcagccgatccgcgagatctccggcgccgtgcagctgccagggtccaagtcgctctccaaccggatcctcctcctctccgccctctccgagggaacaacggtggtggataacctgttgaacagcgaggatgtccactacatgctcgaggccctggaagcccttggactctccgtggaagcagataaagttgcaaaaagagctgtggttgttggctgtggcggcaggttcccggtcgaaaaggacgccaaagaggaagtaaagctcttcttgggtaatgctggaactgcaatgcgtccattgacggcagctgtagtagctgctggtggaaatgcaacttatgtgcttgatggagtaccaagaatgagggagcgacctattggtgacttagttgtaggtttgcaacaactcggcgcagatgctgattgtttccttggcactaactgcccacctgttcgtatcaatggcaaaggagggctacctggtggcaaggttaagctctctggttccattagcagtcaatacctgagttccttgctgatggctgctcctttggctcttgaggatgtcgagattgaaccgcccgcgtcccccactgccgcctcctccccccgccccccaccccccccaccgcgccatcattgataaactgatctccgttccttatgttgaaatgacattgaaattgatggagcgttttggtgtgactgcggagcattctgatagttgggacaggattctacattaagggaggacaaaaatacaagtcccctggaaatgcctatgtcgaaggtgatgcctcaagtgcgagctatttcttggctggtgctgccatcaccggagggactgtgactgtcgaaggttgcggcaccactagtttgcagggtgatgtgaaatttgctgaggtacttgaaatgatgggagcaaaggtcacatggactgacactagtgtaactgttactggcccaccgcgtcagccatttggaaggaaacacctaaaagctgttgatgtcaacatgaacaaaatgccagatgtcgcgatgactctagccgttgttgccctgtttgccgatggtccaaccgctatcagagatgttgcctcctggagagtgaaggaaactgaaagaatggtcgcgatccggaccgagctgacgaagctgggagcaacggtggaggaaggcccggactactgcatcatcacgccgccggagaagctgaacatcacggcgatcgacacctacgatgaccaccggatggcgatggccttctccctggcggcctgtgctgaggtgccagtcaccatcagggaccctggatgcacccgaaagaccttccccaactacttcgacgtgctaagcaccttcgtcaagaactagattggagaatctatggcgaattgcgcttgtactttagtggcctgcccatggtctggtatttttgacattttcgtcttgtcgcgagttggtgtatgactctgtaatattaggtttgtagggcgcgatgtaaaatgaaatgttgtccgcagtaggttgcgtttttaccagtttgcagggtgatgtgaaatttgctgaggtacttgagatgatgggagcgaaggttacatggactgacactagtgtaactgttactggcccaccgcgtcagccctttggaaggaaacacctaaaagctgttgatgtcaacatgaacaaaatgcctgatgtcgcaatgactcttgccgttgttgccctctttgctgatggtccaactgctatcagagatgttgcctcctggagagtgaaggaaaccgaaagaatggtcgcgatccggaccgagctgacgaagctgggagcaacggtggaggaaggcccggactactgcatcatcacgccaccggagaagctgaacgtcacggcgatcgacacctacgacgaccaccggatggccatggccttctccctggcggcctgcgccgaggtgccagtcaccatcagggaccccgggtgcacccgcaagaccttccccaactacttcgatgtgctaagcacctttgtgaagaactaggctgggaaaatcaacaacgaattgcgcttatactctgtagcctgtccatggtttgaggaaattttgtcttctccgtctgctcgtgagatggtgtatgagtctgtaatattagttttgtagcgtgtgcgccttgaggtaaaatgaaatgtattgcacaccgtattcgttttctgaataagaaataaattactgttctgtgaaaaaaaaaaaaaaaaaaaacccatagcaaactagcggccgtttttgaataagaaataaattatgatctangaaaaaaaaaaaaaaaaaaaaaaaaaaaaa

SEQ ID NO: 76 - DNA, 504 bp, Triticum aestivum
  Clone ID: PAT_TA_76
cccgatcggcgcgttctttttctcggccctccttgccggttacgtctacgacaaggaggcggagaggcagaacccgggcgtgctggacccttcaaactgctttggacctgactgtttcaggctcacattctacgtctgtgccatggtgtgttgctgcggaaccctgatctgcctagttttcatcgcgaggatcaagccggtttatcagatgctctatgccagcgggtcgttcagacaccctcgacagcagcagctgtactgatggagtaagtggcatcaataggaaagcttgcaagtatgagaacagaaaagaacagaggaagttgtcagctggttgtctgtaattctgccttcttcttgcatcatattgcagcagcgtatattatcccacggttgtttgcttgattcatcccttgttggtattggagcatatgagagagttctcttgattccataatttgctcatgttgtgaaggtatatacagccgatcgtcgaccattaat

SEQ ID NO: 77 - DNA, 1454 bp, Triticum aestivum
  unsure (1)..(1454): unsure at all n locations
  Clone ID: PAT_TA_77
tttgccccatccaagcaaacaaaacgaatattttagtcgtgtttttcttttttggatctagagttctaaaatgacagaatagtggatttaatattacagaagttcataataaatagggacagcatacatcaccctacagataacttgacataacaatgtataactgaacaacctaagcaaagattcttgctacatccagaatgccacaggaacctgcagggcaggatcgagaatcgttgctgcgctaggaagcttgtagcatctgcgccggcgacgtgatttggtccaccttgcaccattcacgctagactctagaattcggcaggtccagatgtctccattcttatcatacttgacagagaaagtaagcaatcaaagcaaatgcggcatgcaatcatcatctttaacactgaaataatgcagaaggcagaaattggtttcgactcccaggtacaaaaggttggctcctacgtgttcctcgaatgatttcttgcagaacagtttctccttaccaagcttccatggtggtggggaatgcttgttgctggaatcaggatcagtggacacgacatcacaggagcaaaggtggccaagcgtgtcctgatcaccagaaagcccaacccaggcgttgagccctgggacaaagtgagcacgacctgtgaacggcagcccccacatgccatgaaacctccacctagcatgatccgacccagtatcaagggaaaatgtggcggtggatgagtaactcttgaagctgacaaagatggtccggccgtcagggtgcacagcgtgagagataatgtcttggaggttgaaggaaaggtttgggagcttacaccgcaaccatttcccttccagtggaggaagataaagaagctccgagtggttgccatccagagcaacaagcttgtcacaaaccggcagatatatgggttgagaaagacgtgacctggtccgaggaccctgacccatgttgtgagtgctaacatcaaagaaaggggggccgatcttgtccgattttgaatggaataccatgatcttggtgccgaaggccacaaagaatcccctcgagggagaatcgaaatggttgagagcgggcggtagaacctccacaactgggtggccatcgtccaacagattcgtagataaatcaaatttgtggataccgcatctaccgtcctcgtccttcatgacaacataaaggtgacgacggcgacgcttgaccttcttgccaacgcgcccttcgtagggtcgctttggcattctctctggactcttcattagattttaggtacctgaaattgggattaggcagttatgtggcgaggttgcttctgccccttgaaacctgcaactcgaatccgatgagcggtcgtcaaacccaaatcctcatctgaatcagggggcacgaaccctcgagtaaaataagggcgtaaagcgagcctcgnccgaat

SEQ ID NO: 78 - DNA, 959 bp, Triticum aestivum
  Clone ID: PAT_TA_78
tccacttctgccagtgaagaatgacagattttgatgttagcacacttgaactgcaatttgtgccatccccgccggttgaagaaccagatattacattgtttggaagagcaagatttggttctcaagcgattgacataatgaaagaagagttgtgccaccagtacattgctgcagctgaacaaaccagattctgtgcaccggaagatttgcttcatgatagcagcaaaaatgttgaaacatattctgctatggatttaatcacaaagcaagccccagcttcccaacaagattgtgtggaagctggagatgtggcgccctcctgtcagtgtgctgaagctggagatgtggctccctcctgtcagggtaaagcatccccaaccctaccagaagcatttgcagttcaacctttgcctactgttcaacacaatatatcagtagtgcctgatcaaccggaaaagtctgacattataatagaaccaatatctatcagcactacggaaagttcaagtcttcgcatggtcaaaaatgcagaagtaacagattgtcaaacggaccacctgtgtgtcattggatcatcgaaatctttgcatgcgagtctgaagaggctgtacagatcgaggaatgtccctgtcccgcatcctctcccgtctcttgttggacttttggaatcactaaacgggtcaaaaggcgacctggctctgattatagctcgttgaattcacggcacagcctaccttgaagataagattgagcttataccttgccttcaatatgagatatattttatagcacatacgacaaatatagacaaatatggtccgtgaagaatccagctgcgtgagatgttgctgctgtcacccacatttcttctgcgactttgtctggagtgctgatgtgggtgtggttgtgacacatgggttttgaaatgttatgttgtacctgcccgggcggccgctcga

SEQ ID NO: 79 - DNA, 761 bp, Triticum aestivum
  Clone ID: PAT_TA_79
ctccggccgagggcgcgtcgtcgccccgcgtgccgctcgtcgccccgcttgccgctggaattacccttgcagattcggatcacggcctcagcgccgcgacgccgagccaaagctcactgccgccttccgcaaccccagccatggacgacccaggcttcgagatcgagtgcgagatacccggcgtcgtgcgtgtgcacaagagcggccgcgtcgtgcgcttgaacggcaccgagaccgtgccgccctccccgtccggtgacccagccaacggcgtcgcctccaaggacgtcgtcctcgaccccgcggcaaacatctctgcccccctctagcggccgcccggcaagaagctccctgtggtcgtgttcttccacggcggcgcgttcatgatctacaccgctgcctccccgctctaccacaagtacgccgcctccctcgccgccgcggtccccgctatcgtcgtctccgtgcactaccgcctcgccccggcgaaccctgttccggccgcctacgaggacgccttcgcggccctcaaggccgtcgtctcctcctgccggccacgcggcgccgagccctggctcgcggcgcacggcgacgcgtcccgcgtcgtcctcgccggcgacagcgccggcgccaacatggcgcaccgcacggcggccaggctgcggaaggaacgcatcgaggggtacgacgacaaggtcagcggcatcgcgctcctgcactcgtacttgtggggaaaaagaccgggcggtggggaaacccac

SEQ ID NO: 80 - DNA, 266 bp, Triticum aestivum
  Clone ID: PAT_TA_80
cccacgcgtccgcccacgcgtccgcccacgcgtccgcccttccaaggccttccaagattgcatcaaccactacggaagcgacatcagcaagtgccagttctacctcgacatgctgaacgagtgccgccgtggaggagcaggagctggtgcaactctttaagctactatctttgcttgattgcggcttaattggtcggaacctgttttcagtcatgatgatgatgatatatatctcctaaataattcattggcaatattatgaacct

SEQ ID NO: 81 - DNA, 1246 bp, Triticum aestivum
  unsure (1)..(1246): unsure at all n locations
  Clone ID: PAT_TA_81
cgtccgtcgttggcctcctgttcatacactcccccctcccggcgccgcctccagcctagggtttcctcccgccgtccgccacacccgccggccatggctcgccgcagcggaggaggaaggtcttcccgccctgctccacgtgctgctccagtgagaaacccaccagcgccagcccgtcaagctcctccacctgctactacccagaatagcggtggtggtatcatgagcggaattgggtccactattgctcacggcatggcttttggtactggcagtgccatggcgcacanggggccggccaggctgtgtctcagcgcgtccccattccgatccgttggcttcctgttcatacattctcccctcccggcgccgcctccagcctagggtttcctcccgccgtccgccgccatggctcgccgcagcggaggaggaaggtcttcccgccctgctccacgtgctgctccagtgagaaacccaccagcgccagcccgtcaagctcctccacctgctactacccagaatagcggtggtggtatcatgagtggaattgggtccaccattgctcagggcatggctttcggtactggcagtgccatggcgcacagggctgttgatgctgtgatgggtccccgcaccattcatcatgagactgttgtcggtgaggctgctgcatctatgactccaatggacaatgctgctgatgacaagtgtggcaacccttccaaggccttccaagattgcatcaaccactacggaagcgacatcagcaagtgccagttctacctcgacatgctgaacgagtgccgccgtggaggagcaggagctggtgcaactctttaagctactatctttgcttgattgcggcttaattggtcggaacctgttttcagtcatgatgatgatgatatatatctcctaaataattcattggcaatattatgaacctatgccacagcttatgtctattacctaccctagtttgtggtctctgttgtcccgggagtatttccttgtattgatgttggaattaccttcatggcagtgggtttataaatatggagtttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaagtttacttcccggggctgggaaggtaaaagtttttttttgggggcccc

SEQ ID NO: 82 - DNA, 1180 bp, Triticum aestivum
  Clone ID: PAT_TA_82
ctccggtccgctccctctctgcattctgatccgttggcctcctgttcatccgctcccccctcccgcccgccgcctccagcctagggtttcctcccgccgtccgccacacccgccgccccccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaaggtgcctatggcgcacagggctgttgatgctgtgatgggttccccgtaccattcaggcatgagactgttgtcggtgaggctgctgcatctatgactccaaatggacaactgctgctgatgacaagtgtggcaacccttgccaaggcccttccaatgcattggcatcaaccacctatcgggaagcgatatcacacaagtgccaggttctaccttgacatgctgaacgagtgcctccgatggatggtagcaattttttaagctactatctttccttgattggggtgttaatttggggagaagcctcttttcttgcatgatgatggtgtgatatatttcctcaataaatcattgccaatattgtgaacctatgccacaactggtgtctgttacctacatatctctggatcgggaaccagtgccaccgccgtggagtagggagctgggtgcaactctttaagctactatctttgcttgattgcggcttaattggtcggaacctgttttcagtcatgatgatgatgatatatatctcctaaataattcattggcaatattatgaacctatgccacagcttatgtctattacctaccctagtttgtggtctctgttgtcctgggagtatttccttgtattgatgttggaattaccttcatggcagtgggtttataaatatggagtttaaatatggtgcgttgcaacttcattttttgagtacttttgagagcttgatgtccctgctgtaccctttaaatatgcttgccctaagtgcagcaccagttggagtgagacgaaaaaaaaaaaaaaaaaaggccccta

SEQ ID NO: 83 - DNA, 2283 bp, Triticum aestivum
  Clone ID: PAT_TA_83
gctccgcgcgctcctgcctgcctcatccagccagccgttaatgccacacctgcaacatccaccaccctccttccccacttttccttttactcccatctcctctctccctctctcggggtcccccgtcgccattgctgccacaggctggattcttctcaagctttgctacgcgcggtttctcgagctttgctacgcccggttctttgcttgacgaatgagtggatggaggttctgcggcacaaagagggagaagaattcgcctacagtcgctgatgcctagcagtgctctactctgatgcggcacagctccaaattttagcacactgccgccatggtttccactggtctgagtttagagatgacgaagaaggttcttggcctggcattgtgggtctggattgcaatcggtgtggtcgctctcctagtggccattctgctgatgatatgtatctgggcggcgtcccgtcgcaagacaaagagaaccatggagaacttgagccagacacagatccccatctactccaaggagatcccggtagacagggtgggcggtggccggagccttgcgcaaacgatgcatgaacgtgagcagcctagcttcccaacgcaggacaagcacgccgtgaatcgggagccggggaaaacggtggggcatatggcattgagcaagtcctcggatcatgataacgtgagccagggaagctcagtgtgcaatgtggaccgggttggcagtgtgcattctggtgaagatggcggctcggggcacggcaggaaaccgtattctcctgcggcatttgtgtccgcgtcgcccctcgttggccttcctgagttctctcatcttggttggggtcactggttcactctgcgcgaccttgaattcgccaccaatcgcttctcaaaggagaatgtgcttggagagggtggttacggagttgtgtatcgtggtcgtctggtgaatggaaccgaggttgccataaagaagatttttaacaacatggggcaggcggagaaggaattcagggtggaggttgaggctattggccatgtacgacataagaacctggtccgtctgctgggatactgtgttgagggagtgaataggatgttggtttatgagttcgtgaacaatggtaacttggagcagtggcttcatggagctatgcgccagcatggtgtttttacctgggataatcgcatgaaggttgttataggcactgcaaaagcacttgcgtaccttcatgaagctatagaaccaaaagttgtacaccgtgatataaagtcaagcaacatcttgattgatgatgaattcaacggcaaagtctctgactttggtttggccaagatgttagggtcagataaaagccacattaccaccagagtgatgggaacatttggatacgttgcacccgagtatgctaatactgggatgttgaatgaaaagagcgatgtttatagttttggcgttctcttgttggaaactgtgacaggaagagaccctgttgactatagccgctcttccaatgaggtcaatcttgttgagtggctcaaaatgatgatagccaaccggagagcagaagaagtggttgatccaatcctcgaggttaggccaacaattagggcacttaagcgagctctgttgatcgcactaaggtgtgttgatcctgactctgaaaagagacctaagatgggccaggttgctaggatgctggagtctgaagaagttccatttcgggaggaccggagaaaccggaggagtcgcacaggaagcatggacatcgaatctattacagagggatcaacttcggctgaatttgcaatcaaggtagaaaggactggcagctcaagatcagaccggtctcagacctgacgtatacgggtctgtcttgcatcatgagcactcacgctcgtttatcagtccgagaaacgatgttcatcaccaaggtgattactgccccgaatccgtgtaggaaatattagtgggttaatgaaggcacgcccagattttagtagctaaagtttaggccgagctgttagatcgagcagaagcattcttggaggaagaattccctggtattttgttcaattgttttgtgctgtatatgtgtgtgttggtgcctgggatgatgatgcttgtgaaccgggatgttccttcagtttgtgacagtggaccattctttattttcttttcaaaaaaaaaaaactcgcggggcggcccggtgcccttttcccccttctttggcgcgctcctgttgaaaaatgtcatcgtttgtgggcaaactacat

SEQ ID NO: 84 - DNA, 725 bp, Triticum aestivum
  unsure (1)..(725): unsure at all n locations
  Clone ID: PAT_TA_84
gccggccgggctgcaatttccctctcgaccgatcgtgcgcacgatcgactacaatcctcgtaggctcttctgagaaatcaagtacattgctcaacgtcgaggcgcacccatggcggcgaccgtgcgcacatggctggtggtggcggcgctggcgtgcgcgctgacgctggcgctgcgctcggcggacgcgcaggagagcgaggcgcagtcgcagccgacgtcgtcgtcgtcgccggcccagaagcccaactgcgctccgggcgccgccacgccgtgccgcgtgggcgcgctgcgcgacccggagaaccaggaggaggaggggctgttcaatgtgaaggtgagggcgccgaccgccgcgggtgactccggcgacagcgacgacgactacagcgaccccgacaggcccaaagaccccgaccagtccgacgacgacgagcttgtcgttctcggctactgatctgatcgcccggccggtccggcatgatcgatcacgtgcgcgtggcgccgcatggttttttggttttgtttgttggactggccggtggcgggtcgaccggtgctccttggacttgcattttgttgtttaattcttcagctaatttgttgttaagtaagtataagtaggtagtgagtggattggcaaatatgttctgtaatctaataacnntggattgataagtgtgatccaggaatttagtctattttgggcagtccaataactattt

SEQ ID NO: 85 - DNA, 737 bp, Triticum aestivum
  Clone ID: PAT_TA_85
aagtctgctcataatttagggatgcacacatggagcggttcacgtgtgtccctgcagtgttgcagctggggcgtcccaaggtccatagctaggcccaccaaaagaatggagcgtgtgcatagcaatgtccagcagcacaggatgaactgctatgcaacacaccactacacaaggaacggagggccggcgatgcatgacagctttctgcagcaatgcttcaaggagaattggcgtgtaaggcgagggatggttcataatctagcactcctgttgtcaggccaggttgagggaacaaggaagtatcatcatcatgagtgtgccatgagcagctactcaccagtgctccgattcttaggcccttgaccctaatcccaatgctggcgagctcattgcgtctgtctgaacctggcttcagatcaagactgtataggggatttttttcttttaaaatggtttttttttatgtttgtaaatcttgtaattttcattttattttttgcactctgtacttacgtatgctgatgcacgtgtgattccatctggggcatcggcacgggtaccctgcagacggggcaattggacttgaggtgttcccataaaaaaaaaaaaaaaaatctcttctacatgtatgcagcctctgccctgcagagagaatttgtacggttaccaagacgcactgcattcattcatcaggaaacttgaatccatatattaacgacaaaaaaaaaaaaaaaaaa

SEQ ID NO: 86 - DNA, 887 bp, Triticum aestivum
  Clone ID: PAT_TA_86
gccggccgggctgcgcttccagatccttcccgatcccgaccgcgcgtatctcccaccactctctgagccgctcgttcccagccaccagtttcttcccctaatctaggcttccacctctccatccggtggtgccgccctgagcggccctatagggtcgtgccgcggtggccaagggggctgcgccgagccggcgccagaccaatgccgccacggattgcgccgtggtgggacgccgccgcccttcgtcgccgaggttcccgagtccgtcgtgtacgccgtcctcatcgtcggcttctccatcaaccagcatgccctcaagctcttgtcgtgctcttcgccgtcgaccagctcgccttcaagtttgccgtcctaagagcccgccgaccaagtctcctggcctcgtgctgcgcccgcgcctgctcctacgggatccgcaaggccttcttcgttccctacatctcccgcgtggggaacatgcccgctccatcgcctcgcagatctatgccgacgctttgaccgtgatgtttgtcccgctacactaacctttctcttaacttatccattaccttgcatgtcttcctccagaaaggcaaaacagcacatggtgttctccggttccattcgtcgagcactaggcggcactgagcggaccggttgcgcttggaaagcagcacatggcgttctccgggacttcctatagattgaagttatgtgtgttttgctcctgtatttttttctagaaatgtctgtaatttcgagtttgtcgtggtgtttcttttcttttgtgtaaaatgttactatcaaaaaatgattgtaaaaaggatttagtagtaggtttgttgtaatattttgcagtgtgtatatgtaattttcttttctttaaggac

SEQ ID NO: 87 - DNA, 774 bp, Triticum aestivum
  unsure (1)..(774): unsure at all n locations
  Clone ID: PAT_TA_87
gccggccgtcacttcattgtcaatagctagcaagctcttcttcttcttcttcctcctcctccagcaggcctctgttgccgtgcgtgcatcacaaactgattagctatatacttagttggctcccatacagatccatccaccacagaaaagattaggaccagatagctaggatgcaacaggcaagggcagcggcaggggaggacagcagcagcagcagcagcgcgcacacggtgaacgcagccgccgtcgttctggccgccgccgcgcggagcagcgacggcctgcgcccccagctccaccaccaccatctccacggccacgaccacgacccctccgccgccgctacgaagaaacggtggtggtcgcggctgtcgtccacgctctgcttccgcccgcacttccacgcccacccgcgccgcgtcatcgccgatgcctacgcagacggagacacgccgccacgcccgctcgccgcagcatcccacacggcatcagcatcggcttacgtccaccaggccccgcctgcccacccggtcttcgccttcgccgcgccgccctcgtcgccggcctcctcgctcttccagtcggaggcgccatcaccggtcctcctcgacctccacggcaccgccggcagctcgcccggcatgttcgccgtggggccctacgcgcgcgggccgcagcagctggtgtcgccccccgtgctctactccggnntcaccaccgagccctcacgngggccgggaacgcccccgggcaccacgggcccctccctccccc

SEQ ID NO: 88 - DNA, 989 bp, Triticum aestivum
  Clone ID: PAT_TA_88
gccggccgggctgctattgccggtctcctcgcggttcgtccactggcgctggtcttggaaactcttttctgtcgcacattcgcgctgtcgatgccatcttccaggttgttcgttgcttcgatgacgccgagatcattcacattgagggtgacgtgaaccccacccgtgatcttgacatcatcagcgaggagctccgactcaaggatatcgagttcactgaaaaggctctcgagaaccagaagaagaaaacccgtatgggtggtcagagtctggagcagaagaaggccgtccaggatcaagctacgcttgagaaggttcttgcctggctcaacgatggcaaggatgtccgcaagggcaactggggccccaaggagattgaggtcatcaaccctcttttcctcctgactgccaagcccgttgtctacctcgtcaacttgtctgaaaaggactttatccgcaagaagaacaagcatcttcccaagattgtcgaatggatcaacgagaatgccaagggtgaccctctcattcctatctccgtctcttatgagtctcgtcttactctgtgcgagactgaggctgagtctaaggaggagcagaagactgctggtgctgactctgttctgcccaaggtcattcttcagatgcgaaagaccctgcagcttggcagcttcttcacagtcggacctgatgaagtccgccagtggaccattcgcaatggtaccaaggcgcctcaggccgccggtgtcattcacaacgatttcgagaagacctttatccaggctctcgtcttcaactacaacatccttaaggaacttggtgatgagtctgaggtcaaggccaagggcaagatcatgaccaagggtaaggaatacgtcatggaggacggcgatattgtccacttcaaggctggtgctgccaagggctaagcccacaatatcacctgcggtatttaattctatagaaaaaaagttaaatgcaacgatgtgatg

SEQ ID NO: 89 - DNA, 795 bp, Triticum aestivum
  unsure (1)..(795): unsure at all n locations
  Clone ID: PAT_TA_89
cggccgctcaaggcggccggccgggcaattcagagccgcttcatcatctctcgagaatgcgcggctcgcacctgctcctgctactggtggcgttctcttcattccacggtcacctcgccgcccgccatggccggaggcacgcgcctgcagccgtccccgtcgtaggctccgtccgccctggcgacgcggccatggatgctgcttcctcaggcggcgcgaccgccgtccggtgccacgacggggccgtctgcagcgagaagggtctgtttttcccgccgattccgctcgtgccggagccgccgaacattggaggcgtgcccatcccgccgaacccgatcatgccagcgccgccgtcgctcgtcccgccggtgttccccgccccgtctccaccgtccatcctgccgccgctcgtcccgcagccgccgcctgcttcgctcataccgccggtgctgccgttgccgttccttcacccaccgcctccgccgccgccgccgccgtccatcctaccgccgttgcccctcctcccgccgttgatccctggcgtgccgccagcttcctcctcgaagaacggccgaccggtgaaaccatgagaaagatgctggtcttcctgccctatgagttatctatatactgtgaaatcttgtactggaaatactctaattatggctgtgcactcaggggcatgaaaaacaagaggggaaaagttatacatgcctccgagaaatattatacgagctaatggcnagattatttaanaacaacacacaacatacatatagtattaaaaaaaaaaaa

SEQ ID NO: 90 - DNA, 545 bp, Triticum aestivum
  Clone ID: PAT_TA_90
gccggccggttccggatgatcaaggtttcacgagcaattgaaataccaaacgtgtatatatccgccatattatcatccctcgaaatggcacctgtcactgtcaattaccatgacctccagcttcctgcctatatcatgggcgcggtggtagcaggcggaggcatcatgggatacgctaagtcgggatctgttccttccatcgtggctggttgcactgttggactcctatatgctctgggcggttaccgtatccagaacgaagaatcttatggagttgagcttgccttgctcgcgtcagccgttcttggaggctcggctttccctagagctctccgcttgaggaagcctgttcccattcttctcagcgtcatttcggcattcggtctctttacctttggcactgctcttcgaagataagtttaagtgacgcagggagatatgacatctggatgaggtcgagacatggatagcatcacacctgtgactagtagggatgaataatatagttgtcagcctaagaaaaaaaaaaaaaaaaaaggccccta

SEQ ID NO: 91 - DNA, 829 bp, Triticum aestivum
  Clone ID: PAT_TA_91
attttcaacaaaggctctcctgtaaagggagcaccgcactccccaatctcccctcctcccaattgcacccggctgcaattgctctcctttcatctccaaaacctcccgtatacctctaatatgttccggaacgcccttcgacagtcgacgcgcgccgtcggcgctgtctctgctgctggcagggtcgccgcgctccgaaatgccgcacccgcctccatcaacgccgctcgattctacgcttccgacgccaaggctactcccaccgaggtctcttctatcctcgagcagcgaatccgtggtgtccaggaggagtccaacctcgctgagactggccgtgttctttccgtcggtgatggtatcgcccgtgttcacggtatggccaacgtccaggctgaggagcttgtcgagttcgcctccggtgtcaagggaatgtgcatgaacctcgaggccggccaggtcggtgttgtgttgttcggttccgatcgtctcgtcaaggagggtgagaccgtcaagcgtaccggtgagattgttgatatccctgtcggccctgagatgctcggccgtgtcgtcgacgctctcggtaaccccattgacggcaagggtcctatcaacaccaaggagcgacgccgtgctcagctcaaggctcccggtattctgccccgaaagtccgtcaacgagcctgtccagactggtctcaagtccatcgacgccatggttcccatcggccgtggacagcgtgagctgatcattggtgatcgtcagactggtaagactgccgttggtctcgacaccatcctcaaccagaagcgatggaacgatggcaacgacg

SEQ ID NO: 92 - DNA, 1077 bp, Triticum aestivum
  Clone ID: PAT_TA_92
aaatatccgatcccccataaataagcccaccaaggaaggaaatcaaagcgcatcgcatagtggtttccatccatccatccatccctttctctcgttgctaggcagctacatcttgatcttgttgttgcagggccggccatcgttggctggggaagaaaggcagcccgggctggaactcggtcgtagggagccagcgagagcacgatcgggatgatggagggccggcgccggaaggcgggaagaagggcggccggggccgcacggcggcgcagcagcgcagcaaccgcgagtcgggcaccgggaatgcgcgccgacgccggagaaggggcggccgcgggcggcaagtacacctgggccaagggcgacgtccagctacaccgacgacggacgtcgcgcctaccgtcgccagcacggcgggccgggagccaggcgccaacgcggccgcctcgcacgcaagatgtgcctgcccggatccctgccttgcgcttgactttgccatctctccgttgaatccttaactttatttatctcgaatcttggcgtgtttaattatgtacaaatggtggcgtttctagcgtgttcactttgctcttctagtatttccatcgtggaatcacaaataggtgtctggatctcgcatggttgttccttgtgcgttgatttctgcttaattcaccgatccatcatgttaacgcacgatgcgaatgctttcataaaaaaaacatcacatccggctttgcatttccggcaagaacaagtcctagggtgatgcctcgcccgcccgtcgccttcccgtccgatcgatcgatagatttctaaatcgtgtgagttgaataattaaatcgagtcgtggcgtgtttggcatgtacatatgatctatttccagtcgtggccttgctaattgggtgtctggatctcgcactaaacttgggttcagccttgtcttgtgttgcctcgagcgatcgacgacaaggcctgcctaagttgtgacctgaccgatttcgcgcttcacagcatggatttccacgggatctggatcctgatctacgtcatcgagacaccatatcgagagactct

SEQ ID NO: 93 - DNA, 462 bp, Triticum aestivum
  Clone ID: PAT_TA_93
gggggatgaagcgatgcatccttcccagcatcctgctgatgctttcactggaggcagccctcctcgtcgccggccgcccctctgtcgacggcgaggtgggtgccattctcctgccgagccaaggccaagaccagcaagcagccatggcggcgccgaagaggccgtggaagtgctgcgaccgcgcgcggtgcaccaggtccatcccgccgatctgcacctgcgtggacgaggcgttcgagtgcgcctccacctgcaaggcatgcgtgccgtcgacgcgtacaccggggccatcccgcccacatgcacgccagaggcggttgccgccggcggtaactagcacgcgcgtcgtctctactcctgccttgctgctgcagcagcctgcactttgtgactatataaaataaaatttggataagcaaccatgaatacgccagcaggtgttatttaatcttcttaataact

SEQ ID NO: 94 - DNA, 795 bp, Triticum aestivum
  Clone ID: PAT_TA_94
acgctctagcaagctcagtaagcaacgccatggggatgaagcgatgcatccttcccagcatcctgctgatgctttcactggaggcagccctcctcgtcgccggccgcccctctgtcgacggcgaggtgggtgccattctcctgccgagccaaggccaaggtacggttgcgcgcgcgtcaactcctttctctagttcgtggcttcatcgtgcatccatgatccatgaagaaactgatctcagcttcaccacgttaactgagggctcgcagttgcagaccagcaagcagccatggcggcgccgaagaggccgtggaagtgctgcgaccgcgcgcggtgcaccaggtccatcccgccgatctccacctgcgtggacgaggcgttcgagtgcgcctccacctgcaaggcatgcgtgccgtcgacgcggaacccgtccctccaggtctgcgaggatcagtacgtcggcgaccccgggcccatctgccggccgtgggagtgctgcgactcggccgcgtgcaccaagacagacccgccgacgtgccgctgcggggacgaggtcgagcggtgcgctccgacctgcaagacctgcgagccgtccacgtcggacccatccctcaacgtctgcagggacgcgtacaccggggccatcccgcccacatccacgccagaggcggttgccgccggcggtaactagcacgcgcgtcgtctctactcctgccttgctgctgcagcagcctgcactttgtgactatataaaataaaatttggatatagcaaaaaaaaaaaaaaaaaggcccc

SEQ ID NO: 95 - DNA, 1000 bp, Triticum aestivum
  Clone ID: PAT_TA_95
gcatgtacggttttagtcaacactttgtcatcaatctatagcccttatccacacacatgtgatagagagctgccatgtgtgcgtattcaaatctgctcgttgcattgctagcgatttccacgcgttaggtgatccatcggtgtcacgaggctacatacacggctggtcgctagctagccagcttcaaacacacaagcaagctcagtaagcacgccatgaagatgaagcgatgcatcgttcctagcatcctgctgatgctttcactggaggcggccctcctcgtcgccggccgcccctctgtcgacggcgaggtgggtgccattctcctgccgagccaaggccaagtcatggcggcgcccaagaggccgtggaagtgctgcgaccgggcgcggtgcaccaggtcgatcccgccgatctgcacctgcatggacgaggctttcgagtgcgcctccacctgcaaggcatgcgtgccgtcgacgcgcaacccgtccctccaggtctgccaggaccagttcgtcggcgacccggggcccatctgccggccgtgggagtgctgcgactcggccgcgtgcaccaagaccgacccgccgacgtgccgctgcggggacgaggtcgagcagtgcgctccgacctgcaagacgtgcgagccgtccacgtcggacccatccctcaacgtctgcaaggacgcgtacaccggggccatcccgcccacgtgcacgccgccagaggctcttgccgccggcggtaactagcacgcacgcgcacgcgttggtgtgcaccatgatcgagtcgctacgtccctactccttccatgctgctgcagcagcctgcagtttgtgattatacataaaataaaaaatggataagcaatcatgtagtatctttctccctcgatcccaaataagagcatctacagccggacttggcaaattcaggccctcaaacgcccgcggacacgtgacgtctcgacgtgtccgcggacaatgaccgggcacccctt

SEQ ID NO: 96 - DNA, 873 bp, Triticum aestivum
  Clone ID: PAT_TA_96
ggccgggccgggaaagcaaacgcacaagcaagctcagtaagcacgccatggggatgaagcgatgcatcgttcctagcatcctgctgatgcttgcactgcagtccaggcagccctcctcgtcgccggcgacgtgggcgccattctcctgccgagccaaggccaagttgcagacgaagcagccatggcggccaagaagaggccgtggaagtgctgcgaccaggcggtgtgcaccaggtccatcccgccgatctgccgctgcatggaccaggtcttcgagtgcccctccacctgcaaggcctgcgggccgtccgtgggcgacccgtcccgccgcgtctgccaagaccagtacgtcggcgaccccgggcccatctgcaggccctgggactgctgcgacctgcccctgtgcaccaggtccaacccgccgacgtgccaatgcatggacgaggtcgacaagtgtgctccgacctgcaagacctgcctgccgtccaggtcgcgcccttctctccgcgtctgcatcgaccgctactttggacccttcccgcccgcgtgcacgccgtcagaggctgttgccgccggcggtaactagcacgctcacgcgttgatcacccgatcaacgccgtcgagtgtcctctcccgccctgctgcagcagcagtgtctaagaataaaatagaaatggatggcctatatgtgtggtggacacacaattatgaataagacaacgtggcaatgttcaatctttatctttatataaacgaacggtgctgttttcttccgcttcacatagactcttttcctaagaggcaacgtgaacatatatttttgagttcttttatggcaaaaaaaaaaaaaaaaaggccctagggctcgagcgg

SEQ ID NO: 97 - DNA, 1077 bp, Triticum aestivum
  unsure (1)..(1077): unsure at all n locations
  Clone ID: PAT_TA_97
gcacgaggcagagatgcatcgttccgggtcagcaagcaacgccatcgggggatgaagcgatgcatccttcccagcatcctgctgatgctttcactggaggcagccctcctcgtcgccggccgcccctctgtcgacggcgaggtgggggccattctcctgccgagccaaggccaagtggcagaccacgcaagcagccatggcggcgccgaacgaggccgtggaagtgctgcgaccggcgcgcggtgcacccaggtccatcccgccgatctgcacctgcgtggacgaggcgttcgagcgcgcccccacctgcaaggcatgcgtgccgtcgagcggccggcaacccgtccctccaggtctgcggcggatcaggtacgtcggcgaccccgggcccatctgccggccgctggggagtgctgcgactcggccgctggtgcaccaagacagcacccgccggcccctgccgctgcggggaccgaggtggacgcggtgcgctccgacctgcaagacctgcgagccgtccacgtcggacccatccctcaaccgtctgcagggacgcgtacaccgggggccatcccgcccaccatgcacgccaagacggcggttgccgccgggcggtaactatcgacgcgcgtcgtctcctactccctgccttgctgctgcagcagcctgcactttgtgactatataaaataaaatttggatacacaaccatgaatacgccagcaggtgatatttaatcttcttaataactaaatggtgctcgtatcttacgtttcattatgaaaatatcatgcagtttctaaaaacaaggtcctgcaatcctcctcctcaaccggaacgggtcccatcttgacctataggggctccaatttcatatgaaggggccgtcgtctaacttgtctgaattgggaaaacccttggggttacccaacttaatngcnttgaanaaaatncccnttttnccaattggnntaataaccaaaaaggccccnanccgaangccntttccnaanaattggncaaccttnaaangcaaatgggnaaatttaagccttaananttggtnaaaaatnccggt

SEQ ID NO: 98 - DNA, 593 bp, Triticum aestivum
  Clone ID: PAT_TA_98
gcagactgcaaactttgaccagaagacggcgtgcagaacattcagaccgctttgaaggcaccagtgtacaccatcgcatgtaatgcaggcgtagaaggggcagttgttgttggcaagcttttggagcaagagaacactgatcttggatatgacgcagctaaaggtgaatatgtggacatggtgaaggttggtatcattgacccactgaaggtgatcagaactgccttggtggatgctgctagtgtgtcgtctctgatgaccacaacggaggccatcatcgtagaggttcctaaagaggagaaagaggcacctgcaatgggtggcatgggtggaatggactactaagccatgaatacgcacgctatgtgaagcaaactggaacatattggttaggggatttttttgggtgtagtcccatttttgatgtaattttattgtcgatgggttgacagttttgatcgtgcggacgatgttccgaacggaaccagcgttgggacgaataataaagagtagtcgcgagagctgaaacacttgatcggaaactgattaatgacgcctgctgaaggccaattgatgaagagttgcgcgttttg

SEQ ID NO: 99 - DNA, 2193 bp, Triticum aestivum
  unsure (1)..(2193): unsure at all n locations
  Clone ID: PAT_TA_99
ggctgcgctcaatgccaggaggtggtgttgcccttctccctccgtcaacccctcgggttcctcctccccatgaaacatccgaagctcgcacatcatctcacctcggcgcctcgcccccctagcctctacgcacctcgactcccgcgccatctcgctgcattcgccatgtaccgcgcggccgccagcctcgcctccaaggctcggcaagccgggagcagcgctcgccaggttggaagcaggcttgcctggagcaggaactatgccgccaaagacatcaggtttggtgtcgaggcccgtgcctccatgttgaggggtgtcgaggagttggcagatgcggtgaaagtgaccatgggtcctaaggggcgcactgtgatcattgggcagagctttggttgccccaaaggtcacaaagaatggtgtgactgttgcaaataggatggaatttaaagatagaggcaagaacgttggatgcaagcgttgtaaaacaggttgctaatgtaacaaatgattgtgctatgggatggtactatttgtgctgctgttttggtaaaagcggtatttactgaggggagcaatgctgtagcatctggaaggaacgcaatacttttatggcaaggaatctcggacgcgggtgaagatgcaatgactcacctaaagggcatcggtagggtgatcagcacttcagagggaaatagcacaggtgggtacaatatcagcaaatggcgaaagggaaatcggtgagctgattgctaaggctatggagaacggttgggaaagaagatgtaatcaccattgtggatggtaacaccctttataatgagcttgaagttgtggaaggcatgaagctcgacaggggttacatctctccctactttattaccaaccaaaagacccagaaatgtgaattggaagaccccttgatcttgatccatgacaagaaggtttcgaacatgcatgcagtagttaaagtgttagagatggctctgaagaagcaaaggcctctactgattgttgctgaagatctagaaagtgaggcattgggcactctgattatcaacaagctccgtgcaggcattaaggtctgtgctgttaaagctcctggttttggggagaacaggaaagcaaatttacaggaccttgctatccttactggcggagaagtcataactgaagagcttgggatgaaccttgagaactttgaccctgagatgttaggtacatgcaaaaaggtgactgtttctaaggatgacactgttattcttgatggagctggagacaagaagaacattgaggagagagcagatctgattagatctgcaattgagcaaagtacttctgattatgacaaggaaaagctgcaagagaggttggcgaagctttctggaggtaagttggttctaaagattggaggagcaagtgaagctgaagttagcgagaagaaggacagagttacagatgcacttaatgccactaaagctgctgtcgttatgcgtcaaaggacttggataaattgcctacagcaaactttgaccaaaagactggtgtccagatcattcaaaatgctttgaagaccccagtgacaaacaattgctaccaatgcgggtgtagaaggggcggtcattagttggtgaaactcattggtagaaggagaaagttgttgttggcaagcttttggcgaaaggggaaaatgtggatagggatgacgcagctaaaaggggaatatgtggacatggtgaaggtccggtatcgattgatccactgaagtctgatcagaagccgccttcgggaggatgcatgctagtggtgtcatcgtctgatgaaccacaacatgaaggccatcatcgtggaggggcctaatgaggagaaagaggctcctgccatgggcggcatgggtggaatggattactaagccatgaacacggacgatatatgaagcaaactggaacatattgattaggggattttttgggtgtagtcccatctttgatgtaattttattgtcgctgggttgacagttttgatcgtgcggacgatgttccaaacggagccagtgttggacgaataaagagtagtcgtcgagagctgaaacacttatcggaactgattagtgacacctgctaaaggccaattaatgaagagttgcgcgtttcacttgtttaaaaaaaaaaacaaanaaaaaactcgagggggggg

SEQ ID NO: 100 - DNA, 1162 bp, Triticum aestivum
  unsure (1)..(1162): unsure at all n locations
  Clone ID: PAT_TA_100
gccggccggttcgggacgagatctcccaatttctcacctcccagcggaaaacccaacatcccactcctccgaccccctcgcatccctgtcggaatcgcgcatccggagctcgccgccctcgccatggcgcaaggtaccgcgccctccgcggccggcggaggcggcgggggtgttttctccaccccggcggcggtcgcgacgactcccccaggcaccccccgcgcggcggcggcggcgcagccggtcccctccgggcactacgcggtagagctctacttcgatcccgcgctggagaaccaggtgctcaaggcgtggaacgctctcgcgcggcggcagctcagcagccgcctcatcgacaccgcgtcccgcccgcacctcccgctgctgcatctcccggccgccgcgctccccgacccgctccgcctcgcgcccgccctccgcgcgctcgcctcccgcatcgacccgctccctctcgcgctctcctcgctcgcgtcgcccccgtcatcccttgatgcgggggtcctcttcctttcgcccacgccatcggcggcgctgctcggcctccacgcgcagctctgcgagctgctgcgcaaggacacggggctcgaggtgcccgacgggttccgcccagacaactgggtcccgcggtgcgccgtcgccgtcgatgtgccacgtggccgtatggccgaggccttctgcgtgctccgtgagctcaagcttctgcctgtctccgggtatggtatggacattgcgctggtagaagtcgcgccggtggtcaagagaggccgtgtcgtacccgcttggtggcagcggcggtgttgggagccgattgagaggtgttgttgtaatttggtacaatgtgaagaacctcctgggatgggactatcatatttaaacaaagggatcataatgataacatggggcatctccttgtccagtttgcccaattggtaaagaactaatcaagaaaaagaaggcagtnatactgtatcctaccgcatatacagtagttcctcctaattgtttaacctttgggtgataatacctgctactcaactgtagaaactcataaactgaaacgtacctgtgtcaagttangtataatggcagttaatgtcgctcagttaggtacttggtcctgngtttccgcaaaaaaaaaaaa

SEQ ID NO: 101 - DNA, 743 bp, Triticum aestivum
  Clone ID: PAT_TA_101
atgaagatcgatcaactcagcaccataaaaagggccaacgcatcacagcagacatcctgaacacctctggaaaacaagaacaagtctgaggattaacaaccaacagcgcaaaacataacagcagaagctagccaggccatcaagccacgaggcaacaagttgctcaagaatttatcatgagtatcagcgggccccatccaagtcgtccatggaacacctcagtggccctctcgatgagcagccttgctccgctccactgtcatttttgaagtcttggtttctagtcatggaagcagcttcccggccatgaaggacgcgaacttattgctccgggagtactcatacggcaccccagccaccgtgagcagccgctcgaggacctccttggcctggtctggctccgcggtctcgcactcgagctcgtagttggtcccgaaatcgaagtgcgtctcgtcgagctccagcacccgcccctgcccctcgccctccccgagctcatacacgccgcgcgtgttccggaagccgccgaggcagacgaacggcgctttgtccccgccgacgccgtactcgtcggagacgagccggacgatgggggagtcgacggcgccgaggcgggcggggtcgtcgacgcatgcgagggcgagggccgggtcgaggagctcttcgatctcctcgacgcggctgacgccggcgtggatgcgcgggcggcgcttgagcgcgagcacggcgcgggagggggcgcg

SEQ ID NO: 102 - DNA, 1023 bp, Triticum aestivum
  unsure (1)..(1023): unsure at all n locations
  Clone ID: PAT_TA_102
attgcgaaaacaggcgttttgggtgccgcgtcgccgctgagatgtgaaacccaaagccccccttccccttcctttccccgggcttaaccacctcgagaaagagtaaagctagagagaaagctacatcccaccgaatccaacaaccgacaaggaggaggagggagcgagcgagcgagagagctgacgatgcagcaggcgatgtccttgcccccgggagcggtcggcgcggtgtcctcgccggccggcatcaccaccgagcagatccaaaagtatttggatgaaaataagcaacttattttggccatccttgaaaatcagaacctaggaaagttggctgaatgtgctcagtatcaagctcaactccaaaagaatctcttgtatctagctgctatcgcggatgcccaaccaccacagaaccctacaagtcaccctcagatggtgcagcctggtagtatgcaaggtgcagggcattacatgtcacaagtaccaatgttccctccaagaacgcctttaaccccacagcagatgcaagagcagcagcaccagcagcttcagcagcagcaagcccaggccctttctttccccgcccaggtggtcatgagaccaggcaccgtcaacggcatgcagcagcctctgcaagcagccggcgacctccagccagcagcagcacctggagggagcaagcaggacgccgcagtggctggggccagctccggaccatctcgcaccccgagccgcgcgctcgcgcgtgcggacgaggtgggcgctgatgtagcagaacaatcctaagctgttagtgttaggcaaaaataacgccatgtatgtatactataagaaagaaagaaagcccgtctgnctcgtagaaggctcgttttatcatgaaggctcgtttagaacaagcttttagattgatgatgatcatgatggtgtgttctgtccgggattgttatctcactctaagttgttgtaggcttgtagcaattgtgaataactcgccagcccgtgtccaagtcagaggtttac

SEQ ID NO: 103 - DNA, 645 bp, Triticum aestivum
  Clone ID: PAT_TA_103
ggcgccggcaccggaccggcgctaattgatcccctctcatcttggcataggttgccagaaatcatcagcaggggaaaaaaatgattcagctctttctgcaagtgccgacagacgacggcaatgttgatacagatgctgtgagggcgaggagatcacttctggataaggctgagtcggtgatcaagtcggttgtaaggtctggaggccccacgcgtccgaggaggtctctgtgcagtaccgtctcgtcgattcatctgctcgatccgcgtgaccagcgggacctgttcctccatctcctggagatgaaggacttgaggcgggatgtcgctgcacgcctgctgcggatgattttcgacaagaagcctgcgaaggctggctccgttttagcgaagaagtgtcatatgctggagaaattttttgaaggaaaccctgagcggatactgcaatggtttagccactttgctgctactggggagtcagcacacaaaaagggtgctcgggcacttgctcagtttgcatttgttaatcgtgatgtttgctgggaggagcttgagtggaaaggcaggcatggtcagtctcctgctgtttgtgctactaagcctcactactttcgggaacttgatgttctccagacaggggaaaaat

SEQ ID NO: 104 - DNA, 779 bp, Triticum aestivum
  unsure (1)..(779): unsure at all n locations
  Clone ID: PAT_TA_104
ccccgatccaaatgccccgcctcccgtccaccttctgccgcgccaccaccgccccgctcccatccaccttctgccgcgccgttgccgcctcgccgcctcgccccgacctccgtccaccttctggaccacgccgcccctggatcctaccaacgccgccggcatctctgctccactccggcacccagcgccctgtccgccgcgcccgggagtgggatccggtcacctccgacttttggcgctcctccggcgaccacggtgctctctcaaacgcactgccttccttaccgtggagcgcccttctactcctgggatgcccggcatggtcctctcttcggccaactctcatgtttccttccttgccggcccgggacaacacgaaccctctcagcgggttcatcggtgccgatccaacgccgggatgtgatgcttccccaacgggggggggtnttttttttttgaaaaaaaaaaaccaggggcgggggggggggggggttgtccccccccccccccccaccaaaaaaaaaaaaggggggggggggggggggccccccccccccccccacaaattttttttttttttttttaaatctctaaaaaaaaaaaaaaaaaaaagaagtgggggtagtgagaaagaacaagaaaccaaaccacacagtctcgatccgcgaaancacagcctcacccacaaccaccnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 105 - DNA, 811 bp, Triticum aestivum
  Clone ID: PAT_TA_105
gccggcgggcctggaccaataaatcgcggagttccaacgctctccgccctctctcgcccgcattccccaatccaatccgcggcggcatcggcggcgacgccaccaccaccgggaagctccgccccttctccgtctccgttcccgtcccctcccctcccctccacacgcgcccgaatcgcgccgcagatttcgccgccccccgcgcctcccccgattttggcggaacagccgctagggtttcgattcgcctcgggatcgggttcgggccctgatcggaggccgccttcgtcgtccgggggtacaatccgccgccccccctgcttcctggcacggcaggaaccatttccggggaaggatacggcgatggaggggcacgtgttaggaggcggcaactggggctcgtcgccctaccctggccccaacgccaacatcaacgccagcgtcaacgagaaccagttcatgttcgatgccaaggccgcgccgcagcagcttcagctcttcgggagcaacgcggttggcaccagtggatattataactacaatggaaatggcaacccatatgttatgaaccaaccaagaaagacaagcaattgtgcagcggatgaaaagaagctcaagcttcagatgtccttgaacaactttcatgcaggagatgccgaccggttggcatgtactggtaattcaaagtgttgtgtctactgggctgaaactgtcctacgaggataatgagcataattcttccctcacgtctggtagtggaagcatgtcttctttgactccacgacggcttttgggcatgatattatgactg

SEQ ID NO: 106 - DNA, 738 bp, Triticum aestivum
  unsure (1)..(738): unsure at all n locations
  Clone ID: PAT_TA_106
gccnggccggtttccgnagcaaaagagtagtcaactccacgctcataataccaccaagttctttttcatcatgaagtccaagttgttgttcccactcctctctttcgttggtcaaagtcttgccaccaacgacgactgtcctctcatcactagtagatggactgcggatccttcggctcatgtctttaacgacaccttgtggctctatccgtctcatgacattgatgctggatttgagaatgatcctgatggaggccagtacgccatgagagattaccatgtctactctatcgacaagatttacggttccctgccggtcgatcacggtacggccctgtcagtggaggatgtcccctgggcctctcgacagatgtgggctcctgacgctgcccacaagaacggcaaatactacctatacttccctgccaaagacaaggatgatatcttcagaatcggcgttgctgtctcaccaacccccggcggacttcgtccccgacaagagttggatccctcacactttcagcatcgaccccgccagtttcgtcgatgatgatgacagagcctacttggcatggggtggtatcatgggtggccagcttcaacgatggcaggataagaacaagtacaacgaatcctggcactgagccaggaaacggcaccgctgccttgagccctcagattgccaagctgagcaaggacatgcacactctgggagaaaaaccctcgcgacatgctcat

SEQ ID NO: 107 - DNA, 508 bp, Triticum aestivum
  Clone ID: PAT_TA_107
gccggccgggctagtataagtctacaacaaccacaaccaaaaggacttaagaggaaaaaaagagtaaacaatttcgttatggctctaacccgaatcaacacaagtgttctgtgcttgatggcactcttgatggtttcaatcacttttttgtcgtgtgaagcatcagggaggaacataggcctggaagacgccacttgcggtggataccaggaaccctacgatccttccccttgtccaaatgttaacgcgtgtgatcactactgcaagcaagatggtaagggaagtgggacctgccgtaatggcgcatgctgttgctccaaacgtttgtagagcaggaaaatgaccaagagtgaagttggaaataaagattcacttgggagcattaagaattgtttttcttactggaataacttaaatgaaacttctttcttttcctatactctttgtactcgaagcgctttcatggatcatttttttggtccaaaaaaaaaaaaaaaaaaggccccta

SEQ ID NO: 108 - DNA, 1040 bp, Triticum aestivum
  unsure (1)..(1040): unsure at all n locations
  Clone ID: PAT_TA_108
cggacgcgtgggcggacgcgtggggccagaaatccatgggtggcggcagcggcgacctcagccccaccggcatccccgcctccccttcttcgtcctcatcggagccccttcctcgagagtttgccgattatgtgccggtctctgacggcgactccgaagggggttgcatctgcgacgcccccgaggtggaagcccttctctacggcagccaatttcagcaccggtcgctgcgggaggcgaaagacctcatcaggaggtataagcctgggtattggattgaaggagttggcgacacaaaagctggggattgtttgttgcctgataccaccacattgttattggtgggtcccagaggtgctgggaaaagtacacttgtgaaccgaattacacgggtctttgacaaagatgacgatccatttgcaccagagcgggcacaggtttcctataattccaaatcaaatggtacaagcttcatccgggagtataaaatcccaagaaattcaaacggtatatgtatttgtgatacaagggagcttgtccagaaacccagaaaaggatttcaaaatgctgcaacgttggatgatgaaaaatgtttccaacgttggaatgacgaacgggggttacccatgggggcgctggggtcatggggcctctggtcgatggcgctggcattacggtcctccgccccgctgggccaggcaggtcaactttggccttttcgtggccgtgggggcttcttttggtggttcttggggttgtgggtagtcccgacccttggatctgctccgcggggataagaaagntacatggtatctcccgccgaacatttatgaaccatcctacctttgggatacaacctgctgttgtggtacccccggggataacacnttcaacagntcccaatnaagaagatnacanagacctgcatcacccaacaatttgnaaacaagntcgagacanaacgaanacgtgtggnagttcgtacgttcaancnacanattccataactaaacttaacatgccaacaacanaganggcgt

SEQ ID NO: 109 - DNA, 983 bp, Triticum aestivum
  unsure (1)..(983): unsure at all n locations
  Clone ID: PAT_TA_109
gccggccgggttgcgtatttacttaagaaatattcaaatacccccattatgctacatttacaacactcctccatattttgcagaaaagggcgaaaaggcccaaaatccttctataatggagagtgtcaagtaactgtagttgttgtaatttacggagggacccgactgtgaagaaaagaagtaaccagaggggtcaagctaaagttggagggatcatcttgcgaagaaagaagagaagtggaagggcaaaagggaaaaagtggcagctcagggaggggatcaaaatccctagcgctctcaatccccaaatcgggcctggcatctccatctctctctttccctcaccctccttctccacctacggccgccgccgcggccaggccagcgtggcggcgcgccaactagtacctccaccactccaccacgcaccaccagcaccactatccatcatccacacgcctccaccagcacccacctcgcgcgcccctcttgctgcttcctctctgaacctgctgctgctgcatcttccttcttcttgtgccgatctgctgctgctctgcttcctccactcctcctgctactccttctttccccgtgatctgctgctgctccttctgctgcgctcccttggctgatctctcaacgctgctgttcctcccctcatcacgctgctgcttcctttttctccttccgctgctctcttctcccttgcctccaattgctgccctagaatctctgaactcaatctgctgcgcttatacacaaaatgctgcgctctctctaatctctctctctctaaaactctcgattcaatgtcgtcnctgaaaatgtgagtaatactgangtcaaaagtaatgtagacggtgtaagtaancttggccnggtaaatattaccatccgaatggtgggaaattnaattganccgntaaaagngggggnaatttcaaaaaaaacngggcgggcattccaangtttncccnggg

SEQ ID NO: 110 - DNA, 942 bp, Triticum aestivum
  unsure (1)..(942): unsure at all n locations
  Clone ID: PAT_TA_110
gnnagntgnnnccnttnnnnnnnnttntgattccgccaagctcgaaattaaccctcactaaagggaacaaaagctggagctccaccgcggtggcggccgctctagaactagtggatcccccgggctgcaggaattcggcacgagttcaagactcgcccacagaaattagatgagctgggaggagtcgttgcttcgaggctagttctaccccggagttccgcatcacacgccccggccggacggaggatggagaaggacgacgacggcggcgatggcctccgccaccacgccatccggctcccgctcacagcaatggagggctcggactcggaggtcaccagcaacggagactcggagatcaccagcaacggaggaccaagcgtctcgctgcgccagaaagcgtcttcgctcatggcctcctcggcggcggcgtaccgcagcaagcccgcctccttctgggcgctcctcgcgctcagcggcggcgcgatgctcacggcgttcccggcggccagcctgctctcgcggctctactacaacggcggcggccagagcaagtggatcctctcctggtccgccgtcgccggctggcccatcccggcgctgctcctgctcccctgctacctcttcggcgacgcgtcgccgacgtggccgccgtcgccgtggctctgcttctggtacgccctgctcggcctgctcagcgccgccgacaacctcatgtacgcctgggcctacgagtacctgccggcgtccacggcgtccctcgtcgccgcgtcgtcgctcgccttctccgccgtgttcggccgcctcatcgtggggaagaagacaggataggcctgtccacgctgaacgccatcgtggtgatcaccgccgggcgtggtgatcatcgcgctggactcgggatccgaccggtacccgggggtcacgggccggcagtacgcgctc

SEQ ID NO: 111 - DNA, 816 bp, Triticum aestivum
  Clone ID: PAT_TA_111
gcaggccccctaccagcaccccccaacgcccccgcaactcctcccctcccccacaccagacccggccatccccccctagtagcagcaggcggcgatggcgcccaaggacgaggggagcaggcggcggcgaagaggcccgcggaggaggagccggtgacggagaagggcgccgaaaaggccccggcggcgaagaagcccgaggccgagaagcggcggccggcgggcaagacggcgcccaaagaagccggccgcgaggcgaagacgaggggccggaagaagggcagcaaggcgaagaagggcgtggagacgtacaagatctacatcttcaaggtgctgaagcaggtgcaccccgacatcggcatctcttccaaggccatgtccatcatgaactccttcatcaacgacatcttcgagaagctcgccgccgaggccgccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagattgcatctgcattgcttgtatctatctatctatctagtagcgactgtagctggttctgttgctttagttggtgcttgccgactctggttatctggaactctcaagtgctcttattgctggatggggaattgattgatggatgactgccaatgctctgttgcctcttttggcaaactgatatatcaaaagcagtagttcatttcagcagctaaaaaataaaaaaaaaaaaaaaaagccct

SEQ ID NO: 112 - DNA, 714 bp, Triticum aestivum
  Clone ID: PAT_TA_112
tattaaccacagcctggccgccgggctgaggaactcgggcgggttcttcaccgacgccgacgtcgccaggatcgtcgccgtcgccgcggcgaggaacgccaccaccgtgtacgtgatcgaggcgacgctcaactacgacgacgccacggccgcgtccgtggagcaggagctcagctcggtgctggcgacgctgaggcacgaggaggggctcgcgttcgtgcgggacgcgtcgtacctcgagttcctggaccgggtgcacggcgaggaggtggcgctggacaagatcgggctgtggcgcgtcccgcacccctggctcaacgtgctcgtgccccgctcccgcatcgccgacttcgacagcgccgtcttcaagggcatcctccagggcaccgacatcgccgggcccctcgtcgtctacccactcaacaaatccaagtgggacgacggcatgtcggcggtgacgccggcggaggaggtgttctacgcggtgtcgctgctcttctcgtcggtggccaacgacctgaagcggctggaggcgcagaaccagaagatactgcggttctgcgacctcgccgggatagggtacaaggagtacctggcgcactacacggcccacggcgactgggtccggcacttcggcggcaagtggcagcgcttcgtggagatgaaggacaagtacgaccccaagaggctgctctccccaggccaggacatctt

SEQ ID NO: 113 - DNA, 952 bp, Triticum aestivum
  unsure (1)..(952): unsure at all n locations
  Clone ID: PAT_TA_113
gtggactcgccgctcaagctcggctcccatggcgccggcggaagatgcaggcgacgccggcggcggccgctccaccgcccggaagctggtgccgtggtcgagctgggcggagtggcgcttcgtccgcgacgccatcttctccccctaccccgaccctggcgccgctcttcgcaggatcgccgcgtggcggagcaggggctgcctcccgatccccgtggaggtcactgcggccctcttcgagataaggctggcgggatcccttcttccggaatggagtggcttcggatgataagctggaagtcggacgagatgctccccttgctgtacagtatggcaatcaatcaggactttgtaaatggttttatggagaagcccgcacaaaggnaaactgggccgtccatatctctgtttgctgcctctgttcgggtaccacgaattctcgttgacattcgtcatgagagttcacatcgcggcatcccctctctgcgactgctacatttggcagccattaaggcatttgattggttgaagtgtaattactgggattcccagactagtgcaattcctgatgttcgactagaactaaactcagtattgcatgacatcgctcagtcactgaagggaaaagattctgaaaatgcaaaatcaggttccaaaaggaaacgttcccagaaacatattttaaatgccatcagatatgtacgtcgactttactatacatgtccctctgaggctgtctctgttcttttggagttttgtcagctcgatgccccagaaatctctgaaaacagcgatgtacatcaatctgatagtttggatgtgaatcactcatctgatgttcaaattcggaatcaaatatcaaatggagatatgaaaaccatcataacaaaactatcagaaaaagaaccaagagtgcttcttggcttactaaagtcggtaattgaaatgattg

SEQ ID NO: 114 - DNA, 803 bp, Triticum aestivum
  unsure (1)..(803): unsure at all n locations
  Clone ID: PAT_TA_114
cttcactccaaaagtgcccatcagcgaccagccggtcgctccggacctcccttatcgcggtggattggcctcgtctcctctatcttgttggccgcccatctcgactctccaaactctcagctccctccctcgcacacgccgttctcgaatggcggccacctccggcctcacggccaccgttacctcccctccggccgcccttagaacctcgcctcctcccgttctcttcctccgccccatctctcgctgctccaggctccattccctcaaggccaaggcagcagcaaaggaccaggacgaaaagaagcccgaagctaccaaaaagaaggcatacagtcttgtttgcactgcctgcgaagggaacggcgcaatcgcatgcacccaatgcaagggaggtggggagaatttggaagaccatttcggtggccgattcaaagctggaggattatgctggctttgcagaggaaagcgtgaaattctatgtgggagctgcaatggcgctggcttcttgggtggatttatgagcactgccgatgacacttccgaatgaaatgcttatgttgttatttttttttgcttatgttgtgtttgacaaattttgggagatctgtaacatttttacttatatcccctccaaggaatgtgtcccttagaacatttattgcatttaataattgcatatttttttaaaaaaaaaaagccccctaggcgtcttaaatcnacggaaacccngtncaattaccctngaaanccttnacggnaanaagccccttcctcaatncccatgangnnccttgcanaac

SEQ ID NO: 115 - DNA, 685 bp, Triticum aestivum
  Clone ID: PAT_TA_115
gccggcggcacgaggatacatcgacctgtcccgcaacgacttcgatttcgacctatcgggcgtggtgctcccggagcagctctacttcgtcgacgtgagccacaatgccatccatggcagcatcccggcgcaggtcgcgagcttgtccaacctgcagttcttcaacgtaagctacaacaggctctgcggccctgtgccgaccggcgggaacatggcgaggttcgatctctacaactttcagcacaacaagtgcctctgtggtgctcccctcactgcatgcaagaaatagatagaactgtccgctggacatgaaacattatccggtgggtttggcagaataatgctattctatgtcgatcatgtgggctaatgtcaccctggattaagagttgtgctgaaataaagtcatggttgtgtgtgacaaaaaaaaaaaaaaaaataccccccggcgggaacacggcgaggttcgatctctacaactttcagcataacaagtgcctctgcggtgctccactccctgcatgcaagaaatagatagtacaactgtccgctggacatgaaacactctccggtgagtttggcagaataatgctacgtatttctatgtcgatcaagtcgactaatgtctccctgggttaagagttgtgctgaaataatccccaggtgggtgtgggtggccaaaaaa

SEQ ID NO: 116 - DNA, 987 bp, Triticum aestivum
  unsure (1)..(987): unsure at all n locations
  Clone ID: PAT_TA_116
gccggtaccccccagccaatcccgccttggcgtcccctgcgactctagttcgcgccgtgggctctgccgccgccgccgccctccgaggacccgccgctcgccgtctgcgccaacgcgcttctccctccggaaccgcgccaactacaagccccacctaatcgccccccaactgaagtcgcgccccctccccgacgccaaccataagcaaggaagcgacagcggggaagtccaccgccaccaccaggaaaatctgacgaggaagtgcaagatccacagcttcacaagtgcaagtgattgttggcaggagcaaaggaagctgagaaacagggacaaggagctttgaagcacaatgcttgtaaagaagaagaagagtatgtcttttttgagttacagcatgcacattattcccccatacaatggaatgcaaggattatagtctctggtttgtctaaattaactactaccatggtagaaggtgatggaatgaagaaaattggagaatacgaagcaaacggttggcacatgctatttatttttcagaaagtgatgctccaccaaaacctgttcatggagagccggcacctcccaaggaaaacaaggacaagcaaggcagaaacatcaaggaagcaccgcccaaggaggtgaaacatctgacgagcgttcacaagatcctcaaattccggtcgaccagtgagggtcgtcaggagcacagagcataccgatacagggacaaggagttttgactcttctaatgcacacagcaagcgatcctttgacccttggaatgcgaggatagtactccttaatcttaattagccactagcattctctatcccgaggtaaccagcggttgcgatgcatgattccggtgacccttatcctctctctatgaagtatgcactgttaatcttggtgaaatccgccnccatggatccccggtctgtatgtaaactaatgcagtctggcctaaaanttgggaaacgccaa

SEQ ID NO: 117 - DNA, 646 bp, Triticum aestivum
  unsure (1)..(646): unsure at all n locations
  Clone ID: PAT_TA_117
gcactagcaagctctactcgtctcgcaaacgaaagagcagatcatatcagaccagagtgagtttgcatctgcgagctgcgccaatggaggggagaactgctctctgtttcctcgtcgtgctcgcgcttctcgcaagccctgctctcgcagaacgcaagtgctacaaggagcgcttctactccatgatatgcatgaagtggcactgcgccatggagtgcgtcaaccagagcccggacctggtgctcaagtcggcccactgcaccaccaagcacgtcatcatgcgctactgcaactgcgagatgtgtaccaaggagtagactgctctgtctactctggtcgtctagttattagctagggaggcgtaccaccaataaactaaatccatatggagctagagaataatagttattctaggagtgtatatgcatgtcgtcgatgacatgcatgtgcatgcatgttactggctagccagtacgcttcagcttgagcagattgtggaactgatcgatcaataaagattctggatgtgagttccgttttgtttaaaaaaaaaaaaaaaccgagggggaaaaaaaaaaaaaaaaaaaaaaaaaaaaaaaaaaaaaaaaaaaaanaaaannaaaaaaaaaaaaccccnnaaaaaaaa

SEQ ID NO: 118 - DNA, 754 bp, Triticum aestivum
  Clone ID: PAT_TA_118
gccggccggttcggggtacgagccacacgcccacgcgacccccttccactcccaaaatgtccccgccgaggcgcctcgccgtgctctgctcccacctccgccccgacggcgcggagcctccagccgagaatgagcggccggccgggcagaaaacggtgatatccacctctccgtgcggagacgacggccgcggcgcggcggccggtcgcgtgggggatcgggaggcggagagctgcgtcttctgccggatcatacgcgacgaggcgccggcgttcaagctctacgaagatgatgtatgcgtttgcatattggattctcacccattggctcttgggcattcgttgataattccaaaatgccatttttcatctatggaggtcactccacctcatgtcatagcagcaatgtgttccaaagtaccttttctgagcaatgcaattatgaaggctactgactgcgatgcattcaacttggtcgtcaataatggagaagctgcaggacaagttattttccatacccacttccacataattcctcgtagatctggtgacaagttgtggcctacagagagctttaggaggagctctattgagccaaatgaaacctagagtcttattagctgcatcaagaagcaacttgattcttcagaagactgaagctcattaccgcataaggtccaatagaaagctgcttcagttgtccagtcaagtacataatctgcctcggttgcatagctgaagtaatccatgagttt

SEQ ID NO: 119 - DNA, 1012 bp, Triticum aestivum
  unsure (1)..(1012): unsure at all n locations
  Clone ID: PAT_TA_119
cccgcggcctgcgtcccggctcaggcggccctgctcgcaaccttccaccggggcctcccccttcctttgtgttgcctcaagccccgccctcccccgaagacgagagtccacctgctcgtgcaccagcagctgtttcctgcggggcgtgcggtccacccctgcgtcccgcgggaatcaaagaatccggactcgacatgctcattcaggtcgcagcaacccagctcagcgaccagcttcctgaatcaagggaggctgctcgtaacctttcattggagcttcaagcattctatgagaagtctcaagcctctggtttgggcgaagatgacagcgcacctgctatttcaccagaagctgaaacctgggaggctttctgcctatctaagctttctgctttaagcgcccaagcaatcctccgtgtcactgtgggtgtccctgttaccccaaaagaaggcggcatctctgctgctctgaaagaaggcgccatccctgctgccctgaaagaaggtggcatctctgttgtcgttgctccaaaagaaggtggcgcccctgttgctacgaaagaaggtgctgcggccgtgggctgctagcgttgggagttggccgacacaaagcgatgttgcgatttttccacatccaattcacgtttttgctgtacatgatttatgggttgctcggtcggtaaatcgaatctccttttgctggagttcttcaggcttgagggcctggggtgggtgttaatattggtgcgagatatagtcccttatagttgactgtataatcctttggttccgtcactacttatcagtttggcatgatggtcagtcagggaatgtaggatttcttccaccgttcggggggnnttttccccaaaagggggnntttttccccnaangggggggaaaatggggggtttttaangggnaaaaaaaaanttttttttttttccccctttttttccccccaaaaccccccgggggnttttttttnccccgggngaaaaantttaaaaaaa

SEQ ID NO: 120 - DNA, 661 bp, Triticum aestivum
  Clone ID: PAT_TA_120
gcacgagggtgaagcctaaatggctgcatgccttcttccctctgcatctcataactttgttcaaccatggtctccttctggagtttccttctgtcctacccggaagttttcctagccattgcttgcttcttctgcctctccctcttccgccttgtccgacactgccacaagagtgacctcccggtgaactggcctgttattgggatgcttcccttcctcgtgagaaatctgtaccaaattcatgacagtgtcaccgatatgctccgcgaggcgggatgcaccttcaggatcattggcccgtggttcctcaacatgagcttcttggcgacctgcgacccagccactgtcaaccactgcttcaacaccaacttcaacaactacccaaaaggcagtgagttcgccgagatgttcgacatcctaggtgatgggctccttgtggcggactctgagtcctgggagtaccagcgccgtgtggcgatgcaagtctttgctagccgcgccttccggtccttctccatgtccaccatcacgaggaaggccggcacagtcttgttacccttccttgaccacatggctaagcacggctcacaggttgagctggagggtgtcttcatgaggttctcacttgatgtctcgtactccactgtgtttgcaactgacc

SEQ ID NO: 121 - DNA, 521 bp, Triticum aestivum
  Clone ID: PAT_TA_121
gtgcggcgctcgagccggccggttccggaaaacggccattgttggttccatctcggtgctaactagctaggcttctgccctcgcaaagtcaccccgattcagaaacaataatgttacccaacactcgccatctgattcggctgcttaccatcctcttctttgtgatctgcttctgccgactttcatcctcgcgcgactcacactgcaccggagtccacgacccgcgtaaacccccaatgttattctgcccaccatgctgctcataggaagggtaccggttctagataacggaatgtgcgtatatatggatggcggcttgtcttagaggcatctgtcgctcatagttttctccaagaccattgctcatgaaatcttctactgcctataaatataaatggagtgttcatcattcttcagaagtatttatgtactttccacatgtgtaatcctttcaatcaattacaacttgtaattaaagatcatttgttttgtagcaaaaaaaaaaaaaaaaaaggccccta

SEQ ID NO: 122 - DNA, 811 bp, Triticum aestivum
  unsure (1)..(811): unsure at all n locations
  Clone ID: PAT_TA_122
gcacgagggccaaggccaggaagtagcacaagaggagaatcccaagtcctgtgaacttgaatatggaagctattgcctctggtctgttgagcataaggaagagatgaaagatgctattgtgaagaggcttaaagatcaactgtttatggccagagcctattatcctagtattgcaaaactgaagcaccaggaaagatttacacgtgagttgaagcaacatatccaagaacacgaacgcatgctcagtgacaccattgcagatgctgatcttccaccatttttcacaaagaagctagagaaaatggaaggcacaattgagaaaatcaagtcttgtgaagtaggctgctccaatgttgaacggaaacttnnnnagctactcgatctaactgaagatgaagcttatttccatacaaggcagagtgcatttctctatcatctcggggtccagactatgccaaaaactcaccattgtttgagcatgagattgacagtagagtatttcaaatctgtatctcctcaaagggagctattaaataagcagaaatttgaagaccctgccttctatcactatgtaatgttctccaggaatgtacttgcagcttcgactactatcaattcaacagccatgaactccagggattctggcagcattgttttccatgtattcaccgacacccagaatttttatgcaatgaagcattggtttgacaggaactcatatttggacgctaatgtccacgtgactaacattgaggatcacaacaagctctctaaggatgttgaatctcttgagaggcaacaattatggcct

SEQ ID NO: 123 - DNA, 823 bp, Triticum aestivum
  Clone ID: PAT_TA_123
gccggccgggtcggggaatccccggcttaacccacgccttcctcccccaaccttcgcctgcctccaagaaacccaatcccaccacctgctgctgctgctcctgctccgggatcgaggcgaggcggcgatggcgatcgagaagaaggggatgtcggcgtacgaggcggagcgggagaggacggtggaggagaacaagcgcaagatggaggcgctcaacctgcgccacctctccgccgccgtcgcccccaagaccccctcccccatgaagcacaagcggcgcaggatcatcgaggccgcgacccccgtcccgtcgccgccgaggaggtcccgccggctcgcccacatccccgaggtcaagtacgccgacgcctgcgcggaggtgggagaagatagtgagagagtgggaaggtggtctcctagaagacgaagtggcagcatctacttagcaggaggtggaggtggaccaatttccatgaaagctaggatggaggcagcaagcaaagctgaggagttagaatcacaacttgaccctgaatttccatccttcatgaagcggatgctacattcacatgtggtgcgagggttctggttgggtctcccaagccatttctgtgacacgtacctgccaaagaatgactgcactatcactttggtggatgagaaagatgaagagttcgagtccaagtaccttgcctacaagaaggggctaagtggtggctgggctggttttgctctggatcatgtgattcgggatggagactcgacggtctttcagctgatcaagcctacaaccttcaggtgcatatcatccgagctgctgttg

SEQ ID NO: 124 - DNA, 2275 bp, Triticum aestivum
  Clone ID: PAT_TA_124
gcggaacaccgccgcgtggcgttaaaaaaggacaagagctcgattcaaatccgatcctgcgctacgtatcgcgcttcttccgtccgtgcgttcgttccgaggccgagagtttgaggagatggccggcggcggtgtcgcgcactcctacggcgcgcacagggcctccgaggagcagctcatcacgccatggtcattctccatcgcaagtgggcaccaggtttcggagggacccccggcaaagccaggggctggccttctccgaggcggagcgcgacgcgcactacctccggggcctgctcccgccggccatcgtctcccaggagcaccaggagaagaagatcatgcacaacggccgcagatacgccgtacccctgcaccgctacctcgccatgatggacctccaggagaggaacgagaggctcttctacaagctcctcatcgacaacgtcgaggagctgctccccctcgtctacacgcccgtcgtcggcgaggccggccagaagtacggcagcatctaccgccgtccgcaggggcgctacatcagcctccgtcgtatgcgcgagcggcgcgggggggtccagaactaggcctgagagcagcatccaggtcatgcgtcgtcaccgacggcgagcgcattttggggctcggagatctgggctgccagggtatgggcattccgggtggcaaactgtctctgtcgacccggacggcgagcgcatcgcgggtcagcttgccttgggctgccaatcgatgttggcaccggcaaggagacattgcttaacgacgagtactacatcgggctccgtcaacggcgtgctaccggcgaggaataccatgagcttcttcaagagttcttgctcaacgacgagtactacatcgggctccgtcaacggcgtgctaccggcgaggaataccatgagcttcttcaagagttcatgaatgcagtgaagcaaaactacggcgagaaagtcctggtccagtttgaggactttgccaaccacaatgcattcgatttgctcgcaaagtacagcaagagccatctcgtcttcaacgatgatattcagggcacagcatcagtggtcctcgcaggcctcttggcggccctgaagatgatcggtggaggccttgtggatcagacctacctcttccttggtgctggagaggctggaactggcattgcagagctcattgctcttgagatgtcgaaacacactgaactcccggtggacgactgccgcaagaagatctggctggtggactccaagggtctgcttgttgagtccagaaaagagtctctgcagcacttcaagaagccgttcgctcatgagcacgaagaactgaagaccctgctggaggccgtccagtccatcaagccaaccgtgctgatcggaacctccggcgtcgggaagaccttcacccaagaagtgatcgaggccatggcctccttcaacgagaaacccgtcatcttctcgctgtcgaacccaacgtcgcactcggagtgcacggccgaggaggcctacacctggagcaagggcacggcggtgttcgcgagcggcagcccgttcgaccccgtggagtacgaggggaagacgtacgtgcccgggcagtccaacaacgcctacgtgttccccggcttcggcctcggcgtcgtcatctccggcgccatccgcgtccacgacgacatgctcctcgccgcctcggaggcgctggcggaggaggcgacccaggagaacttcgacaaggggctcatcttcccgcccttcaccaacatccgcaagatctcggccagcatcgccgccaaggtggccgccaaggcctacgacctgggcctggccagccggctgccgcggcccgacgacctggtcaagtacgccgagagctgcatgtacaccccgctctaccgcagctacaggtgagcgcggcggccagttttgcggccagcacggacggagtcagtcaataaaatcaatctccttcccccatatgccaaccagctcaagcgtatggttcagcgacgcaacctaaaacataggtttgctttattctgtgtccgtctatgcgtatgtgtactcttgtgctgttctactttgctttacttttgtactgtaatgtactgtttacgggagcacggcacgcacgcacctgtctatctgtgtcgaggtgcgtcgtcgtcgtcgatgtttattcttttgtcagattgagttaaacgagtgtaatagtttgatgatttgtgttaccagggttgctcttttacttcccacgctcgacctcaaat

SEQ ID NO: 125 - DNA, 574 bp, Triticum aestivum
  Clone ID: PAT_TA_125
ctgtgcggcgctcaggcgccggtttgggactgcaaccagcttcctgcattctctcttactcctcgagaaaggaactcttgcacaatggcggtttcgtcgaagcttttcccggccgccgtcctcctcctgcttctcctcctggccacagagatggggcctgtgcgggaggccatggcgtgcgagcacgcgcggtgcaagaagtgcaccggggcgtgcttcgacccggatgagtgcgccatcacgtgccggaacgagggctacgactccggcgactgcaccggcagcggagcctaccgctgcacgtgcagcaagaattgctagctaactagtgcgtgaagaacacacgagtagaataaaaaggggattacagttctgtgctactctagtttgttctttcctttttgaccatggattttttgttcgaaggttcacacgaatgtggcctaaacttagtggttccagttctgagattattttgtatcgcaagctatgtactaagagagatttctctcaacaaagattatactaaaagagagtaatcgtttggcaaaaaaaaaaaaaaaaaaggccccta

SEQ ID NO: 126 - DNA, 833 bp, Triticum aestivum
  unsure (1)..(833): unsure at all n locations
  Clone ID: PAT_TA_126
cgctccggnaccccacacgtacccccgtgccgtagcgcttcttcctccctccgctcccgtccgatccggctataaattcctcgcctcctcccgtcttgtatccacacatccgatccaatccaatccagccccccatccgatctcgccgggaaatctctccgatcgaagcgaggcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccagcagcgtctcatctttgctggcaagcagctcgaggatggccgcacccttgcggactacaacatccagaaggagtccaccctccacctggttctcaggctccgtggtggtatgtagatatttgtcaagaccctcactggcaagaccatcaccctggaggttgagtcctcggacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcaggctccgtggtggtatgcagatcttcgtcaagaccctcacaggcaagaccatcaccctggaggttgagtcctcggacaccatcgacaacgtcaaggccaagatccaggacaaggagggcattcccccggaccagcagcgtcttatcttcgccggcaagcagcttgaggatggccgcaccccttgcggatt

SEQ ID NO: 127 - DNA, 1174 bp, Triticum aestivum
  unsure (1)..(1174): unsure at all n locations
  Clone ID: PAT_TA_127
cacggaaattttatagctttcgtgtgggaactcgtaaccccatgttcatatgtgactggcaaagtacaatgcattttacatgaaagaaaatagcacaggagcttggtgatcaactcgctgataacacagaaaaccaactggtagagtggaaaagtgggaggtggccgtgagctgaatcatcattggatttagttcatctacaccacgtcccttggcccctgcacctcaacaagccttcctcaaaggagccccttttgctttcatcaaatcgtctaatctaagttttacatcatatacaccaaggaaaacaaaacagtgtcgtggcaaatgaaagaatcggtatatgagggttcgtcagtgcaaatctcccagtctctgaacgagctgctcatgcgctggtgacacccgacatccagggcacaacaacgggggctctcggatgagaatctctgtaagactcggaatacttgtctttgaagttcagtttaggctggtcagcctgtttcaaccagcactcctgatgtttatgctcatatttatctggtgaatagcaaccaaactctgaagggcaatatacccatatattgcactttaattcacccggcttggcattcctagcctggtctagacatgcttgacaacaatcagcagcagattctttgtggtgcgttaagccccatctcacagcagcgccaccataatcggcatgtagctcagtgttgcattgtggatgcaaaggtggaccagctattatttcttcttcttctggttcattctcaggtttgtcatcatgctcggtgtgtgggatttctggtgaaatccaaagaccaatatcctccaacagcgcatgccagttgaactccagggctcgctttaacaatcgtgcttcctcactggagaggcccaaatttgatgaattccgagtagatgcactttttgcatcttttagcgtctcaacacgccatgattccagagcttctcgttgctggatggcagtgccgttatcccctaggccgttcagccgccccacgagctcatacgataccctcagcttcagctcgagaggcagctccttccgccttttctcctcccgtgcgaaaaccttgcgcagcttcttcaccgcctggacgagctcgacgggctcggccncgcggcgaatccgcctcgtgccgaa

SEQ ID NO: 128 - DNA, 818 bp, Triticum aestivum
  Clone ID: PAT_TA_128
gccggccggccggcgacccgaggaactctactctctctcgccttgttgaaccattgggagctggcccggcccagcattacttcccagccatgtctgccgctctcctacgatcacgagctgccgtttctggcacccgaatcgcttcttccgcccgccctgctcttcccaagtcaaacctcgtccagcgccgcagcgcttcatcctcttcttccgccggtgatggagctggtctcaggttagctctctacggcagtgctgccgctgctgttctctacggttcatacctctacaccaccgatacaagagctttcttctaccgatgggtcgttcctccgctgctgcgctgggcctaccctgatgccgaggacgcccaccatgctggcaccacggccctaaaggtgctccatgaactcaacctcaacccccgcgagcgcgatactactctcaactcttccgacctggctgtcaatgtttttggaacagaggtccagaacccaattgctatctctgccggtctcgacaaggatggagaggtcgcagatgcgttgtttgaccttggagctggcattgtcgaaattggtggctgcacacccctccctcaagctggcaaccccaagcctcgagtgttccgcgttcgaagcctcgatggtatggtcaaccgatacggcctgaactctcgcggtgctgatgatatggctattcgattgagggaccgacttagacgatttgcccgatctcttggtctgactgaaagggatgtccttgacggaaacgccaaggtccccccctggaagtcttcgagagggccgactactggg

SEQ ID NO: 129 - DNA, 750 bp, Triticum aestivum
  unsure (1)..(750): unsure at all n locations
  Clone ID: PAT_TA_129
acngatgcacccnttgcaaggcttgcacctnttgaccatgcggggcggatcctcggtgatntggacgtgccgcctgacctgcccggccacggtggccctccccgtcctggctcgtgatgaggggaggcccacgcgtccgggcgggggcgctcctcttgccgtgtgcaggcgaggacgaccgcgacgacaccggggaagtggacggaggcggtccggcaggctgggtgaagtagacgacggcaacggcgggagctgctagggttctgggagcagagaggtgggagagggaggtggaggcgaggcgtgccagccgggatcccgatccaactccagccggccagccctatcgtcgccggcgagaccaccccaccccagggcgcctacctcctcctatcctccctccgcatcttctcttctgcagggacgcatcaatggggatcgagagatcggggaaacgagcagccggccgccggagcgaggcccacccccaccatcgaaaccctagcaggggaaatcgatgggggtgaccgcatgaggcgaggaaaagtagatcgacgcggtgaagctagtagagctcgtccaggagcagctgtgtgtgtgttgggtggcaccaaagctcgccggagcggccggaatcggtcggcgaacgaggcggcgacagtggggatcgagagagtaggcaggaggggggtgacgggaggaagagagatgggctgcgcaagtgcgcccacgcgtccgcccacgcgtccg

SEQ ID NO: 130 - DNA, 780 bp, Triticum aestivum
  Clone ID: PAT_TA_130
tgtgcgcctctcgagccggctgctagttgatcatttcacactcccacccctgccctcactctctaaaggctcgactactcactctgcccacacccgtcaccgcagcctcgcaaaattatcgccccaggtacaggtaagagggcgagagagaaggcgatgtcaatggcggaggagcagtactacgggggcccgcgcggggcgccgcacgggctgctgctggcggtggtggcggggctggtggtggcgggcccgctcttcctgggcgacggcggcgaggcggtcaccgacgccatcgccgagctgctcagccccgtgggcctgctcctcctccccgtgggcctcctcctcctcatccgccttctctcctccgaccgcggcgccgcggcgttcgccgacgtgttcgccttcggcggctcgcccgacgccgtgcaccgcgtcgggggctcccccatcggcgtggcgctcatgctgcttctcatcctcgccctcctctactaccgctccgcgctcttcggcggcggcggagacgacgacgagtaggcgcctgccagtaggtgggtagagtctgatctcggggttgttttggcagtttccgtttgatggctgggcctgggtgtaaaagtgcggtgtaaattaactggtagctactcgccgtgttggtttgctctgcgttaagggcttaagcgctgaaggctctgcgctgcatgggtccatgtgcttatctatatctactagaaggggacgcgcgccctgccgcgccctttttttttcccccccccc

SEQ ID NO: 131 - DNA, 714 bp, Triticum aestivum
  Clone ID: PAT_TA_131
ccggccggttcgggccacgcgttcgggcgaacagcccaatcccctttcctcacccctcgctaggtttcctccacgccgccgccggtcccttgtgcgcagctccctccgccggtgcctcctcctccgctgctcctcccgttgccgtgacccgcccccgcccccgccccggtctccagcagcagcaacaggcccgcccggcactctactccggcggacgccgccaaactctcttctccaaaatttcatctcccccctcccgatctagccagacggtcacgcgcaccggcacgccagggatgatggagcccgcctcccgcaagcgccgcgcctcgtcgcctccgccgtcgggccccgtcacgctgccgccgcccggcttcgtggcggacagggaggaggcggcggcccgcgtggagcggcttctccggtaccagttcaacaaccgctccctgctcgaggaggcgctcacccaccagtccttcgccggtggcgccgcggcctcctaccagaggctcgagttcgtcggggacgcggcgctcggcctcgccttctccaccttcctctacctcaccaaccccaccgtcggccccggcgcgctctccacgctccgggccgccaacatctccaccgagaagctggcccgcgtcgccgtgcgccacgacctctacccgctgctccgacgcaactgccctcggctcgatctcttggtaggacagt

SEQ ID NO: 132 - DNA, 1155 bp, Triticum aestivum
  Clone ID: PAT_TA_132
atgcatgtgcaagtatgaaccaatttgaactgtgagcccccacaaccaacccttcctccttcctcaagcgcgtcagctcctccgccccggcgacccgagcgagatggtttccgccgacgcagctcgcaacgtcgtcggtatcatcgggaatgtcatctccttcggcctcttcctctcccctacgccggttttctggcggatcatcaaggccaaggacgtggaggagttcaagccggacccctacctggcgacgctgctcaactgcatgctctgggtcttctacggcctccccatcgtccaccccaacagcatcctcgtcgtcaccatcaacgggatcgggctcgtcatcgagggctcctacctcatcatcttcttcctctactccaccaacaacaagcggctgaagatgataggcgtgctcgccgccgaggcggcgttcatggtggccgtcgtgctcggcgtgctcctcggtgcccacacccacgagaagcgctccatgatcgtcggcatcctctgcgtcatcttcggaaccatcatgtatgcctccccgctcaccatcatgggtaaggtgatcaagaccaagagtgtggagtacatgccattcaccctgtcgctggttaacttcctcaacggctgctgctggttggcctacgcgctcatcaagttcgacctctacgtcacgatccccaatggcctcggcgctttcttcggcctcatgcagctcatcctctacggctgctactacaagagaacccccaaggaggagaagagcgtcgagctgcccaccagcaaccccgctggagccggcaacgtctcggtcaccgtggacagataagcattggcttgcagcagcagcaagcccgccgtcgccaagtgactctagtccggccggcggccgagattttagccctaaacattttgattagttaaattccggatgatcgatgcttcaacaagtgtggtgtgctagtctttgttataattagctagtcttgatcgagtgtgcgtttcgtgaaccactgtcgtctgccctcgtgcaaattagaactatattcatgcagaggcgcaaactggaacttaatatatgtagctgcgttgtcccgcaataattacagcacgcttgtcacatataaaaaaaaaaaaaaaaaaaaaaaa

SEQ ID NO: 133 - DNA, 1014 bp, Triticum aestivum
  Clone ID: PAT_TA_133
cgcctcgccggcccctcgggtccgggccgccgcccgcgtcgccagccggcctcctcgtgcctcctcgccgctgcgaagaggaggggccgcactcccgcacgaacgaaggagccagggttctccgccgccgccactgcagccgtccctccggcgaacctccagtccgcgccgccgccccccggagcagcgctcgtctgccggcccaggagtttagctgttaattctgctcagccttcttgtgtggctatggggacagttgcaatctacagccttttcatcatcaacaagtctggcggccttatatactacaaggactatggctcagcggggagaatggacaccaacgacagtttgcgtctcgcgagtctctggcactcgatgcatgctatctcacagcagctgtcccctaccactggctgtactggcattgacctcttacaggcccacaatttcgatctccattgcttccaatccctcacagggaccaaatttttcgttgtatgcgaaacaggcgctcaaaatatggaaatcctgctgaaaactatatatgagctgtacacggagtttgttttgaagaacccattctacgagatggagatgccaatccggtgtgagctctttgacctcaacttagctcatgtcatccagaaggaccgtgtcgcacttctgggccggtgaaacatgaaaggaacatacggagcacaatttcgtgtgtgtttctctaccatctttgtatttggtcacatagaacatggttcttcttgaaagtgattctggctggtaacatgaatgtggtttgcactttgatatctgtaaatctgctatacagtgctgggttacagcatttccaagacagacgatgtgtctagactttgacattgctgagtttgaatttccatgccctccgtgatttggacaagaattatgtattgggggggccatgtggggtaataacctgtataacggccggtaataccatgaatatcagatgttttaaaaaaaaaaaaaaaaaaa

SEQ ID NO: 134 - DNA, 845 bp, Triticum aestivum
  Clone ID: PAT_TA_134
ccccctcgggtctccgcgcctcgcgcgctcgctctctctgcccactccctcccccatgcagcgcctccctccgcggttgccggtgaccggacgccaccacgcccgccgttgccctcgccgctgcatcgctccacgcgccttcggccctctgcgcgtatccctcttttgaaatcctgctgctcatctccgctgaccgatgtcgtcgccggatccggcgccctgtgcccagctttaccccggatctgcgccctcccagccacctccacgctcgtcggagctccttgctgccgggcgccctcgacccaacaggattcgggaggaggacgacctcgtgggccccgctcgccagccgtgtcccgcgcccgtcgcgagcagctgctcctgctcctcgttctgatctggatcgggagggagttctgatctcgcccgctgcctcgctggaccctgccagaatcgccgccgctgtccgaccggtcgccggagatgcctcgccgggcccgccagagattatcattcgatttcttcttcttttttgcctctgattctcttatgtctgatgtcaatcttttgacacacccgaggatccctctccctcgttgctcctcattgttctttcccttgtaattgctgattgatattacagatattttgcaaatgtatgtaaatttatgagaatcagtgtatgggaccgaggtgggactatttttaacaggaagctacagacaatgcacacaaattttagacacacggcaggcccagctaagtcaccgcgggttggatagtaaaaaacacacgttcctatttgaacaccgaaacattttcttggatattcccttgaaaaagat

SEQ ID NO: 135 - DNA, 1672 bp, Triticum aestivum
  Clone ID: PAT_TA_135
attctgataacctgttgtatgcactagaaggtgtaagctcaaggctttcacagctggagggtagaacacaccatcttgaaagttctgttgatgacttcaagctaacaattggcaactttaatggtagcactgatggaaaactgaggcaacttgagaatatgttgagggaggtccaagcgggtgtacagattatgcgtgacaagcaggaaattgttgaaacacagcttcatcttgcaaagctccagatacccaaaactgagacccagtcatcagaaaatagtggggttggacaggcagactcgcggcaccagtcagttgctgcgcagcaggcaggcgttcagccgcaacatcaaccccaaacttttcctgcccttcctgctcctaacgcgccgcctacacctccaacacttcaaagtcagcctccagcacagttcctaggtcattcatcggctccctctgtaccagctttaccacaggaaccctactacacaccatctgcccagacaactgaagctattcatcagcagtatcaagcccctccagttccacagccgcaggcgcctccagcaccacagcagcagtatcaagcgcctccagctccaccacagcagtatcaagcccctccagttccacaggcacatgcacctccagctccaccacagcagtatcaagcccctccagttccacaggcgcaggcgcctccagctccaccgcaacagtatcaaaccccgtctcagttttctcaatattcacaacaacctcagcctacaaatgttaacccttcaagtccacttgcacctcctgcaccccagcagacagagtatgcgccttctcatagctatacaccaaatgttcgcactccttcagcttacatgccgccgccaaatgaatcagccctgcctttctatggacagaatcctagcatgtatgaacctcctgccgtcaggcccaactctgggccaccgccatcctatggtgcccctgggtatgggccacagggaggaagtagcttttctgaatcatatggttacactggatctccttcttaccgtgggaatgctggaatgaagtccacaccttttgctccctcaggaccatcctctggtggtagcggcaacagctacggcaccaggctccccacagctcggatactaccacaagcagagccagtcagttccagcccaactgctgcatcgggcaacagggtggcccttgatgatgtggtagagaaggttgcgacgatggggttctcaagggaacaggtgagggcaaccgtgcggaggctgaccgagaatgggcagaacgtcgacctgaatgtggtgctcgacaagctgatgaacgggtgataagtcaagatgcggcgaccacgccgcactaccatttggcacagtttgtgtataatatttaaaatgacacgtcttgcgcgcaaaatatcagtgttggggcaagtatcaggtttgctgcccgctctctcggtcgctctgctttcttccatccacaggtgttgttaatgagtgaatatatataacataatcttgttctttccgtacatgtgatgatgatataccaaaaactcaactatggtttcttttgttctgttaataaaaaagacatttagtgtgtttcgtaagctaaaaaaaaaaaaaaaaaaaaacgcgaaactagttctctc

SEQ ID NO: 136 - DNA, 737 bp, Triticum aestivum
  Clone ID: PAT_TA_136
tcggcacgagggtagcacgctagtgcgtagtccgaccgccgcccaccactaacgtagcacgctagtacgtagctcgtctgtgcactgcactcatggcagcttcgctgggacttaccggccatgagaccagctacccggcccacccggcggcctcctccttgtacaacttccaagccggtgatcccttcgcggcagcggcgggcggtgccgcggagctgagcttcccggagctcgtggacgccgctcggccctccgactactcgctgcttccggcgttcggcgccgctggaggcgaggcgatgaacatgtacgagcggagtgtcgtcttccctgtgacgacctcctactactgcgacggcgcggggatgttcgacggcgacgcttcggcgagggcgagaggaggagggatcggtgctatggcggggcggccgtcggggaggatcgggttccggactcggtcggaggtggaggtgctggacgacgggttccgcaagaggaagtacggcaacaaggcgtccaacgacggctgcggggtgaacaactactaccggtgcgcccgcgacgacccgcgctacgtcctcaccacctacgacggcgtccacaaccacgtcacccccggcagcacgtcgtcgagggcagcgccggcgtactcggcgccgacggcgcccgcttggacctggagcgagctgcatgcggcggcgcactcctcggagtcctactgaacggagctactgatc

SEQ ID NO: 137 - DNA, 875 bp, Triticum aestivum
  unsure (1)..(875): unsure at all n locations
  Clone ID: PAT_TA_137
gcgattcctataactccataggatctcctccttcccgtcccgagctttgggctggcccggcatactccaactcgccgccacccagctcgctgcctattcccaagttctcactccaccagaagcgcagtgtatcgcttgagttgccacctgctgataggccagagcatgtggaggtgcttgtgcatgctaagtctgcaccttcgacacccactgctggctcaggacttggcttcttcggtgacaatgatactgccattgccacggagaatctgaggaggatccttaatttggaaatcaccgaggactgaatgccgggggcatcaccgtgtacataggtcatcagcaactaaccttgggtactttgtataaagtaacttagaatagcagccttccacctagattctgcatcaacaggagtactgttaggtgtgttagcaagcacatcatgactcgcgggaagctgccgtgaaggatgtggtggtggtggagactgttggggtggagagagcacagcagtttcagagtcaccttgtagcttgtgtgcacctatcgggttccaactttatttaacagatagatcttcattcccatccatggtcagtgatccattagtggttggtagtctgcgtgatcctagctagtaggaaactgcagcaggcaggggtagggtaataagttctgttctactgttagataactagagtttacgctccagcatctgttcccatcttatattctgtaggatgtctgcatattatattcttctgatacatacattctgcctcgccatcttgacactcctctcacaccgacttncctggtgctctgcaaagaacacaaggatctctcctcgctggctcttctgattttttgga

SEQ ID NO: 138 - DNA, 2667 bp, Triticum aestivum
  Clone ID: PAT_TA_138
ccactcgcccccccacccgcagcggccccgaacggcccccctccctcccctctcgcgaggcgcgcatctctcgccccgcctccaccggcagccgcagcggctgccagatccgtccgcccgccggccgcgcgaggttccacccgccgattccccgcatacgcttccctcgccgccggccggtggctcgtctgatcggagcgcgcgtgccctcgcgccgcaagcggttagggacggacgagagaagcgcggtgccgatcggcctggctcggacggacacctccgagcgcgcgccgcccaggctctggccgtccgatggcaatacggccagcagggcgaggaccattccgctaccaggatctccgccttcccctcccgcgctttggccccgcccggcatacccccactaccccccacccagctgccggccgattccaaacccctaccccgccccgcagcgccctgtaccgctctgactcgccacctgctgataggccagaccctgtggaggtgcctgtgcctgcctagccctgcaccttcgacacccactgctggctcacgccttgggctccttcggtcaccatgataccgccatcgccacggaggaagctgcacagggaccaaaagcgcaacagcgccatcccttgaatgatggggggatcaccgccttcccgtcctgagctttgggctggcccggcatactccaactcgccgccacccagctcgctccccctccccgagtccgcgcccccccagatgcgcagtggatctcttgacttgccacccgctgataggccagagcttgtgggggggcttgtgcttgccaagtctgcaccttcgacacccactgctggctcaggatttggcttctttggtgacaatgatactgccattgcctcccagcttctgtggagggtccgttcttcggtcccctccgtggtctgaatgatgggggcatcacagtgtacataggtcatcagcaactaaccttgggtactttgtatggggtggcttagtagtgctgccctcctcctagattccgcgtctttacggctccagcatctgttcccatcttacactccgtgactcgccggcagctgccgtgacggatgtgacatacatgctgcctcgccatcttgacactcctctcacaccttctgccccaccgctctgcaaagaacacaaggatctctcctcactggctcttctgtattttttggaatgaagaagccagtggaggttcaagaagccccccttcgatgcccttatcccatcatctgggaaactacatcaggcaggggtagggtaataagttctgttctactgttagatagctagagtttacactccagcatctgttcccatcttatattctgtaggatatctgcatattatattcttctgatacatacattctgcctcgccatcttgacactcctctaatcacaccgacttccctggtgctctgcaaagaacacaaggatctctcctcactggctcttctgtattttttggaatgaagaggccagtggaggttcaagaagccccccttcgatgccctttctccctcatctgtcaactgacttttatctacgcacctcccctcccaccttagtttgttgcatatgtagcatgtcagatcccctcccctgccatccaatcttcgttccatgcatataatctaaagttccatccagtggcaccttgtgtagattctgtttcttgttcatgttcatggaacatgtggaggttttgagttccgttggcatgtttgataaatggatgcgagattccattttcagagacctgcgagcggacaaaccataatacggttggcttatccagtgcacttcatggcgcacatacctggggtgctcagccgagtttgcaataaatctagttgcttgtttcctttttagttaaagagcagcgcagcttatgctagactgtttcctttcatgtaatgcctgcttggctagctgtttctggtactgtttaaaccttggacctagtggtgttccaccttctaagcagatgttgctgctttctttgttagcttcgcttgtttgagcgcataaatgcaagacctttaagttggtgttaaattctctggccaatgtcgtgttgtcgaccattcatgaagatcagtatgttttataatctagttggttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaaaaaaatttaactccccgggcttggaaagttaaaatttttttttaaggggccccaaaaataaaatcaggggcccgggtttaaaaaacggggaaatggaaaaaccctggggttacccaaattaatggccttggaaaaaattccctttttgccaagtggggaaaaaaaaaaaaagccccccccctttcccctttcaaaaaatttccaaacccaaaggggaaatgggaccccccctttaatgggcaataaaagggggggggggggggggttacccccaagggaaccctataatttgcaagggccctaagccccctttttttgggttttttcccttcctttt

SEQ ID NO: 139 - DNA, 842 bp, Triticum aestivum
  unsure (1)..(842): unsure at all n locations
  Clone ID: PAT_TA_139
gggagagaaggcgggggcggagccaccccccggagaaccgcaggccggcggcgaggaaggcgaagacgaaagcgtcgaccatggtggtccggatccggctcgcgcggttcggctgccgcaaccggcccttctaccgggtgatggccgccgacagccgctccccgcgcgacggcaagcacctcgaggtcctcggctactacaacccgctccccgggaaggatggtggcaagaggatggggctcaagttcgaccgggtcaagtactggctatctgttggggcacagccatcagatcccgtgcagcgtatcctcttccgtgccggtgttctgccgccgcctccgttgctagccatgggccggaagggtggacatcgtgacaggaaccccattcatccgatgactggccgtcccttggatcttgagggtgtcacgattgtcgatgatcccaatgctgctgaaggtgatgctgaagcacctacagaaccttcgttggaggcgtgatagattttctgttctggcatatggagtggtgctgcaaggcaaaagaatttgtttgttgtgcttctgttaagatcatgagcacgtagtgtatgatcttcaacaatttcgtcatgtaactctgctttgttagcctttgctgcaccatgggttagccagccgtctccagtctactacgccgtgtcctaatatggttccttttgaatggattatgcaatttctgcattccttttggatgctcaagttgacaaataataattcaagtaaagtgctggactgggtgccccaaccctccgcgttgctggcgcgtgtgcatgtagataatctgcgcggatcaaaaaaana

SEQ ID NO: 140 - DNA, 749 bp, Triticum aestivum
  unsure (1)..(749): unsure at all n locations
  Clone ID: PAT_TA_140
actccacttttccccacacacgcgcgcgaatgatcccaaggcggcggagcaacccaagcattcccatggctcgcacctcctcgcagtcgcagtcctcggtcgccggcgccgccggcgcctcccgcccggccaccgtcggtccccgcggcacggctgccgcgacggcgggcatgcgccgccgcccaggccgcacctcctcgtccggcgcgggcggcggcggcggcttctccggtggtgggaacaacatgctccgcttctacaccgacgaggcgcccgggctgcgcctctcccccaccatggtgctcgtcatgtccgtctgcttcatcggcttcgtcaccgcgctgcacgtcttcggcaagctctaccgctcccgcaccgccgcctcctccgcctccgcctgatcggctccgcaggcccgcccggtggtgaccttcctgcttcttcctcttcctcagctcagatcagatcagatggttttggtgggtaacaaggatgatagtttttgttgttgctgatcctttctgggttagatctgccaaagatggcttttgtgtgtaacagatccaagaggctagccttgcttcatccttacttccccacttagatctgccaagcaactttactagtttaaattatggtgcccttctgtttctgtctaccttgttgcgatgaattgtggctaatcacctgtgaatttgcaatcaccatatatgatgtgtgccttgtggcacccattatagttatnaaaa

SEQ ID NO: 141 - DNA, 771 bp, Triticum aestivum
  Clone ID: PAT_TA_141
gcacgagggtccgttctgactagagagggcggatgagacttttctttcgatccgcaggagatcccgacgagaaggcgaaggcgaagccggcggcgcaaccgaagcccctcatggcccgctcgtcctcgcagtcccagtcctccgtcggcggtgccggcgccgccggatcccgcccggccaccgccgggccccgcggcacgcccgccgccacggccggcatgcgccgccgacccggccgcacctcctcctccgcgtccggtggcggaggcttctccggcggcggagggaacaacatgctgcgcttctacaccgacgaggccccggggctgcgcctctccccgaccatggtgctcgtcatgtccgtctgcttcatcggcttcgtcaccgccctccacgtcttcggcaagctctaccggggttccccaccgccgcctccgcgtccgcctgatcaatccggttcgctgctcctgtttggtcttcgtttcagatcagtatcatgatggttttcggtgtggtaacaaagtacggctggtggttgctacctgaaacaagttagagtctgtccgaaggacccatacatgtttaattatggtgccctttctgattcaatttaccttgttgatgcgatgaattgtggctaatcacttgtgattgtcaattgaaataatctgaagtgagtgcttgttgaagtagtgggccacaaataaaaaaaaaaaaaaaccacaggggaaataaagccacccactggcttcttcccttccgtaattaagt

SEQ ID NO: 142 - DNA, 623 bp, Triticum aestivum
  Clone ID: PAT_TA_142
cgtccggtcattgcaaggacgaaggacaaagaaaaaatggcagatcttcagaaagaggtagacatgtatgatgactttttgtttattgatgctgatgagggtaagaagcccccagagaagatgttagcatatttcaaagcagcttatgacatgttccacgcagaattttacgtcaaagctgatgatactatctatctgcgcccagatagacttgctgctctccttgcaaaggaccgacttcatcaccggacttatattggttgcatgaagaagggaccggttgtcagtgatccgaatatgaaatggtatgaaagttcatatggattattaggtaatgagtacttcatgcatgcatctggttcactgtatgctctttcttcagaagtggtgggagctatagctactacaaacaatgatagtttaaggatgtttgattatgaggatgttactattggctcatggatgcttgccatgaatgtaaatcatgaagacaaccgcgcaatgtgtgattccacatgcactcccagttccattgctgtatgggacagcaagacatgttcaggctcttgtaaccccattgagaaaataagggagctgcacaacacaactttgtgctcaaaaag

SEQ ID NO: 143 - DNA, 742 bp, Triticum aestivum
  Clone ID: PAT_TA_143
acccggccgaaaaacccgaaccctcgaccgccagacgaccacggtctgccgtctcacggcctccgaaagtcgacgatgaggcacacaagcatcacggcggcggtcgccgtcgcattcgccgtccttgcagtcgccgccgcagcgtccacgggcctcaccgccgccggcagggggaagcagcagcgtgctccaggcccggcttccggcagcagcgtgtacatcgggatggtgaagcccccggccgtcgccgccgacagcgcggcctaccacatgggcatcctcatcgccgcggtcggcagcgaggacaaggccaaggcggtgttggtctacagctacaagagcgccatcagcgggttcgcggcgaggctcacccccgcgcaggtcgccgtgctcaggaaaaaccctaccgtcatccgggcgcagcctgatgtcaagtactcccttcacgacgacaacaacaacaacaacctcaactgagcaagagctcttgtccagttattaagagttgttgcgcaatatgaaacgagaagcggcgcgcatgatctgccctcgaaagaatcttgtgtggatctttctctgcatacttcaaaattacacacacacatatatagtgtaacgttgcaagaagtttatagtgtaatttgtttagaattgttgcacttgtataactctgtctgcgtatatactgatgggcaaagatgtctggtttgctaccatattatattcctacatattttctctg

SEQ ID NO: 144 - DNA, 1151 bp, Triticum aestivum
  Clone ID: PAT_TA_144
atccgccgccgccatgaccgacgcgccgtccgctcccgccggcgactcgcccccgccgccgcagaagccagagagcggcggctccatctcctccatggtggcctcctccgcgtcctccgcggcggccgcggccgcggactacacgcgccggggcgaggccttcggggccgacctggccgccgccgccaggaccgccgtcgacaccgcccacgcgcacgcctactcctccgccatcgccgcgtccgacgccgccaacgcggccatggccggcgcgctcgccgccgtccccaccctcacccaggccgcaaaggaagagtttgaatgggtgaagaaggagtactttgctcgtgagcagatggcgctgggcaagatcaaagagggtgtcatcatggccatcgagcatccaggcatcgctgcaggctcagccacggttgcaggaatcgtgctgctcaaaaggccaaggagctacctaatccaacgtgtacggcgtgtatttgtcagcaaggagaccctactttctggcatccaggctgaagtgaatcacatgcggcaaacagtcaatcttatgtcgaatgaaagccaaaaactgatggatcgagctgcaacagcagaaaagagattccagaaaggatggaatacactcagggaagaagggcgtgccattcaaagtgagttgaagcaaattagtgatattgaaaaccaagcagtaggtctcaagggaattctcgatcagcttccaagagcacatgcatctgaatttcgatcagagatttccggcctagcctctcaggtcaagaaggagaagcgtgtgctcaactccgccctgacgaagattgtgaattatggcgtccctatctaaccgtcttcaccatcgtccctgcggccacatttcttcttctttttaacctcaaggaacatgaagtgcaagccattggcggatcttcttccgcagaaaatatcttcccatggaatggaagaaacaataagttttgtcactcctgtaaatgcgcttctgctgcgctgaattctgaccagcaacagatgacactctgcggtatctttgttcatcgacattggttgatgttattttaaatatatattttggtatgatttgcaaaaaaaaaaaaaaaaaaaaaaaaaaaaaaaaaaaa

SEQ ID NO: 145 - DNA, 761 bp, Triticum aestivum
  Clone ID: PAT_TA_145
gcagcaccggactgtggttaagggtagtatctgtcacatgaaaagagcactctatgatttagtgaaggaggagaacaaccctgttgggtatgggatgaatctcatgcaagtaaagatcgcgagtgagaaagggagctctggtattggatggcaggggaaatgttattgggatcctacatggaggcttgggaggtccattctcttactttgtcttgctctgtcgcatactaccgttcctgagaaaatatggcatagatccgtgtgtggggtagtaatttgtccatgctcattcctgtccagaggacatgccactcccactgctattggtgtttcttgacagcaatgttggttccgattgcttcattggcaagtacatgcacaaatggagaccaccctgcagcagttcataaagttggagtcaagttatctctctgttgacaaacattatcttacgtcgctctctggtttgaactccatgttaggatacactacgtgacgtttctgtcttatctaaaccgagctctgccttctgttaccagttgagtttatgagttacggggtccacagggccaaccttaggcatcgatgctattttgcttaagatatactcccttcgctccaaaatagatgacccaactttgtactaaagttaatacaaagttggttcatctattttggaacggagggagtacgtatgactttctgcatggtcagttcttttttctgggtttaatctgaatggtatccccgttggtattgac

SEQ ID NO: 146 - DNA, 816 bp, Triticum aestivum
  Clone ID: PAT_TA_146
atgtgaagaaaacttgttaattctcagcctggataacatttcaacgacaaaacagcctgctaacaaggccgcatggaagtatccatgtatttacatctcaagcaagttgcaagttactgcctccaactccaaggccctgaaccgaaccgctgcagaaccacctcagtcccatatcgtcgccgccttcttcggcgtctgcatctcgctgtacggcgccccgccgctcctggtgaccggccgaccagaccggagcgctggcgccagcggcgccgccatgtagctgccgcctcgcgcgtaaccgccacgcgtgtcgtacctcccggccacgccggcgtggtgcggcacgggcacgggcgctggagagtactgcggctgtgggctgcggtaggggttgtagctagcctgcgagaacatgtggccggcgcccgggtgcaccggcgagccgctcatgtatccagccaggcctacggggctgtccccagctgcggtatggaagggcagcggtgccgcgttctatgtggccgccgcccgggtgcacgggcgagccgctcatgtatccagccaggcctccggggctgtccccggcgtggtcatggaagggtagcagtgccgcgttcaggccgccgaggttgggcgagctccggacgcgctgcatcccgccgcggaacacggcctgctccacgatgttggcgcgcggggagttacccgccgaggcgacgccgttgggctggtccgggtacggcgggcttccgtcgggcgtgccgggcaccgaggccccgtagcgctcccgctccggctggaggtggtggtggtggg

SEQ ID NO: 147 - DNA, 767 bp, Triticum aestivum
  Clone ID: PAT_TA_147
gcattttcgggccacatggtaactacgaagccgtcaactggttcttcctcatcggcgcagcaggccctgtcatcgtgtacatcttccacaggatattccccagtcagaggtggatactgatgataaacctgccggtgctcatcggcgctacagccaacatgccaccatcgacggccgtgaattacaactcatgggtgctgataggcaccatcttcaacttcttcgtgttccggtaccggaagaagtggtggcagaggtacaactacatcctctctgccgcgctcgatgcaggcgtcgcgttcatggcggtgctgctgtacttcacactgaccatggagaaccggacagtcaactggtggggcacggcgggtgagcgctgtcctctggcctcatgccccactgctaaaggggtggacttgggcccggatagtgtgtgccctgtgttctaagctaaatctctttcaccctcaaggtacagctacaagattagtcatgatccattcgagttgtgtgagtgtaatagtatgatcatagatttctattgtactctccaccaaaagagagagagaacaaagcttctagatgcgtgtaaactgtaaaggtcgtagtcatccacgcgaaagagaaaagacaataattatcagccgcaatgcgagacaatcagtcttgggcaacacaaatgcgtgctagttctggaaccctataaactttgacacttattccaaaaataccttttagagcaaaaaaaaaaaaaaaaaaggccccta

SEQ ID NO: 148 - DNA, 804 bp, Triticum aestivum
  Clone ID: PAT_TA_148
gtgcggcgctcaggcggcggttcaatcctcccatctcgtctctccttctccctcacccagcgcctcctccatctcccggctcgtccccaagcaactgccctcgaggagttccccgtccccgtcgccggccatgctgctacgctgtctccctctccttccttcttttccctgtggttcttcttccactaacatctgtctctctcttgtttgctgctgaacgcaggacgccgccgctcctaccaaatccagccgccgccggatctgcctccaccggaccagatccgtccggatccggctgccctcgaccgtcctcgacctcatattctcctccagtcgcctgattgatgcgccgccgacggatctgcctccactggaccggatccgtccggatccggacgccctcgaccgccctcggcctcgtctgcgactcctccgtccggattctgctgtcctcgaccgtccccggcctagtttgctcctcccgtcgtgtgatttgatgccccacctattcgatttcttcgatttcgtggtgttgcaatctgcttttctttgatcgattatttgatagaccgaatccttcccttgtgattattctcatctctgtgtcctgatttctgtggtcgcttgttgaatcatcaacgtctacctatatgaaccagtcagattaggtgtaaagaaacgatgtggttttattacttggccaagtcataataccacatctcgtacccccttctccctcacccagcgcctcctccatctcccggctcgtccccaagcaactgccctcgaagggggggcccggta

SEQ ID NO: 149 - DNA, 454 bp, Triticum aestivum
  Clone ID: PAT_TA_149
gccggccgggtcgggaacgcggcgctctgggaggagtccgaggccgaagaggacgacgacggcatgtcagagagccccgctgccgagaggatcagagcattggcatcccctccgtcggcattcccggactgggactcagacgaaggctggatcgacgtgctcagcgacagccgtgaagctcgcgatgccgccgccgaggacgagcgcgcatcatcgggcgaagtagctttcgaagcggaggccgaattcttcgtgtctgcatacgtggaggatgccgatcgtgttggcactgtaggattaactgctctctcagtctcagctgagcagcagaatgacttctgctcgggcctcttgagtgacccacctgtatttcctttgagcagtgccttccttgatgaaagtggaataacagaatcgttattgcatcgaaaaaaaaaaaaaaaaaaggccccta

SEQ ID NO: 150 - DNA, 739 bp, Triticum aestivum
  Clone ID: PAT_TA_150
gccggccgggctgcgaccatcctaaagctccatagctgcttctcttcctagctaatttagtggcagcgagaagagagagagagacacacatgtactcagagtctcagagataaccggactagagtcatggccgccgtgattgcaaagctcgttctgccggtgatcgtgatggccttggtgttctcggcggtgctcggctcggcgcggccgctggcaggagagaaatggggcgccggagactccgtcgtcggattcatccggcaggtgtatctccagcagctgcaaggggagccaggggcaaaaccctcgtgctcgacctggagcccaaataacaggtgcccctgatagtctgcagaaaccggcgagaggaagctggtgatgcagagaccggggtactccccttttcgaaaaaggcaaagaaagtggtaatacatttgttgctttgttaatcggattgtaacatatatacagatgtctttaaaataactcagttgttctttataaatctatacttattgtaatttgataggtaatgtatataaattttatagggtatgtatataaagacagatattattgtttcttttggcaagattttaaggcccttgttgacagtgtaccccgtagagaaatttgttcaggtggatggcaacggtagagaaatagtattacagtggaaatttatagtacaattatgtacttctgtttgcttctcaaaaaaaaaaaaaaaaggccccta

SEQ ID NO: 151 - DNA, 701 bp, Triticum aestivum
  Clone ID: PAT_TA_151
ggccgggcacatcctaaagctcctagctgcttctcttcctagctaatttagtggcagccagaagagagagagagagacgtactcagagataaccggactagaatcatggccgccgtgattgcaaagctcgttctgccggtgatcgtgatggtcatggtgttctcggcagtgctcggcgcggcgcggccgctggcaggagagaaatggggcgccggagactccatcgtcggattcatccggcaggtgtatcttcagcagctgcaaggggcgccaggggcaactccctcgtgctcgacctgggacccaaataacaagtgcccctgatagtctgcagaaaccggcgagaggaagcagatcatgcagaggccggggtacttcccttttcggaaaaaaaaaggcaaagaaagtggtagtacatttgttgctttgttaatcggattgtaacttatatacagatgtctttaaaataactcagttgttctttataaatctgtacttattgtaaatttgttcagggggatggcaacggcagagaaatatcacagtggaaatttatagtacagttatgtacttctgtttgcttttcactcttttgttctgcgtatgaaactattgctcttttggtagtagtagtagtaacaaaattaatgtttctccagtcttcaggttttgaattcagttcaagttggcaacccagccgc

SEQ ID NO: 152 - DNA, 410 bp, Triticum aestivum
  Clone ID: PAT_TA_152
gccggccgggtcgggacctgaccgacctactatgttttacgcaggcgatggagtttccgatctctctgccgctaaggaaaccgacttattgttcgccaaggctgataaggatctcgtcacctggtgtgagaacgagaacgttccctttgtcacattccgtgattggtctagcatcactcagaccgtcaaggacattgcggctggcaccgtatctgtcaaggatgctgcccgcggtcgtatttaaatatttttcttgtgatttagaaggagatggaatgctttagtgtctgtggttgcatagaggcatagaggataaagaattagatacaactatctacacggattatatgatagatcttgtatagattttgggtagaattggccaaaaaaaaaaaaaaaaaaggccccta

SEQ ID NO: 153 - DNA, 664 bp, Triticum aestivum
  Clone ID: PAT_TA_153
gccggcctggccggccgaaaaaaaacaacacatcaatcaagcaagcagcacattcttgagagattctgaccagtctcggactctcagggaaggtagagactgcctcgtgaactcactggtttcgtgtgatcaagagctcgggcgttaatcagttgacatggagttcgaaatgatgagccaacaaggggcgctgctcaaagtggggctgttcgtgttggtgcaggcgctggtgtacctcatccttgcccagtcctcctcagtcttctccaccaccaagaccctcggcctccccccggcgcgctccctcagcgcccgccgcatggtcgcgctgatctccgacctgccgctgctgctgggcggcgagccctcgccccgcgccgtctccgtggagccgtcgtcgcccgtgcccctcgcccaccagaagaaggattcgttgttaaccaagcgcgactggcggcagggacacggaccgagctagcaagcgatcgttgcccagctacgagtactcggtgcgtgctgtaggagctgttcacgccattctttgatagattggttattggtttgttctttgggattggatatggaaactgagttacacgcccgtttgggtttgcacaatcaagtgaccgtatgagatcaaaaaaaaaaaaaaaaaaggccccta

SEQ ID NO: 154 - DNA, 847 bp, Triticum aestivum
  unsure (1)..(847): unsure at all n locations
  Clone ID: PAT_TA_154
ggcgggacaagcagctgaagacggtggggaccaacgagagcagcgagatcatccggatgctcaacgccgagttcaacgacatcgcggagaaccccgggctggacctcaacccggcgcacctccagggctccatcgacgaggtcaacggcctcgtctacgacgccatcaacaacggcgtctacaagtgcggcttcgccaagaagcaggggccatacgacgaggccgtcacgacgctgtacgaggctctggacaagtgcgaggagatcctgggcaagcagcggtacatgtgcggcaaccagctcacggaggccgacgtccgcctcttcgtcacgctcataagatttgacgaggtttacgccgttcacttcaagtgcaacaagaagctcctgagagagtaccctaacctgttcaactacaccaaggacatctaccagatccccgggatcaacagcacggtgaacatggagcacatcaggaagcactactacgggagccacccctccatcaacccctacgggatcatccctcaaggccccaacatcgactacaatgccccacatgacagagagaggctgttcctgtaaaaagaaccaccgtttgcttgtgtacttgggatgctgtgatgtgatttgctttgcttgtgtccgaagctgaaaggtgaaagcctttttctcaaataatgatttttgtctttgctgtgcgctggttgtggtactgggagcagcatgcgtgtaataaggttctctgcatccaaaagaaaaaaaaaaaaaaaaaagtaacctacnnagggaaacccnggtacaatttaccctganaancctttccanngggaaanganggcccccng

SEQ ID NO: 155 - DNA, 1006 bp, Triticum aestivum
  Clone ID: PAT_TA_155
aaaaaacttttacttcgcatgcaaggggagtaaaacttggatcctctaaaccggcccctggagcgcatattactcttattatatacatctggtgcattccattcggaagtgcatatgcacacttatttatgcttgctacattaaaagtttccacatttttttttttttttttttttttttttaagatgggtcacacatctatataaagaagagaacggattacattattttggagcgcatattactcttattcatatacatctggtgcactccattcggaagcgcatatgcacacctatttatgcttgctacataaaaagtagccacaaacacaaatctggtccaaagaagggaaaaagccaacacacacaattgcagagcattaagtcaactcaagagctccttcccgaaaagcccagcaatggctcgcccaggatcttcttccttgatcagggactctcctaccaaaacagcagaaacgccagcactatgcacatatgcaacatcatcgggagtgaacaggccagattcaccaacaaccaatattcccttctcctttatgatatcaccacgcttctccatcaacatccttgtgtttgaagtatcaactacgaatgtctctagactacggttattgattccaataagctcaacaccatctattctgagcacgcggtccagttctttctcatcgtgaacctcaataagagcagtcattccaagatttttgcaaatgcgaagcatgtacttcatgtcaagatccggtagcacagcagcaatcaagagaatcgcatcggcgccctttgatcgtgcgtagtagatttgccagatatcgatgacgaactccttacacagaagagggcactgcacacccgaattgcggaccgtttcaaggttctcaaagctcccctgaaagtgcttctcatccgttaggatgctaaggcaagccgcgccgtttttctcgtatgcctgcgcgatctcaaccggattgaagttctcccttagc

SEQ ID NO: 156 - DNA, 630 bp, Triticum aestivum
  Clone ID: PAT_TA_156
tggcgatacctcgcttgttccgccatcttccgcggacgtctctcaacaaaggagatcgaggaccagatgctcaaggttcagaccaagaactccgagtactttgtcgactggatccccaacaacgtccaaacttccgtctgttccgtgcctccccgcggtctcgacatgtccgccactttcgttggcaactccaccgccgtccaggagatcttcaagcgtgtcgacgaccagttctcagccatgttccgacgcaaggctttcttgcattggtacacaagcgagggtatggacgagatggaattcaccgaggcccagtccaacttgcacgacttggtttccgagtaccagcaataccaagacgccgacatcgacgacgaggctgaggagtacgaggagggtgagcccgaggagtacgagggttgaatattggttgggaacgttggttaacatcatgactatttggtttatatcctcactactaccctcaaaatgtttctcatccccttcctcgttatacacacatttaaaacagaaattggttcaccaggcctgactaaattggccatattaataacaggcgtgtttttaagcacgatttctaaagaaaaaaaaaaaaaaaaaaggccccta

SEQ ID NO: 157 - DNA, 602 bp, Triticum aestivum
  unsure (1)..(602): unsure at all n locations
  Clone ID: PAT_TA_157
gccggccgggccgggatggagctatacncaaatcggagctccaacttgaacctctcttgaacaatcgtggttctcttttatcgtcccttgacaaacacactacagaatcaaacaggcaaaatgtttcgcttccgcaagacactcgatattgtgacggtctttcacaaggccagctctccagcatccgtgagagtcgcaaaccttctcaagcaggtctccgccaacgcatcctccggcgccactcttgaccaagcaagcgatcattctgcccagaccgctcctatccgagaagaatttgagctcaatatcacagaggatgccccaacagaagaccaagttaagacaatcctggaatatgttggaaccggcggcatccacaaggtgatcaatggcgcaaacaccgagaaggatgcgctcaagaagttcaaggaaagtaaggagaacttcgtccgaccggtggttgtagactggaacaatggcaaggccattgctggcgaaaacgagtctgagattctcaagcttctcaagcaacaacagtagtggtttaactttagaaaaacttcaaaccctaccatatgcccctctttatatacatgttacct

SEQ ID NO: 158 - DNA, 753 bp, Triticum aestivum
  unsure (1)..(753): unsure at all n locations
  Clone ID: PAT_TA_158
tcctaatggtatcgttctcgnagactatgtcattgagtatggggatgatgatactggagacgactatgaagtgctccacagggttaggaggaagtggtggtcttttatttgttgcaaggcattttgtagatatccaagaagccgaagaagagggagaggaagggacagtagaggaagtggaaggaggaacagcaatcaggctcatctggagaacttcaatctcgaggttccgacacaagctgttgacctgagggaactcagatttgatgaaatcgatgatgagtacattgtcacaggggccgtacctagtatggcaacaccaggaagaatggccagtttccattacagggatacaagatatggtcggtgatcgggcgtactacttaacagaaccagctgataaagaaaaggatttgcagccgcgatgtgatgccgcagccttcaggaaactccacccccgcccatttttcgtttcttttcccgccccggtcgttgctaggcgccgctccagcccggacttcctgtgcataaaaagtagcaacagaaacccttcgccgccgtcctcgttcgtttgcaatagatttcatttaccgtagcttccattctgtatatatttagcacccatcttatacagtgatgccggtgaaaagcctttttttctcttttttggaaatggatctcacctcctgccgcaacgcagcaccagccccccgcgcctaccgcggctgcanttggntggagaaaaaaaaaaaa

SEQ ID NO: 159 - DNA, 602 bp, Triticum aestivum
  Clone ID: PAT_TA_159
ggagctgtctggtgttaagatctctgagccagagtttcagggcactcaggtgccaatggtggcagtggtagaaaatggcatggatttggatgaggcaaaggtggaaaagaagaggaagaagatgaaggcaaagagggctgcattagttgaaggtggggaggaggaggaggtcaaggctctgaagcaagagaagaaggtgaagaaagacaagaacaagaaggagaaaaaagaaaagaagaagaaaaataaggttgaggatagtgatggaggggatagcagtgagcagagtatagatgccacatcagaggaccagcagatgggcgatgacactgatgccattacatttgatgaggctttgatgtccaatcttcaaaagcagtttgagaaggctgctgcagaagccgggatgccggtgacaccagttactgctaaagtggcaaagaagaggaaccgctcaaaatcttccgataggtcatcagaagtttctggtggaggtgttggcagccaaggtaatgttcctgctcaggatggagataagagtggtaagaagtgaggttctcaatgaaagagtatctagtttggaaccctcctactctttacca

SEQ ID NO: 160 - DNA, 925 bp, Triticum aestivum
  Clone ID: PAT_TA_160
gtgggacgaggagaaaaaatcaaggctccagaaaaataaggttgaggatagtgatggaggggatagcagtgagcagagtatagatgccacatcagaggacgttgagatgggtgatgacactgatggcagtgagcagagtatagctgcctcatcagaggaccagcagatgggcgatgaccctgatgccattacatttgatgaggctttgatgtccaatcttcaaaagcagtttgagaaggctgccgcagaagctgggatgccggtgacaccagttactgctaaagtggcaaagaagaggaagcgctcaaaatcttctgataggtcatcagaagtttctggtggaggtgtgggtagcgaaggtaatgttcctgctcaggatggagataagagtggtaagaaagtgaggttctcaatgaagagtaatctagtttggaaccctcctactcctttaccaccacagtgcttgaggctcccaccatctgctactccaagagggagtgcactaaaaagtggagtccggcctgggcctataaaggaaagctccacgccggtgaagaaggccaaggcaaaagcaaactctgcaaagaaactgttgaagaagatcccttcctcggctgtggagccttcgcggaagttgcaaaccttatcacgagttaatcccttgcctgtatgatggcatgtccgccgtacgattctgcactttaaaatgtgctatcatcataactagtttcttaaccagttagcgtagtcttctacactgtcggcttgctgtttttgcattatttatggattgcttaattaatgcatgatggcatgtaggccgtaccattctgccttttaaattgtgctctcatcgtaacttgattcttctccattaagtagtcttatacactgttggcttgctgctacctttgcattatttatg

SEQ ID NO: 161 - DNA, 997 bp, Triticum aestivum
  Clone ID: PAT_TA_161
gccggccgggaacaacattcagcacccacccatctgcaggtcgcacgcatccatcccgtacctgtccgacgagggagaagaaaaaaatgctgcgccacgccgtccgccgcctcgcctcccgcgccgccgctgccggcagcggctccatgagccgcagggccctcgcgacggcgcaggcgcccgcggaggcgggcgaggaccccgccttcctggaggcgtggaagaaggtgacaacaatcatcgagcccccccagacgcccatgtcggccatgaagccccgcccgcccacgccggcctccatcccctccaagctcaccgtcaacttcgtcctcccctacaagtccgagatcaccgacaaggaggttgacatggtaatggtaccggctacaactggcctgatgggtattttgccaggccatgtttccacaattgcagagctcaagcctggtgttatgtctgtacatgagggaaatgatgttacaaagtactttgtgagcagtggctttgcattcatccatgcaaactccattgctgatgttgtggctgttgaggctgtcccccttgatcagattgaccaaagcttggtccagaaaggtcttgctgaattcactgccaagcttggatcagcctcgactgacctagagaaggcggaagctcagatcggagtggatgttcacagtgcgctcagtgctgcattgactggttgatgatgacatcttacatttttatgtccttttcatccgcatctttagaatgtgagtcgaagtcggcaaactcatgaacgagggtggagggaatgatcttaaataaattatactccatctcaaagaaagacttgtttcttcctgcgaggatttttgtaatggtaatattttcctgtgttccaaaatccagtgccgccttcggtttttatttcttcatttcaaatggaattgattgatttccatttcataattgcagtcaaattgtcaaaatataatcaaagttattttttttc

SEQ ID NO: 162 - DNA, 1052 bp, Triticum aestivum
  Clone ID: PAT_TA_162
gccgcacgaggccaattcattcagcacccacccacccgcacgtctgcaggtcgcacacatccatcccgtacctgtccgacgagggaggagaaaaaaaaaatgctgcgccacgccgcccgccgcctcgcgtcccgcgccgccgctgccggcagcggctccatgagccgcagggccctcgcgacggcgcaggcgcccgcggaggcgggcgaggaccccgccttcctggaggcgtggaagaaggtgaccacaatcatcgagcccccccagacgcccatgtcggccatgaagccccgcccgcccacgccggcccccattccctcgaagctctccgtcctcttcgtcctcccctacaaatcaccaacaaggaggttaacaggttgacatggtcaatggtaccggtctacaactggtatgttgccagggtattttgccccaggccatgtttaccacaattgcaggagctcaagcctggctgttatgtctgtacacaagggacaaattatgttacaagagtactttttgaccattggatttcatccatgcaaactccattactgatgttgtggctgttgtagggctgtcccccttggatcatcattgaccatagcttgatccaccaaagcttggcttccattcaaaaggtcttgctgaattcgcttccgaagcttagcttagagaaggcggaagctcaggatcggaggtggatgttcacagtgcgctcaatgctgcattgactggttgatgatggcatcttacatttttatgtacatcttacatttttatgtccttttcgatccgcagcttgcaaaatgtgagttgaagtatgcaaactcatgtctgaagaaagatgtaattcatcttaaataaattatactccttctttaaagaaagacttttttttcttcctgcgtggattttgtaatggttaatattttcctgtgttccaaaatccattgctcccttcagttttcatttctcagttgtgactaaaatcaaatggaattgattgatttccatttcataattccagtcaaattgtcaaaatatattta

SEQ ID NO: 163 - DNA, 900 bp, Triticum aestivum
  Clone ID: PAT_TA_163
cggcccttgtcttgctgcggcgcgctgtggccgccgtgggccccgcggtcgcctcctgtcgtccaggccttgtgccccctgccgggctggagcccgtcgtggctcctcctggcgtcagcttctccccagcgggccgcggctccgccgcgttctcggcggcggccgcaagggcgcggtagacggtcgtgagtcctactacctcgatctcgacctcccgtcaatcgccgtgccagaccttgaagacaacggcgtgcctcagcacagtgtgactaacgttgggtcgggggaagcaacatatcatttagtggttgaagctcaagctgggatacatctgtgcgtatggccatctataattagtttcatcaaaggaagcggtagaccctggcttggttcacgacatggatccaatggcgtacaacaagtttttcaactgcactcttggatagactaacattgggccagcggaagcaacatatcatttagtggttgaagctccagcggggatagacgtgtccgtagaagcgcgacatttatggttacattcacaacaaggcagagagtgcaaggaggatacactttcgggagcttgacatggtcagacggaagtacccactcagtgagaatcccgattgctgtacggactgtgatacaagactttgttgcggataccgcttaaactcgtatcttgcttttgtacaccttctttgtgtattcatgtaggccgcgtacataaatgtaggagaaacactcagtattgaatttgtacatcataaaaaaatgttatactgaaaaaatatgattcttcttcgcaaaggtgtggtttcttcacaaatttgtataaaaattgcagttaataagcaatgtcgggtcatacaaaaaaaaaaaaaaaaaaggccccta

SEQ ID NO: 164 - DNA, 471 bp, Triticum aestivum
  Clone ID: PAT_TA_164
attccgcgggtgcgacgccacgccgtaccccacgcgtccggcatctcccgcggagcacacatctaccggcaatggcggccacctccatcggcgtcttcgccgccagaccgtcgccggctctagggctgcctcggctgagacttgccagggccgaggggctgaggtgcagggtcagcaagaaggcgtcttcggctctggctccgatggtggccaagggcgcgccgctgctctccaaggcgagcggcatggcgtcagcagccccgatgctggcctcggctctggcgctggtagacgaggggatgtcgggcgagcgcgccgggcagagcaacgacctgctggggtgggccctgctgcttgtcttgggcctcgtcttgtgcttctacgccgtctactccaccaccttcgacgacgacgacgaccggtcaggtggcggcggcatcatgctctgcagtctcgacaccaccaccatct

SEQ ID NO: 165 - DNA, 686 bp, Triticum aestivum
  Clone ID: PAT_TA_165
atcctcatcgtagcagcaaatagcacaggaagcaacaacacttggagagagaacccgaaacacacacacacacacacacagggggagggggagagggagagtggctgaggtgatgatgtggtcttcgagcaagcaacaaggaggagaccgagaagaatggaagcagcacaagatggtaaaagaggtgaagaagagtgagacacccatcttcacgtatcagctccccttccattctctcccccttaacaaagtcaagaacatcgaggtcgaccgcctgaggctgtccttcacgacgccgaaaaattctacgctggtccccgttgattccggttctgatgaagagagtgacgaagatcaaggctgttcggacatcgattctgataagcctatggacgaagtgttagatcacatctgttgtggtctgcatgctattccccggaaaaataaagcaagatcggccaagaaaagatcccacaagctcagctctaggaaattctacaaaatattcagctgagggccctttttttggagtgtacaagggatctcgaggactggctgaattcagatagcctcctctttggtcaaagtgtacagtttagatttcattgctgattctccatacattgtaaaatttgtacgcgcatatgtatagcttctgatcttgaatagtaatcatcttgtttggc

SEQ ID NO: 166 - DNA, 809 bp, Triticum aestivum
  unsure (1)..(809): unsure at all n locations
  Clone ID: PAT_TA_166
gccggccgggccggggaacatagcagcaaatagcacaggaagcaacaacacttgagagagggcccaacacacacacacacacacacacacagaaagagagagtgcctgaagtgatggtgtggtctaccagcaagcaacaaggaggagagcgagaagaatcgaagcagcacaaaatggtaaaagaggtgaagacacctatcttcacgcatcagctctccttccattctcttccccttaacaaagtcaagaacatcgaggtcgaccgcttgaggctgtctttcacgacgccgaaaaattctacgctggtccccgttgattccggttctgatgaagagagtgacgaagatcgaggctgttcggacatcgattctaacaagcctatggacgaagggttagatcacatctgtagtggtctgcatgctattccccggaaaaacaaagcaagatcggccaagaaaagatcccataagatcagctctaggaaattctacaaaatattcagttgaggggccttttttttggagtgtatatgggatctcgaggactggctgaattcagatagcctcctctttggtcaaagtgtacaatttggatttcattgctgattctccatacattgtaaaatttgtacgcgcgcatgtatagcttctgatcttgaatggtaatcattattacgttttgggcaaaaaaaaaaaaacaggtccatgcgtgtagcgcagtccgcctcaagaaaccttgctgccgaccgaaaaaacttggacttggaaaatcgatgtatggtnnctttttacgtgggatatttcttttat

SEQ ID NO: 167 - DNA, 728 bp, Triticum aestivum
  Clone ID: PAT_TA_167
cccacgcgtccccccccggaccgcgacagaccccaagcaacccgcaaccagactgaagaccgacatggcccggatcggcgtcgccctgctcgcgctcctggtggccgccgcggcggtggcgtgcctgccggccccggcctccgcgggcgagcaggactccatgctgctgacgcgcgcggcgacctgcgacggcgccgtcggggagtgcggcgtggacgaggacgaggagatgggcacgggcgcctacggcaccggcgaggccctgcgccggtcgctggcgcgcaagccgacggccaggtacatcagctacgcggccctgcgcgccgaccaggtcccctgcaacaagcgcgacaagtcctactacaccaactgcggctcgatgcagcaggccaacccctacacgcgcggctgctccgccatcacgcgctgcgcgcgcaacatgaactgattcgtcctccgtatgcccgcctctgctgccccgtcgatctcgcgcgcgtacggagcggagaggagtgtcaccgtgtgagcgcctaattaagcactgtgtgcgtttgtgctgcttcaacattgatccaacaaaattaacgactgttattgtatttgtttgtgagtagattttgtgtatccaacgtgttcctgctactgccatgtgtacgccaatttattcgttttgaaaaatgtttgtgtatttgaagaagaacaggatttttattttattttccgcctct

SEQ ID NO: 168 - DNA, 1076 bp, Triticum aestivum
  Clone ID: PAT_TA_168
cctccaccgcggtggcggccgctcctcgccgcctgcgtcgtccggcccgctcgcatcacgcccgtccaccgcttcgtcgccgagttcatgatggacgacctccgctaccccatgaagcccaacaccatccccgtctgggccgtcccgatatacgccgtcatcctgccgatgctcatcttcgccgccatctatgtcaagaagaagaatgcctacgacctgcaccacgccatactaggcctgctgttctccgtgctcatcaccggcgtcctcaccgacgcgatcaaggacggcgtcggccggcctcgccccaacttctactatcgctgctttcctgacggggtgccgaactacgaggcggtcacgcgacaagtcatatgccacggagacgcaaaagtcatcaaagaagggcacaagagcttccccagtggccacacttcatggtcctttgccgggctgggcttcctgtcgtggtaccttgccggcaagatcagggtgtttgaccggggcggacacattgccaagctctgcatcgtgatcctgccgctgctcttcgctgcgatggtcggcgtgtcacgggtcgcagactactggcaccactggcaggatgtgtttgccggtggaatccttgggctggttgttgcttcgttctgctatctgcagttcttcccgcatccggctagcaaacacgggctgtggcctcatgcattccggcaccacaatccgaacccggaaactgagaaccaaggaacaacagatacccatcagtcggtgccgccgcatgatctgtccatggtacaatatgttgcctccatggagatgagaaccaatggccgagcgttggataacatggaggctggcagcggcagagcctggtaactgaagacgaccaccatggggatgggggcaggcacgcaccatgagagacatcaaccttgtaggtaggtaggtactagtagaactcttgttctgtatatgtttcttgtaaagacaaataaaattgcgcgatttcgttcgtggttggaccgaattagttctagtccttgagttttcagaatcaatccattgatctagtcccc

SEQ ID NO: 169 - DNA, 670 bp, Triticum aestivum
  Clone ID: PAT_TA_169
ggccggccttcctcctccggagctgcctcctcccaaaccacatccacgccgacctcctcccgagcagcctcctcggcgacgaaggtgccggagagctttccagaaggtcagggggagggatgggcgagttcgacgactactgggcgcgggcgtacaggggcgaccccgcggtgccgcactccgacccgcagcggctcatctccacctggaccggcgccttcgccctcggcgccgccgcctgcgtccaccaccacgtctccggcctcgcctccaacatcaagtcccttccccacagctggcaagacatgacaatgatgctcgatcagaagcgctggaagaaaattcttgacaagaagcagcaacaagcttaagttccataaccttcaccgcttgggccacagttggaagagctttctatcttgctgttgggcatggcagaggaagttctgcatcagtttggtatttggatagagtttttctacctcttgtttccttccatggtgttggaacctcattcttgaagttgtacgtgtgaccggttgtattcatctgctgccattgtgatctacatatacagctttcttgggaaatggtgatatttagtagtaaatgcttgcaatcctagtatttgagtggtttgaacaaaataaaaaaaaaaaaaagcccctag

SEQ ID NO: 170 - DNA, 858 bp, Triticum aestivum
  Clone ID: PAT_TA_170
gccggccggcggcgaatcaaggcaagtttctctagcaacttcgactcatcttgatcgccagtgttactctcgttaccatgcgtgccaccctcgctcttaccgcccttctgggcctatcaaatgccgctgccattgagcctcgccaatctcgtgagaccaagctctacaagatcgagctcggacctgatgacgtccgcactgtcaccgaagcggagaagtgggcattgagagctgaaggcaagcacttcatcgacgtgactaacctcgacgaacccggtttcagtcttcagttcctcgccagcttccctagcgctgtcgctcaatcctctgccgtcaaggctttgttgcctaagctgagccaggctaacctgcgcactactctgacgaccttctccaacttttacaacagatactatacatctgcctatggtgaacagtctgccgattggttgttccagcaggttgagtctatcatctctgccagtggagccaagggcgtcaaggttgccaagttcaaacacacttggcgtcagcccagtatcattgctactatccccggaaagagcgattctactatcgttgttggtgctcaccaagactccgtcaacactcgcagcccttctgctggccgcgctcctggcgctgatgacgatggatctggaactgttactatcctcgaggccttccgtgtcctcttgagcgactctcgtgttgcatctggtgaagcacccaacactatcgagttccactggtactctggcgaggaggccggtcttctcggtagtggtgccgtattcaccagtacaagcgcgaaggtcgtcccgtcaaggccatgctcacccagatatgactggttat

SEQ ID NO: 171 - DNA, 1042 bp, Triticum aestivum
  Clone ID: PAT_TA_171
ggcacaccaggtgccgcacagctccccaaatcatatagcggctcccaccaacaacggcgacggcggcagcggccacggaggagggcggcggatcagcggcgccggcgatggcgtccgtggcggcggtggagggcgcggccgcggcgctccggtcggtgctgtcgcgcgcgcagcaggcggcggcgcgggcggggcgcgcgccggagtcggtgcgcgtggtggccgtgagcaagacgaagcccgtgggcgtcatccgcggcgtgtacgacgccggccaccgctgcttcggcgagaactacgtccaggagctcatcgacaaggccccccagcttccagaggatattgagtggcacttcattgggaacctgcagagcaacaaagccaaagccctgctagctggtgtaccaagtcttgacatggttgagagcgtagacgacgagaagatcgcaaatcgtcttgatcgggtggtagctgatttggggagaaaacctcttaaggtcttggtccaagttaacacaaagtggagaacaatctaaatttggggtagatccctcagggtgtgtgggattagcaaatcatgtcaagctgagctgcccaaaccttgtaccttctggtttgatgacaattggaatgcttgattactcctcaactccagagaatttcaaggcattgactagttgccggaaggaggtatgtgatgaacttggaataccagaagagcagtgcgagctgtcaatgggcatgtctgccgattttgagcaggcgattgaaatgggcagcacaaatgtcatggttggatcaaccatatttggtgcaagagaatacccaaagaagaactaggataattacagggtttaattgtgagaccgtgcatctaacagctgcagtattggtggtaaatatgtatctatttccaccaatatttacacttcgatgttttacgcaagtgccataaataaggatattgttttgtcatgtgtctcctgttattaaacattcagagagcactgcaattcctacttcctgattcatcaaaaaaaaa

SEQ ID NO: 172 - DNA, 900 bp, Triticum aestivum
  Clone ID: PAT_TA_172
aactcaatcatgggcaacgatcaaaaaatgggcgcctactacgcccccaagggtggtctaccaccccaaacacaaatcctcaccgacagagctatgtttactgaatcatacgccgtcattcccaagggctgcttcagcgatattgtcaccagctttctacctttctgggagcagactcgactatgggttattgcccgtcctctctcaggatttgccgaaaccttctcccaatacataatggaggtttcacctggaggtggtagtgatcgtgctgagatggacgacacagccgagggtgtcctgtttgttgtcgagggtgaaatcactgtaactgtggccggtgaagcacacactctcgatgctggtggctacgcttttctcccacccaagtgtggctggaccctccgcaacaactcaagcgagaacgccagtttccactgggtccgcaaggcctacgaatacgtacccggcctagacgccccagaagccttcttcgccaatgaaaaggacattcaggcaagggaaatgcccgacacaaacggtgcctggtctactacccgattcgttgatcccaccgacgtgcgacacgacatgcacgtcaacatcgtcacctttcaacccggcggtctcatcccctttgcagagacacacgttatggagcacggtctttatgttctcgagggaaaggctgtataccgtcttaaccaggactgggtcgaggtggaagctggagattttatgtggctgcgtgccttttgtccacaggcgtgctatgcgggtggacctggaaaattccgatacttgctctacaaggatgtaaaccgtcacgcaaagtttctaagatagaacaatttgaagagtggatatgatgcctaaaaaaaaaaaaaaaaaaggccccta

SEQ ID NO: 173 - DNA, 916 bp, Triticum aestivum
  unsure (1)..(916): unsure at all n locations
  Clone ID: PAT_TA_173
nnnnnnnnnnnnnnnnnnnnnnnnnnnnnnnnnnnnnnnnnnnnnnnnnnnnnnnnnnnggccgcttcgagccggccgggccgggataccaggaaaagacctcaaccttgccttcgacgccctcacctcgcaacgccacaccccacgatccctcacgatggcgaccctcgcgaccgcttctcgcctctgcctgcgcgcggctgctaagcccgtcgctcccgccgtccgcgccctgagcaccaccgctatccgtcccgacagcgcgtccgcctccggatactccagccccttcaagttccaaggagagtccaagggctcccagatccccgactttggaaagtacgtctctaccggcagcgagggcaagaacaagctctactcgtacttcatggttggcgccctcggtgccgtcagtgctgctggtgccaagagcacagttcaggagttcctggtcaacatgtctgcttctgccgacgttctagccatggccaaggtcgaggtcgaccttgcctctatccccgagggcaagaacgttatcatcaagtggcgaggcaagcccgtattcatccgacaccgaacccaggacgagatcgaccaggccaacaaggtcaacatctcttctctccgagatcccgaggaggacagcgcccgtgcccgacagcctgagtggcttgtcatgctgggtgtctgcacccacttgggttgtgtccccattggtgaggccggtgactacggcggttggttctgcccttgccacggttctcactacgatatctccggccgaataagaaagggacccgcccctctcaacctcgagatccccgagtacgacttccctgaggagggcaagcttatcatcggttaagcgaacgatgtaagagtaaatcttttataacggagaaacgatcaaggagag

SEQ ID NO: 174 - DNA, 524 bp, Triticum aestivum
  unsure (1)..(524): unsure at all n locations
  Clone ID: PAT_TA_174
cgtncgcccacgcgttcgaccacgcgttcgaggactcttgggttaacatttgcctgatcatgatacgtccgcggacgcgtggggagatcgtcgtcatccgccaaaccagatcggctgcttcttcttcttcttcttcttcaacttcgcagaatcgtcggcggtcgtctcttcctctagttagatccttcgagagcaatgggaggaggcaatgatggtcatgggtacccacccggtggccaggggggataccctccggcagggtacccgccgcagcagggaggttaccctccacagcaaggaggttaccctccacagcaaggatacccgcctgcacctggagcttacccacctgcacctggggcataccctcctgcacctggggcgtaccctcctgcacctggagcgggaggccctgacggggagaaggggctcctctccaacatcatgcatggtgttgccggtgctcatggtggtggtcatgggtgccggatctgggggatatgggtacctaattggtggtcatg

SEQ ID NO: 175 - DNA, 724 bp, Triticum aestivum
  Clone ID: PAT_TA_175
ggaaggtgccaacgcctgcgatgcgagccggaaggaagcgcgtacacgagcccaccgcccctgtataaaatcccccagcacacacagccacagcaacccaatatacacggggagaagagatcgtcatcatccgccaaaccagatcggctgcggctgcttcctcttcttcaacttcgcagaatcgctgatcttctcgtcctctagttaagtccctcgacagcaatgggaggaggcaacgacggtcatgggtacccacccggtggccaggggggataccctccgcaagggtacccgccgcagcagggaggttaccctccacagcaaggattacccgcctgcacctggagcttacccacctgcacctggggcataccctcctgcacctggggcataccctcctgcacccggagcgggtggccctgacggggagaaggggctcctctccaacatcatgcacggcgttgccggtgctcatggtggtggtcatgggtacccatctggtggtcatgggtacccctctggtggccatggataccctccacaacaagggtaccctcctcagcatggttaccccccgcagcagcatggctaccctccacagcagcatggttatccccctgccggctaccctggctcatctggtcacagtggtagccatggaggaaggaaggcatgggcatgggcggcatgctagctgggcgcagcagctgctgaaggggaaaaa

SEQ ID NO: 176 - DNA, 781 bp, Triticum aestivum
  unsure (1)..(781): unsure at all n locations
  Clone ID: PAT_TA_176
ccacgcgtccgcccacgcgtccgagcgcacggaggagaacgccatcatccatccagatcggcctcttcttcttcagcttcgcagaatcgcagatcttctcctctagttagctccctcagagcaatgggaggaggcaacgatggtcatgggtacccacccggtggccaggggggataccctccggcagggtacccgccgcagcagggaggctacccgccgcagcagggaggttaccctccacagcaaggatacccgcctgcacctggagcttacccacctgcacctggggcataccctccagcacctggggcttaccctcctgcacctggagcgggaggccctgatggggagaaggggctcctctccaacatcatgcacggcgttgccggtgctcatggtggtggtcatgggtacccgtctggtggtcatgggtacccatctggtggccatggataccctccacaacaagggtaccctcctcagcatggctaccccccgcagcagcatggctaccctccacagcagcatggctatccccctgccggctaccctggctcatccggtcacagtggtagccatggaggaggaggcatgggcatgggcggcatgctggctggaggcgcagcagctgccggtacggagcacacaagatctctcacggcagccacggtggaggtggacacatgatgggaggcatgatgggcgggcatggaggctacngcggcgggtacggccaccacggcggcaagttcagcacgggaagcacgggcacggcaagttc

SEQ ID NO: 177 - DNA, 1473 bp, Triticum aestivum
  Clone ID: PAT_TA_177
cccacgcgtccgcccgagggtccggccatcatccatccagatcggcctcttcttcttcagcttcgcagaatcgcagatcttctcctctagttagctccctcagagcaatgggaggaggcaacgatggtcatgggtacccacccggtggccaggggggataccctccggcagggtacccgccgcagcagggaggttaccctccacagcaaggatacccgcctgcacctggagcttacccacctgcacctggggcataccctccagcacctggggcttaccctcctgcacctggagcgggaggccctgatggggagaaggggctcctctccaacatcatgcacggcgttgccggtgctcatggtggtggtcatgggtacccgtctggtggtcatgggtacccatctggtggccatggataccctccacaacaagggtaccctcctcagcatggctaccccccgcagcagcatggctaccctccacagcagcatggctatccccctgccggctaccctggctcatccggtcacagtggtagccatggaggaggaggcatgggcatgggcggcatgctggctggaggcgcagcagctgccgccgccgcctacggagcacacaagatctctcacggcagccacggtggaggtggacacatgatgggaggcatgatgggcggccatggaggctacggcggcgggtacggccaccacggcggcaagttcaagcacgggaagcacgggcacggcaagttcaagcacggcaagcatgggaagcacggcatgttcggcggcggcggcaagttcaagaagtgagaagtaatgccgctagctagtagcttcaccatggctgatgaatcaaaaaatacctaaactcttcctgtaggtccgcagaacttggtttggtcagggaaagcctttgagatgtatctaagcagggtggtgtgtggtcgctgctcggatctcgtggagcttccatcctttcctctatatgatttggcactctagtctgcgtctgtgacaagatatgacttgctaataagtacctgaattctgtgtggtgctatgctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaaaaaaacaaaattttactcccccgggcttgcaagattaaaattttttttttggggcccccaaaataaaattatcggcccgggttttaaaaacgcggggacgggaaaaaacccggggttacccaaattaaatccctttgaaaaaaatccccttttccccagttggtttaataccaaaaaagccccaaccgatccccctttccaaaaatttccccaccctaattggaaaagggaaccccccctgtacgggca

SEQ ID NO: 178 - DNA, 1501 bp, Triticum aestivum
  unsure (1)..(1501): unsure at all n locations
  Clone ID: PAT_TA_178
ccggtgcttatcgtgcgcgcagcagatccccgccagccgccaaaccagatcggcttcttcttcgccttggaggagatcgtcgtcatccgccaaaccagcatcggcttcttcttcttcttcttcttcttcaacttcgcagtaatcgtcggcggtcgtctcttcctctagttagatccttcgagagccatgggaggccacactgatggccactgggtagcctcctcggtggccagggcgcagaacccgctggcattgtcctccgccgcagcagtccctcgacacccctgggaggaggcaacgacgctcctggggcaccacctgctggccctggggcttacccttcccaagcgtacccgcgggcagcacggaggttaccctccgcggcacggacacccgcctgcaccggagagcttacccgcctacacctggggcatatcctcctgcacctcggggcgtaccctcctgctcctggagcgggtggcagtgaacggggagaaggggctcctctccaccatcatgcacgatgctgccggtgctcatggtggtggtcatggctacccagtctggtggccacgggtacccccccgcaggcagcatggcataccctcagcaaggctaccctcctcagcatggctacccaccgcaacagcatggctaccctccacagcaggcatggctatccccctgctggctaccctggctcatctggtcacagtggtagccatggaggaggaggcatgggcatgggcggcatgctagctggaggcgcagcagctgctgccgccgcttacggagcacacaagatttctcacgggcggcccacggtgggaggtggacacatgatgggaggcatgatgggcggccatggaggctatcggcggcgggtacgggccaccagcggcggcaagttcaagcacgggaagcacggccacgggcaagttcaagcacggcaagcatgggaagcacggcatgttcggcggcggcggaaagttcaagaagtggaagtaatgcgctagctagtagcttcaccatggctgatgaatcaaaaaaaaacctaaactcttcgtgtaggcttccagaacttggtttggtcagggaaagcctttgagatgtatctaagcagggtgtggtgtggttgctgcccggatctcgtggagcttccatcctttcctctatatgatttggcactctagtctgcgtctgtgacaagatatgacttgctaataagtacctgaattctgtctggtgctatgctttaccgctgttcatatgtcgttgctctttctgcggcatcttattctaaaaaaaaaaaaaatgtttgctttgctgtgatttcaactgttcaaaaaaaggccaaaagggcgggcaagaaacattttgtaaaatgctgctccatctagcaatagtaatgcacctnatccactttgtagagcatcctgttacaaacttgttctgatcctgtagagaacagacttagctgttcgatgcaacattctgtagc

SEQ ID NO: 179 - DNA, 692 bp, Triticum aestivum
  Clone ID: PAT_TA_179
gccggccggtttgcgatctcgccaaacccacctcattccccaaggaaaacttccaagccgccaaaggcgatggctgcgtccgcccctcttgccggggtcgcgctcctcctcctcctcctccatgccgcccatgacggaggcatggccgggcttgctagcacgggcggagcgaggatggcatcatcggaggggtacgcgccggtgcagaccgtggtgtaccggtcggcggcgttggaggcgtcggaggcgttcgagccgttccagctgtgcatggggtgccggtgctgcccggcggggaacaacggctcgtcgtgcgtggacacgcagtgctgctacggcatcaactgcaacctccccggcaagccgttcgggacctgcgccttcaccccgcgcacctgcggctgcggcgccaacaactgcacggctgcacccgccccgccgccgcctacgagctagcttatggaatccgattgattttgatcgattggtccgatccatttacgagtatggtcggatcgatgcatacttaccgcaggctagctgattattattgattaataatcagaatcgttttctttcacatcgtatgatctatcgtccatttctcatgcatccatctttcaaagttgttcggtatgttggcatgtgattgaaagtatgatggtaacatcgatcaactgttacactttaaa

SEQ ID NO: 180 - DNA, 1120 bp, Triticum aestivum
  Clone ID: PAT_TA_180
gccggccgccgcagggcgccgtcgagacttcccagcacccgctgagcgcccttgcagtttgatgcaacaccaggtgagcgtcctgagctcgttcttgaagcccgtggaagaggtgcagattcttgctgaccgctcgattggcctccatcttctgttactatccctcttacaagccagatggaagaatatttcagttatgtgtatggcgctgatggcatgagaatcagcaaatttgcaccagagcccgaagatgatttgggagttctcttctgtcggtgctacagtgtgatgctgggaaggcgcaaaagacagtgcagttaggtgtgtggtctcgggcgtggacgtgcagctcgacaaccatggacatgcagctcggacgcgtgcgtgcagcggttcagtgctcgtgtacttgtaggctttggtgtttttgcgtgtgggtgcagttcgtcattgcggcgtgtggtgtgcagctgcagttcgtgcaagtcctctacacccttgcgctcgtgcaggtacggcttgtcgtcaacgcctacatcacttcccctcatttttgaagtacactgatgctcgggccttggcattagaggcacgtcgccccctcttcggcaactggtgtgactcctcccttgcccctgcagcttgcacatcatgtagcagtgcactccaggaggtcatcatggcgtttgacggctgtagttgtcggtctcgctatcgctgaggctagcagctacccaatgatccctgaactcctcatgcgaccatcacaatcaggccttgtgctgccaccttctacctgaagctcccctgtgtgctcctcaactctaacctgatttcggtgctccctttctgctagccccatcccgtccttttcggcgctcaatggtaacagagtggcttggacctccttcatcatggtcataaaaacatcataacacttaacattgctatcgccaagcagcacacactctagtgccttcgtgtacattgtgtgatgtctgaatgtatcgctggaaggaggccctctgtctttctggtatcggaccaaatgtgcagggagaacatcatttgcatctcttgtccagcgtttcattatatgcttctctggtatcttcgacag

SEQ ID NO: 181 - DNA, 623 bp, Triticum aestivum
  unsure (1)..(623): unsure at all n locations
  Clone ID: PAT_TA_181
gcccacacgaagcccccaccccaacccaccgagctcctcgtctccggcggcggaaggaagcagcagccatggtgaagggacgcacggggcagctgcgtcaggctctacgtccggggcaccatcctcggcttcaagaggtgagcggcccctccttctcgccggatctggccgttcatttcatggcggcgcgctgatgggaatgcggggaaatttttgcaggtccaagtcgaaccagtacgagagcacgtcgctggtgcaggtcgagggggtgaacaccaaggaggacgtggcgtggtacgccgggaagcgcctggcgtacgtctacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttttttcgatctagggccagtaatgcttgtttcttgcgattgtcatgagccgagaaatgtcattttatggtgaatctatgctatgttggcancngaaactaatcatgtattccgagaatctgtgaagtttg

SEQ ID NO: 182 - DNA, 586 bp, Triticum aestivum
  unsure (1)..(586): unsure at all n locations
  Clone ID: PAT_TA_182
cctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggncgcccgcccgcatggcaactccggcgtctccgcgccaattaagtccaacctgccgccggaatcaatgggccgtaagtcaaggtgttcatgtacccaacaacatctaaagatatctgaatgtgtggaggacctttctccnanatttactcagcttccttgtaggttgtttaagtnagattacaggttaacttcatctagaacattaagtccgatttggngtatgtacggattaataantaataaaataatgttcaacttgttatanctancctattcctatgactt

SEQ ID NO: 183 - DNA, 556 bp, Triticum aestivum
  unsure (1)..(556): unsure at all n locations
  Clone ID: PAT_TA_183
ctgcgcgctccaacagacgtcctagctgccactccgccgcgcgcgtcagcgacctcaccgtcaccggcgaagcaacaccggcacccatggcgctcgcctccacctccgccaccgcctccgcggccgtgctcaagaacccgttcctcggcgcgaggcgcgcgctcgctaatgccgcctccctcggcgccgccaagcccgtgacgcgccgcgtggtgggtccgtcgcccgcgggccgtcggcaagaatcgtggttccccgcgggtcaaagagcgatgccgattcatcaacccgtcttgggctcgatggtcgctccccgggtgacttcggcttcgaccgctggggttggcaaggaccggcttcctcaatggtacagggagccnactgttcacggcggtgggcaatggcgcgncctggnatctcatcgggaagctaaacggctgccgtggtcgagncgggggcanctggcgcgtgggcctccctcgggtcctctgggaaccaactctgctatgggtgggtgagtcaacgtggtcactcttaccggaccaatcgtggtggg

SEQ ID NO: 184 - DNA, 579 bp, Triticum aestivum
  unsure (1)..(579): unsure at all n locations
  Clone ID: PAT_TA_184
cggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcaagtccaacctcccgcctgagtccatggggcgcaaggtcagagtgttcatgtacccgagcagcatctaaggttttgttggagtaaagatggactagaaatggccatgtgtttatttctcacttttctctgaacttaaaatgccttgtgttggtaacttagatttgttcaagtgctgaacctgtggaattgtgcaaaattgtttccaacggtgaactaatgtcctaantatgcaacagcagtnttaattgcccgttaaaaaaaaaaaa

SEQ ID NO: 185 - DNA, 1154 bp, Triticum aestivum
  unsure (1)..(1154): unsure at all n locations
  Clone ID: PAT_TA_185
tattctttcggagatttttgatgggcactttattcccccttgataaattacatacaattcaagctataatcactattaactcttatggtaccaactaaatcatcatttatgggtacttgcagactcaacattgcagagctacggctaataggactaaacaggcacatcagctggatactctgcagaatgctttttgatggtatccagcagcgaccgctcttgctcacgaaggttggaaggcatttgatcataaacatcagtgaagagctccgcaagcccgtgttttggcatcctctcggccacctgaatggcttgcaggagctcttgccgcacattgttcctgagttcagactcttgagtgtcgcaccaccatccattcccctgaacccattttctgtacctggagacgggatccctcgctgttcgccaatgctccatctcatcagccggcctgtacttggttgaatcgtcggatgtcgagtgatggccgactcgataggtcatcgcctcgattaaaataggccttccttcagttatagccatttcccgggcggtgtggactgtactgtacacagcaagagtatcgttgccgtctaccctgatactacgtattccgtaggcctgaccgcgggtaacaactccatcacttctgaactgttctgcggttggggtgctgattgcccagccattgttgcggcagaagaagatcactggcgcttccgtgacagcagcgaagttgagcgcggcatggaagtctccctcgctcgtgccaccatcgccgaaatacgtgatggcacatgccttcttcttgtccatcttgagagaataggcagcaccaacagcttgagggagctgagtgctgatcaattgccaacaaggataaatctctgcttcacttgcacaacatttttctttttccttttctttttttcagaaaggaaggaggaagtatttcattttttttttgttttccgaaaaggaaggagaaggaagtatttcatacttacgcgataggcgatgagactgtgaaataattcagacggtttgatccgtaatgtattggcatctgcctgcctttaccgtaatccagcttgttcccaaacaactggtttgcaaattcttgcagtgtgaagccacgccatannnnaacaccg

SEQ ID NO: 186 - DNA, 522 bp, Triticum aestivum
  Clone ID: PAT_TA_186
ccgaacccccagcccccctccccggcgccgccgcagcagcaagatggtgaagggacgcaccggccagcgcgtgaggctctacgtccgcggcaccatcctcggatacaagaggtccaagtcgaaccagtacgagacggcgtcgctggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgccccgccgaggccatggggaaaaaggtcagggtcttcatgtacccgagcagcatctaaaaggttattttgaagtgtggaggatttcgctcgtcccttaggtttcatttcagagtcttgtaaggatgggattcaagcctggataggcaagttcaaacttgctgtttcccctgtggaaagaactgtaagtctttcatgt

SEQ ID NO: 187 - DNA, 644 bp, Triticum aestivum
  Clone ID: PAT_TA_187
tcggcacgagggcggaaggaagcaaggcggccaccatggtgaagggacgcacgggacagcgcgtgaggctctacgtccggggcaccatcctcggatacaagaggtccaagtcgaaccagtacgagaccacgtcgctggtgcagatcgagggggtgaacaccaaggaggacgtcgcgtggtacgctggcaagcgcatggcgtacatctacaaggccaagaccaagagcagcgagacccgctacaggtgcatctggggcaaggtcacccgtccgcacggcaactccggcgtcgtccgcgccaagttcaagtccaaccttccgcctgagtccatggggcgcaaggtcagagtgttcatgtacccgagcagcatctaaggttttattggagtacagatggactaggagtggccatgcttatttcttacttttctctgagcttaaaatgccatgtgttggcaagttagattgttcaagtactgaacctgtggaagtcctgccaaaatttgttgtcaaacggatgaactattgtcgtaatgttatgccagcagcatatctcattttgccccgtgccatcggtgtctgattgcagtattttcaaattcatatagccatattttacacttgtttaaaaaaaaaaaaaaaaaa

SEQ ID NO: 188 - DNA, 785 bp, Triticum aestivum
  Clone ID: PAT_TA_188
acaacaaccattccccctgcaaccgcaacaaccattcccccagcaaccgcaacaaccattcccccagcaaccgcaacaatcatttccccagcaaccacaacaaccattcccccagcaaccgcaacaaccattcccccaacaaccaccccacacgaagccccccacccaacccccgagctcctcgtctccggcggcggaaggaagcagcggcagcggcagccatggtgaaggggcgcactgggcagcgcgtcaggctctacgtccggggcaccatcctcgggttcaagaggtccaagtcgaaccagtacgagagcacgtcgctggtgcaggtcgagggggtgaacaccaaggaggacgtggcgtggtacgccgggaagcgcctggcgtacgtgtacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggtttttttgatctagggacagtaatgcttgtttcttgtgaattgtcatgagctgagaaatgtcattttatggtgaatctatgctatgttggcaaccgaaactgatcatgtattccgagaacctgtggaagttttggctagacttgtttgtcaaatgtgcggaccattttagtatatttctatatcagcactaaagcgtaatttgtcatgaaaaaaaaaaaaaaa

SEQ ID NO: 189 - DNA, 2085 bp, Triticum aestivum
  Clone ID: PAT_TA_189
agaggcatctgcctgcagttataaatatcttagcatagctttgttcaacataaatgtcagcaacaactattctttgtgtgagcaacagccaatctcttgtattatttctttcagagatttttgatgggcagtttatccccccttgttaaattacatacaattcaagctataatcaatattaactcttatgggaccaactaaatcatcattcatgggtacttgcagactcaacattgcagagctaaggctaataataggactaaacaggcacatcagctggatactctgcaggatgctttttgatggtatccagcagcgaccgctcttgctcgcgaaggttggaaggcatttgatcataaacatcagtgaagagctccgcaagcccgtgttttggcatcctctcggccacctgaatggcttgcaggagctcttgccgcacattgttcctgagttcagactcttgagtgtcgcaccaccatccattcccctgaacccattttctgtacctggagacgggatccctcgctgttcgccaatgctccatctcatcggccggcctgtacttggttgaatcgtcggatgtcgagtgatggccgactcggtaggtcatcgcctcgattaaaataggccttccttcagttatagccatttcccgggcggtgtggactgcactgtacacagcaagagtatcgttgccgtctaccctgatactgcgtattccgtaggcctgaccgcgggtgacaactccatcacttctgaactgttccgcggttggggtgctgattgcccagccattgttgcggcagaagaagatcactggcgcttccgtgacagcagcgaagttgagcgcggcatggaagtctccctcgctcgtgccaccatcgccgaaatacgtgatggcacatgccttcttcttgtccatcttgagagaataggcagcgccaacagcttgagggagctgagtggcgataggcgatgagactgtgaaataattcagacggtttgatccgtaatgtattggcatctgcctgcctttaccgtaatccagcttgttcccaaacaactggtttgcaaattcttgcagtgtgaagccacgccatagaagaacaccgggctccctgtactgaggtagtacaatgtcttgagcactaagcgcagcagcagaggctatgttgattgcttcttcaccattggaagtcagatagaaggaaattcttccctgcctctgagcttcgtagaagattgtgtccataatctggagggtgaccatgttactgtacattttcagagccaactccttactgacctcttggaatctactgctgtatatagtcccaccatcgtcgtcaagaacacggtaacaattgatcctttccctttgcgactccggcaggaaattcatttcaccaacaaaggaaagctttcctccagggaaatctacaaactgcagatcgcctgcggcaagtccattctccggctcctcgacggcagcggcggcggtgctatctcctgcgaagcgccggacggagcagaaccccctgctttggtcccctgatggcaccccgagaaccggcaccgtcgacaagctcaagggccacggccctggtccatggctgcacagctcgccagcgagccttctggcagcccgacgcgccagccacgcggccatgtatatgtacgtgattatctaggtacacgcactatctcgtacgatgcaagtttccggcgcaatcagctgcaagaattctgcgcaatcgactcaattcaatggtggtggctggaatttataggtggcagagtgggagttggatagagaggagaaaagggaacaagagaagaagcagcgagcgaagcaaagagggagaaagtgtgagttggaaagataagtgtgtgtgcagcgaggagcgcgaggagtttggaggtaggagaagacgggcacggctcactagtgtccggagagtgacgactgattgattgcagctgcaggggttgaaggatggcgcgtggggcaggaggttgcacgtggaagctgtggcccggtgccggggtgggtgggtgctgaaggatgggagctgagctcgtgcc

SEQ ID NO: 190 - DNA, 695 bp, Triticum aestivum
  Clone ID: PAT_TA_190
gccggccgggccgggccccttcctggttgcgcagctcaccccgaacccccagcccccctccccggcgccgccgcagcagcaagatggtgaagggacgcaccggccagcgcgtgaggctctacgtccgcggcaccatcctcggatacaagaggtccaagtcgaaccagtacgagacagcgtcgctggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgcccgccgaggccatggggaaaaaggtcaggatcttcatgtacccgagcagcatctaaaaggttattttgaagtctggagggtttcgctcgtcccttaggtttcatttcgagtcatgtaagatggattcaggccgggatagcaagttgaactgctgtttccctgtgaagaactgtagtcttcatgttatcttgaatgtgtgggtcgcatattatatgatgttatatgtagttcgaacctgatgctgtgttttgcccactttttgcgttctatccttgcaattttagctatcaaatctgattcagtgatgtttttactcttcttttatgaat

SEQ ID NO: 191 - DNA, 1338 bp, Triticum aestivum
  Clone ID: PAT_TA_191
gaattcggcacgagaacagacgtcctagctgccactccgccgcgcgcgtcagggacctcaccgtcacaccggcgaagcaacaccggcacccatggcgctcgcctccacctccgccaccgcctccgcggccgtgctcaagaacccgttcctcggcgcgaggcgcgcgctcgccaatgccgcctccctcggcgccgccaagcccgtgacgcgccgcgtggtggtcgtcgccgcggccgtcggcaagaagtcgtggatccccgcggtcaagagcgatgccgagttcatcaacccgtcctggctcgatggctcgctccccggtgacttcggcttcgacccgctggggcttggcaaggacccggcgttcctcaagtggtacagggaggccgagctgatccacgggcgctgggcgatggccgcggtgctgggcatcttcatcgggcaggcgtacagcggcgtgccgtggttcgaggccggagcgcagcctgggcgcggtggcgcccttctccttcgggtcgctcctgggcacccagctgctgctcatggggtgggtggagtccaagcggtgggtcgacttcttcaacccggactcccagtcggtggagtgggccacgccgtggtcgcgcacagccgagaacttcgccaacttcaccggcgagcaagggtacccgggcggcaagttcttcgacccgctcggcctcggtggcgagaccaaggacggcgtctacatccccgacaccgagaagctcgagcggctcaaggtggccgagatcaagcactcgcgcctcgccatgcttgccatgctcatcttctacttcgaggccgggcagggcaagacgccgctcggcgcgctcggcctataagacgattttttggcttgcgcgcgtggtgggagaggggttgttgcattgcatcagatcggacgcatggattgatgggatctgctggaggtcgaagaagcagcagcaacgtatctgtgtccgtgacttctttcgggtggtgtgtgtgaatcgaatggggaatcaagtacctgctcgagcggccgcccgggcagggacttgcagactcaacattgcagagctaaggctaataataggactaagcaggcacatcagctggatactctgcaggatgctttttgatggtatccagcagccgaccgctcttgctcgcgaaggttggaaggcatttgatcatacacatcagtgaagagctccgcaagcccgtgttttgcatcctctcggccacctgaatggcttgcaggagctcttgccgcacattgttcctgagttcagacttttgagtgtcgcaccaccatccattcccctgacccatttctgt

SEQ ID NO: 192 - DNA, 679 bp, Triticum aestivum
  Clone ID: PAT_TA_192
gaggaattcggcacgaggcccacacgaagcccccaccccaacccaccgagctcctcgtctccggcggcggaaggaagcagcagccatggtgaagggacgcacggggcagcgcgtcaggctctacgtccggggcaccatcctcggcttcaagaggtccaagtcgaaccagtacgagagcacgtcgctggtgcaggtcgagggggtgaacaccaaggaggacgtggcgtggtacgccgggaagcgcctggcgtacgtctacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttttttcgatctagggccagtaatgcttgtttcttgcgattgtcatgagctgagaaatgtcattttatggtgaatctatgctatgttggcaactgaaactgatcatgtattccgagaatctgtggaagttttggctattgtttgtcaaatgtgtggaccattttagtatatttctatatcagcactaaagcgtaatttgtcatgagtttgtgactgttttgcaatgtttgagtgttatatgataaaaaaaaaa

SEQ ID NO: 193 - DNA, 1183 bp, Triticum aestivum
  Clone ID: PAT_TA_193
cccacgcgtccgcccacgcgtccggctccaacagacgtccttagctgccactccgccgcgcgcgtcagcgacctcaccgtcacaccggcgaagcaagacccgcacccatggcgctcgcctccacctccgccaccgcctccgcggccgtgctcaagaacccgttcctcggcgcgaggcgcgcgctcgccaatgccgcctccctcggcgccgccaagcccgtgacgcgccgcgtggtggtcgtcgccgcggccgtcggcaagaagtcgtggatccccgcggtcaagagcgatgccgagttcatcaacccgtcctggctcgatggctccgctccccggtgacttcggcttcgacccgctgggggcttggcaaggacccggcgttcctcaagtggtacagggagggccgagctgatccacgggcgctgggcgatggccgccgtgctgggcatcttcatcgggcaggcgtacagcggcgtgccgtggttcgaggccggagcgcaaccaaggcgcggtgggcgcccttctccttcgggtcgctcctgggcacccagctgctgctcaagggggtgggtggagtccaagcggtgggtcgacttcttcaacccggactcccagtcggtggagtgggccacgccgtggtcgcgcacagccgagaacttcgccaacttcaccggcgagcaagggtacccgggcggcaagttcttcgacccgctcggcctcggtggcgagaccaaggacggcgtctacatccccgacaccgagaagctcgagcggctcaaggtggccgagatcaagcactcgcgcctcgccatgctcgccatgctcatcttctacttccgaggccggacagggcaagacgccgctcggcgcgctcggcctataagacgatttttggcttgcgcgcgtggtgggaaaggggttgttgcattgcatcaggacgcatggattgcatgggatcggctggaggtcgaagaagcagcagcaatgtatgtgtgtccgtgacttctttggggtagtgtgtgtaaatcgaatggggaatcaagtactctttatttctccagcgtatgtaccatgtaatatatagtctgagctctgtaatttaaggcagaatgagcaagggcatttgattcaaaaaaaaaaaaaaaaaaaaaaaaaaaaaaaaaaaaaaaacggggggccgtacc

SEQ ID NO: 194 - DNA, 1158 bp, Triticum aestivum
  Clone ID: PAT_TA_194
gccagcgtccgcccacgcgtccgcccacgcgtccgcggacgcgtggggtcctagctgccactccgccgcgcgcgtcagcgacctcaccgtcaccggcgaagcaacaccggcacccatggcgctcgcctccacctccgccaccgcctccgcggccgtgctcaagaacccgttcctcggcgcgaggcgcgcgctcgctaatgccgcctccctcggcgccgccaagcccgtgacgcgccgcgtggtggtcgtcgccgcggccgtcggcaagaagtcgtggatccccgcggtcaagagcgatgccgagttcatcaacccgtcttggctcgatggctcgctccccggtgacttcggcttcgacccgctggggcttggcaaggacccggcgttcctcaagtggtacagggaggccgagctgatccacgggcggtgggcgatggccgcggtcctgggcatcttcatcgggcaggcgtacagcggcgtgccgtggttcgaggccggggcgcagcctggcgcggtggcgcccttctccttcgggtcgctcctgggcacccagctgctgctcatggggtgggtggagtccaagcggtgggtcgacttcttcaacccggactcccagtcggtggagtgggccacgccgtggtcgcgcacggccgagaacttcgccaacttcaccggtgagcaagggtacccgggcggcaagttcttcgacccgctcggcctcggtggcgagaccaaggacggcgtctacatccccgacaccgagaagctcgagcggctcaaggtggccgagatcaagcactcgcgccctcgccatgcttgccatgctcatcttctacttcgaggccggacagggcaagacgccactcgggcgcgctcggcctataagacgatttttggcttgcgcgcgtggtgggagaggggttgttgcattgcatcagatcggacgcacggattgcatgggatcggctggaggtcgaagaagcagcagcaatgtatctgtgtccgtgtcttctttggggtggtgtgtgtaaatcgaatggggaatcaagtactctttctttctccagcgtatgtaccatgtaatatatagtctgagctctgtaatttaaggcagaatgagcaagggcatttgattcatcacctaccccctcttttact

SEQ ID NO: 195 - DNA, 1009 bp, Triticum aestivum
  Clone ID: PAT_TA_195
ggggatacataacccaccacgagcgcagcccgctagggtttcttctcccttcctggttgcgcagctcaccccgaacccccagctcccctccccggcgccgccgcagcagcaagatggtgaagggacgcaccggccagcgcgtgaggctctacgtccgcggcaccatcctcggatacaagaggtccaagtcgaaccagtacgagacggcgtcgctggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgcccgccgaggccatggggaaaaaggtcagggtcttcatgtacccgagcagcatctaaaaggttattttgaagtgtggaggatttcgctcgtcccttaggtttcatttcagagtcttgtaagatggattcaggcctggatagcaagttcaactgctgtttccctgtgaagaactgtagtcttcatgttatcttgaatgtgtgggtcgcacattatatgatgttatatgtagttcgaacctgatgctatgttttgcccactttttgcgttctatccttgcaattttagctatcaaatctgattcagagatgtttttactcctcaaaaaaaaaaaaaaaaaaaaactggagggggggcgcggggcccaatattccctatatggaaggggattaaaaacaccggccggcgttttcaaaccgcgggaaggggaaaaaccccgggggcccccattttattcttttgggaaaaaacactctttttccccggggggaaaaaaaaaaaagccccccccctttgctcttctaaagtttccccccctcggggggagaggaaaaataagacccctaattttttttttaaaaccgcgcctattttttttaaaacccctcttcttcct

SEQ ID NO: 196 - DNA, 856 bp, Triticum aestivum
  Clone ID: PAT_TA_196
ccctactaaagggaacaaaagctggagctccaccgcggtggcggccgctctagaactagtggatcccccgggctgcaggaattcggcacgaggcccacccgaagcccccaaccaacccccgagctcctcgtctccggcggcggaaggaagcagcggcagcggcagcggcagccatggtgaagggacgcactgggcagcgcgtcaggctctacgtccggggcaccatcctcggcttcaagaggtccaagtcgaaccagtacgagagcacgtcgctggtgcaggtcgagggggtgaacaccaaggaggacgtggcgtggtacgccgggaagcgcctggcgtatgtctacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttttttcgatctagggacagtaatgcttgtttcttgtgattgtcatgagctgagaaatgtcattttatggtgaatctatgctatgttggcaaccgaaactgatcatgtattctgagaacctgtggaagttttggctagacttgtttgtcaaatgtgcggaccattttagtatatttctatatcagcactaaagcgtaatttgtcatgagtttgtgactgttttccaatgttttagtgttatatcagatgttctctgctgtttgatcttatgataactcaagatatattcctgatgccagcatgaatgatggtcaaaaaaaaaaaaaaaaaaaaaaaaaaaaa

SEQ ID NO: 197 - DNA, 771 bp, Triticum aestivum
  Clone ID: PAT_TA_197
gccggccggttctctcgtttttctctccccttcctggttgcgcagctcaccccgaacccccagctcccctccccggcgccgccgcaacagcaagatggtgaagggacgcaccggccagcgcgtgaggctctacgtccgcggcaccatccttggatacaagcggtccaagtcgaaccagtacgagacggcgtcactggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgcccgccgaggccatggggaaaaaggtcagggtcttcatgtacccgagcagcatctaaaaggttactttgaagtgtggaggatttcgctcgccccttaggtttcatttcagagtcttgtaagatggattcaggcccggatagcaagttgaactgctgtttcactgtgaagaactgtagtcttcatgttatctcgaatgtgtgggtcgcacattatatgatgttatatgtagttcgaacctgatgctgtttttgcccactttctgcgttctatccttgcaattttagctatcaaatctgattcagtgatggttttactcttctgatatgaatgtttgtatgcccttttgatgattggtggaagagtttaatttttttggctgggtactgaccagcgc

SEQ ID NO: 198 - DNA, 1011 bp, Triticum aestivum
  Clone ID: PAT_TA_198
cataataaaccaacttggttaaaagttttccatcaacacaagtcaagtatgattacaactttgaactctgataaagaagcctaataagaagttataaactgatctctgcaccagcttcttccaattattgctgaagcacactgatactatgaacaaacctctcactttgcaccttctcaaattcttcgggaaggtgcagaatcaacaaggagaaaaccagagctgtttatcatttcagaatgacacctgcttcatgaaaattaagacttctacaccatttcttcagcagctaagtaagcaaagccagatcaaatatctatcatcagccatgggaatctagctatatatgccgaccaggcgacttcagcagtgctgtttctttctagatagtattactcgcttcggttatcttaccaacataacatctatgctttccatcctactctactataatctcaggtagtttcaacatgctgtggctgcagcagctgcgcgccctagtcctgcaacacctgcggattattccggtacgaccaaccggccagcttgaacaaacttctttgcctttgctttcacatcccttgctgctcaccgtactgtgacagtttcccctgctgcaatctgtcggagccgggacgtgatccttgaccttcaggtgatgtccacacgctttctctttgtgctctttgatgcactggatttcctgctcatggtgatcaggcaatgcgctctcgatagatatcgacagctctggaactggatcagccgcactgtcgtcatgcttatggtcatggcaggaatgcgtatctgctacatgcactgtttgctcttcatcacagcaatgatgctcatggttctgctcatggtcgtggcaagcatgctcagtggcacaaagcaagctgattggttcttcacagtgcttgtgatcatggcaatcatgctcatcggcagaatgtgaactgttgggttcttggtggtggctatgttcatggtcatggcaatcatgcttgc

SEQ ID NO: 199 - DNA, 874 bp, Triticum aestivum
  Clone ID: PAT_TA_199
gtcgccgctcaaccctttcaatcaccgcacgtcaacgccatctccattacctacctaaccctgtcatcgagctcgatcaacaagttttgtcaagaaacataggctcgatcagcaagcatccgtcgctccgatccgatatgtcgccgtctcactgccgccgactgctggcggtggctctggtctgcgtactgctcctgtggcggccggccggagcggctgagtacccggtcggcgacggcatcaacggctgggacaccggcaccaactacgcctcctgggcgcagagccgctccttcgcccccggcgacgtcctagtgttcgagtacgtcaagagccagcacaacgtctaccaggtgacggaggccgcttaccggacgtgcgacgcctccgcggccggcgccgtgctcgccacctacgacaccggcttcgacaaggttcctctccccgaggccaagagctactggttcatctgcgagatctccggccactgcatgggcggcatgaagctcgccgtcaacgtctccgccgggccttcggggggcggggcaccggcgcccgacgctccgccatctccatcggccggggccgcctgccgcagcagctgggtggcctgggccgccgggttggtggtgctcgccgcggtgcacgtcttggtcaattgagctagctagtttgacctgttcaaagttggctcatgtacgctagctgtttattcttctgtccctgtccaatttttgtatttaatttatgattttttgcgaatcagtcatgattcacagatacaacattcaattcaattgcagccactgtttgccacaaacatttgcatgaaattttaatggttgatagaattatgcggcaagttttgtttttc

SEQ ID NO: 200 - DNA, 372 bp, Triticum aestivum
  Clone ID: PAT_TA_200
cgatgctgcaaaacatgccatgttgcaacattaaagcatggtttttcttacactgaaggatggacagacacaacttgcagataacatggtgcttgcctcttcggttctttcggaacagtggcttgaagaagaaagcatacacacagaatggtagctgacggaagcatgaggaaatgcagggagcgtggcggcgatctagatgcagggttgtttatttcttggtttttatgtacgtgacagatgggcattgccatgacgactaagtttctggatgaaatgggagggagtggattgattggtcaggcctgtgcctgggcccgcttcgcggttgcgctgccagggctccaacgctgcttcggttcagacttggac

SEQ ID NO: 201 - DNA, 877 bp, Triticum aestivum
  unsure (1)..(877): unsure at all n locations
  Clone ID: PAT_TA_201
gattgacaacttgcatagcctcttcggaacagtggcttgactacgaaaacatacatatagaatggcacatgaaggaatgcatgacataatgttacgacaacgcctgcgtggcagcgatctagatgcagggtggtttatttcttggttttatgtacacagatgatgatgatgcagcggcacgcgtgacagatgggcattggccatgaacaagtttctgaatgaaatgggagggagtggattgattgatcaggcctgtgcctggacccgcttcgcggttgcgctaccggggctcggtcgctgcttcggttcagacttggatgcacctttcgccgtgttcttggaaccgacggaccgagttttctcgctgctgctcgcctggccttttcttgctccgccgctggcagttgcgttgttaggaagggatagccgcttcctcgttggtgcattgacttgtgctggcctttccttcgggttacttgtggaccgcggagccggatctgtagtctgagtgctgacttcctctgaggtttgatccgacggcttcggttgagggctgacttccttcagaggtttgatccgatggcttcggtttcagcttagatgatcccaaagaagcggtgggtggcacagccgcagattgccctgatgaagaaccacttgcatcagaatgtgacttcttgtgttttgcctctcgtggtcttggctttnanccattnaacttgaatgcccggaaactncaaattttccttttnggttgtttaacatccctgtccccattttcctcagcctccttatcatcaccaattggtacattctctttggcattactgtccagtaacctgttctcccacgggcgtacagccacccacctctccac

SEQ ID NO: 202 - DNA, 925 bp, Triticum aestivum
  Clone ID: PAT_TA_202
gccggccgggccgggatcttctataaagacctcgaacagcacgacatcctcactgtaaatcccaaaacaaagtatagaggaacgggcttcgtatcctccactattaaaatcacagcagtatcaagtaattgtctcattttttagcacgccaacatcaagatggcggacagctacgcaaaaatcccttctggcgctttggtccagccaacgcctttccgagtctcaattgaagacgaaagggttgaagagcttaaattacttgtcaagctaggcaagattgcaaatcctacctatgagtccacgcaaaaggagcacaactatggtattacgcaccaatggctcactgatgccaaggatgcttggatgaaatttgactggcgagctgctgagaagcgcatcaattcattcaaccattggaaagtgcctgtccatgacacaaaaggcgactttgatatgcattttacaggtctcttctcaacaaagcccaatgctatccctatagtgatggtgcacggctggcccggaagtttcctagaatatctcggcgtcttgtcaattctgaaggatcgttacacttccgaaacactcccataccatattatcattccgtccttgcctggtttcgccttttccagtaagccgccgatggaaagagacttctgcatcgaagatgcttcacgcattatcaacacccttatggtccagctgggatttggcagcggttacgtcattcagggtggtgatctcgggagcatagtagcttgtgagctagctacgaattacaaagagtgcaaagcgcttcatctcaacatgtgtatggtacccgagccgtccactgtcacaagtgaagtcaccgaagctgagaagcaagcccttgagcgcggcaaggactttttcactcgaggctcagcttacgcctttaccc

SEQ ID NO: 203 - DNA, 895 bp, Triticum aestivum
  Clone ID: PAT_TA_203
gccggccggccggggaaggaagaatcactgatttgtactctgttcccaagcgtcatctttctcagcgcagcacttctataatttagcggcctcaccttctgtaacaccaacaccaagtgatttacaaacaccaccaaaatggctttcaagatacagctcgacaccctcggccagctaccaggcctcctttcgatctacacccaaatcagtctcctctaccccgtctctgattcctctcaatatcccactattgtcagcaccttcgagcaaggtcttaagcgcttctccgaagccgtcccatgggtcgcaggccaggtcaaagccgagggcattagcgagggaaacacaggaacttcctttatcgtcccttttgaggacgttcctcgtgttgtagtgaaagacctccgcgatgatccttcagcacccacgatcgagggtatgagaaaggcgggataccctatggcgatgtttgacgagaacatcatcgcgccaaggaagacgttacctattggacctggtactggtcccgacgacccaaagcctgtaattctattgcagctcaacttcatcaagggcggactcatcctcactgtcaacggacagcacggtgctatggatatggtaggccaagatgcggtgatccgtctactctccaaggcgtgccgtaacgacccattcaccgaagaggaaatgacggccatgaacctcgatcgcaagacgatagttccttaccttgaaaactatacgattggccccgaggtagatcatcagattgtcaaacctgatgtagctgggtggtgacgctgttctcacgccggtcagtgcaagctggggcgttcttcacattcagccccaaggccatgtcagagctcaaggatgctgctaccagactctg

SEQ ID NO: 204 - DNA, 846 bp, Triticum aestivum
  Clone ID: PAT_TA_204
tcaggccggccaggtcgggaaacaacaaacaacaactttcatcctacaattcatcatggacagtgacagagactacttgctctccctcagggcagttcgaattcatgccaacaaagtctttgaggctgcgaagcgtggagagctgaagcatttcgactatgacgagagtcgcatgagcgaggttgctgattacgtatcaaaggtcattgatcgtgactttggtcccgacaagtacgacacaattccgcctcatggtcgctggcagcatttcgatgttggaggtgtcactcgtgttgactctctgatcaaacagtggaccagcgaatccgatgtcgacaagactgaaatcacaagacgcctgattgatcttttctttgtttcagttctcctcgatgccggtgccggcgatgtctggcgctacaaggagtctgattctggtcaagaagtcgtccgcagtgagggtattgctgtagcctcgcttcacatgttccaggctggtgccttcagctcggacgattcagcaaagaccagagtggacggaaacggactggttcagttgcatgaatcggctttcaacacacactttcaagtatcagctgacaacctcatggtcggcgttccatcacgagttcactttctccaagcggttggttcgtctctacttaagcaaccagaagtcttttggagagtccggccgcccgggccaaccctggttgattatctcatgactaagtcttctggactccaagacgttgggatacgagcagctctggtcttgcttgcaatcccttctcatcccctccctggcaggcaacaggacccgtcttcatggacaccaatcggcga

SEQ ID NO: 205 - DNA, 785 bp, Triticum aestivum
  Clone ID: PAT_TA_205
gccggccgggccgggatcatcactcacacaagcctcttctcagcatctccttcacctccgtcttttcttacttcatctgctgttctgtgaacgcattcgcttctaccactccttctactttaataccttctttttgcaccgctggttggttgcttcgctctctaatccctcagcaatcttctatacaactcactatcatcccaaccaactaaacattcaagatggctatttccaagtctttcgtccttgccgctcttttggcttacgccgaggctcgatttggccaggaacaggagcctgttgctgctgttcaggcacttgatggaactttcggcaaccctggtgttgctgctaccattgctggtagcatccccagtgctctgctcgccgctgctagcccttgtgacaagctcactattgctgatcagatgatcactgagcttggagatgaccaggctgttatcgatgcagccatcggcctcgtcgccgccgagaccaacttcaacccctcggctgttgacaagccctttgtctgtgccgaccctgccctacccgccactgctgctctccgaggaatcatccccctcgttgacccagctgttgatggcgccgccaccgagaatgccaactcggccacttcagttcaaaccccctttgacgctgcaggcctgtctcaggctgaggtcatgatcgcacagggattcaccacattccaggctgtcgatggcagtggtgccaacgtccagctcgccggtcaggatgctgccgctggaggcggtgctgct

SEQ ID NO: 206 - DNA, 829 bp, Triticum aestivum
  Clone ID: PAT_TA_206
gccgggccggccgctcagccaagacatcaccatcatcttccaatccaacactctaccaaactcttcaactctatcaaaatgaaggcctctttcggattcctcgccgcgttcctcgcaccagttacactggcccagtctctctgcgaccagtactcctactacgctaacggcggttacgagttcaacaacaaccgctggggccaaggctctggctctggttctcagtgcacttacattgactggaccaacagcaacggtgctggctggcacaccgactggacctggtccggtggccaagacaatgttaaggcctaccccaactctggtcttcagatcagcaacaagcgcctcctcagctccatcagcaacatgcagtccgccgctgcttggtcttacagcggaaccaacgttcgcgccaacgttgcttacgatcttttcactgcctctgaccctaaccacgtcacttacagcggtgactacgagctgatgatctggctcggacgatatggtggcgtgcagcccattggctccaaggtcggcaatgccaacgtcgagggccgcacttgggagctctggagcggcatgaacggtagcatgcgagtctacagcttcgttgcccccaaccccgtcaccaacttcaactctgacgtcaagcaattctggaactaccttgccaacacccagggataccctgccagcaagcaataccttcttaccttccagttcggtaccgagcctttcaccggaagcggtgctcagttcaaggttaccaacttccacgctcacatcaactaaacaaaagaaaatcggcgatgattatgagtctctg

SEQ ID NO: 207 - DNA, 951 bp, Triticum aestivum
  unsure (1)..(951): unsure at all n locations
  Clone ID: PAT_TA_207
ggccggccgggccgggctctgccaagacatcaccatcatcttccaatccaacactctaccaaactcttcaactctatcaaaatgaaggcctctttcggatnnnnnnnnnnnnnnnnnnnnnnnnttcctcgccgcgttcctcgcaccagttacactggcccagtctctctgcgaccagtactcctactacgctaacggcggttacgagttcaacaacaaccgctggggccaaggctctggctctggttctcagtgcacttacattgactggaccaacagcaacggtgctggctggcacaccgactggacctggtccggtggccaagacaatgttaaggcctaccccaactctggtcttcagatcagcaacaagcgcctcctcagctccatcagcaacatgcagtccgccgctgcttggtcttacagcggaaccaacgttcgcgccaacgttgcttacgatcttttcactgcctctgaccctaaccacgtcacttacagcggtgactacgagctgatgatctggctcggacgatatggtggcgtgcagcccattggctccaaggtcggcaatgccaacgtcgagggccgcacttgggagctctggagcggcatgaacggtagcatgcgagtctacagcttcgttgcccccaaccccgtcaccaacttcaactctgacgtcaagcaattctggaactaccttgccaacacccagggataccctgccagcaagcaataccttcttaccttccagttcggtaccgagcctttcaccggaagcggtgctcagttcaaggttaccaacttcaacgctcacatcaactaaacaaaagaaaatcggcgatgattatgagtctctgagagatgttgggatacggtggaaagattgtattttcttctattacatatatattatatccatgtatataacgcttagctacaagcgttttgttt

SEQ ID NO: 208 - DNA, 850 bp, Triticum aestivum
  Clone ID: PAT_TA_208
gccggccgggtggcgggctattctatgatcacaccatcagtttcttttacaggtctatcaaagacttgagctttagaagatgattgaccaagattggatcaagagcttgctcaacatccccgtcagccatgttgctgggattttcgcagcatcgactgttatctacttcctctcttcctgcttttacaacctgtacttgcacccactgagaaagatcccgggaccaaagctcgctgccattggaccctaccttgagttctaccatgaagtcatccgggatggccaatatctctgggagatctccaagatgcacgataaatacggccccatcgtccgagtaaacgcccgcgaagttcacatcagggattcatcctactacactaccatctatactgctggttctcgcaagaccaacaaggaccccgccactgtcggtgcttttgacgttccctccgccactgccgccactgtcgatcatgaccatcatcgttctcgtcgcggctacctgaacccttacttctcgaagcgaaccatcaccaacctcgagcctttcatccatgagcgtgttaccaagcttttgactcgattccaacagcatctggacgacgaccaggtcctcagtcttgatggtgctttttgtgctttgaccgccgatgtcatcactaatcgattctatggcaagcacaacgactatctcagtcttcccgacttccactttgtcgttcgcgacggattcttgggtcttaccaagatctacatcttgcacgcttcctccctggtctggtcaccattctgaagcgcctcccttactcttgtatccgcatgatcgcaccttctgtgtgtgatcttc

SEQ ID NO: 209 - DNA, 946 bp, Triticum aestivum
  Clone ID: PAT_TA_209
gccccgaatccggtcgaccacgcgtccgcccacgcgtccgctcacagaagcactaaccttacattcgacgagcaattaacacagatggtgctttggtcgatggccaaatcccccgtcatgtatggaggtgacttgaggcatctcaacgatgatacattcgatctaatcacccaccctactctgctgaagattaatcaccacactaaaaacaacatggagtttggttatattcacagtgaaaggacttcagaacgcaatgaacattctggtcgctcggacctgacaaacaatggtggaactgttcttggtcttgctacctgcaacgataagaacaccggtggatggcacagttcctcaaaagatcacatttgcagaggctttggaatccagaatgacaatgcctcattttgcatgtccaaagcaaaacttcttccaacatcggatggagttaccatgagcggtgtggaagaccaagcgaagttccatctggtgggtattgacaccaatgatggttgccgtccggcatctgtcagtcccatgttctcgacctgcgaacagcattcaaagcaggtctgggaggtaacggagaatggacaacttaaaagcagctactcaggattgtgtgctacattgaagtccagcaaggaaggagagagtgaaactactggagcacgagcatggacagcaactggagacaaaggagagatctacctggccttcttcaaccttgacactgcaagcaggaagattgctgtgagggtgccggatctagagaaggttgcagggagaaagttggcaaggaaacacttgtgcacctgcactgaagtctggagtggaaagagccggagtctcatgaaaggggacatctcagcggtggtgagctcacatggctccatattgtttgaaatccagtgttgagggctccctaatgttcgccagttcatct

SEQ ID NO: 210 - DNA, 1208 bp, Triticum aestivum
  Clone ID: PAT_TA_210
gcacgaggctcatctccgtctccatggccctggcagcctctcctcgcatcctcagcaccgtcctcgtcctcttcgtgtcgtcccttatctggggctcctccggggcagcggcggcgggagacggccggcggcggctcgccatgctgccgccgagagggtggaactcgtacgactccttctcctggaccatcgacgaggccgccttcctccacaacgcgcagatcatggccgacaagctgctcccgcacggataccagtacgcggtgatcgacttcctgtggtaccggaagaacgtcaacggcgccggggaggactcgtacggcttcgacagcgtcgaccagtggggccgcccgttccccgaccccgagaggttcccgtcgtccgccggcggcgaggggtttaagcacgtcgccgataaggtccacgccatgggcctcaagttcggcatccacctcatgaacgggatcagcacccaggccgtcaacgccagcacccccatcctcgacgtcgacacgggaaaagcctacgtagaggatggccggcaatggacggcgagcgacataggcctcacacacaggacctgcgcgtggatgtcgaacgggttcatgagcgtaaacaccgacgcgggagccggacgagcgttcctcaggtctctttaccaccagtacgccgattgcggtgtcgatttcgtgagactagggtgcatcttccccgccctttttcgcccgtggcgctgcggccgggtcggtggccctcagacgcgtggggcggccggtcatcctgtccatctcgcccggaaccgaagtcactccggcgttggccgagaacatcacccaacacgttgatatgtacaggataacaggggatgactgggacagctggaaagatgttcgcccgcatttcgatgttgccagatcatttgccgatgcgaataagatcggcgccactggattgcaaggaaggtcttggcctgacttggacatgcttccgtttggcaggcttactgatgcaggtgttaaccagggccctcacagaagcactaaccttacatttgacgaacaattaacacagatgctactttggtcgatggccaaatcccccctcatgtttggaggtgacctgaggcatctcaacgatgatacattggatctaatcacccaccctactctactgaagattaatcaccacactaaaaacaacatggagtt

SEQ ID NO: 211 - DNA, 854 bp, Triticum aestivum
  unsure (1)..(854): unsure at all n locations
  Clone ID: PAT_TA_211
ggcttgtccaccacaccaccacgaggcggccggggtggcggcgccgcaaaacattcggttggctcgtcccggtgggaactgcccgcagctccacccatctgcttccgccgcacctaccagcgcatcgtctgctcctcgaccagctccgggcgcagattataactggcttcggataaaggtctcggggaggccacggattcgacgcatggggagctccgccagctgcctctggagcggctccaagtcggggccaggtccaaatggtctagcggccgcggctgcgtctcctcggtctggccatgtattatcaagatccggacgaaatatacaagtcttctccctaaaagagttgaaatctgccacacggaattttcacatgatgaactgcattggccgtgggggttttggaccagtttataagggagacctgagagatggcacccaagttgcaattaaaaggctttcagctgaatcaaagcaaggaactaatgagttcttgacagagatcgatgtcatatcaaatgtgaggcaccccaaccttgtaaagctcattggttgctgtgtcgaagggaataacagattattggtgtatgaatatgcggagaacaacagtttgtcaaatgctttgcttggaccaaagagtagatgtattcctttgaactggcaaacaagagctgccatttgtactggaactgcttctggtcttgcatttcttcacgaggaagcacaaccacgcatagtccaccgtgatatcaaggctagcaacatcttacttgataagacgctggctcctancattggagattttgcactggccaagcttttccctgatgccatcactcacattagcacgc

SEQ ID NO: 212 - DNA, 528 bp, Triticum aestivum
  Clone ID: PAT_TA_212
gccggccgccgccaccaaccgacgactccaaaaaaccaccctcacgagactcgacttcccgtgccaaaaccgccaatatgagaccgactcagatgctccgaagcggcgctgccgaccccaagaacggacactacattggtaactggggccactttggtggtgagaagcagcgaggtatcatcacctacggtctgtccgccaaccgacagaacccctgggctggctccttcaacgacgccatcttcaacactttccgccgcaccaagggccaaatcttcttctggctccctcccatggttgccggttactggatgatgagctgggccatcgagcgaagcgagtaccttaactccaaggctggtcgtgccgagttcggtgacgaggaggagtaaattggttagatactggcagcaaaaccacggcggatgttttggggtaggtcctctggactcattgtacatcatcaatacctagatcaggaggtgcaatagacatttgtcgcaaaaaaaaaaaaaaaaaaggccccta

SEQ ID NO: 213 - DNA, 1133 bp, Triticum aestivum
  unsure (1)..(1133): unsure at all n locations
  Clone ID: PAT_TA_213
tangatgcttgnnngtgnnncaatgcttgccatcatcnnnntggtctcggcgccggcgcagcccgcgaggcgccgcagcgcggccatgacgaggaccctgacctcggcgtcccccgcgccggcgagccgcgcgagcagcgccggcaccaggaccccgccctcctcgtcctccccgagcctcccctcggcggccagcgctgccacctcccgcgccacggcgccgagctcgggcccggcgccgttcttgacgcgcaccaggggctcctccatagagaccgcctcccggccggccggagtggatcgtgctcatacgtcgaccatggccacgcgccgcagcagcacgggcggctcccacgtctcctccctcctcgtcctcctcttcctcgcctccgcctcggcgtccctcctcggcgcccgcgccaaaggccccgtcgtggacgtcaaggcgtcctgcgccaagacggacggcccgatcacctgcaactccttcctcgggcccgagccggacaccaagacggcggacgcgcgcgggctggcggagatcgccatgagggtcaccgccaagctcggcggcttggtgggggcctacgcgcgccgcgagctggatctggtcaaggacaacccgacgtggcagtgcctggacgagtgcgccgaggacatcgaggacgcgctgtcgcacctggacgacgccctgggcggcgtcaacgacgcccagttcgaccaggtccgccagtacatcgacctctccgagcaggacacctggtcctgcgacgagacctgccgggacacgccgcccagcccggtcaggaccgagctgctccgcaagaacctcgaattcgagaggatgatgaacgttacccgccagctcatcaagctcgccgacgggggcgcctcgccggtgctgccgaaacccgctattctgccatgagctagatgcataattcacactaccgatacaccattcatgatgagcatatatatatgtacgcactcacttcgagtgttacatattagctatatatacatatagctaatataattgtacgtagtacttgttttattctgcaaaaatgtctcttatcaataaattaaactggttggcgaatagcttatctcggacaaaaaaaaaaaaa

SEQ ID NO: 214 - DNA, 919 bp, Triticum aestivum
  Clone ID: PAT_TA_214
gtcggccgctcgaggcggcgggccgggagttgagcacgacaccctcgagatcaacccccgcatcagtcattatgaagtccctcctcgccctcagtctcttcgcaggtctctccgtcgcccaaagctcagcctgggcccaatgcggtggtgaaggcttctctggttccacatcctgcgtctcgggctacaagtgcaccgttgtcaaccagtggtacagtcagtgccagcccggtactgctgagcctccctctactaccctcaagactaccactggcggtggctctactcccaccggaacacctggcgatggaaagttcctctgggctggtgtcaacgaggctggtggtgagttcggagagaagaaccttcccggtacttggggcaaggactttatcttccccgaccctgctgctgtcgacaccctcatttctcagggctacaacaccttccgtgtgcagctcaagatggagcgtgctaaccccagcggcttgactggcgcctacgaccaggcttacatcaagaacctcacctccattgtcaaccacatcactggcaagggagccactgttcttcttgacccccacaactatggccgcttctttgacaagatcatcacctccacctctgacttccagacctggtggaagaactttgctactctgttcaagagcaacagccgcatcatgttcgataccaacaacgagtaccacaccatggaccagacccttgttcttaacctcaaccaagccgccatcaacggtatccgcgctgccggtgccactcagtacatctttgtcgaaggcaaccagtggtccggcgcctggtcgtggcccgacgtcaacgacaacatgaaggctctgactgaccccgagaacagctcatctacgagatgcaccagtacctcgactctgacagctcc

SEQ ID NO: 215 - DNA, 876 bp, Triticum aestivum
  Clone ID: PAT_TA_215
gggtgcctaacaaaaatgccctaaggcatcagtacaagcttcggttgagggataaataaataagaatacaaatgcagttttttttttttttttttttttttttttttttttttttttttttttttttttttttttttttttttttttgccattttttttttttttttttttttttttttttttttttacaacacaaccttggaaacatttattaataactattttcgccctaaggcatcagtacaagcttcagttgagggataaataaataataatacaaatacaggactactgaattatggagcgagcacagaagctccttgcagctacatagccgagaaataagagtacatatgccatgaatgattacatggaatctagattttactgatgacaccatgcatcttattcttcaattattaattaggacctgaagtgaatcacagcaggcgaagccatcggcaactccttagtaatctcctccctcaacatatccttctcctcagtggttcgtggataccgagaaggacagaccttgatattgggatcctagtcaccgcagtcctcgcacgcctgcccagtcgtacaaagatatctccttcatgtgcaccgcgatttccatgacacgcctaatgtaagacacaaagttctcctcacgatataacatccttgcggagagcttaaccagaatcttgtgcttaaaatgaacagcagatggttgccactccacgtttgctttctcacagtaaccctttttccttcgaacatccttgtttgtctccatttcacaccaatgatcccacaccgtgatgcatagctcctttagggagcttgcagcttcaagaatgaacatggtccaatcaatattgccggacg

SEQ ID NO: 216 - DNA, 762 bp, Triticum aestivum
  Clone ID: PAT_TA_216
gccggccgggtccggaaccgttctcgctgcctaagaacatcatcaagatttaacaaaatcttttgtctacagacacaacattcactctacatcaaatcgcatcaatctatttcaccatgccgccgccttcacaactcgccattgctacaggctccgtcaaccgccttctcaaggaggaagcttcgtaccacaaagagctcgaacaggaggaagccagcattgaagccttgaagaagaagattgacagcggcgccggcgacagtgatgagaacgccccgtacatactcaagcagcagcaaaccgccctcgagcagacaaagggcgttttcggacccctgcgagaaaagattgccctcgctatcgagaagctagaggagcagctcgctgtaagcgaccagctcaacgtgccggaggagcaggtgcagcaggccaaggagacgctggccaaggccaaggccactcagaccgatgcgtaatacagcatacgaaaagacgggggaagggaagaattactttacgatattaatcatatgagacttgatgcaaaagaaaaacttctaaaaatttatgcacttgagagtccataccaagtatcttgcataagaggtttcgtctccctgcatctaccattgtgttgcatgggatcgaaaggagaacaaaatcagatgtacttgagggtatcttgaaaagtattaattacaggaggcggacaaaaaaggttccatactggtaaccaatgtcaaagactaattatccacttcc

SEQ ID NO: 217 - DNA, 1236 bp, Triticum aestivum
  Clone ID: PAT_TA_217
ccacgcgtccgcggacgcgtgggcggacgcgtgggtcttgttccattccagctcaggcgagcagcgaccaccttccggcgagggtagcagcgatggagggcaaggaggaggacgtgcggctcggagcgaacaagtactcggagcggcagcccatcggcacggcggcgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgaccagggcggtgttctacatcatcatgcagtgcctgggcgccatctgcggcgctggcgtggtgaaggggttccagcagggcctgtacatgggcaacggcggcggcgccaacgtggtggcgcccggctacaccaagggctccggcctcggcgccgagatcatcggcacctttgtcctcgtctacaccgtcttctccgccaccgacgccaagaggaacgccagggactcccacgttcccatcctcgccccgctgcccatcgggttcgccgtgttcctggtccacctggccaccatccccatcaccggcaccggcatcaacccggcgaggagcctcggcgcggccatcatctacaacagggagcacgcctggtcagaccactggatcttctgggtcggccccttcatcggcgccgcgctggccgccgtgtaccaccaggtggtcatcagagcgatcccgttcaagaccaagtcctaagccgctcctgctgctgcaaagaagatgccagcccaaaccgaagagcaggctgcgtgttctgaatttctgatggggcggctatctcttcccatcatcatccgtgttactaccgtggaattccaatttgtcttccaagtttgatgtactagtcttgctctgtattcacctgaacctggacccagacttgtatgtaatctcaccagtactcagttgtgtgtgcaaatccaatccaatcaagtttattcatgtgtataaaaaaaaaaaaccccccttagaa

SEQ ID NO: 218 - DNA, 1438 bp, Triticum aestivum
  unsure (1)..(1438): unsure at all n locations
  Clone ID: PAT_TA_218
cggcggcgtcggcggcgccggccgcggccccctcgacggcagctcacagaagccgcccatcttgctccgttccagctcaggcgagcagcgaccaccttccggcgagggcagcagcgatggagggcaaggaggaggacgtgcggctcggggcgaacaagtactcggagcggcagcccagcggcacggcggcgcaggggtccgaggacaaggactacaaggagcccccgccggcgccgctgttcgagcccgggcgaggctcaaagtcctggtcccttctaccgcggccggcatcgccgaagttcatggccaccttcctcttcctctacgtcaccatcctcaccgtgatgggctacagcggcgccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtgggtgaaggggttccagcagggcctgtacatgggcaatcggcggccggcgccaactgttggtggcgcccggctacaccaagggctccggcctcggcgccgagatcatcggcaccttcgtcctcgtctacaccgtcttctccgccaccgacgccaagaggaacgccaggggactcccacgttcccatcctcgccccgctgcccatcgggttcgccgtcttctcggtgcccctggccaccatgcccacccaggggcaccggcgttccccccggtcgggccccctgccgaagcggtgatctacagcggtccatggcccctcgtgggaccactatacctccatcaccggcaccttggtaggaaccgcgcgagcgaccgtcggcgcgcccgtgcatctcagaacaatcgagtacgcctcgaaccagaccactggatctttctgggctcgaacccttcatccaggcgccgcggaagaccgccgtccgaccaccagatggttcatgcgggagctatatctcttttaaggccaagtcctatacctgggactgtcctttcgtgcttaccaagaagaatccaacccaacccgaacgagcaaagctgcgtgttctgaatttctgatggggcggctatctcttcccgtcgtccgtgttactaccgtggaattccaatttgtcttccaagtttgatgtactactagtcttgctctgtattcacctgaaccggaacccagacttgtatgtaatctcatcagtactcagttgtgtgtgcaaatccaatcaatcaagtttattcatgtgtgcaaaaaaacaaaagggggcccggtnccattcgcctaaangggccnnataccgggnaatgnctcnttaaa

SEQ ID NO: 219 - DNA, 1184 bp, Triticum aestivum
  Clone ID: PAT_TA_219
gccggccgccggccgattctcccaacaccagcccctctccccatcagcaactgagagaatgaagttcctgaacaacgatctgcttgcttccagcaccctccttcttgccactcttggaggtgcctcagctcaatgttccctccctactagctaccgttggacttcaagtggccctcttgctcaacctgccaatggctggaacagtctcaaggacttcaccgttgctccttacaatggtcagcagctagtttatgctactgcctatggccaaggtggttggaagtcgatgggctttagccctgtgtcggatctgaacaaccttggttctgcgtcgcagactcttcagaccggtaccgctgtggccccaactctgttctatttcagacctaagggtatctggatcttggcccatcaatggggccctaccaagttctcatacaggacttcaaacaaccctgccaacatcaatggttggtctcaaccgcaacctctctttactggagaaattgccaatgcaccattcggccccatcgatcaaaccgtcattggcgatagcagaaacatgtacttgttcttctgcggcgacaatggtagaatttaccgcgcgtccatgcctatcggcaacttccctggaaactttggatcgaattcccagattatcctgcaggatactgaagacaacctcttcgaagccgttcaggtttataccgtccaaggacagaacaaatatctgatgattgttgaggccaagggtagaaatggtcggttcttccgatctttcacagcgaacagccttgatggtcagtggactgtcaatgctggcaccgaaagcaaccccttcgccggcaaggcaaactcaggcgccacctggaccaacgatatcagccacggagagctgatccgcactgccaacgatgagacattccccattgacccttgtaacttgaagcttctgtaccaaggacgcaaccccagcatcaatgtcgactacaacctcctgccataccgccccggtctcctgacactccgtcgatagatcgttggtctgttatgtttataaaatgtctgtccttacctctttagcatatatgcttaggtagctcacagtagttcactcattgtatagtcaattcaaacttgttgcctgaaaaaaaaaagaaaaaaaaaaaaaaaaaaggccccta

SEQ ID NO: 220 - DNA, 760 bp, Triticum aestivum
  Clone ID: PAT_TA_220
gccggccgggtacgcggactcctaaacatacttctctcccatataaagaaactttattctctacggtggcatccatcgacgccatggctgcggcttctcctcccctcctccccgtctccgttctcccggcggccaccaccgcgaccaccaccatcgtcctccccgttccggacacctcctcggcggccgaccagcgcgcctacctctcccgcctcctcgactccgccaagcgctccctctccggcgcgcgcccgtgggcggagctcctcgaccgcgcggcgctcagccgcccggaatccctcgccgacgccaccgcccgcgtccgcaggaacctcgcctacttccgcgtcaactacgccctcctcgtcgcgttctccctcgccgcctccctcctcgcgcacccgttcgcgctcgccgccctgctcgcgctcctcgccgcctggtgcgcgctctacctcctccgcgccgccgacgcacccccgctggaggcctttgggaagaccttctccgagagggagacgctgggcgggctcttggcggcgtcggcgttcgtcgtgttcgtgacctccgtcgggtccatcgtcttctccgccctcgcggccggcgccgcgctcgcctgcgcgcatggcgcgttccgggtgcccgaggaacagctcttcctcgacgacgacatacagcctgggcgctggaggaagagtgggctcctccgtcgacctggtctccttcttcaccaacgccgccggaggaggacgctggacgc

SEQ ID NO: 221 - DNA, 853 bp, Triticum aestivum
  Clone ID: PAT_TA_221
gccgccggccgtcccggggttttccctcttctttcctctccatataccctcatcttatatacacctatacatcatgtctgtccccgacaagttccagggcttccagtcccccagcgccgagcactggaccgacttccagaagaactcattcgagcctcgtccctttggtgaatacgatgtcgacatcaaggttgagtgctgcggtgtttgcgccagtgatcgccacaccatcagcggagactggggtgcctgcccttaccctcttgctgtcggccacgaggttgtcggcaaggtcctccgtgtaggcgacaaggtcactctcgccaaggttggagaccgtgtcggcgccggtgcccaggtttggtcctgtatggactgccgtcagtgcaagaatgacaacgagacctactgcaaggaccagattgacgcctatggcgctgattaccttgacaccggattcaagacccagggtggttactcttcccacagccgagtgcatgagtactgggtctaccccatccccgaggctctgtcaagcacccaagctgctcccatgctctgcgccggtatcaccgtatacagccctctgaagcgtctcggcgccggtcctggaaagaaggtcggtatcgtcggtatcggtggtctcggtcactacggtgtcatcttcgccaaggctctgggtgccgaagtctgggccatctcccgctcgcgagccaaggaggaggatgcccgcaagatgggcgccgacggtttcctggccacgggtgagaagaactggaccgagggccacaagatgacatttgacatcatcatcaacaccgctacctcgttcgatggcttcgctctcagcgag

SEQ ID NO: 222 - DNA, 878 bp, Triticum aestivum
  unsure (1)..(878): unsure at all n locations
  Clone ID: PAT_TA_222
cgcccgccgccgccgcccgcctgtggaagcgcgccgcctccctcctcctcgcccgccgcacggccctcgccgcgcagcgcgccccggcgatctcgggatccgccgcgggcgccacccgccgcgcgcccgccttcttctccaccctcgatgcggggcaggcgaggacgcgggtcgaggacgtgatgccgatcgccacggggcacgagcgcgaggagatcgaggccgagctccagggaaagaagcggtttgacatggacgcccccgtcggcccattcggcaccaaggaagatccagctatcattcagtcatactttgacaaaaggattgttggttgccctggcggtgaaggagaggatgagcatgatgttgtgtggttttggttgaagaaaggcgagccacatgaatgcccagtctgcactcagtatttcaagcttgaggttattgggaacggaggaaaccctgacggacatgatgatgacgatgaccaccaccaccattaagatcgaagagagggcatgtctactgatgaaacagtggaccggtgccgattatttttgttgctgagattctttgaagctgtgaaaaacaccagcttttttgcgtgcccatagagtttaatacccatgccaaccagtttgctgttctcagttgtcatgactgggaaatcagagcagcagagggccctggaaacatagttttcttttctttttggggaattgccgcacacgaataatgtgattcattaaacaaacagtgactccctttcattttcaaaaaaaaaaaaaaaaaaagnnaagggtataggggggcaccaaaaaaaaaacaaaccgggggagcgctcttaaaaaaaaaaaaaattttacctgcggggggggggg

SEQ ID NO: 223 - DNA, 1009 bp, Triticum aestivum
  unsure (1)..(1009): unsure at all n locations
  Clone ID: PAT_TA_223
gcccgcagggcccggcattcgaaccgaccccgccccagagagagcgagaccgcgccattcgaaccacccccgaccccgacctgtctcctccccaccctctccatcgcccgccgccgccgcccgccatgtggaagcacgccgcatccctcgtcctcgcccgccgctcggccctggccgcgcaccgcgccccggcgatctcgggatccgccgcgggcgccatccgccgcgcgcccgccttcttctccaccctcgatgcggggcaggcgaggacgcgggtcgaggacgtgatggcgaccgccacggagggagagcgccgggagatcataggccgccctgcagggaaagaagcgtcttgacatgaaccccccagtacaggcttttcggttagccaggagggtgaaggtatcattcagtcatgctgtggagaagaggattgttgattgaagtcggtggctgatggatgggaagagcataatcatgtgtggtttcttggtgtgatgagagacaagagacatgaatgcccggtctgcactcagacatctcacgcttgaagttattaggaacggaggaaacactgacgaacatgataacggcgaccacgtcccactccatcattaagatggaagagtaggcatgtgtaatgatgacaaggtgttctggcgcgaattttagagtttaataacattgcctgccactttgatgtactcacttgtcatgactgggcaaatcggagcaacaaagggccctggcaaacatagtttttcttttccttttggcagaattgccgcacacgaataatgtgattcaccaaacaaacattgtctcatttttcgatcactccttgcctttcaaacaataaaatagattggacttgcacggcacccaataccaccttcggcgcgccgttcatctagtcaataaggttttaattgctgatttgcgtggacggctccaattttagtgggcacatcaacgttttgctggtgggcganttgttaaaaaaaaaaaa

SEQ ID NO: 224 - DNA, 825 bp, Triticum aestivum
  Clone ID: PAT_TA_224
gccggccgaggattccatcacgcaattccgatcaatctattccatcacgcaattccgatcaatctcttaagcttaattagctttccagagctacaggcgatcgaactcaacctagctagcgagcacctgccatcaaaaaccggccattagtgaaccttcggtcatgaggtcgtcgccatggatggtgttcgcgtcggcagcggttgttctgctcgccttggccgcctcgtcggcggtggtggacgcgtcgccgccgtcgaagtctttggaggtcgggttctacaagcacacgtgcccgcaggccgaggacatcgtgcgcgatgccgtccgccgcgccttcggccggaaccccggcctggccgccggactcatccggatgcacttccacgactgcttcgtcaggggctgtgatgcctcggtgctgatcaactcgacgccggggaacacggcggagagggactcgccggcaaacaaccccagcctacgtggcttcgagatcatcgacgaggccaaggccgcactggaggcgtcctgcccgcgcaccgtctcctgcgccgacgtgctcgctttcgccgcgcgtgacggagcctacctcgctggcggcatcgcgtagggcgtccccccgggccggtgcgacggccccgcgtacaactcccacgagctgctcgtcaacaacgtgccgctccctacagacggggtcgacgagctcgcgatgagcttcaacgcctctcaggctccgccgacgttatcctcacgctctgctcctccctcaccatccggatctcccactgctcctccttcacgcagcggatacacaactttctc

SEQ ID NO: 225 - DNA, 1268 bp, Triticum aestivum
  Clone ID: PAT_TA_225
gccgcatcgagccggccgggccgggatcctcattcagatcatcaacatacaaccaaaccaattcgactccacttacaacaacaacaatcatcacaagtagccagcaccatatctagtgcttgcctacttaactcatatccattgacttttcaatccgtcacaattcttcttcaaatcaaaccctcttccaaacccccaacaataccgccaagatgagtgcacagaagacctcggccatcgctgaccaggagcccgttgacgttctcttcgctattcacgaaaagttcgatcttctggactttgccggcgcgctcgaggtctttacttctgcatgtcacaacttccaggatcctgagaacagcaaggcctttgaggtcaccatcgtcggtcccgaagccaaggtcatctcggaccagggtgtcgtcgttggcgcccagatcacctacaaggaggcacacgaccgtcttgaggactttgatatcctcgtcgtcgtcggtggtaactccaaggaggttgtcgccaaagagcttcaacccctctccctgatcaccgacttctcagagcttcagaagcgtgatcccgctcgcgagcgcacgatcctctctatctgcaccggtgccctcttccttggcaagcagggcatcctctctggcttgtctgccaccacccaccccgattaccttacttcatttgagaatatttgcagcgatgctgctaccgtaaacctccaggagcgtaccgatgtggtagaggacgctcgttatgttgtcaacaacctgcgattcgatctcggggaggacgagagcccatacatccgccgcaagtccgatgctggtcagggacgtcgcccttcggcagcccgaaagggaagcatgtcgttcaaggactccaacacacgccgtgagtcaattgttcgtcgtgccgccatgcgacttggtgttctccgtgtggtgacatccggaggtgtcagctctggcattgatgctgctctgtatcttgtcagcgctctgattgatgatgctacttcgttggaagtggccaggcgccttcagtggacctggaacaagggcgttgtcgtcgatggtctcgacgtctaagatccctggcagtgagtgccgtgtacgaattaagagtttatgatgggctcaggcatagccccgattgagaccaatttccatatatttgtgtatttgacagctgagcgtgaggaaccctaagaaaataccaaaaagactaggagctctctatttaattcaattgtttggtcg

SEQ ID NO: 226 - DNA, 472 bp, Triticum aestivum
  Clone ID: PAT_TA_226
cccacgcgtccgccatccacatccacgagacacacacagcacagcatcggcgtaaagggaacaccagcaagatgtctcagctcgcccgcgccagcctgactgcgatggcgatgctccttctccttgccgctgctgcggcggcggcggggccggcggccggcggcgcggctgtggcggacccagcaggctgccaggacgacgttgtggcgctcaacgaggcctgctacaagtacgtgcagaagggcgcgccgacggtgccgccgtcgcaggagtgctgcgacgccgtgaagagcgtggacgtgccctgcgtctgcagctacctgggcagccccggcgtgagggacaacatcagcatggagaaggtgttctacgtctcccagcagtgcggcgtcagcatccctggggaactgcggaggatcgaaggtctgaagcaagaacaggccgctgaatggcaagcttggataatgtaagc

SEQ ID NO: 227 - DNA, 675 bp, Triticum aestivum
  unsure (1)..(675): unsure at all n locations
  Clone ID: PAT_TA_227
acgcgtccgcacgcgtaatggcccacgcgtccgcccacgcaaccatccacgacacacacagcacggcagcggcgtaaagggaaaactcccgcaagatgtctcagctcgcccgcgctagcctgactgcggtggcgatgctcctcctccttgccgctgctgcggcggcggaggggccagcaggctgccaggacgacgttgtggcgctcaacgaggcctgctaccagtacgtgcagaagggcgcgccgacggtgccgccgtcgcaggagtgctgcgacgccgtgcggcgcgtggacgtgccctgcgtctgcagctacctgggcagccccggcgtgagggacaacatcagcatggagaaggtgttctacgtctcccagcagtgcggcgtcagcatccctggcaactgcggaggatcgaaggtctgaagcaggaacaggccagctgaatggcaagcttggataacgtaagcagcgcagttcgcactgctggaataaataagacgtcctggtcaactcataggtggacgatgccggagcacaaggaatgcattgccattcagttgctggaaatatttataatattgtactttgactacgttgcaacttgttgcaagactgttgtattgccattcagttgctaaaattattatactttgactaaaaaaaaaaaaaaaanaaa

SEQ ID NO: 228 - DNA, 787 bp, Triticum aestivum
  Clone ID: PAT_TA_228
gcacgaggcctactgcagcggccgaccggccaaccatccacgagacccacaaccacaggacagccgcggcacggcagcagcgcaccgggaagaccacccagatcgcccagctcgcccgcgccgcggtgacggtgatcctgctgctcgctgccgctgccgcggcggggccggcgggctgccaggacgacgttgtggcgctcaacgaggcctgctaccagtacgtgcagaagggcgcgccgacggtgccgccgtcgcaggagtgctgcgacgccgtgaggcgcgtggacgtgccctgcgtctgcagctacctgggcacgcccgggcgtgcgggacaacatcagcatggaaaggaaggtgttcgacgtctccccgcgctgcggcgtgagcatcccttagcaaggtggagcggggatcgatggtctgaacagagcagaggccgggcaaccggcgagcatgtataacgtggacagcgcagttaggacttcgaaaataaataagacggcccggttagctcatgggtggacgatgccggagcagataagaagtattgctagccagtcgaagttatataaaacttcattgtccacttaccactttggatcccggagcactgtgattgtattcacattcagttattggtattatttaccgtattgtactttgactacgttgcaacctgttgcaagatgtattgccattcagttgctaaaattattatactttgactcgatgcaacttcccaatagtattataaaaaaaaaaaaaaaaaaaaaaaaaaaaaaaaaac

SEQ ID NO: 229 - DNA, 1379 bp, Triticum aestivum
  Clone ID: PAT_TA_229
gccggccgggtccggacgcccgactccaaatacgcacgatcttcaccaaaaaccaaaaaaacaacgcccgaaacccccccgaagagccctacaagcactttttacttgcttcgtttcagtgtcatcgtttcttgaccgctgaacattttttggagattttgtcgcgatggctatgatatagaatttgacgctcccacgagctttttacgcgttacaccctgggcactcttactggacactctctactgtttctcgaacctcgaaccactaccataaccataccataatccattcttttcttccgaaccgtgacctcgacatggacgatccagatgtagcatggcctgcctggaaattcggcatgaagagggatgacctctttaccaacctccaccaacaatacaatacctttaccttcaacctccaagatcccgaagcttttcatcatgacgtttacgaaatttcccacgatgccgataccgtcgatgagttccaccgcttgatggctgagcgaaagcaacaacggctctgcgagttacacgaatccctcgagtctctcgccgttgagatcatcgccaaccccaagttgatggactctgagcattggcagcatgctcttcaacttttccgcaccaaatcttttgactcgatcgtccgttattttgcaagctacctccccgctaactacgttgatcgtaacgaacgcgatcacgatactatttctattgcttcatcctcttattccgaagccaacagcgtcaagacagacagcactacggccagcagcgtcgacggtgtttcaagtttctttgatgatgagcctgtcatgaagaagaagtcccccctgtctattcacacagatatgcggtcatcttccatcgtgcaggcgcctccttcgccgccccactctgtggttgcgcactcagatgagtcttctgcttcgtctcctatggagtcgcaccgatactcttctaatcccccttctcgttccatgtcgttttctgggtccgtgtcaaggccttttcttcctgacttgccccgattactcgttcacgacgacgatgagacctcacagtccgatgacaatgacgaggccgtcatttcggatttggattgtgcagagagccagtcgtcactggacaccatggatgaaggggagcaacctcaagagtatgaggacgatctcgaagacgaggacgaatttcctactgctcaatttcctgaagatgctagcgacgctttcgatttctgtaacgataccccggagtccaatgacacaccaactcctcgacaggagactaccgcgtcctgctatgttgaatacaaatctgttgcggcctgggagaatccgtctcctcgtcgttcaacttccccttcgc

SEQ ID NO: 230 - DNA, 815 bp, Triticum aestivum
  unsure (1)..(815): unsure at all n locations
  Clone ID: PAT_TA_230
gtgcggcgctcgggccggccggtccgggaattctttaatcttttccctttcccatacaaagggtcaactcttctattctgatctgcctttttgatctttgctccagagagatcaatcaccaccatgacgtccaaggaggaaaaggtcgacattggcactcacacgccgccgtcgcacgaggtcgcgcccggacaccaaaaggatgtcttcactggcgacattgagggagttcgcgaagattttcgcgaggatgacttcatgacccgtaacggtctgaacctcaagtccttccagcgccgtgactacggtaccggtgtcgtcgaactcgatcgctccatgaagaagcgccatctccacatgattgccattggaggttctatcggtgctggtttctttgtcggttccggtggtgccttcaccaagggtggccccggcgctgtcctcatctgcttcatgatcgccggtgtcatgatcttcaacgtcgtccacgctctcggtgagctcgctgtcatgtaccctgtctctggtggtttctatacctactctactcgcttcattgatccttcctggggttttgccatgggttggaactacgtctttcaatgggtcatcgtcttaccactcgagttaaccgtcgcatctttcactgtgcaatactggaatccaaacatcaatgaaggtatttggatcaccgtcttctggctgttcatcatcttcatcaacgtctttggtacacttggttacgnccgaggagggagtttggagttcttgcttcaagctcgccgccattatcatcttcatgattgtcgccgtcg

SEQ ID NO: 231 - DNA, 740 bp, Triticum aestivum
  unsure (1)..(740): unsure at all n locations
  Clone ID: PAT_TA_231
anacaactcttctactttggtttgttttctacgcaaattcctttgcttattatggactagtcttgctgaccgcgcaactgagcaatgcaaatagaagctgcgcatctgggctgaaatatgtgaagagtgaaacagatgccagcctttacaaagatacatttgtcactagtcttgcagagattccggggtctaattgcatctgctcttcttgttgaatggtttggccgaaaagctacaatgtggtgcttgctcttcacatgctgtggtttccttggcccacttgtgttttatcagagtgagctatggacaactggccttctatttggtgctcgtgcttgtgccatgggtagctacacagttgtatgtttatatgccccagaggtatacccgacgtcggtgcgctcgaccggggttggaatcgcgactgccatgggcagagtcggtggaattatttgcccccttgtagccgttgggatgctgagaagctgccatcagatggaagcaatcattgtgtttgaggtggtgttattccttgctgcaattgcctgcatgctcttcccttttgagaccaagggccgcgcaatgaactgatgatggtcatggtgtaaacaagtaaaaacacttggaccataaaattcgtcatgctgcttcgcgtgaacgtttatatacaaactgttatatgtctagtattttagtggacatgacgatgaagattcctcgaaattcatttcggggtttcg

SEQ ID NO: 232 - DNA, 1753 bp, Triticum aestivum
  Clone ID: PAT_TA_232
tgctgcaaactctccccgcagcatctagtacttgcagtgtattccggggtctggttccatcggcacttcttgttgcattgtttgtccgtaaatctcctatgtgcgcatttctcttcgcttactgaggtatcctcagccctcttgtgttttagtggacatgacgatggagaaccggcggacattcttgtcggggtttcggtcgcttaggtacatccttttgtaaagtcctcgctccctcagacggtaagcaggtgtttggtatggtttcgtttgctatgtttggtcccttgttaccgttgcgatgctgaggagttggcatcaggatcaagcaagtcattgtgtttgaagtggtactattcctcgatccaattgcctggatactcttccctttattagattaacggacgcgttaatgaactgattatggccatggtattacctagtcaatataggtatacccaacgtcgttgcgctcgaccggggttggaatcgcgacagccatgggcagagttggtggaattatttgcccccttgtagccgttggaatgctgagaagctgccatcagttggaagtcatcattgtgtttgaggtggtgttattccttgctgcaattgcctgcatgctcgtcccttttgagaccaagggccgcgcaatgaactgatgatggtcatggtgtaaacaagcaaaaacacttggaccataaaattcgtcatgctgctatgcgtgaatgtttatatacaaactgttatatgtctagtattttagtggacatgacgatgaagattcctcgaaattcatttcggggtttcggatgttattggacatcattttgtaaagtcctcactccttgagactgtaagtaggagtatggtatggtatgtatgtataaatttctcctggtgctataagaagttccttgcattctgcaaacctctttgatggtgcagcaggccaagaaaccggtggaagttcttctcatactgtgaaccattttcggtcagctatcaagagaaagaatgttgctggaagtctcggagagtcttctgccaatgggagttcacgcaatcatcgccaaaacaatgacatgctgctaccttcgctgtccagtcatgaaagtactgctaatttaaatatgacctctgtaaactatggtttttcataccctcccatggagcagttggaccagaatactgatacctcagaagatgacattttttctgacccttatacactatctggtcatctgcatgaaaatcaaagattcctgagaaatacccggatgagaataagcgccaatgagtatgagcaatcacttactaatctgctgcctgaggaaagtttcaggtgttcagctcatcagcctgcgcggcaacagtcttcttttacgccagtgcaacctagaggagcgagttcttcagcaagttctcaaaatcgtcctcatgtacctgctgttgctcaattctcgcaaagtctgcagcgacatccatcaaatggtaatttcggttcaagagtagggagttctgctgatacaataaatccgacacctgcttcacaagatccgggtgccgcccgcgcgaggcgctctccccctgcccccttgctgctccgtccggcgtcgtctgctcctcattcttcctaccggctcccggcgcccggaagcagaagtaaccagcaaaatcccagctccagctctacacttcgagctgctgcaaatgtaggaccccaacaggttcctgggttgaattcatctca

SEQ ID NO: 233 - DNA, 1119 bp, Triticum aestivum
  Clone ID: PAT_TA_233
agaaacacggtgggagaaagaaaaggaacccgaagtcggtcgctgggtcacccactcgctggacgctcctagctaggtcacccacttccccacccagcgccgccgcggaaagggaattgggcgatggcgatgtggatgtcggcggccacccgcgcgatgcgcgtccacgcgcgccgcacccccgcctccttcctcctccgcgactccgcccgcccggaccccaaccgggcgctgctgcagggccaagcgcccgcgccccgctggtactcgggagccgccgcgggcgccgatccgccgtcgatcccattcccagcgcaccttggcgtggccacagtgccggacctacatgtgttcgtcgtcgagcgattcggccactaccacaagatcctgccctctggggttcacttcctcttgcccgtcgtcgaccgcatcgcgtacgtccactcgctcaaggagaagcccatccgcatccccgactatcctgcggtcaccaaagataacgccttgatccagtttggaggattgcttcatctacagatatcagatccgttccttgcctcctacgctgtggacggcaaccccattcacgctgtcacccagcttgcagagactgttcagatgagggaaatcggcaagatgacccttgagcagagctttgagcagcgagaccagctcgaccgcaacattatgaagtcaatgaatgacgcagcgtgcgaatggggggtggagtgtatcaaatatgagttttgcattcaatgggagcgaagtaagtcactgtatgaggtgctgtccaccagcgacgacatgggcggcgtcttgtcagatgacaagcaggaaccagtgccgcataccaagcaagagtagatgtgtttggtgtggaagtcgtcccggcacttgagtatcaaaccagtggtgacttttgttgcatgagtttttgtttgtgcacggggtggaacaagtgtgaggagaagtgcaggctgccttgagctatgactagttaagcaaaattaacttgctgttgccaacggagctagtcctttttggcttgatatatctctctgacatgttaattggtaatgccagccgttttagctttggatttgcaaaaaaaaaaaaaaa

SEQ ID NO: 234 - DNA, 778 bp, Triticum aestivum
  Clone ID: PAT_TA_234
gccggccgggctggggttcgtcggtcttctcatcaccagcttcaacatccaaacaatccttccaacttacaccacaactaaaacaacaacaccaaaaaccaaaaccaactacatcaccactatgcctgcctacgagtactgctgccagtgtggaggcatgattgtcatcagcaccacctgcaccgcctgtggccacaagcagtgcaacaactgccctctctgctaaatgcccagtcaagacggcgacaacatcacctatcccactccttcttttcccctactcctctgaactctaccccagaggttgcaatgcccacgagatgagagtctcgacacaccctttctcagatgagacatgacgacttttaacgacggcgcatctccttctctctaccctcttcaacaatgacacagtcgtcacattcaccctttacttcttcgacttgattgatacccttcttcggcattccagtatcagcaacactggtctcgtttcaggtctttgttaagtttacaatgtgcttttccatctcttgcgaggcgcacaaaggaagcaaggaaatgacgtcggtggtctttttttgttctgcaaccagggcgtttcaatcgtgctagctttggaggaggcttgtctgggggaggaacggattcaaaacggattattttctaagtgtacaacatatcgatacccgtggtctcttttaagagggacttcttcttttctcttcaggatcgcagacaagaatacctaataacagggcttctcactttcttccct

SEQ ID NO: 235 - DNA, 1263 bp, Triticum aestivum
  Clone ID: PAT_TA_235
gccggccgggttccagcactcatcaccgcgacctgctagcaattaaccaagctaagcaccttgcttcgagaactacagctgttggcatagtttcctcacacgtcacaagagtatattctgatcaggtgatcggcccgttggcatcacaagccatggcgtcctccaagggctcctgggccgcgcttgcattgctcctctttgctgctgtcgcatccacggccgtcaacggcgaccacaagctctccgccaggtactacgacgagacgtgccccaacgtgcagcgcgtcgtgcgggcggtcatggcgtacaaggtcgccagcgagccggcggtggcgcccgccctcctccgcctcttcttccacgactgcttcgtcaacggatgcgatgggtccgtcctcctcgacggcacgcacttctccgagagcgagaaggacgcgctgccgaacgcttccctccgaggcttcgaggtgatcgacgagatcaagtccgtgctggagcacgactgcccggccaccgtctcctgcgccgacgtgctcgccctggcgtcccgggacgccgtcgccatgctcggagggcccgcctggagcatgcctctcggccgcatggactctcgcaccgccgacagggacgccgccgagaacctccccagcccacacgacaactacacgtcgctcgtctcgacgttcagggagcgcggcctcgacgcccgcgacatgaccgcgctctccggcgcgcacaccgtagggatggccagctgcgtgaactacagggcccgcgtctacggcagcgacggcgacaccaacatcgatccctccttcgcggagaccaggcggcagtcgtgccccgccggcgacaatgaggatggtggcatggcgccgtttgacgagcagacgccgatgacattcgacaacgcctactacaaggatctgatcgcgcggcgtggcctcctcagctccgaccaagcactctacggctccggcgggcggcaggacgatcttgtggagatgtacagcagggacggtaagaagttcgccaaggacttcgccaaggccatggtaaagatggggaacatacgcccgtccaaggggaccacggtggaggtcaggctcaattgcaagatggtcaactagcgatgatctaatgatttgctctcaagacgtacgtcaagtgcagtcccctcgttttttggtttaatttgtgttttctgggtcaagtttgtcaaataaattgtaaatgtattctttcattcattcattagtttgc

SEQ ID NO: 236 - DNA, 2284 bp, Triticum aestivum
  Clone ID: PAT_TA_236
ctattcacttgcccatttcgatcgaccgtccgtgcaggttgcccttctcgctactttttttttttttttcactggtgtgaatgatttttttttccagcaggcaaaacttatacatcaacatgtaggaacaagcatcctgaagatccatctagaaattgatgttgctaagcataaaaaaacaaaccaaaatcaaataaacggtaatggcaacaagactatgtgtattgtgtccacgcgcccaatctgaacctgttacatatccttcttttaatggtcagcaacgcgtgaagatgagttcagcgtcgaatttggcacacagaaaatttgtgcccggtggccaaaacggccagtgctgccgagatgtgtctgtgtcgattgaagcttgcggaggctcactttgtcttcttgtcctccgtgctcgtctcagccttggcctcgatctgttgggcagccgctgctccttccaaagtttggggtgctgcgggttcgtcttcccctccaaagccaaactcgttgacacgcttcttgtcaactgggtatacccacctctggtagaggtatatcaagaagataacatcatctctgaaaaccgagagacgatgcaaccatggcatcttaatcacaaatgcaaacagatcatcaattatagtgttgaggaacttgtaggtcatttgtctccatggcatgtgagcaacggacttcagcttgtagttgataaataattgtgggcacatcataatgaaaccaaacatgtaaacacaacttgtgagggaagagagtatccacgagtaccagctcttgtgtttatcatacttgagtgaatagatagcaaaaccagccataaggactagaaggacatacgtaagatacttcattgcaagcgcatcgtactccttggtcttattctgtgcatatgactcacgatcccggaatctcaacatgggcatctttccacttctgtcaatctcaacatgcatcgcttttcctatcttccagaattcaatgcacacaccaactccagagctagcaagaatcatccatgatgtatcattgtcaagcaggtacagaaatataatcagctgacaaatgaagttcagaacaacagatttcgctgaaagaccttccatggacttgtttttattccagaactggatatcattcttgaaagccaggaaatcgaacagagagtggaacagagatacaatcatggtcaaccccagtagatatggatttccttcaaggaaaaccctcttgagctcatcagcctcgccttcaagcatacttccataactacgatgaacttggaaagactgctcaatctgtagaaataattgccacttggtcatgctgataggactaacttcaaggttcaaggtcagttccttcacagtctcgttgagtgctgtcaatttgtccctcaacagccaaaattcattgaagaatacagttggatagtaactgtttgtagttggatccacattcaaatatggagcaacatttggaggaatgttgttttggggataccgtgtgaagtcatcaacaagatttattgtcacatttggtttccaataagaaatatattcaactgggccctcctctttgtcttcggactctttgttctccttagggggtagcttttcctcggactcatccgaatctccaagcaagctcttcttatgaccagcttttgatttccgcaagtatgccacaataggatgtgtccttccaaatgcagatttttgctcatattcaggatcggtagggtccacagggtaacccgaacgggaaaaataaacatgagcatacaaagagccattgtgcttgagagcctccgttggatagtatgtcagtgtgtgtgttctggtactggtaggtgtccagactgcatatggtatgtttgtttcatgccagatgagtgcatcctcattaccaaagtcgctaaatttatcattctccgataaatacatccacatatccattggctctcccttctgaaagaggttggacatgagcaagcccggctccgtgggggcgcgcttggggccgaagaacttggacgcgaagtaccagaacacggccatccgcacgatgccggcgaggctctggcccaggccgcctccctgccgcccagccggggcctgcccctgcggctgcgccgcgacggcggcggcagccggctgcgacatggccgccggcgagttagatcggggcgaggaggggggagggagccgccgcgatgcgatgggaacaagcggacgcgtgggtcgacccgggaattccggac

SEQ ID NO: 237 - DNA, 849 bp, Triticum aestivum
  unsure (1)..(849): unsure at all n locations
  Clone ID: PAT_TA_237
gtgcggcgctcgaggcggccgggctcggaatccccagctaaacccacctcacattgcatcagcaacaaagtgccccaagcaacctcccctcctcctcctcctcgagctccctcgttccctccactaccccgcacgcgccgccacacgccacgcaccaccaccaacccaagaagctccctctcctctcccttcttccttctctctcacaggcacgcacaagagtaggtgccgccggccggcatcgagattcgagaccagccatgtcggcgtcgcccgagttctactagccggcgccggccttctccccatgccgctcgccgcttgccccgcgcggagatgtcgccccaagagcggccggcggagcaggagtagcaggaggagtggaccagcaggcaggcgcgtcggaggagcagtgctgccggacgccaacgggcaaggggagcgagctgaagcaggcgtccgcgacgtgcccgccggcgccgaggaagccgcgggcgccggccgcgccgtgccggaagcggctgttcgaggtggaggtgttcagcctgcggctggatgagctggagcgcctcttctggcgcccgcacgcgccgccgccgccgcccgagaagaaggccaagctcaagcgccgcagggtggcgccgccgagcgcctcgccgtcgccggggcccagcaagagctagctcgccagcaagacgtgcgtctccccggccgggcaagccgttttggcctgccggtgctggtcgcggtangcaactagtgtaagatttggtaccgcgtttttaactgctgtactcgngctctaatgctactactactcgattaggtcaantcgtgggtacccgtaac

SEQ ID NO: 238 - DNA, 969 bp, Triticum aestivum
  Clone ID: PAT_TA_238
ggatgggcggtgccgtgaaggtgtacggggtggcggcgtctccgttcgtcgcgacggtgctgctgtgcctggaggaggtcggcgccgactacgagctcctccccctcgacatggctgccgggcacgggagcctgctaaattaccctacctctctcgggagagagagagagagagagagatgggcggtgccgtgaaggtgtacggggtgggggcgtctccgttcgtggcgacggtgctgttgtgcctggaggagacgggcgcagactacgagctcgtccccctcgacatggcggcgcgagagcagaggactgagcaccacctctcccgaaaccctttcgggaagatcccagtgttggaggacggagagctgacactcttcgaatcgcgcgcgatttctcggtacgtgctccgcgagtacgcaggcaccagggcgaccgatctcctaggagaatccagcgtcgaggaatcagccatggtggacgtgtggacggaggtggaggcccaccagtaccagccggccatcgaacacatcgtccagcagtgcgtcatcctgccgttcatcggcggctcgcgagaccaggtcgctcgtcgacgagagcgtcggggagctggagaaggtcctcgacgtgtacgaggcgcggctgtggacgcacgcatacctcgctggagatttcttcagcctcgccgacctcgtccacttcggtattacctactacctggtggccggcatcgagtacgcgacgctgctggagtcgcgcgcgaacgtgtgggcgtggtgggggcggatcatggccaggccgtcggtgaagaaggtggcgccgttaatccacctctggttgaagccgtcttcgtctgcttaaatttttgtattgcaattctattttgctagcttaccaacctgaccgcttggtcttcgtctggtaaactgaacatcgtacattcagtctacttatatatgcgcgccttgct

SEQ ID NO: 239 - DNA, 917 bp, Triticum aestivum
  unsure (1)..(917): unsure at all n locations
  Clone ID: PAT_TA_239
gccggccgggctgcgaaccgtcccgtcgtctttcgtttttttgtactgtttaacgtccttcaacttcacccatacggcctcgtcgctcgttttttgtcgctccaacaacttcaaccgattcgatttgggtttttgctaacctttaattcaccgttacaatggccgaccaaggagcagccgcacccccagtaactaccatcgttcccttcaacaaccaacaaatccttccagcatgtgccgccgcctgtggtcccctctacgatgccaacggcgcctgtgttccaccccaagtagccgctgatgccggccccaaggcctatacatcatgcttctgtctcgaccaacgagtcgccgctttcaagaccgcgacccaaggtgtttgtgatgatgcatgtggtgcagagggtctttcctcgatcgctgggtggtttcgcagcatgtgtggtaccgcgaccaagacgaatgcaggatcgacacaacaaactggacagggttcaacagcttcgacggccggggactcttcatcgacctctggttcaagggtttctaacgagggtggtggtgactggatctcaaaccattggcagtgggtcatcatgattgtcgttctcgttgtcggcatcaccgccatctgggtcggtgcctgcatctggcgtcgccgctaccttaagaagaaggaccgccaatcccatctcattcaaaagcattctggttccgcctcgcgaccatcttgnggtcccggtatggaggcctctgagggtggcataccctacgacgacgaatcgaaccgaaattcgcacggcctcatgcttgccggtgccgccgccgccggtactgtcgaagagaacccaaagagaagaagcgatggatcgtccgcgaccgaacatgatgatggccatcgccaccatttgacttta

SEQ ID NO: 240 - DNA, 453 bp, Triticum aestivum
  unsure (1)..(453): unsure at all n locations
  Clone ID: PAT_TA_240
aggataatatatgggcttgagtcaaatgtggcgagtggtttcatacacaggagtgagccttgatcagggcggcagtgtttcagcttctacctttgctagcggatacccgcacgttaccattgggattataggaatttgtatacacacagaatcatcagccttatttaatcccacaaaaagaaaagaatctatggtcttttttgaacactccatacaatgtactggtgtctgcatacggagacacgaacttactagccttatttaaccgctttggtgctggtaaaccgtcgatcagtccttcagctgcaggctgggcatggtgtagtcgccgcacttgtagccgatggggcggtcggccaggtcgcagcgcttggggatggtgatggccacctccggctagaccccgacccggcgcacgatcttggagagcagcaccgcgcanaggcacgcggt

SEQ ID NO: 241 - DNA, 722 bp, Triticum aestivum
  Clone ID: PAT_TA_241
ctagtacaatatcatccggttttttttgcgggcagtacaatatcgtccgttatccaatttgtcgaacgatttcatacacaggagcaatccgccacccgcgtcactgcggcgccgcgcctaccggcgctgcccgagtcccgcacgtgaccgccgggcgcctcggcgctgccgcgcggacttgttctacggtctgttctttctgtaacataactgcccctgtctgtctaattgctcacatttgcccgaacttactagccttatttaaccgctttggtgccagatcctggtgaaccgtcgatcagtccttcagctgcaggctgggcatggtgtagtcgccgcacttgtagccgatggggcggtcggtcaggtcgcagcgcttggggatggtgatggccacctcgggcttgaccccgacccgacgcacgatcttggagagcagcaccgcgcagaggcacgcggggctcctctccccgatctccttcaccgccgcgcagcagcggtccgaaggcttggagtccgggtccttccccgccgccacgcacggcaccagcttcagggcctcctggtccggcggggtggcgccgcactcgtccttggcccccgcgagccgcggcgcggcggcgaggacggcggccaggaccagcgcggccgcggacgccgacaccaggtatctcattgttgtgctcgtggtggtttattacgctccctttgctcgcctcctg

SEQ ID NO: 242 - DNA, 776 bp, Triticum aestivum
  Clone ID: PAT_TA_242
gccggccgggtcgggattccttcctctagagcacctgccgagccacaagccatcagcagcgcactgccacgaccctaagctctctccctccagcgccaccccaccaccatggggagaaccaccatgcttctcatggcgctggccctcgccctcaccgccgtcgcccacgcgacgcctcccgcgctccggaggagccgcttccttgccgacaagaccccgccgccgctgtcctactacgactgcgtcaggaagcccccgtcggtgtgcctggagcccgggagccccgggaacacctgctgcaagggcacctgcaccaacaccttgtccagcgtggagcactgcggcaactgcaacaggaagtgcaagtacggggacacctgctgcgacggcaagtgcgtcgacctcctcaaggacaagaagaactgcggcgagtgctccaaccagtgcgccaactccgtcaagtgcgagttcggcatgtgcgactacgcggggtgatgccgatccggcgacgccggccatgcccgccatgcgtacgtgtggtgtgatcggcggccacgcatatacagttctgcacccatcatgcatgaccaacaaataaaatcggcagtacgtatatactacgtgagtgcatcttaagaagtccaaattgtttaaggtatttcaattgttgatctcctcgatcatatgtatacaaaaaaaaagggtacagatgatttatacgtctctctgttcgtctcatgatttacgtgttttatttgttggactacatactataa

SEQ ID NO: 243 - DNA, 849 bp, Triticum aestivum
  unsure (1)..(849): unsure at all n locations
  Clone ID: PAT_TA_243
gccggcccgaattcggagccaaatcaccattgagaatcatttgcaccccaaactggtttcttgctgaatacatctgctttcacagtacataccacaggccacagctgaatccatggcgaaatgcttcctgctgctcgccttcttggcgtttctcctgccggcggcctatgcgacgtgccaccctgacgaccttcaagcgccgcggggcttcgccgggaagagcaatagaagaacactccaacaacaacaaccaaacaccattactgggaccaacaacagtgttagatctggaagtggcaacattgtatctgggagcggcaacactgttgtatctggggacaacaacaatgtttctgggagcaacaacacagtcacatctgggagcagcaatgtcatacttgacaccaaccatgtcgtaattgggagcaacaatactgtatccggcaataacaatagggtaactgggaacaataatgttgtatccgggagcaaccaagtcgtgtccggggacaacaaagtcgtaactggctaatgatctgttagtggattgatttcggcttccctggtgcagttcatacgtccttgcacaatttcagtgtggctgacagctacttcttcaggctaatcgtctatggaaattcaattctatagcattgtacctacttaaaataaaatttccctaaaatatctatagaacgttttacatactaaatgctggcctggacagcaatggcgacttgcagcttaggtacaagttttcatcgtggatgtctagatgtggttatttcatctattctgntatctggaatgggtgatgttttattatatatgaagattgatctatgnatt

SEQ ID NO: 244 - DNA, 787 bp, Triticum aestivum
  Clone ID: PAT_TA_244
gccggccgggccggcctcttctgcatcaagcaactttctccatcgatcagatataacccctccttgttatttcgacgggctgtctttgaggataacttcactcctgtccgacataccatagtgcagtcgaaactcgaagagccaagagctagccttcacccaccatgtcccttcccgcagacttcaaatggggctttgccacagcttcctatcagatcgagggcgccattgacaaggatggccgaggccccgctaactgggataccttctgtgcccaggctggcaagatcgcagatggcagttctggtgtcaccgcctgtgattcttacaaccgaactgctgaggacatctctcttctcaagtccctaggctccaaggcctaccgattctctatctgctggtccagaattatcccactcggtggtcgtaatgaccccatcaaccaagctggaatcgaccactatcgcaagttcgttgatgacctgcttgatgccggcattactccattcatcactcttttccactgggatgttcctgatgagctggatcgccgatatggtggtctgatgaatcgcgaggagttccctcttgactacgagcgttatgcccgtgtcatgttcgaggcgatcccccgctgcaagaactggatcacccacaacgagccctggtgctcagccattcttggttacagcacaggttccaacgctcctggtcgctgctctgatcgcaataagtctgacgtcggtgactcctctactgagcccttggatcgttggccacaaccttc

SEQ ID NO: 245 - DNA, 826 bp, Triticum aestivum
  Clone ID: PAT_TA_245
atccaaggggccggcatctttggccgattgagtatatctagagttgactgacatacgggatacatgaaccgtcacaataattccaaaagaagaaacaatcagaagcttcaccgtctatctggtcaacgtcgataccaaccaccgtcaacatggccgtcatgtccaagcttctaaactttccgagccttaccctcgcagcctgcatcgagggtttctttgccatcaagttgtttccgaattattacagcactcagagtcacttggcggctgtagttaccatattgctaatcaactatgcgtttggagtcgtcttttgggcggtcttgtacccgcgcttattcagcccacttcgacgtattcctggaccaaaggcgtatctaagtgccgctcaccattctctcgtcgtcaagggaagaccatctggcgacctattcctcgacctagcaaaggaatatcccggaaaggatgtcatcatgctcaattcctttcgcaaccagttatgcatcatgaatcctcagcttctagcagacctcttagttcacaactgctacgactttgccaagccgaaacgaatcagcggtttcttgcgtcacgttcttggagacggtctcatcatagtcgaaggtgaacagcacaaatttctacgaaagaattcgacaccagcctttcacttccgtcacatcaaggagctgtatcccatgatgtggaccaagagtgagacacttaccaaggcgattgctcaggatatcacagcatccagatcaccagtcgttgagctgaatgggtgggctagcaaggtgaccttggacatatcggcattgctggt

SEQ ID NO: 246 - DNA, 766 bp, Triticum aestivum
  Clone ID: PAT_TA_246
aataacggatgaactactaactacattatagagtaactacggatgaactagtaaatactattgcctatgcctactgagacagaaataatacactgtccgcggtgatagcattgagcatacatactggtaaacatgatgctaagattgaaaaaacaaagtacttgagattatgtttctagttggaccacggtacacaataatagcagtgacaacggtgtctcagttttgatcccctacacttgtatcccgtggcaaatggttttgtgtccgcatactccagtttcgcgttcatccagctctatgtcttgcagtcgaaacctaagcaattttccttatgccactgaatttcaaaattgaagtagtcgtcaaaactagaagcaaaattaccaaatagctcaatcctagagaggatgcaccaaattgcctgtcttctatccatatctaacactccaggagtgttctgagcggggactgccgtgtcgcagttttgttcccgtgcccttgtatcccttgacacttggttttgtgcccgcatattccagtttcgcgttcagccagcactctgccttgcagacgaaaccaaagcataatgcgctctcattgtattcttcccagcaatagtcgtcgtctgccgcggaagcaaaattaccaagtaacacgattagtaagaggatgcacgtggttgcctgtctcctatccatatctaacactccaggagtgtactgaatgtggaatgtcaaaagggagattctttttgccctcgtgc

SEQ ID NO: 247 - DNA, 827 bp, Triticum aestivum
  unsure (1)..(827): unsure at all n locations
  Clone ID: PAT_TA_247
gtgcggcgctcgaggcggccgggtccgaacagatcacctcaacccaaagaaaggtcgctcccatttccgatatccacggcatccctcctaaaatcatacaaaatggctgctattatcaaggctgctaacgccaagatccggtccaacccggtatctgactacatttgctcgacccacttttggggtcctgtctccaactttggtatccctctggctgccatcatggacacacagaagagccctgagttgatctcgggacagatgaccggtgctctcatcatctatgccggtacttttatgcgatactccctcgctgtcacccccaaaaactaccttctcttcgcctgccacttcgtcaacgctggtgctcagctcacccaaggataccgatacctgaactaccactactggggcggaaagcagagcatgcccaaggagcagctggtacaagccgctgaggctgctaagggcaaggtagagaaggccgcagagaaggttcagagcgctgtcagtaaataaagaggaagctagacagacggccactgggcggatcggtatatcgggctgcaagccgaccatataatgggagcgcccccgggttggggttcgggattcggagagtgtcatcagcacacaactaccgcacaatgaatttgtacctttacaataatttgttccctcaatcgtctagaaccgcactctgaaccggggtacctgcagtgcatgcacggaagaggtgctaggaggatcgagtttggagaccctagatcagtcaaaatggttaaagcaaagatactatcaaaaaaaaaaaaaaaaaggcccctann

SEQ ID NO: 248 - DNA, 398 bp, Triticum aestivum
  Clone ID: PAT_TA_248
gccggcctgggttgggacaagtctacaaccaaaaggacaagagagagagaacactaaacaatttcattatggctctaatccggatcaacactggtgttctgtgcttgatggcacttttgatggtttcaaccactttattgtcgagtgaagcatcagggaggaagataggcaaggaagctaacattggcgtcgaggggcaccgtgaaccctacactccatgtacggatccttcattttgtaatgatatctgcaacagagatggttacggaggtgggacctgccgtgatggtcactgcgaatgcatcagataattgtagcaagaaaatgaccaagaataatgtttggaaataaagattcacttgggagcaaaaaaaaaaaaaaggcccctaattaacacc

SEQ ID NO: 249 - DNA, 1205 bp, Triticum aestivum
  unsure (1)..(1205): unsure at all n locations
  Clone ID: PAT_TA_249
gccggccgggtcgggcttctctccttctctcgtcaccctcgctcgataagtcgtcgcccttcattaagaactatctatttgcgtcttcgatagatcgcatccacactctctaaaccggccgtgccgatcatataactaccagcttacacctcgatatttcgtgcgtcgttgctttcactcctcagtgatcaactccccgaacatcaatccacactcattacaaagtcgactgccgacgatccaaaacaccgggttaccttcgatccttactcaaacagtcactttcaggaacttcagtcaagatgatcgccaacaagctcaccattgtcactgccgccgccgctcttcttgagccggctcttgccctcggccaccgccacggccaccagcacaagcgtggtgacaccgtcgttgccaccattgacggtcaggtcgtctcttgggagaacaactactacggtcccggcggcgctgctcccgctgctactcaggttgcttccaagcccgaggctcctgctgctcccgcccctgctcccgcccagcctaccaccatcatcaaggtcgccaagccctcccaggccgccaaggctgcctacgaggctcccaaggccaaggagttcaaggaggccgctgctcccaagaaggccgagaaggtcgaacaggttaagcaggtcaaggctgccagcgcccccaagaagaccaagcccagctccggtggttcttctggctctgccggtctttcccacaagcgaggtgtctgctacaacaatgtcgacctcgctaacactttctacaaagactgctccaactgtggctggggttacaactgggactccgagtccggcggtcttgacagtggcctgaacttcatccccactctctggtctgacgatgccgtccacgtcgaccgcttcgcctccaactgcgctaagtcccttgccaacggcgccaaggccatcttctccttcacgagcccgacaacggtggccaggctcacatgacccctgaggccgctgccgctgctcacatcaagtatctcaacccttacgctggcaaggccctcattggtgctccttccatcagcaacagtggtctcgctggggagggtcgcgagtggctctccgctttcgtcgaggcctgtggtgacaagtgccacttcgatttctgcaacatccactggtactccgaggttgagtacggtgagn

SEQ ID NO: 250 - DNA, 896 bp, Triticum aestivum
  Clone ID: PAT_TA_250
gccggccggcggcggcttccgaccttggacgaccccatctctatcaattgatccgtaccgcgatcaattgggccaccgttggcagaggctctttctctacgtccccaatcctcagtcaagatgttgtcgcgagccgctagaccagctctccgagctgctgttgcagctaacgctcgggccactgccgtccccagcaccgctgctacctatgcgactctccgtgagatcgaggaccgtctcaaatccatccgaaacatcgagaagatcacaaacaccatgaagatcgtcgcctccactaagctcaaccgagctcagcgcgccatgaacaactcccgcacctacggacagacttccaacgaggtttacgagtctgccgagaccaaggctctcgagaccgaggagaagaagactctcatcatcgtctgctcttccgacaagggtctttgcggtggtattcactctggtctgtcccgatacatccgcagactcagcgccaatggagagaagttcgacctcgtcctcgttggcgagaaggccaaggctcagctctcccgaaccaacgccaagtccatccaactcaccttcgctggtattggaaaggatgtccccacctttgccgacgcccaggctatcgccgaccaggtcatccagctccccactgagtacaccgacgtcaagattctgtacaacgccttcgtcaatgctcagacctacgaggcttctctgattgaggcattttccgaggaggctatccagcagtcccccaacttctccgctttcgaggttgacgacgaggttctcggtagcctccgcgagtacggccttgccaactctctctactgggctcttgctgagggccacgcctgcgagcagtctgcccgacgaaacgctatgga

SEQ ID NO: 251 - DNA, 646 bp, Triticum aestivum
  Clone ID: PAT_TA_251
caaaataacaagcacttcaacgccgaggagatcgatcagcgaccgagaatggagggcaggatgttcgggctggagaccccgctgatgacggcgctgcagcacctgctggacgtcccggacggcgagtccggcggagccggcaacgccggcggcgagaggcagggcccgacgcgtgcctacgtccgggacgcgcgtgccatggcggccaccccggccgacgtgaaggagctgccgggcgcgtacgcgttcgtggtggacatgccgggtctggggtccggcgacatcaaggtgcaggtggaggacgagcgcgtgttggtgatcagcggcgagcggcgcagggaggagaaggaggacgccaggtacctgcggatggagcgccgcatgggcaagctgatgcgcaagttcgtgctccccgagaacgccgacatggagaagatctccgccgtgtgccgcgacggcgtgctcaccgtctccttggagaagctgccgccgcccgaaaccaagaagcccaagaccatccaggtccaggtcgcctgagatgtatcgtgtgcgcgtcgaatcgaagcagagagtagcgagtttcctgtgatgagcgatggtctgtctgtcttttggtttcgttaatggaaatggggatgcggccgcg

SEQ ID NO: 252 - DNA, 833 bp, Triticum aestivum
  Clone ID: PAT_TA_252
ccaacaagaaacaaacaaactcaacaagcactccaacgcagagcagcccgatgagaaggaccgagagcgaggtcgggggggggggtagggcgggcagggcgctcgggtgggacgcccccgtcacggccgcccggcaccgccggccgggcagcccgggccgcgaggggggggccgccgcccgcgggccgccgggcccggcgcgcgccgccgcccgccccgcgcgccggacgggggccagcggccgcgcggtgaaggggctgccgggggcgtgcggggggggcggtggtcgggccagggcacgggtcggggggcatcgaggtggggggtgggggacgaggggggggcgggctgggcaggaggggcgagcggggggaggggggcgagggaggagaccaaggacccgcggtggtggcgcccggggcgccgcatggggcgaacgtcggcgccagctcgggctgcgacgtgaacgccgacgccctccgcagcgtccccggcgcgccgcccgcgccgtccccgacggtcaagctcccagaagccccgagccccagaagcgcccaggccatccacggccaagacacctcgagtgcgccttggaatgagattcacgatgggtggggtgagtcggtatcgagtttgtcgtgaggtgtgagtgggggtgtctgttgtttgttttatcttttgatgtcaactgctatggggttggtgtcgtgtctattcttgctcactggtgatagtttgatgtttcgttaatgcaaatgggggtcatctccggcttcgaataaataaaacatgcgaatcgtcgcgccaccctttctattgaaagtaaaataaac

SEQ ID NO: 253 - DNA, 904 bp, Triticum aestivum
  unsure (1)..(904): unsure at all n locations
  Clone ID: PAT_TA_253
gccggccgggtggcatagctttcttcacctttccttccactattcctatagaagaactcttcattcgttcaatatgtcctctgagcaactcgttctctttgatcttccaagcaaagatggtggtgcttggtctctcaacccatggaagacacgatttctcttaaacttcaagggcatcgactacaagactgaatggctcgaataccctgacatcaaggcgactcttgagtctcacatttccgccaacccagctaccggaacatggacaatccctaccgtcaagttccccgatggaacttatatcatggactcggccaagatcctcgagcgaattgagaaggactaccctgaaccctctgtccacaaggattcgcctgtccttaccaagctattcgaaatcatgccaaatatcatgggcgccctgcgacccatctacttcacccacgtccctaagcatattctcaacgagaacagtgtcccttactggcatgagacccgaaccgagacggctggagagcctctcgacgagctctacaagagagatggtggaaaggcatgggacaaagctaagccacatgtgcaagatgtcgaggctctcctcaaggagaactctgaagggccgttcttcctaggaaagactcctagctatgctgattttgtctggggcggattccttatcttcatgcagcgtaaccaagttatagacgaggtgtacaagatcagtggtgatgctcagcttcacaaggacctcctagaggctctagctccctggcataagaggaacaaccactaanngtacatataggcttggttcgaaaagaagcagaaaaacagtgggatataggaactgaaaagcataccatagctagactagagagtgacaaaaaacccagacatacgacgc

SEQ ID NO: 254 - DNA, 837 bp, Triticum aestivum
  Clone ID: PAT_TA_254
gccggccgggcttgcgataaagataacgcttacatatcaatcacaatgcttcaactaagaatgataataccacggctacggccaactcaattggcttcactcacccgccaagcaacacccatacaatcctcagcccttcctcgaagtttccgccgctcacttcagaaatctctacagcaagctcaattgcgatgctacgcagcgaaacccacagctgctcccacaaaatctaccaagattgaagatgagctgaagagacaagctagagctgtagccaagggaggcaaagaattcgaactaccagagaaactcatcatataccatggcggtacaggtcgtatcacattcatggccatgctcaaaataacgacactcttccttggcgcattcttctgcttcattgtagcaccgagctatgtcaaggctgaaaagcctgagtgggttaccgcaagcatcgttctctgcggcatcgtccccatcttcttcgtcgcgtacataacctcccccttcgtgacacacatccacatccacatcccgccatacgcccggacttcgcgcgcccttctggaacgcttcgtcaaggcactcccaccgtccacgcctctaaccctgaccaccatgagcgccatctccaagcctcgctacagcagcattcaggccggcgacctgagccctgtacgacgccgcctcggcctcatcaactacgtgcgtgacaccaaggaggagaacgctaagcgcagctggtatatgttccgtgccgttggcaagttctacatccaggacaagaagccgcaggcgagggtgcggtaccagaagaagacggacaaggttgatggg

SEQ ID NO: 255 - DNA, 1829 bp, Triticum aestivum
  unsure (1)..(1829): unsure at all n locations
  Clone ID: PAT_TA_255
ctcggcccgcctgtcgccctcccccggcctgaattccgcccgctcccctatcccgctcaaatcccacctctcacctggccacgcccacggtccatcacggccgccacctgaggatgcagacaatccggcgacccggtaacccagccggagccggtggggaagggcgacgggtacgcgtacctgtcggggctgggcaacagcttcacgtcggaggccgtcccgggggcgctcccggccgacggccacaacagcccgctgctctgcccgctggggctctacgccgagcagctctccggcacctccttcaccaccccgcgccaccgcaacctacgaacgtggatgtaccggatcaagccgtcggtgacccacgaccccttccacccgcgggtgacccgcccaacccgcgcctcctcgccgacttccacgacccgcgcgccgccctcgccacccccacccagctccgatggcgccccgccgacctgccgccgcccgatggcccgccggagctcgacttcatcgacggcctctacaccgtctgcggcgccggcagctccttcctccgccacggattcgcagtccacatgtatgccgccaacaagtccatggacgggtgcgccttctgcaacgccgacggcgacttcctcatcgtgccccagcaagggaagttgttgatcacaaccgagtgcggaaagatgctggtgccgcccggcgagatcgtcgtcattccccagggcttccgcttcgccgtcgacttgcctgacggcccttcgcgcggctacgtttccgagatcttcggcgcccatttccagctccctgatcttcccccatttggggctaatggcttggcttccccaagggattccctccatcccacccgatggtgcgagcaagcacaccgcaccgggggcgtatacgaggcgaagagccgatggctgcctccccccaccccccaggctgcacagctgcttgacgcccccgcggggcggggaacttatgtccccgacaagtccgtccggagccttggctgtccggaggacaacgtgccgttagggctgggcggcccgctggccttcatgttcgagtctgcgctgatcccacgcgtggtgccgctgggccctcgtgtcgccgtccccccgcctcggtggctgccggccgtggacacggtccgccccccgttcttccatcgccactgctggagagtgaccgaccggcggatccaaggcgtatacgaggcgaaagccgacggtttcctcccgggacgccgcgagcctgcgcagctgcatgacaccgcacgggccggacaccaagacgtacgaggcgaccatcagcaagctcggcgggccggaagccaacacaccgacaaggctgagcggctcccgcgcccttgtgtttgagccggccctgatcccgcgcgggtgccgctgggcgctcgagtccccctcccgggacctcgactactaccagtgctcgatcgggctcaaatcgcacttcgcgcacggcatagatggcggttatgatggaccggcgacaaccggcggtgacgacaaggatggcgagaagtagctctgtttccacaggtaggaaatgaaatgaaatgaaattcctaggccatgtatatgtatgtatactactagttgttacctgtgtaaagggagaaaacaaacagtaatcaatccagtagggataaataagcagaatgtgcagcatgcatgtacaatcaccatccaacatgccaatgtgtatacctaataatatcattatagcaagcaaaagcatgtacatttatggtgatgagcagtcgtttttcttttcngttagcagcgtattta

SEQ ID NO: 256 - DNA, 884 bp, Triticum aestivum
  Clone ID: PAT_TA_256
gccggccggccggcgaacttcttcattcaagagaaacagtcgttacaatgcactccaagacattgggagtagttctcggttctgccgcgttggccaatgccgctaaccttttcgtcgcggattatggcggtaacctcagcacgctgaagttgaccgaggcgcaaaacggctacaatcttgctgtctcttcagtttcacgcgattgtcaacctggcccatcttggttgacattggacaagaagaacaatgtgctttactgccttgaccgtggcggtcagactggctcgctgaactcgttcacgattggaaacaatggtgctttgaagaccgttgcaagggtcaaggcaccttcgggcggggtggctggcgagatcattactggaaacaagggaaagcgcggctattttagtgcagcctacgattcaggtaccgcagcagtattcgctgttggtgaacaaggcgctctcccaggaactgagcaactccaacaagtctcatcaaagatcgacaagataggccccatcccatcacgacaagaggcagcccatctccaccacgtcattatcgacccaactggaaagtatgtcatcacgcctgatcttggtggtgatgtttgccgcgtctggtcctttgacaaggacaagcttgctcccatcgctgaagtaggcgctctcaaagctcccgctggttccggaccccgacacgggtttttcaaggtcatgaagagcggtgaaacttttttcatcttcaatggtgaacttgaccaaaaggtgtactcttaccgtgtcacgtatacccgtatgggtctttcctttcacaaagttttcgagatacatctctgaatgccaaattccctcccacacggccccattacgagatgcatg

SEQ ID NO: 257 - DNA, 869 bp, Triticum aestivum
  unsure (1)..(869): unsure at all n locations
  Clone ID: PAT_TA_257
gnggggngcgcttcccatatgtggaacaatttccccatgaacgccggcaagccagctaagtgagtccagctacctatggccgcgcaacacatcgcgagagatcaaaagccacctcccacatctcgactcgcaccgtaaccaataattcatcttctatatataaagcacattctagccagccggccggttcggggaccctcgggtaggtagtaatcagaaatggcgctggcacgccggagtcccacctccctcctggtcatcgccgcggttctctccgttcacggcctcctccccgctccggccgccgccacggggaagaccggccagctcaccgtcttctggggccggaacaaggacgagggctctctcagggaagcctgcgacgccggcctctacaccgcggtcatcatgtccttcctcaacgtctacggccacggcaagtaccgcctcgacctctccggccacccgctcgccggcatcggggacgacatcaggcactgccagtccatgggcgtcaccgtctccctctccatcggcggcttcggcggcgactacgcgctcccgaccaaccgctccgcgctcgacctcgccgaccacctctggttctcctacctcggcggcaggcgcaggggcgtgcgccgcccgttcggccgcgcgcggctcgacggcgtcgacctcttcctggagcgcggcgggccggcggagcactacgacgcgctggcgagggagctggccaggcgcaaggcccgcggggggaaggccccgcgcctgacggcgacgccgcgctacgcgttcccagacaggctcgcggcgccggcgctctcgacgggggtcttcgagcgcatccacgcgagggtctacgaataccc

SEQ ID NO: 258 - DNA, 847 bp, Triticum aestivum
  unsure (1)..(847): unsure at all n locations
  Clone ID: PAT_TA_258
ctgtgcgccgctcaggcgccgggtgggaatgaattctctcctgcaatattcttgctacatatcgcgggacttgccataactaggtactaactcgttcattctttgcgactgacctccattgcatcatattcaaacagcacatattccacattggacacttatcttcatcatgcgtggcatccaaatcaccgaatatctcaagggccctgatcagcttcaggtcactgacctacccgatcctaagccctcagacgatcaatatctcatccaagtacacgcggcagcggccaactttttcgacatcttgcagatccaaggaaaataccagaaccagccccctttcccttgggttgctggcgccgaattcgcaggcacagttatcgctacacccaccgacggtcccaagcccaagttccctgttggatcgcgtgtctttggcgcgtcccagggtgcgtttgcgacaaagatctgtgctatcgaagacactctgctgcccgttcctgatggctggtcgtttaaagaggctgctggtctgtttgtcaccgcgccaacaagttacggcgcactggttgtgagggcgggtatcaagaagggcgattatgttcttgtccatgctgccgcaggcggtgttggccttgcagccgtccaagtggccaaggcattcggcgcaactgttattgcgacagcttcaacacagcacaagcttgacattgccaagtcctacggcgccgaccatgtaatctcttataacgacgcttcatggccctcgcaggtcaagaaattgacccccgactcccgaggtgtcgacattgtctaacgacccgntcggtctagtcgacctctcgac

SEQ ID NO: 259 - DNA, 886 bp, Triticum aestivum
  Clone ID: PAT_TA_259
gtgcggcgctcaggcggcgggtggaacattcttcgatcacccattccattcgttccacagagctagtctcacttcattctttcttatcaacttactatcgttattttcatcgcttgcgatcaactatcattcacttctctcactccaactccatcaaaatgaagaccaccagctacgtttctgctcttctcggcctggcctccgctgtcagcgcccactacaccttcgacaagctcaccctcagcggccagcaagagggaaccgacaaccagtacatccgcaagcaccaaaacggttacatgcccaccaagttcaagggtattcccgacggttccatctcgcccaacgacaaggacttcacttgcaacaagggcagcaccgcctcccccgacgtcttcaaggttaaggctggtgatgagatcggtctcaagcaggctttcggcggtactggtatgcagcaccctggtcctatccaggtctacgctgccaagatcgacgatgctaccaaggctgacccctccaacctcgactggtacaagatccatcaggctcttgtctgcaaggctggtactcctgagcagctccgcggcccctcttggtgctcctgggacgaggactctgttcacttcaagattccttctactctccctgatggtcagtacctcgtccgtggtgagcacattgcccttcacggcgcccacggtggtgaggctgagttctactacgcctgcgcccagcttgagatctctggcaacagcgcctccagcatccctggtacctctgtcaagatccctggtgtctataagcaggatgaccctgccgtcaacttctctctctggggctcttccactggctacgacgtcatccctggtcccgatgtcattcc

SEQ ID NO: 260 - DNA, 677 bp, Triticum aestivum
  Clone ID: PAT_TA_260
gccggccgggcttcagattctcactcactcacactcaccaacaaacaaacaatcacaatcacaacatacacacaaaccacctcaccaaacactcaatccatgccctacctctcatctggaaacaactacctcttctccccatacacctcacaaaaccacgccacaatggcaccctcagtatacatcctcctccagcgcgacacagagtccacagtcataatctcctcagtctatctcgacctccaagacgccaacgccgcgcttctccacctcgcacaagaagcaggcatcgaccctgcaactgccaagcctactgccgatgccggttccgaacagccctcgcttgtcaaggagcctctgctatgggaggccgccgatggaactgccgcctgggttgagcgccatgctgtgacaaatcgcaagacgcacgcctctggctctgctggcgctgctgataagcctgggttgaagaggaatgatagtcggttgtatgtcaacgatgatgatgatgttatcgaggttaccgaccatgatgggcactacgattaaagatggaatcaacgatttggaattaatgcggaggaaatatatgctaaatagcgtgagagtaattcaatctttatagcaattcaaagcaatgtttatcagccacaaaaaaaacaaataaaggcccctaa

SEQ ID NO: 261 - DNA, 856 bp, Triticum aestivum
  Clone ID: PAT_TA_261
gccggccggttcgggaattgctcttcaattgtaccgcaaaaaatgaccgtctcaaagctccccttcccgctgaccacattggttctctgatccgaccagaggcgctatcgcgcactcaggagcaggccgatgctggccaagtctctgctgagcagctcgtcgccactcaaaaggctgccattgccgacatcgtcaagaagcagcaagagcatggcgttcgcgctatttcctccggcgagtttgatcgcaagtactacttcggcggctttttcgagcgtctagggggtttcaaggaatatgagcctgtaccatgggacctcgtgcgcctctctgcgccgcccatcgctgccctcaagaaggctggcaagcagtaccccatggctgctatctgcgagtccaagattgagtacaagcaaagcccctaccttgagaactggaagatgctgcgcgagtgtgtccctcgcgagcagtgggccgagtgcaagttcaccatgccccctccttgctactttcacctgcgactcgcctctgggaagtgctacagccctgaggcttactccaacgacgaggacttctttgccgatctggccaaggcttaccgtcaggagttccagactctgtacgctgagggtgtgcgcaacatccagatcgacgaccccactctcgcctacttctgttccgatgagatgcttcaatctctgagggatgagggtgttgaccctgacaagctgttcgacacttacctcaaggctcacaacgacgctatcgccgaccgccccgagggactccatgttggtctccacgtctgcagaggcaacttctccaagtcgatgcacttcagcgagggctcatacga

SEQ ID NO: 262 - DNA, 833 bp, Triticum aestivum
  unsure (1)..(833): unsure at all n locations
  Clone ID: PAT_TA_262
aaccccaccatcaagtccagccccaagcctaccgacctccagtattctcaagcactggcccagggtttaacgacaacgatacatatgacacgaaacgaaacgatacatacgagacgatatccacgataatactccaacacccactcacgcacaactcaactcaataatatcaagactcgctccgagtcttgcgcatcgataatccagcgacctcagctgaagccaggacatggtacctcgtctctaaaccgtgtttatcaataactagtcttattcttctttcttctctacgcccagcatgatggatgactatgtgagcgagtcggatagcgactacacaagctactggagggattggtttatctcgtccaggggcaacgagtacttttgcgaaatcgatgaggactacctcacagacaggttcaacctgactggcctgaacacagaggtacaatactaccagtacgcgctggacctcgtcaccgacgtctttgacctcgagtgcgatgatgagatgcgcgaggccatagagaaatctgcaaggcacctttacggtctcgtgcatgctcgctatattgttacgactagaggtctatcaaaaatgcttgacaagtacaaaaaggccgagtttggaaaatgccctcgtgtcatgtgtcactcccaccccctccttcctatgngtctctctgatgtccccaacctaaagccagtcaagctctactgtgccagatgcgaggacatctacaatcccaaatcatcgcgccatgccgccattgacggcgcttactttggcacctcgttccataacatcctcntttcaggtgtatcccgcc

SEQ ID NO: 263 - DNA, 1437 bp, Triticum aestivum
  Clone ID: PAT_TA_263
caacaagagcgccaggccaggcgccggccggagaccatcccccctcccccattgccgcccgcggaacctcgagcgcgggacacgtacgcgcaggaaaaggcgcgcgcatttcggctgtcggcggggaggcttgttcgccggcggcggcgtttcttggcggccgggccggtcgttcggcgggatgaacagcggcgacgccgccgggtccagctccggcggatccggggacgcgggcgcgcccaggagggcctccaggaagcccaagtattccaagtttacgcagcaggagctcccagcttgcaagccaatccttactccaaaatgggtcatttcggtgtttcttcttgtcggtgtcatttttgtcccgataggtgttgcttcgttgctagcttcaaataaggtcgttgagattgttgatcgatacgatgatgcgtgcgtcccgtctaatgttactgacaagcttgcctacatccagaactcaacgatatctaaaacctgccaaaggacactcaaggtcccgaaggatatgaagcagccaatttttgtgtattatcagttgaataacttctaccagaatcataggagatatgttaagagccggaatgaccaacagctaagagatgctagtaaggcaaacgagaccacgctttgtgaccctgagaagaccagagatggaatggctattgttccatgtggtctgatagcatggagcacattcaatgatacatataccttccaacacaacactaacaacttaactatcgacaagacagacatctcttggaagagtgatagggaccacaaatttggaagtgatgtcttcccaaaaaactttcaagaaaggtccctcttataggtgggaaaaacactcaacgaatctataccgctgagtgagcaagaggacctcgtgcggccgccccggccggccgcgcttcctacattcagaaaactgtatggtaggatacgtgtggacctcaaagaaaatgacaccattactgttacgctggacaacaattacaacacatatagctttgatggcaaaaagagtttggtgctttctacttcaacttggcttggtggaaagaatgattttcttggtcttgcatatctcactgttggtggactctgcttcttcctggcatttgcattcaccttactctacttgataaaaccaagaaaattgggagataacaactacttgtcatggaacagaaactctgcaggccactgatacactctgaaagttgatttccgcattcaacatcttggtcttatggttaacttgtatctttgtacctcggccgcgacctcgctataccgcccccggtaccacgccatgggtctgggtgtcttgcgcgcctgagctgcacgagtggcggtactctttcacgctctttgttagatacacggttcttttgttaaaaaaaaaaaaaaaaa

SEQ ID NO: 264 - DNA, 806 bp, Triticum aestivum
  Clone ID: PAT_TA_264
caaaggcaactgagatttttgaagaaattgctcgtcaatcaattaacaacaatctggtgaagtatagtgtcagaggcatcctccttaatgcagggatctgccaactatgtagagctgatgctgttgctatacaaaattcattggagagataccaggaaatcgacccgactttctcaggaactcgtgaatacaaacttttagctgtatgatacaacatttatttgcctttccgttgcaacacttgcaggctttgatcattatgcaggcttctgccaactatgtagagctgatgctgttgctatcaagaattcgttggagagataccaggaaatcgattttttattctcaggaactcgtgaatacaaacttatagctgagcttgctgcatcaatggacgatggagatattgccaaatttactgatgccatcaaggaatttgacggcatgacacgcctggatccttggaaaacgacactgctgctgagggcaaagaatgagctgaagaaacaagaggatgatgaggatgatctaacctaagccttattgtaaaaactctttgatgcttcaacatggtgtgatttatgcctctatttcgtcttggaggtacatataatgggcataatgaagatccaccttttggttgtatagaacttcattttgaagtaccatatcgggtgtcgtgtgtcatttgttcttgtcatgacttggttttccgtccgaatgaaaataccatagcacgctgttgctggtatccttctgtaacatgttctatttcaccctcattaatgatttgcattttccaaaaa

SEQ ID NO: 265 - DNA, 1278 bp, Triticum aestivum
  Clone ID: PAT_TA_265
gtttgcgcggtcgcgcgtcccgtttccgatccccttcctcctctcccttcgttttctgctcctccccccgcaacaaatcttggtcgcttcgccgccggcacaagcgatcggagcagcggcccgtcggcagcgatgggggaccacgaggcgcgcggtgacgacacgtgagaggaaggcggataagaagctctccggctgggggctcttccggctccaagtacgaggacgccgccgacctatacgataaggccgccaactttttcaagctttcgaagaactggaacagagctgcatctgtgtatatcaagattggtaaattgccatctgaaagggtgatagtaagcatgaagctgcctcagcttatgtggaagctgcaaactgctacaaaaaattctcacctcaggaagctgcgcaagcgctagaccaggctgttaatctttttcttggcaaattggtagattgagcatggctgcaagatactgcaaggacattggtgagatttatcagcaaagaattaggaagaagagaaggcttcacgtttacctagcaagtgatcttttcgacattgaagaataaacaactcaattaaacaccaataagcagaaagttgcaagaagtagaaattgctgcgaagtgggaacagtacccaaaggcaactgagatttttgaagaaattgctcgtcaatcaattaacaacaatctgctgaagtatagtgtcagaggcatcctccttaatgcagggatctgccaactatgtagagctgatgctgttgctatacaaaattcattggagagataccaggaaatcgatccgactttctcaggaactcgtgaatacaaacttttagctgatcttgctgcatcaatggacgacggagatgttgccaaatttactgatgccatcaaggaatttgacggcatgacacgcctggatccttggaaaacgacactgctgctgagggcaaagaatgagctgaagaagcaagaggacgatgaggatgatctaacctaagccttattgtaaaaattctttcatgcttcaacatggtgtgatttatgcctctatttcgtcttggaggtacatataatgggcataatgaagatccaccttttggttgtatagaacttcattttgaagtaccatatcgggtgtcgtgtgtcatttgttcttgtcatgacttggttttccgtccgaatgaaaataccatagcacgctgttgctggtatccttctgtaacatgttctatttcaccctcattaatgactttgctattttcc

SEQ ID NO: 266 - DNA, 753 bp, Triticum aestivum
  unsure (1)..(753): unsure at all n locations
  Clone ID: PAT_TA_266
tcgaggttttttttttttttttttttttttttttttttttttttttttttttttggggaacaacagtagacattgcattactcacacagattattcatccgtacgtaaatacgtttcatcaccattccacaccggcagctcatccttcagcgtagtaaaagtagtaagtagtaacgacgtcgtgctagcttgcagcacacaagcaaggagcattatactcctaccacacaacgtatctgatgatcgcaagcagaaacaagcccctcgtatacgtcttactcatggattgtactgcccgttctggttttcctggacgccgccgtcgtcgttctgcttctccgccaccccgttgtcgttctcgtatccggccgcctcgccgtagctccgctggcggccgggggcgggccttacccggagccgttgtcctcgggctcggggcggcgccgtccgcaccgggttggactcctagccgtagccgtacttgtcagtctccacgtcgtaataataccgcgtccctcgggtcctccgtgtcgctcatccccgtaataacccctcctgctgccgccgtggccaatgtacaaagcggcgccctgccgctgcctccgcngggaacccggnctctcgccgaggatgtctccgaacgggacggcgctctctctgcgcggtcgtccggacactggggcgagctccgngtccgtgaccccgggantagcgnggaattctccnagggcttaggctncccgttcgcgccaa

SEQ ID NO: 267 - DNA, 1895 bp, Triticum aestivum
  unsure (1)..(1895): unsure at all n locations
  Clone ID: PAT_TA_267
gcacgggggcctacgcccgcaagccaaactcactaatcatacacgtacgtgcttagcttaagcccttccggcgaagtcaagtgcaatggcgtcgtccagcaagccctgcgccgcctccgtcctcctcctgctgctggccctcgccgtcgccacggcggccgacgcggcgaagaagagcatcgcgtcggagcccaagcacatcttctcgaggccgtcgggacccatcatctcgaggccggcggcgaaggacatcatcgcgtcggagcccaccatcccgaggccggcggcggtggacgtgtcggcgacgtgcatggggtcgctgctggagctgagcccgtgcctggccttcttcagggacgcgggcaacgtccaagggcgccggcggggtgctgcaaagggcctggggtcacgcatcgtccggagaccaggccggcgtgcctgttgccacatcttcaaccacaccctcggtagcgggccatcgggcgtcggcatccccgtcaaccgcgcgctcgccctcatccgcgacgtcctgcggcctcacgccgcccaaggttgccagctgcgccaacgccggtcgccgtgccgccgctggacgtgtgcccggcgccatcggcctgatctctgcctatccacgtctaagtgcgtgagttgaagcacgaagcgactcgcacctgtggcgacaacggcggcgtgccgccactgtacgtgtttccggcgccctcggcctgaatcgcctgatatctgtcaacccaggaggatttgcgtgagataaagatggcagcccctcttccaagcaagacgaaggatgcatgcataagaatgcagcttatcacagatactccatactaattggagtttcgaattaacatcacatgcaatggatatgatactactagctaccagatcgatcctgggtatactgtggtcacagaagtatgtactgtctccacgcataatgataaatatataagaaacaaaaaagtattatatatcaaaaaaaaaaacagggacgcgggnacntcccacgcgcccgcaggggatgctctaaacgtcatggacgcggctcgaggtggaatatgcaactgggaccggagccagccctgtctcgccctcagactcaacaccaccactgacgcctccaggagcactggcgcatcaccggtggcgccggcaaggcaacggttgtggttaggctttagtctcagcgtccgcacagttgtagctgttggggaaacactgctatgctcgctatccggtggtggggtttgggcatgccacttgtgctccttcggattggcatcgatgcctccacgctcggagtctgctgtatctacgggtttctagattttatatggcccattgtataagatgcagtttggattattaatctggaacaactatatcatggaggtgttgtttaaggttcccttgctaattttatcttaagctgcagttctgcatctttgggaggttaggagaccatcaaccgtaaggaggaataaaaagaagttcagaagccaaggaccatcttcaacctgattttaggcatcctcaagtaaagggatgagagggctttctaactgtaatgatgttctagctaggagaagacgaacttgcaaacataagagccaggtgacgatgaatatttattttgggacgacgattttaatgatgttccagctaggagaggcagactcacaaacacatatgttatagacgaacagtaaatattgtttctcttcacaagcattangacttgattttggtaaatcatgttaccattttctgtgacctcggcatttggatgacatgccatctggatcgtctatcataactgaaccattactatcacaagcatcttacttttaaaaattcatatgatgggtcaggtgtct

SEQ ID NO: 268 - DNA, 689 bp, Triticum aestivum
  unsure (1)..(689): unsure at all n locations
  Clone ID: PAT_TA_268
gccgggtggcgaaggccggcattgcaaggcaacacaagcaaccgccatctcgcacgtctctgctcctcctgtcctgcattatctgccatgctctcatcgtcagtgcacgcgggtgagcggcgctataagctttctctcgacgagctcgctcaagcttcaagccgtctgctccgagcccaaggtgaatccgtcgtcgtcgtcgtcgagtggagccacggtgccgttcaggcacgggccgggcccgtgctcgcccgcccccgaaggaaagtgccttaccttcgaggtgctccgccgccgaccacggttccgagccggctacgtccagcggcaattctccacgaaccaacccggtggcgggctgcagcagtcggaggagctcaaggtgcccaacgagctgggctcctccctggacactctggtgtacatcataatcgtcggcgtcggctcgccgggggtacagatgacatggacaagggacacctgtagctacgtgtctggaatgcactccaacgcggtctccccggccgcggcgacgcccttcgaccccgccaagtcggccccgtacgccgcgttcccgtgcggcaacccggcgtgtacatgcataatgtccgtaggaaacgcctgctccaactcgcagtgactgggcatggtccgctaaagatcantcgtgaacctnngaggttgaaaac

SEQ ID NO: 269 - DNA, 873 bp, Triticum aestivum
  Clone ID: PAT_TA_269
gtgcggcgctcgaggcggcatgtgcaggtgctattctcattgaacatttggaaaggtcaccatgaagctcgacccctcacaactcactgccttcctggccgcaaactcaaccggtgtcggtgtgctagtatgtcccggtggtggatacagcatgatggctcgaggccacgaaggacacgaccctgcccgctatctcaacactcttggcatcgacgcctgggttcttgagtacacgacagcctccaacatgaccccgccactatatccaaagcccatggaagaagccctaggtgcattggatctcatccggcaagaggctccagacctaaagaagcttggcatctggggcttttcagctggtggtcatcttgcaggaaacacacttaccaatcctaccaccaatctcgactttggaatcttgggataccctgtcatcactcttgaagacgattacacgcacgagaactctcgatacaaccttcttggaaataaccctaccaaacaacagattgacgaactttcagtgcagaagagagtttctgacaagacacctccaacgttccttttccacacttcgaacgacggtcttgtacctgttcagaacacttatctctatgcagaggccatggcgaagcacggcagattggctcatgtggtagtactccctgacgggcctcatgggattggcttggcacaaaatgaccctgttagagattggactccagagctgaaacgatttctcacatattcgatctagagacgctataaagaattgtaacgcattctgtgtcacagcgttctttaatttatgtatatcttagccgaaacatgtctttgattgatttgacaaaaaaaaaaaaaaaaggccctagg

SEQ ID NO: 270 - DNA, 970 bp, Triticum aestivum
  Clone ID: PAT_TA_270
atcttctcatattcgccacatcatatttctatcaataccatctcaaacatacccatcatgcatatctctctttctctgctttgcaccgctgccttggctgctgcccacggctacgtcgagactgccaccatcgggggccagacgtaccagttctacaacccctaccaagacccatacatgaaccctcttcccaagcgtatctctcgcgctattcccggtaacggccctgtagaggacgttacttccattgatatgcagtgtaatggatacactgccggtggtatcaagggcagccagcccgctgctctccacgccgaggccgcagctggatcaactgtcaacttgaagtggactctctggcctgactcccacgttggacctgtcttgacttatatggctcgctgtcccgactctggttgcgatgcttggatgcctggtactgagaaggtgtggttcaagatccaggaggctggacgtgatggaaccagcaacaactgggcttcttccgttatcatgaaggctggcaacagtggcgtcaactacaccattccccaatgcatcaagcccggctactaccttgtccgccacgaaaacattgctcttcactctgcgtatggctacccaggagcccagttctaccctggatgccatcagctcaaggtgacgggaagtggcagcaccacaccctcaaacctcgtcgcgttcccgggcgcttatgcaagcagtgatcctgggggtacctacaacgcttatcaagctgccacttacaagatccctggacctgctgtgttcaagtgctaaactcagcattgattcgcttgtagcattactcttctttccactgggtggactttattatttttttgacatatttgatggtgagcatatgaaattgttggatattagtggcatttaacacaaatagtacatagcattatagttctttaggcatcatactacatggtttgct

SEQ ID NO: 271 - DNA, 922 bp, Triticum aestivum
  unsure (1)..(922): unsure at all n locations
  Clone ID: PAT_TA_271
aggggttgggcacggctcacgcctgactccgtccaatccagccccccctccgatctcgccgagaaatctcctccgatcgaagcgaagccaaggctctctcgtcctcctccccaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtggtggcatgcagatatttgtgaagaccctcaccggcaggaccatcaccctggaggtggagtcatctgacaccatcgacaacgtcaaggcgaagatccaggacaaggagggcattcccccggaccagcagcgtctgatctttgctggcaagcagctcgaggatggaagcacccttgccgactacaacatccaggacgacgcggccctctactgatatctcaggcgaccctcaccggcaagaccatcaccctcgaggctgagtccctcggacaccattgataatgtgaaggccaagatccaggacaaggagggtattnccaccggaccaacagngttttatttttgctggcaagcagct

SEQ ID NO: 272 - DNA, 739 bp, Triticum aestivum
  Clone ID: PAT_TA_272
agttcgatttttgtctccgcttcagcttctctcgttccccctccagccaacgacgaaacgaaacaaagaaaagtgagggaaaaaagacacaccaccacacaccaaatacatcatgtctttctctaccgtcttccgtcgtgccgccgtcgcaccggctttctctgcccgtgctttcagcaccaccgctgctcgacctctggccaagatcaccatcgttggcaaccttgccgacaccccagaggttcaacccaccagcaacggccgcgacatcgttcgctactctatcgccagcaactctggtaaccgcgaaaaccgcaagacgagctggttcaggctcaccagcttcgccgagggtccctctcgagactaccttatgagccttcccaagggtgctaccgtctatgtcgagggcgacgccactatgcgctcttacaccgacgccagcggccagaaccgcacaagcctcagcattgtccagcgccaaattgaggttcttcgacgtccccaagctcccgagcagggcgagtaaacatgcccacatggacgcgaccttttcgtggcgccacaatacctcgactgctgctttcttctctctgtctcaaagatggtctcttttgtcggatgctaatgtatgggtgcaatgtacgatgggctttaagacagccggtgaaggaactgtatgataccacgatgcaatatacttttaacatcgcaaaaaaaaaaaaaaaaaaggccccta

SEQ ID NO: 273 - DNA, 1556 bp, Triticum aestivum
  unsure (1)..(1556): unsure at all n locations
  Clone ID: PAT_TA_273
gccggagcccggatcgcgcgctgctgttcgccggcgggctgaggcgggcgtccgggcgcgcgccatggacgtggacagcgtcgagtgcctctcgctgcccgacgccgccatggacgcggacgacgtcggcctcgccctccacccgcacggcgggatcctcgccgccgccgctcccgcccggccgcctaccccaaggccggcgccggcgcggggggcatcgtcgcgccggggagcagcgtgcacgagctgctcgagtgccccgtctgcaccaactccatgtacccgccgatccaccagtgccaaaatggacatactctgtgttccacatgcaaagctagggtacacaatcgttgccctacttgccgacaagagctcggtgatatcaggtgtttggcactggagaaagtagccgaatcgcttgagcttccctgtaagcactattccttgggttgcccagaaatcttcccatactacagcaagataaagcatgaagcgatgtgcagctttagaccatacagttgcccctacgctggttctgagtgttctgtgactggtgatattccttaccttgttaaccatttgagggatgaccacaaagttgatatgcacagcggttgcacattcaaccatagatacgtcaaatccaacccaagagaagtcgaaaatgccacctggatgctaacggtgtttcactgtttcgggcagtacttctgcctgcactttgaggccttccagcttgggatggcaccagtgtacatggccttcctgcgtttcatgggggacgagaatgaggcgcggaactacagttacagccttgaggtcggcgccaatggcaggaagatggtatgggagggcacccccaggagcgtgcgggacagccaccggaaggtgcgtgacagccacgatggtctcctaatccagaggaacatggcattgttcttctcgggcggcgaccggaaggagctgaagctaaggatcaccggccggatctggaaggagacgcagaccccggatggcgcctgcgtaccagttctctgtagctaagcacaagcagcgaacaatcttcaaaagaaaagaaaaaaggattcgatatcatatgtgacatgatatcgcctatcccctcgccatgccctactgttatcgtatggtctgaggcgacatttcatgattttgtctttgttgagcaaaattaggagggtaggatgaccttgtaaagtaaatcctgtatatatggcatcccagggcttattacaggttggctcatcaagctctctgatgccttcagtcatgtctcaaggaaactgtattcttactgaacttgcatcatcagtcttccagccttagagggtaactggagttggtatttgatagcgccatcaaatttcagccccaggccttcaggccttcagcccatcgtgtggtgatagagagggtttataatttggactgggatggggcctagtataaaacgtcttatattagttaacagaggtagtacatgacatttgacagcttgactccggcactttgcaccttatatttcatttatgatttnn

SEQ ID NO: 274 - DNA, 1209 bp, Triticum aestivum
  unsure (1)..(1209): unsure at all n locations
  Clone ID: PAT_TA_274
tcgaggccggccgggccgggactgcatctcagccatggcatctatttcgaagcttctgcttctcctgctgtgcacctaccacactctcgttgctcacgcaggagatgaccttcgcagctacaagcccgttggctctccggaatctgccaccgtcaactgctcccagcccaaagccgcgactccatcgtccggtggtgtcacggtgccgttgcaccaccggcacggcccgtgctcacgcctgccctccacgaaggcgccaacctgggaggagatactcaggcatgaccagctccgagcggcctacgtcacacgaaagttctccggcgtcaagggcggcgccggagacgtcgagcaatcggacgtcaccgtgccgaccacgactgggcacctccatgggcacgttggagtacgtgatcaacgtcggcatcggctcgccggccgtgacccagcaccatgtccatcgacaccggcagcgacgtgtccgtgggtgcagtgcaagccgtgtttccaagtgccagtcccatggcggactcgctcctttgcccccagctcgtctcgcacctactccccgttcctcctgaaactccggcgcccccgcgcaggtcagccaggccgggcagggcaacggctgctccggctcccagtgccagtacatcgtcacctacggggaccaatcgagcacggccgggacctacagctccgacaccctcgtgctgggctccaccgccgtcaaaaacttccagttcgggtgcagccagtccaactcgggcctccttctgacgcaacaaaccgcggggctcatggggctgggcggcggcgcagagtctctcgtgtcccagactgcggggaccttgggcagggccttctcctactgcctcccgccgaatccaggctcgcgcgggttcctcactctcggcgcaccaacttccacttccggcttcgtcacgacgcccatgtacaggaaccgccgggcgccgacgttctacgccgtgcgccttcaggccatccgggtgggaggcaaggaactcaacataccgcctccgtcttctccgccgtctccatcgtcgaatccgggacatatcagcgggtgccgccaacgcctatccgcgctggctccccgttcaggcggctgacgggaccgaacccggccccacaagtcctacagtacggcatcaaataactgcaaggcccccggccacctcgnctctt

SEQ ID NO: 275 - DNA, 884 bp, Triticum aestivum
  unsure (1)..(884): unsure at all n locations
  Clone ID: PAT_TA_275
gccggcgccggcgggactcctcatcacaccttcttcagtacactcatctatctaccggttcagctttttgttcacaatgtatcgcgccatcgccaccgcctcggcgctcatcgcagccgttcgggctcagcaagtttgctctctcacacaggagagcaagccctccctgaactggtccaagtgtacatccagcggatgcagcaacgtcaagggatccgtcaccatcgatgccaactggcgatggactcaccaagtatccggatctaccaactgctacaccggcaacaagtgggacacttccgtctgcaccagcggaaaggtctgtgctgagaagtgctgtctcgacggcgccgactacgccagcacctacggtatcacctccagcggcgaccagctcagcctctcgttcgtcaccaagggaccctacagcaccaacatcggtagccgtacttacctcatggaggacgagaacacctaccagatgttccagctcctgggtaacgagttcacctttgatgtcgatgtttcaaacattggatgtggtctgaacggtgctctttacttcgtcagcatggacgccgatggtggcaaggccaagtaccccggtaacaaggccggagccaagtacggtactggttactgtgatgcccagtgccctcgtgacgttaagttcatcaacggccaggccaactctgatggctggcagccctccgacagcgatgtcaacggtggtattggtaacttgggcacatgctgccctgagatggacatctggggaggccaactccatctccactgcctacactcctcacccttgcactaagctcactcagcactcttgcactggcgactcttgcggtggaaactactccnnacgacgttac

SEQ ID NO: 276 - DNA, 714 bp, Triticum aestivum
  Clone ID: PAT_TA_276
gccggccgggctgggactcccactgttagccactttaactttaattacctacttttactctattcatcaaaatgccttccctcatcaacacttttgctgctctggcttccctcttggccatctccagcgctgcgcccactattgtaccccgcgccacagagtgcccctccactggaaaagctcgcctccaaccctcggctctctacaacatcttccccagcgctcccaacgtcgcgaagaagacgtctggcttccacgtcgagacatacaacaacgcctcccaagtcgagcagcttctcgttttcaaggatctccctgcagacgccaaggactgcagcatcggctgggcccagggcgagcgaccggagcgcacctttatcgtcaagggcggcgatgctctgaccgagatcaagcagctatctggcttccccgataccaagtcaatcacgtacgagacagccaagaagtttgagacggccgacaagaccgctggtgctgccgactttaccaactgggacgatctccctgcccaaggccacatcatcggcgcgatcgactgcaagagctccatctacctcaaggcagctcttcgaaaccccgacggcaacacaaaggtctaccttgagcagaacagcaagaacggactgtacattgagtacagctgctagtttacctattgcttgcacgtatacatcacccgactttcacttctca

SEQ ID NO: 277 - DNA, 874 bp, Triticum aestivum
  Clone ID: PAT_TA_277
gcggggccggccggggtatcatccatttgttctttaatacacaacctcattaaacaccgtcacaatggtcaacgttcccaacatcaagctcaacagcggcttcgacatgccccagattggcttcggcctctggaaggtcgacgacaactgcgccgaggttgtctacaacgctatcaaggctggttaccgtctgctcgatggcgcttgcgactacggcaacgagaaggcttgtggtgagggtgtcgcccgcgccatcaaggagggtatcgtgaagcgagaggacctcttcattgtctccaagctctggcagacttaccacgacaagaagaacgtcgagcccatcacccgccgtcagctcgccgactggcagattgactactttgaccttttcctcatccacttccccgtcgctctcgaatacgtcgaccccgaggtccgctacccccctggttggcactacgatgacgccggcaccgagattcgctggagcaaggccaccaaccaggagacctgggagggcatggaggacctcgttgagaagggtctcgccaagtccattggtatctccaacttccaggcccagggcatctacgacatgctcaagtacgctaagatccgtcctgctaccctccaggtcgagcttcacccttaccaccagcagtctgagcttgtcagcctcgccaaggctgagggcatcgctcttactgcctactcctctttcggtcctaccggcttcattgagctcgacatggacattgccaagtctgcctctcctctcatgcagcacgaggtcttcaccacctcgccagcaagtacaacaagactttccgcccagtccttctccgatgggctactcagcagggtcttgcagtca

SEQ ID NO: 278 - DNA, 842 bp, Triticum aestivum
  Clone ID: PAT_TA_278
gtcatgtcgctgtctaacaagcccttcatcctcaattattttactccctacaaaccatcgcaatcatgtcgctgtccaacaagctttccatcgccgacgttgacgtcaagggcaagaaggtcctcatccgagtcgacttcaacgtccctctcgacgccgacaagaacatcaccaacaaccagcgaattgtcggtgctctccccaccatcaaatacgccctcgagaatggcgccaagtctgtcatcctcatgtcccacctcggacgccccaacggctcccccaacgagaagtactccctcaagcccgtcgtcgccgagctcgagaagcttctcagcaagaaggtcacctttgcccccgactgtgtcggccccgaggtcgaggagatcgtcaacaaggctgaggatggctctgtcattctcctcgagaacctccgattccacattgaggaggagggctcctccaaagacaaggagggcaacaagaccaaggccgacaaggctcaggttgaggctttccgcaagggtctgaccgctcttggtgacgtctacatcaacgacgctttcggcactgctcaccgtgctcactcttccatggtcggtgtcgatctcccccaaaaggcctccggtttcctcgtcaagaaggagctcgagtacttcgccaaggccctcgagaacccccagcgccccttccttgctattctcggtggtgccaaggtctccgacaagatccagctcatcgacaacctccttgacaaggtcaacaccctcatcatctgcggtggcatggccttcaccttcaagaagacccttgagaacgtctccatcggaactccctcttcgacg

SEQ ID NO: 279 - DNA, 401 bp, Triticum aestivum
  Clone ID: PAT_TA_279
gtcgccgtccccgtcgtcgctcccgtgcccgcccgtgaccatgcccattgaggagcccatggaggagaccccggcgtccgcgccggcgccgtcgcagggccacgcgctgcaggcgatgatgggctggtggtccgccgccggcgtggcgctgggaatggcgtgcgtgctggcgcacttgtaggttcgcagattagatgagatccatcgcaaagcctcgataaattttggtcttgattagcttgcactccttcggaactcggatttttttcttagattttaattatttcctatacaaattttatgtgagattgttatgattcaaaatgcctgccctgtgggttctggcctgtgtaaaatctaggggattatccaatttttcaaccttattgcacttccccccc

SEQ ID NO: 280 - DNA, 850 bp, Triticum aestivum
  Clone ID: PAT_TA_280
gccggccgggttgggatctcatctcaactcaacataacttaactcaacttcacaactctatattcaaacctttgctcttcatcttgccctatcaagcaagacttaactctaatcttaatcaacaaaacacaaaccaaccagcgtacaaaattttattatttttacctttgcttgtcctatatattggacaaggtcaccacccccaaagactctctctctctcccacaacacaaccacttcgtcttcatcacacacagccaacatgaacacgaattctccccctcaccgaagaggcccttggtcccagcaagaggatcatcatctaatgaccctcgttcatgaacacggccctcttaactgggttcgcatcgcccagagcctgtcttccagaacaccaaagcaatgccgcgagcgtttccaccaaaacttgaagccaaccctcaaccacgaacccatctcacctgaggagggtgccctcatcgaacaactcgtagcacagattggaaagcgttgggccgagattgcccgccgcctccatggacgaagtgacaatgctgtcaagaattggtggaatggaagccaaaacagacgcctgcgatccgaccgtcgccgtgccacccagggccatgatgacttctattctgcaaaccgacatggacttactatctcgacaacaccatgccaccagatcccaggatcacacctgtcgcccatctcgggtcctatcacgcgccaccctgttggatcatgggttgaagctcctcttccttcgccttgttcatccgagtccgccgaatccgaaactggatccaactacaccacatcaccaggtcaccactctgtcaatctc

SEQ ID NO: 281 - DNA, 874 bp, Triticum aestivum
  unsure (1)..(874): unsure at all n locations
  Clone ID: PAT_TA_281
agattctacctcgcttctacttcagtaactcattcttcgctgatagcttctctgccggccggcccgggttttgattttcctctcctgatatcccctcaacacctcacgaactcgacccttaagaaagctccctctgagcttctcaattctcgcacacgaaaccactttttagctgtttacccctcgtcagctaccaccgtcaccatgacgctctactacactctcgtctttatgcttctcgtcttcgagatgggcatgttcgtgctcttgatcttccccatgcccttcggcgtcaggcgaaagatcttcacctttatttccgagaaccccgtcgtcgccaagattcagtattggatgaagattaccttcatctttatattgatcctctttgttgacagcgtgaaccgtgtctaccgtgtccagctcgagctcgccgctgcctctgaacaggctaagcatggtggaggtgctgccgttatgggtcacgagcgtctcgaagtccaggcccgcaagttctactcgcaacgcaacatgtacctttgcggcttcaccctcttcctttcgctcatccttaaccgtacctacgttatgatcatcgaggtgatgcgtctcgaggacaaggtccgctcttacgagggtaccaaggacaacactaaggaggctgagaagcttgctgccgccggtaagcccggtgagctcgcccgtctccgaaaggagctcgagcttaagggacaggacctcaagaccctncagaagcaaagcgaacagctcccacagagctacgacgagctcagcgacnagtacgctgctactcagcagaccggtggagggcaggaagggcatctaagagtgtaccacgatacgctattactac

SEQ ID NO: 282 - DNA, 832 bp, Triticum aestivum
  unsure (1)..(832): unsure at all n locations
  Clone ID: PAT_TA_282
gtaggattcccttccgcctggttcgcgcacctgagacgggggagatgcggcggccgtcggcttcgtcgcctccggcgaggggcccggtgttggctgccgcagccgctgtcgtgctcctcccggctattttccccgcgctgttctccccgctcggccgcgccttcccttccctattctcggagtggaatgcccctaagccaatgcacaagtctcttttgaacgcgtctttgcgatggacaataccagatgaacaaaagagagagatctggacacccttgcctgaccaggggtggaaaccatgcataagatcatcgattactcgtgggttaccttcggaacctagtgggtacatacaagtatttcttgatggtggcctgaaccagcaaagaatggggatatgtgatgctgttgcggttgctaagattctgaatgctactcttgggatcccacatctggaagtaaccctgtttggaaagactcaagctaatcggagatatttcatggggatcatttatcaacacctaaagngagggttaatagtgagactcaccaaagatattcgtggacaaaganagtttatggacannaaacgtctcaanaaaaaactgccctgttacnctnactgattggatataaaaatggnancctatcttcaaantttggattganncattgcccctttttaccccttgatttnaggattgctggggcatnaacgnnggctnaaantannttnaacccggtttggcctaatttttntgggnggccttnnnaanntnnnantcnnncngggnttcnnnnnttnnnnnannnnaaaaaaannaannnnggn

SEQ ID NO: 283 - DNA, 1163 bp, Triticum aestivum
  Clone ID: PAT_TA_283
gccggccggtccgggaacaggagggtggtcgcattacgatcacgtagacggcctacgccaccaagatgcttgaacgagcaggcatgaaggactgccatgctgtgcacgctccaatggaggcacggctgaagctcagcaaggatagctcggagaaggcggtggatgctacactctaccgcagcatcatcgggagtctcaggtacctcgtgcacacccgaccggacatcacgttcattgtcggatacctgagtaggttcatggaagccccggcaagcgatcatctcgctgccgtcaagcacctgctccggtacatcgcgggtacgctcacgcatggatgcgtgtatcatcgtggcgacggcgagagcttggtcgggtacagcgactccgaccacgctggtgacgtggactcccggaagagcacctcgggcatactattccttctcgggaatagtcccgtcagctggcaatcggtgaggcagaaggttgtcgtcgtatcttcgtgcgaggcggagtacatcgcggcagctacagcagcctgtcaaggcatttggcttgcttgccttctcggcgagatgctgaatcaggacaccgcccctgccctcatcttcgtcgacaacaagtcggcgatttccctctgtaagaatccagtgcttcacgaccgcagcaaacacatcgatctccgctatcacttcatacgtgactgcgtcgagaaaggctcggtgatcgtggagttcatcaggactggtgaacagaaggcggacatcctgaccaagtcacttggtcgtgtccggttccaggagctgcgcgacaaggtcgggatcatcgacaccaagctccttctacaaggttgagggggagaatgttgagtcaaccttggtcttccagtgcacacaatggcagcagcagcatttacgtagctagtctcagatgcatgcatggttgcatgtcggcagcagtgaaaaatgaataaatgactgcaactgctgtagccttagtagctaaggaaatatacgttagccatgagctcactcatgtgcttgacgtcacccgttactacatatcggccgctcgctagcctatataaggagccgagcttcagcgctaaaagaaggccatgagcctccattttgagcaaaaaaaaaaaaaaaaaaaaaaaccctagg

SEQ ID NO: 284 - DNA, 602 bp, Triticum aestivum
  Clone ID: PAT_TA_284
gcaaggacctgatgcgccgcatgctctgcaaggacgtctcccgcaggttctccgccgaacaagtcctgagtaagcggcgacccccgacagatccactgatacgaaaacgctcgccgtccttggagttcctcgctgacgtttctggattgggtggtgatttccgcagggcatccgtggatcgcgagctgcggcggggatgcggtggcgggctgaagaaatggatggaccgacatgcggcacggactccatccacctgtagatagaagatgttctccacggacgacgacggctccgctctgtttctccggcaaatcggcggtggacagaagcaccggtggcaccagagttgagttcagtaagtagatcctttaggtctagcgacgggtctctggtgaagctggaattgcaggagctttcaccggagttagcctgaatgtgtgtttgttcgtcgtgtttgttctctgaatctctgtagcagtccttgtacatacagtcttgttcagttctagctgaagaagagagagggtttagtagtactacttagtaggcaggcttgttcagaagaatgaaaatggagcaaaaatatgtgcatgtctctgtac

SEQ ID NO: 285 - DNA, 1395 bp, Triticum aestivum
  Clone ID: PAT_TA_285
cccacgcgtccgcgcacaccacaaccgcccgccccaacgacatcggagacggacccgaccatggtttacggcggagaggaggcgctgaggcggcagtactccatcggcgacgagatcgggcacggccggttcgggaccgtccgccggtgccactccaacgccacgggggaggcgctggcgttgaagaccacgcccaaggcgccgctgcgggacgcgctggacctggccctcgcggagcaggagcccaagctgcacctcctcgcctcctccccgccctgcagcccgcacctggtcgcgctccacgccgccttcgacgacgccgacgccgtccacctcgtcgtcgacctctgcgccggcggggacctcctctcgcttctctccgcccgcggcggccgcctccccgagcgcgaggcggcggggctggccgcgcagctggcctccgcgctcgccgcctgccaccgccgcggggtcgcgcaccgcgacgtcaagcccgacaacctgctcttcgacgccgccacgggcgcgctcaagctcgccgacttcggctccgcggagtggttcggggacgggcgccgcatgtccgggatcgtcggcacgccctactatgtcgcccccgaggtggtcgccggcagggagtacggcgagaaggtggacgtgtggagcgccggggtggtgctctacatgacgctgtcgggggccgtgcccttctacggcgccaccgcaccggagatcttcgaggccgtgctccgcggcaacgtccgcttcccgccgcgcgccttcgccggcgtctcccccgaggccaaggacctgatgcgccgcatgctctgcaaggacgtctcccgcaggctctccgccgaacaagtcctgaggcatccgtggtccgcgagctgcggtggaaatgcggtgccaggctgaagctatcgatctaccaacatgctggacgcgctccgtcctaattgtgatagaagatggtgggataccccgcttccccgggaaatcgggggtgggcagaaataacgggggtgccggtgtggggggccgagcccatacaactggggctagctgctgtcgtgctccgtcgacggcgggtccgggtctgtggtggggcggggcggggggcgactgtcgccccggtggcgccagagttgagttcagtaagtagatcctttaggtctagcgacgggtctctggtgaagctggaattgcaggagctttcaccggagttagcctgaatgtgtgtttgttcgtcgtgtttgttctctgaatctctgtagcagtccttgtacatacagtcttgttcagttctagctgaagaagagagagggtttagtagtactacttagtaggcaggcttgttcagaagaatgaaaatggagcaaaaataaaaaaaaaaaa

SEQ ID NO: 286 - DNA, 652 bp, Triticum aestivum
  Clone ID: PAT_TA_286
gccggccgggccggggtcgttataatttctaacaaaccgaccaagctatacttttttcaaatcatcatcatgattatttacaaggatttccttactggcgacgagatgatgtcggactcatatcctatcaaagaagtcgatgatgtcatcttcgaagttgactgcgatgcaatctatccagaatcggttgctggggatgatgaacccgttgaattcaacaacgtcatttactctttccgtctccagcctacgacatatgacaaaaagacttatgtgtcttctctgcgttcttatctcaagattgttaagaacaggcttaagaaaattggaaagaatcccgagtacattgccaatttcgagaaaaatgcgcaagatttcttgaagacaaagctacttcccaacttcgacgacttggaattttacaccggagaaagtatggacctcgatggaatgattgccgtaatgggatatcgggaggatggtaccacaccttatttcatgttctggaaggatggccttaaagagatgagaatttgaacataactaagtcagaatgcctaggcagaagatacggacggcgagatgctggtttggaacgcaacaatataaatatcttgatacagaagaaaaaaaaaaaaaaaaaaggccccta

SEQ ID NO: 287 - DNA, 860 bp, Triticum aestivum
  unsure (1)..(860): unsure at all n locations
  Clone ID: PAT_TA_287
gccggccgggctcgggatgtcatcatatcttgaaaaacaggcaaacgccttccgaggcaccctctcctctgcggcgaccaagatctccaacccctcgaccaacaaagccgcgtcccttgctgtaccatcatcactagctccttcttcaccttcaccttcagctgcttccgatcctaatactcctactaccaagcgaaagcgagatgctgcgcctgatgtcccctactcgcagccacagctcacgggctatggtgccgaggtcaagactcaaatgacctttgctgtcgaatacctgaagaagaagggcgatacaaagacgattacggaaatcatcgaccatctgagtctgagaggttacgatgaagagcacaagcgccagctggcggagggattgcgaggtcatccccgtgtggactggaaacccgacgcgaatttgagcgaacagacctggaaaacgggcacatacgctcaccgacccatcatccccggtgttaagaacgcaaccacccttctgggtcaccttcaagcgaagacagatgcgtcaggcgtgtcagtcaaggatctcaaggacggctggcccgactgcgaagacacaatatcagcactggagcgcgagtataagattcttgtcgttcgcacgaagaaggacaacctcccgcgatacgtatggccaaacgacgcttctctgcactacaaggtccagccagaattccagtccatgtggcagcgcgtccagctaccgcctatcgacgagatgcaccgcanactcaccagcgtcggacagaagcccacaagcgaggacccgcgcaagaccaaggacgggcaggcaacaagcccaaggtgcagaagcgacgcaaggg

SEQ ID NO: 288 - DNA, 1209 bp, Triticum aestivum
  Clone ID: PAT_TA_288
tcggctccgggcccggccagccggcgccgccgccccggcccgctggcgggcgcgtcccccttcgcctcctccgggccgcgctggctcatgggagtcgccgccgccgccgcccgcgcccctcccatccgcacagtatgatcaacttgcgtgaaacgtcgtggctacagtctgatcatggccctctctctcccgtgatcttgtgccgttcgtcctatccagtatgcacagtccagagtctgttagtaatatatctagcatctattctcgtgccttcttatccatatccacagcatgttccacttattcttctgtcattgtgttgtgtgcgcgcttatctgaatttctttgtgtgtgtgtgctctgtcagatacgatcatgctggagttcaagcactacgcggccgggtcgaggcggcgccccggcgaccacttcaagatccagtggcggaagaacgaggacttcccctacggcttctactacggcgtcgtgggtcacctggagccgtgcaacgccaacgagcatctctgccgctgccatgaagacgatacgatcatgctggagttaaagcactacgcggccgggtcgaggtggaggcagacgacggtgagcaggaaagaccaccgggagaaaggggacgagacggacggcttctacggcggcatcaggaagctccagaccaaagacgagatctcaacgtggcggagattctggccggtggacgtgctcagctgaacatggacatatggctgctgcgctgttgtactgagtcttcactttgcaccgcgctgctgccggattctagacttgaatgcacccacctttttggtggtgatgatgcggccgcccgtcggattgttcccggtccttctagccaggttctgttgccggcgccgcggcccctccggccccgcagcgctgcctggcccccactggctcgcctgtgttggacggtgttcacctccacctgcccttcagctggccccgggctgctgctgcatccctctctccgagtccctctggaaacaaatataagagtgtttagaacactattttagtgatctaaacgctcttacatttctttaccgagggagtagatttctggtatagaccgatgtccagttgtatttttcgcagtcattgtagccagttagtagtatatccagttacgcggctgcttcggacacggaaagcaactttgccctcactata

SEQ ID NO: 289 - DNA, 757 bp, Triticum aestivum
  Clone ID: PAT_TA_289
gccggccgtcccgggaagcacttacggatacctgtaactctgtagctcgacgcctatcgctgctgttcgccgtcgacatcacgtaacgtttctagctaaacacctcaacctcaattctctacagccacgcgcaccctccgaaatcgacagcaacatcgaaatcgcaacaatgtctctggcctcaagaatcctctcttccagcagccgcgcgctcgctagccgaacctttagcacctctgcccgacgaatggccgatgcctcgcctcttcctgctcggaaacccttgggagccttccgtggaggactcttcggtttcctcctcggtagcttcctctccggcagcgccgcctacagctaccttctcaaggaatacaagactgccaacgacctgttgactgaggatatctacactcttcaggcttccatcacccgccttagcaaccacgtccaggctctcgagaccaggatgcagggcaagaaataaatggacaggaaagcacgagcgatgaaaactgtataaaagagtttgggttgggagacagtgtaaactctcgctcgctaggtggaagcggtggtatcatgacgcctctcatcatgtcctatctcagggctacgaggaaacattatcacggaaagctgaggaagatctgtacgattctgtaccacgacattagcacatctgcaaaagttagttatcaagcatgttgcagtttgcacgagcaaacgcgtagtaaaaaaaaaaaaaaaaaagccccta

SEQ ID NO: 290 - DNA, 996 bp, Triticum aestivum
  unsure (1)..(996): unsure at all n locations
  Clone ID: PAT_TA_290
ggggccacaagcgaaagcttagcaatgcccaacccgcccaccccctcccttctttgcccggtccaacccgcctaccccctcctcgccgtcgccgctcccggccccggcgcgcaaatctccgtccagccgccggcgccagcgcctcctcacgtccccgaagccgtcgtccgctcccacctcctcgtcctcgtcggcgtcgtcggcgtcgtcttcctccgcgtccttctccttcgcccccttctccccggcgccctcgccgttccaccaccgcttcctctccccgctccgggcctccgcggtgcccttctcctgggagcaccggcctggcatccccaagacccccgcgcgcggcgccagcacccgcaacaagtccggtgcctcgccgctacccctcccgccgtcgctcttctccaacaacaaggtggtcgccgagtactccttcggcgccgacggcgcgtactccgtcgtccctgcgaaggcaaggaagcgcaagcagcagcggcggtggccgtgctgagcctacgccggtcgtgcacgaggtcgcgcgactccctcgccgcctcaggcccgccaccgcacccgcgccggtgctcgccctaggcctggccggcgagccggcatcgaccaatacgtactgtagagggttggtgtgcgtgtttcgcccagtacgtatcctacgtagtgattgggtgtgcgtgtgcccctgagtgcgcttcctcttattttttttttctcttggcgatttggggtaccaccgagtcgttcaggcatgtacgtgcgaattgggtggcatgacgctgtaataaggttgtccattccgtgtgtccggtaatatgcatgtgctgtggcttggctcccaaacaaataattaaanggataattccggnacgattggattngattaagctgcttggtttgattaantacaaatttttttttnaagggttnggtnaaagattccaataatgtccagtgtttacaccttggacatttttt

SEQ ID NO: 291 - DNA, 722 bp, Triticum aestivum
  Clone ID: PAT_TA_291
gtgcggcgctcgaggcggcctttcgggaaccatctcacagtgctaacctttgcagcacaatctagctaagctagcgagtagcgacgcatagcgctatttgcgaagtttgtttgtgtgaactgacctgaatttagaatatgatgatgatgagatcgaagttcgttgcctcggtgatcgtgatgatggcgatcatagcgctcctcatcgggtcgagctcggcgcggccgttgggcggcaatgtgctggccggagagaccactgccgtggtagtccccgacgactccggcctccagcttcttcagcgactgtatctgcagaaccttcagggaggactaccagggccgtcgtgctcgacgaacagccccaacgttaaatgcccaccacccccatctatgggttgaggaggtgcttacacatgagctacgtttacacagtgtccgtgcttcgtattatacgttctttgattttgtttcgtttagttacttgggtattgctttcgttagttccattctttgacgaatagttcccccaagtgtaagggtggagatttttccatttcagtttatgcaaactgtgcctaaatctgagctaggggttttctacttttcttaaccgtggtatattcacgtggtgaaatgtaagggatcatatatatcggtatatactcgtgactttcaataaaaagaagttgataagaaaaaaaaaaaaaaaaaaggccccta

SEQ ID NO: 292 - DNA, 714 bp, Triticum aestivum
  Clone ID: PAT_TA_292
gccggcctcatcgaaagtctatttatcctcttcacctcctcctctctctgatactttgttggacaatctcccctcttcctttctgttcttctttttgtcacagtatcttcatcatggcttctcctgttgcttctgccgccctcaaggcgcgtgtgcgcaatcccgctctcctcaagaagcttgcgcgacctgaggatctcatgcaccactttcccaatggttcttatatcggctggtctggatttaccgctgtcggatacccaaagaaggtccctgccgccatggccgactatgtcgagcagaacaacctccagagcaagatgaagtactccctctttgtcggcgcctcggcaggttccgagacggagaaccgatgggctgctctcgacatgatcaacaggcgaagccctcaccaggtcggcaaggacattgccaagggaatcaactctggtcgcatcaacttcttcgacaagcatctgtccatgttcccttcggatcttgtctacggtttttacacaaaggaccgtcaaaacagcaaccttgatgttactgttgttgaggctactgacattcttgaggatggcagcttcgtccctgacccccctgttcaaaggactcccgagttgatgcaaacgcacccccttcatcatcgaggtcaacactgctatcccctccttcaaggtctcacgatatacctttacgacgtccctccca

SEQ ID NO: 293 - DNA, 715 bp, Triticum aestivum
  Clone ID: PAT_TA_293
tgtgcggcgctcgaggcggccggtcgggaactactcctatttcctcatattcctgtgcggttgtgtcgtttcttctttttcctttctgtctatataccatattccgttcctttctccagccggtcttggggtttgcttctgtcctttttcctcgtccctcgtcccttgtccgtcaatctcgatttatctatccatccttactaggtagatatcttcaatatggagcccaccaccacaaacatgtccatcggcaccaagaccgagatctcggcctccaattttgagacagacgttgagtcagtccgcgccgaacccagctttcgcctttatcgcttgatcgacagtgccaggctgggccttacagtccttgctcttgcggctggcctgacgatcctcgggctgtcggcagataccatcgctgtctaccatgccacctacgtcccagaagattggttcctgcaattatggccatccaacttcgacatgggccccagcatcgctctggtagtaggcggtgccctggttgttgtggccaatcttgtttcgctgatcgctgacaagattcagactgtccgcgggaacgctgttattaaagctgtcatcacattcacgcccccagctatcgcgctgattgctgccatcatttccatgtcctacttttacggtgtcaacgcatcgaccaccaacgattctctgcagagctggacttgtcgct

SEQ ID NO: 294 - DNA, 420 bp, Triticum aestivum
  Clone ID: PAT_TA_294
tcgcgatctagaactagtgggagccgacagcgatgcacggtgaaacaccagcctcatagcgcaaagagattttcgcgtgttcatcgcagggccgggttttcaacgtgtgatctgtagagattgtgacggggactgatatttactagaattcgggtgaaaatcgtgtggtgatatgagaaggcacagcagaatacatagcagacggtagagaaaagattaggccggttgaggtcctgatggagaagtttgtgatggcagtcctccctttctattctggtttcttctgttattccccccttttttctgttctcattgctcaaaagaaagaatacaagtagctttggtgcgactgcgatagggttttctctcttacacatactgcaaacataagcatacacaaatatacactggtgtttttgg

SEQ ID NO: 295 - DNA, 2117 bp, Triticum aestivum
  Clone ID: PAT_TA_295
cgagtaagtgtcctcgcctgggccattcctagatccgcttgtcggccaccggggggatgcacattgaagtttatctgttcctgtccacgaccaacacgtgattgcccagtatgtggtattcgtaatcctgtgtcggtcagtccatctgcactcttatctttgaacacaacttccccgtactgtacagtatagtagacccacataaacaggtatgcacatttactgctgcatgtatcggcttatctggcagtaaccactatacactaagcttgggacggtaatacacacacgcaaatgtcttcgtaatggagtcaacacacgcccttgttatccttttgggcgttgccgtgttgtcaagcgtgacccggtcgagatgtctctccttctcactaacaacttctatcaagttctttatctgcaacaagaaggcagacgcgagtaagtacgagaactcgccgaaaatgttaggagagtttatgtccattggaataggaaaacaatggactaccaacacatgaaagcacaggctatgattatttaaaagaagatcagttttaacatggcccctcttaccttctatccacaatgactctagtctaaccgcggagttgggacacacaacaagtaccgaatagtaggctactaggctctatagtttctgatttcgcctcgctgctgcagaagcagaacacgttcatacgtccatggccaatactttttcaggttcaacaggagtgttgaccttctctgacagagaatcatagactcgaattggagccacccgttttgatatgcgtggcatggagcacttctgtttcctgtcatgatatattctaacaatgacagcagctgtttcctctacggcttttccagtgacctggatcactggccatgttgggtgccgaacaaaaatttgatttgcatggtcgagctcctgcctcacatgctccatttcagcataattgctcttctgcccatgaaatcctagagtgcttgctcttgtctttctgattgcctgaagaaccacggggtttatcgtcaacccaaagatcttatcctggtcgatctcaaatagggcctttggaagatcaatacccatcacaattgggacgtttgccactttgtaccctttttgtgctagataaattgacaatggtgttttcccagtacgtgaaacaccaacaagcacaatgtgtgcacgggcaaggttctgtggctgagcaccatcatcttgtttgatggtaaaatcaatcgcttcaattcgttggaagtaatcctcagaaagttgaccctttcggctagcagagcttcgtgaaatcccagatggagcaacaccaatatgagaagctatggcatcaatagtaggacgaagaacatcggtggatggaacaccccataaatcacaagccttcttagttgcctcagccattgaaggatcggcaagggtatatagaagcaatgctccttcttttgctgcttgccttactatctcaataaggttatccatgtcatcaatcccagagaacaggtgggtgcttgtggcacagcggcggtcgacgaggcagtgctcgaattgcccgagcacggcattcaccgagtgctccaacgtcgaacccgtcccgtccgacaccatgtagatcgagttccccgctgcctcgcttccgaccccaaccgcctcgtcaccatcgtcgtcgtcctccgtcgccgcggcctcctgctcggtgggcggcggcgacttggtccgcaccgagagcgccgcgctcgcccgtatggccggcagctccagcctccgcccggaccggagagcgcgcgcgcgggaccagcggctcagctgcgagctcgcgcgcgagcgcggctgggagggggaggagaccgccgcctcctcttgcccgggcgcgccagagtgctcttggtccggtcccgcgcttagaggcgggccggtgccggtgtcggggaggcatgacgcggcggtgggggaggggcggacgccgtggagccgaggggagggcgggaggagcacggacggcgtcgccgcgccgagcttggcgctcatcatggggtcaggcgatacacctagagcactgccccgcgcgtcgccgggaggaattgggttcgtc

SEQ ID NO: 296 - DNA, 777 bp, Triticum aestivum
  Clone ID: PAT_TA_296
gtgcggcgctcgagaggattgacctccatctcactcttttatataccaacgctgcaaccatggcccgccgacagcacttaacgctgacctttatactggtcctaggtgtatttttcaccctgtcttatttcttctctggtcctacgcgcagtgtcctacttcccaaacttcaaaatgacgttgaattgcccctgaaagacgcttctcgatccgagttcgtggcggacctcaacgctatgcctgcgggtctcctccagggcgagtctattgcgcctaagctcgaaaacgcgacgttaaaggctgagcttggccacgcgacgtggaagttcctccacacaatgatgtctcgattccccgataagccaaccaaggatgatcgcatggccctcgagactttcatgcacctttttgcccgactctacccttgcggccagtgtgccgagcatttccgaaagctacttgctcaataccctccccagacaagtagtcgcaacgcagccgctggatggctatgctttgctcacaacattgtcaacgagagggtacacaagcctttgttcgattgcgagaacatcggagacttctacgactgtggctgtggcgataaggataagaaggggggtgtcgagggcgtcgcgggtgagggtcctgatcaagagttgcacaaacattagaaagcttggccacaagtcaagtatcgatgatacatgagtaatcccggacgggaaaagaaatccgtatatactggaaaaaaaaaaaaaaaaaaggcccctaggg

SEQ ID NO: 297 - DNA, 1314 bp, Triticum aestivum
  unsure (1)..(1314): unsure at all n locations
  Clone ID: PAT_TA_297
gccggccggtccgggacgtactaagctccaacgaacttttcagttttcactcgcaaataagctgcggtcatggagggttggttaaccttatgtttcatagccgtatcgacgttagtggccgtttggttttccggtggcaagagcaagcccaagaagcatctgcctcctgggccatggactctcccggtcatcggcagcctccaccacgtcctcagtgtcctcccacaccgcaccatcacggagctgtgtcgccggcatgggccactgatgctcctcaagctaggtgaggttccaaccgtggtagtctcgagcgccgaggcggtggagcaggtgatgaagaccaatgacatcgccttctcgtaccggcggaccaccgagttgcaggacatcgtcggcttcggcggcaagggcatcatcttcgccccctacgacaaccgctggcgccagatgcgcaaggtctgcatcatggagctcctcaattccaagcaggtgaagcgcatggaagacatcagggccgaggaggtgggccgcctcctccgctcaatcatcacggccacagctgtgggcgctaccgtcaacatcagccagaaggctgcggcgctcagcaatgccgtggtgacgcgggcggtgttcggcggcaagttcgcacggcaggaggagtaccttcgcgagatcaaccaactcctagagctgttgggaggattctgccttgtcgacctcttcccgtcgtcgcggctggtgcggtggttcagcacttgcgagcgccgcacaaagaagagctgcgacctcatccagcacatcatcaccggggtgcttgacgagcgcaaggtggtgcgagctgccggtgacggcgcctgcagcaccgacgatgaggacctactggacgtgctgctcaggctgcaggaagaggactcgttggcataccctctaacgacagagaatataactaccgtcttgtttgtgagtattttccactcagtcatttcctaaccatttggatgtactatgtgatttctacatcatagagaagccacacatgaagctatggctaaagnacaattanagttcnagaagtactgggtcaatggccgactatcatttngaatancattcttgcaaatccactactttccgatggcacnaaggagtccttaaattgancactgggcccattcccccaagacananagactgcaattnggttatgacatctaaagtcaaattancataagtctccaattccagatctcatatggacatctaaagttatcaagaagttnacatactgntatangaaatcttatcncctttcgg

SEQ ID NO: 298 - DNA, 587 bp, Triticum aestivum
  unsure (1)..(587): unsure at all n locations
  Clone ID: PAT_TA_298
ttttttttttttggcaagtttggaggtgaaatcatatcacatcatgcttgcacaacaaatcaggtaaagaaccaatgctagcacaggcacatacaatcatcacatgccacttgaaggttccaattcaaccgcatcactcaacaataggacgatcatcatcaccaggaaaagaagaagaaagaaaccaaaactctcaatttgtcctagcaaaaatttggcaacatattggccaccaatcgccgaattaaccgtctagcagctagcctcttctcgcgaatcgcatgaagagggcggtaggaaagaatcccctgatgaacagggtcggctgggagccgcccggacgacgggacgagcttccggagtcttcagcggtgcgccgtgacgagcgtctcgatgaaccgcagcccgtcgaacctcggcgcgaacctctcgccccggccgctagaagacgangattccgctgtcggaagagaaccgtcgcatctgccgacgacgcgcggtcgcgcgtcggggcgcatcgcaccnaggactcgcgcggaggcacgcgacgcgcgcggagcacgcgtgcaatcccanatatcgtcggg

SEQ ID NO: 299 - DNA, 841 bp, Triticum aestivum
  Clone ID: PAT_TA_299
gcaccgccatcactgagagcgcgcgcagcagccactacacacagtatggctccgccgatctccgccgacgtcgtggtggaggctgcaccggcacctgcgtccatggccgtgctaaaccaaatggtttgcgcgagcgcgccagcgccgatcatcaccgtcgtctccaagcagctggttctgccggagggcgcctcgccggttggagacctcaagctgcccgtctccgacatgcctatgctgtcgtgccactacattcagaaggggctcttcttcccgcccgcgggcatgccgaacgcccgcctcgtgtcgtcgctcgcgctgtcactctcccgcgcgctcggcgtcttcccggcgctcgcgggacggctcgtcacgctccccgacgaccgcatcgtcatccggtgcgacgacggcgctgccgttgagttctaccatgcggtggcgcccgctctgtcgctcgccgacttcctcgtgcgcgacgccgacgtgcccaccaggctgacgaaagatctgttcccgatggaccgcaccgtcagctacgaaggccaccgccgcccgctcacgtcgtttcaggtcaccgtgctcggcgacggcgctgtctttgtcggcctcgtcgccaaccacgccgtcgtggacggcacctcattctggcactttttcaacacgtgggctgggctgtgccgcggcgagccagtccagccgccggacttcagccgcaacttcttcggcggctccacggctgtcctccgcttctccggacgcgacggccccgcggtgacgttcgacgcatcggcgcccctccgtgagcgagtcatcaacttcagcgccgcgtcgattcgcg

SEQ ID NO: 300 - DNA, 633 bp, Triticum aestivum
  Clone ID: PAT_TA_300
cggccgggccggagaccaggcaacactagcaacactagcagaccagaggactcgtggggaagaagatagtcctggcctcttgcttgcgtgcagcagctagataacgatagccggcgatggtgtacgaagcagcagaggccgttgttcataggggcgcgggaaaaggtggcggtgcgagaaaaagaagccatgagcagaagcatcaggtgcacaaggagagcaagctaagatggatgaggattgttctctggattgtcaggagggttcatccggcaccttgaagaaataaattcaagtgcatatgtacagtggcgtctcatacatacctcaagttacgatgggaggtttttatgcatgtatatttatttataccaagtaacatagatcctggcgtacggtgatttcagcactgtagtttgggaagtgtatcatatgcttgatcttttttgcgagtagtatcatacttgagtttttcacccctagttgtaatgatgattgcatattcgaagttttgagattgctaactgggtctgccgcccagtacacctaattgtagttaagatggggctttcatttatttctttgttcaagcaaaacagaaagtatgtgtctattggaccgaaaattttaccc

SEQ ID NO: 301 - DNA, 1207 bp, Triticum aestivum
  unsure (1)..(1207): unsure at all n locations
  Clone ID: PAT_TA_301
gccggcctttccgactacttggtactactcgccttcggcgaaatgagaaaacgaagcaaattctcgtggccgtggaacggcctctctcaccgtccaatcttgcaccgaactgttctactcctcctatagttgtttgcgtatacgtatttcggtgattgcgaacggacatgcgaagaaatcaattacgagtatctaatttggtgatgggaattctgggcggtgtgcaggcgtggcgagggcgaggtggaggaggacgtggagaagtacgcggagcagctgctggtgctggcgcacgcgtaccgggtgccgtggctgaagctgtggtgccaggaggccatcgggtcgcggctcaccccgggcaccgtggtggacgcgttgcagctggccgacctctgcgacgcgccgcagctgcacctccgctgcatgcgcctgctcgccaaggagttccgcgccgtcgagcgcaccgaggcatggcgtttcctccgcgacaacgacccctggcaggagctcgacgtcctccgccaactccacgacgccgacatgcgccggcgaaagtggcgtcggaagcgcgcggagcagaaggtgtacatggagctgagcgacgccatggacatcctgcggcacatctgcacggagggctgcacggaggtcggccccgtggggcaggcgccgaccaagtcgccgtgcccggcgtacgcgacgtgccggggcctgcagctgctcatccgccacttctcccggtgccaaagccgcgccacctgcccccggtgccagcgcatgtggcagctgctccgcctccacgccgcgctctgccgcgtccccgacggccactgcaacacccctctctgcacgcagttcaagttaaaggagaaccagaagtaggcgctctcggaatcccgagacggatcggcggcatgtcggatcctnctgtggttctggtggttccaggcatgctctctccctcaaaggaccgctcctgcagcgtgttcagcgcctgtggccaggtcccccgcggcgtctgttccgntccttgggatataaggatggctcgctctcattcgcctcggggactagccaccggtttgccccacccacccatgatttgtatgagatcctccaaactatcatnttcataaacagaatacctgganagtactaattttgtcatnataacgcnattttgctcttcatgaaccccatacagtat

SEQ ID NO: 302 - DNA, 783 bp, Triticum aestivum
  unsure (1)..(783): unsure at all n locations
  Clone ID: PAT_TA_302
gccggcctctccgggatggaaagacccacaaatttccttagctgtgtgagtcaaactcgtgcagatcaggttggactttgattgaaaagatcccattcaatctccagcttttgtgagctgtatcactataaaatcccccatgtccatggaccatgctctggcatgtgcttcttctttggttccctgccaagaggtggttgaagagcccctgctgaattccttgctctccatcaaacaaggcctcaacatgttcatcatagaagacaaagggggcgccattgccatcatgtgcgcctccctcttttttctgggcacgtggccagcggtgcttaccctcttggagcgccggggacggctgccgcagcacacatacctcgactactccataacgaacctccttgcggccgtcctcatagcgcttaccttcggccagcttggggatgcaaagcacaacatgcccaatttcttcactcagctcagtcaggacaactggccttcagtgatgtttgcaatggcagggggtgttgtgctcagtgttgggaacctctcaacacagtatgcttgggcatatgtgggcctctcagtcactgaggttatcagctcaagcatggttgttgttataggcacgacactaaattacttcctagacaatcgcatcaacaaggcagagattcttttcactggagtggcatgcttccttgttgcagtcatccttggctctgctgttcatgcttccaatgcggctgacaatgaanagaaactcagtgaatccacaaataccta

SEQ ID NO: 303 - DNA, 978 bp, Triticum aestivum
  unsure (1)..(978): unsure at all n locations
  Clone ID: PAT_TA_303
gccggccgtgccaacaagcatcaacagtctctcactcaacaaccactcattcaagcctttaactttcttcacttcttagtcaatctttcagagcctccatcttaaccactcaccaaataaccaataatcacaatgaagttctctattgccgccgctcttctcgccgctacggcttctgctctccccacagcccaggactctgctcttgaggctcgccagctcggcggcagcacccgcaacgatctcaagaacggtaactctggcagctgtcccggtgtcatcttcgtctttgctcgtggctccactgagcttggcaaccttggtactctgggtccccgagttgcttcagcgctcgagtccaagtatggccgaaatggagtttggatccagggtgtcggtggtgcttacactgctggcgttggcgagaacgctctcccccgtggaaccaccactgctgctatccgagagatggttggccactttaacgatgccaaccagaagtgccccaacgctgtcatcgttgctggaggatacagtcagggtgctgctctcgctgccgccgctgtcaccgacgttgacgctggtatccgcgagaagattgccggtaccgttctctttggatacaccaagaacctccagaaccgtggcaagatcccctcttaccctgaggaccgcaccaaggtcttctgcaacgtcggcgatctcgtctgcagcggtactctcatcgttgctggccctcatctgctttaccagaccgatgcttctggcgctgcccctcgcttcttgatccagaaagccgatgctgctcttggtgctgcaaaggcctaaggaaattagatgctttgtcttaatgtaaacgactgattgngagtcagatagaataggccggnctatacttgngacatttacgaggntcacgtatgttagnctggatttaaattgctttatatttatcaatgatattggntgatagaaaaa

SEQ ID NO: 304 - DNA, 2000 bp, Triticum aestivum
  Clone ID: PAT_TA_304
gcgccccgcccggctgcctttcacatggatgccaccaagcggcagcagcaacagcacgacgaggaagcactctccaactcttctcctcccgcttcttcttcctgggcgtcaacctcttcctcctcttgcttgcctggctcaggggacacggacagggcgccgctgctgccctgcaagatggccgacgatgaaaaggtcgacaggctcgacgtttctgatgatacggcccaccagattagcgttgatccttggtatcaagttggatttgtcctgacaacaggggtcaatagtgcatatgttcttggatactctgggtcgattatggtccctttgggctggattggtggaacatgcggcttgatcctggctgctgcaatctcgatgtatgcaaatgctctgcttggtcgccttcatgaagttggcgggaaacgccatattagatacagagatcttgctggacatatatatggaagaaaaatgtatgcgcttacatgggctctgcagtatattaatcttttcatgatcaacactggctttatcatcttagctggccaagcactgaaggcaatatacgtactctttagagatgacgggcttctcaaacttccctactgcatagcattatctgggtttgtctgtgctctttttgcatttggaattccttacctatctgctctccgaatttggttgggattctccactgttttcagtctcatctatatcgtgatagcatttgtgctgtcgcttagagatggcataacagcacctgcaaaagattacagtattcctggatcagagtcaactagagtcttcactacgataggtgctgtagcaaatcttgtatttgcgtacaacactggaatgctaccagaaattcaagcaaccataaggcctcctgtggtcaagaacatggagaaagctctctggttccagttcactgttggttcgttgcctctgtatgctgtgacctttatgggatactgggcttacggatcctcaacctcgagttatctactgaatagcgtccatggtccagcttggataaaagttgtggcaaatctctcggcctttcttcagactgtcatagcattacatatatttgcaagcccaatgtatgagtacttggacacaagattcggcagcggacacggtgggccttttgcaatccataatgttgtgttcagagttggtgtgagaggaggctacctggcggtgaacacgttggtggctgcgatgctcccgttccttggcgacttcatgagcctgaccggcgccctgagcaccttccccctcacgttcgttcttgccaaccacatgtacctgatggtgaaggggcccaaactttctgccttccagaaaggttggcactggctgaatgttgttgggttcagcttgttgtcggtcacggctgcagccgccgcgctcaggcttatcatactggattccagtacctaccacttatttgctgatatgtgaggccaatttctagtcagctctagattttcatatattataggatgggttaagtcaatagagtattttacaccctcgttattgagataaaatagcatcagtgaacgaagtattcctgtatgtgtggctgcctaaacattgcccgaaagtctgaaatatctatttggataagcttttgtcagcaccgctactttggacatgggggcggcgcagccataagctgaaggaaaaggctccaactgccctgctggctagccaagctgtttgggtcttaggtgtgcattaagttcattgagcattgggctaggtgtgtgtgtgggtcagcccagtgcggcctgcagagagttgtcgagcggagttataagctctttttaatagtttggattgcttaccacgtgtgtcacatgttagtggtgttataagctgtggtttcactaaaaataataattgtaagctctgttatctctcctacataaaaaaataagtagtgttctaaaaaaaaaccaaacaaaaaaactcgaaaaaaa

SEQ ID NO: 305 - DNA, 646 bp, Triticum aestivum
  Clone ID: PAT_TA_305
cgaagccgggcctccaaactcagatcaggagcaacctaatcaagaaagaagagcagcgcagagccgtgtttaatcactcgtcaaggaccgatggcgtttctgggcggatcactgcgtgtgacgagaagcattggcagccggaatatgacggaagggaagagccacggctggtcggggttgtggcggcaggcgccagcgcccgtgaggcagctctactggagggtgaggcggtccatgctgcggctgaagcgccacaccgtgagtttcgggtatgacatcaagagctactcccagaacttcgacgatggactcgtccatgcccactgcctctagcaacacacgcagcgtcttcttcttcttcttcttcttttcaattttacttggtccggagccgaagcacggctcgaggctggagagtttgaagcgccgtcaccttttgtgcttcgttcctttagcccacgaaccggtgtactagtgaaaaaaaattgagttggaaaatacccagtgtactagtattagaaagtattgttcgtacaatagttgcttagtgttgaaagtctgaaactgccaacgaaatgacagtgtatctatgtgcttctatgtagtctgcaagccgtcacttgccacaatagaacggcatttcagc

SEQ ID NO: 306 - DNA, 1258 bp, Triticum aestivum
  Clone ID: PAT_TA_306
cacagatcggaaacctcaccgcacgccacagccttccccgcccgccccatccgccaccgtcgccatgggcagaggccgaggaggccgcaaccgcaagccccgcaactccgccaccttccgcctctgcccgcgccccggcgccgccgacccctccgaccgcgtcctcgtccgcgtcgacggcaaccagtaccacgtccccggcctcgacgacgacgacgacgcctgctacttcgagggcgccttaggggacgacggcgccgagccctcgtcctccccatctggggccgccctccccgaccacgtccgccgcgcgatcctcgagctcggcctccccgacgacggctacaactacctcgcccacatccgcgagatccgcccctcatactcctccaccggtggggccgggggctcgtcccgcccgtggttccctccccacccgccgcgccgcgcgctgcggcctcccgctgagcgttcaaggcatacgacgcgcgtggtgttgatgttggtctggacaatgtcgctgcagcgggagcgctgattccagtggaggaggccatcgacccggatgtcaccgacctgcttgaggagagcgacgtgccaccggagacctcggaggatgagaatgaggatgaggagagcgaggtgccaccagggatcgtggaagatgacaatgaggagagtgaggggccatcggagacctcggagaatgaggattcagagctggaggacgattttgttatcattgcaaatcagcctgagcaggaagaccagatggatcttgaggatgattttgttatccttgcaaaccagcctgacggcgaagagcagatggacatgatgggcggtaggttggcgcgaggcagtttcgcagctgccttatgggcatgttaaactgcttgctttgggaaagaatgatgcggtgaagatggccgtgataaccaaggctcagaaagcttttaggggtccgtccttgtcggcgcaccttgtgtgctgattatttatcttatatatattgtgttgatagtgaactgtttgtcatagcaattcgattgtcagtaggaataatattgaacatttgtgccaaatgtcgcacgcactaagttaggtttccttagtagataaaagttatgggtgatgtacgatattcatcttctactgtaccgctctccccaagattatgtttcaaaactcgtaattcaggatgtacaaagttatcgttgtctcattgtgctaaaacaaaaaaaaaaaaaaaaaaaaa

SEQ ID NO: 307 - DNA, 1088 bp, Triticum aestivum
  unsure (1)..(1088): unsure at all n locations
  Clone ID: PAT_TA_307
gaattgtcgatcgaggttgttgatcgggctctccggaaaccngccaagtagcttacgtgatcagtgaccgcaccgcacctctcgtacatatgtcgtgtgcgcgccgttcatctcgataagacccacttaggcccgcgcgctcacgccggcagatttgttacatctggacggacggcgtcgccacttgcactcgcacgctgcaacatactagctgcctccactcctccgcacactagcgccgctgtccagctgatttgcttcgagatggacatgtgcatgggcatggccaagctgctgctgctgctgctcctcgtggtcaccgccggccacggccacgcggcggcggcggcggggaaggagaggaacactatcacgcacgtcaaggggttcgacggcccgctgcccttcgccctggagaccgggtacgtggaggtggacgaggcgcacggcgccgagctcttctactacttcatccagtcggagcgcagcccgcgggaggacccgctcatcctctggatcaccggcggccccggctgctccgcgctctccgggctcctcttcgagatcgggcccctcaagttcgacgtggcggggtacaccgagggcttcccgcgcctcgtctacttcgaggactcgtggacccgggtcagcaacgtcatcttcctcgacgcgcccgtcggcaccggcttctcctacgcgcgcgaggaggagggcctcgacgtcagcctcaccggcaccggcacgcacctccgggtcttcctgcagcgctggatcgcggatcatcctgagttcgcctccaacccgctctacatcggcggcgactcctactccgggtacaccgtccccgtggccgcgctcgagatcgccgaccagccggataaggcaggcctgaacctcaaggggtacctggtgggcaacgccggcacggacgacaagtacgactccggcggcaagatccccttcatgcacggcatggggctcatctccgacgagctctacgaggcggcgaagggcagctgcggcggggacttcgtgacgacgccccggaacgcgcagtgcgccaacgcgctgatggcgatcaccatggc

SEQ ID NO: 308 - DNA, 1188 bp, Triticum aestivum
  Clone ID: PAT_TA_308
cccacgcgtccgcacacacaaccgcagcggcaagcaacacgggccgtcctcccgcacgcacagagccgacccacctcccccccttatcgacgagcctctcaaaagccaagatctcccagcgcgcggcgccgtaatgctcgcctgattgcgctggtcatggcgccaccacaggagcgggactacatcgggctgtcgccggcagcggcggcggcggccacggagctgcgcctggggctcccggggacggaggacgctgccggggacggcggtggagcggcgtcggaggcgccgctgacactggagctcctgtccaagggcggggcgaaacgcgggttcgcgggcgcggtggcggaggaggaggacgagaagaagaaggcgcagccgccggccgccaaggcacaggtggtaggatggccaccaatccgcagttacaggaagaacaccatggcgacgaacttatctgctcccagaagcaaagacgaggccgaggcgaagcaggcaccggcaccaggctgcctttatgtgaaggttagcatggatggtgctccttacctcaggaaggtggatctcaagatgtataagaactataaggacctctcgctggagctggagaaaaagttcagcggctttactgttggtcatggtgaatcgactggaaaatcgggaagagatggattatctgattgtcgactgatggatcttaaaagcgggactgaacttgtgctcacttatgaggataaggatggcgattggatgcttgttggtgatgttccatggcgaatgttcacagacagctgtaggaggatgaggatcatgaaggggtcagatgcagtgggcctcgctccgagggcggccgagaagagcaagaaccagaaatagcaaaaaggatgaacccggtctgtttcctgtgattcgcatcgtctcgtacgagggtgatggacttcatgtgtgatgagaaagggatttacttatatatataacctacgtgtattctctttattatttccttgtatgttggctcggaacaagcatgttaggttgtgtaagttgatgtgtgtgtatctactactactgcactattttactttgattcgcgtgtgttgtatgtggtttgcgttgtaaattggtgtgctctgtctgtaccgcaaactcttttctttctggaattgggtttgtctgcttgaaaaa

SEQ ID NO: 309 - DNA, 1233 bp, Triticum aestivum
  Clone ID: PAT_TA_309
gcgcgcgcgcgccacacacacacaactgcagcagcaagcaacgaacacgggccgtcccgcacgcacagaagccaggaaaacctcaaacccacctcccctccccccttctcggcaagcctcctaaaagccaagatctcccggcgcccggcgcagtaatgctcgcctgattgcgctggtcatggccgccgccacaggagcgggactacatcgggctgtcgccggccgcggcggcgggcggccacggagctgcgcctggggctcccggggacggagggacgctgctggggacggcggtggagcggcgtcggaggcgccgctgacgctggagcttctgtccaaggggcggggcgaagcgcgggttcgcgggcgcggtggcggaggaagaggacgagaagaagaaggcgcagccgccggccgccaaggcacaggtggtaggatggccaccaatccgcagttacaggaagaacaccatggcgaccaacttatctgctcccagaagcaaagacgaggccgaggccaagcatgcaccagtaccggagtgcgtttatgtcaagcttagcatggatggtgctcctaacctcagaaggacggatcttacgatgtacaagagctagagggacagctcactggcgctggagataatgttgggcagctttactgtaggtcatgatgagtcgactgataaaattccggaatggagggattttcagattgcagactgctggatcttaattatgaggattgagcttgtggttggctgcttggtggtgaggtggcgatgcgaatgttcgcagacagctataggaggtggaggatcattaaggggtcagatgcagtgggcatcgcgccgacgggccgccggagaagagtaaggaaccagaagtagcaagaacgctaaaaccgttatgtttcctttcctgcgatcgcatccttccaagggtgacggactttatgtgcgttgagagaggggtttacttatatatataacctacatgaattctctttgttctctccttgtttgctcgttcggaacaagcatgtcagacatgtgtgagctgatgtgtgtgtatctgcgactaccgcctaattttgctctgttttacttggattgtcgccggtgtcgtttgtggtttgcgctgtaatgtctgttccgctgactcttctccttactcttttgatactggagttgggcttgtccgctggcaacaaaaaaacgaccacgctaaaaaaaaa

SEQ ID NO: 310 - DNA, 533 bp, Triticum aestivum
  unsure (1)..(533): unsure at all n locations
  Clone ID: PAT_TA_310
cnnnnnnnnnnnnnnnnnnntnntnttttttttnttttttttcccaacaaaatcattgttcacatcccaaaaagttaaatacaattcgaaccattattcagatcagttaatttcgccggcggggggactcatacccgatttattttaccccacgcgttattacaaaacccataggattttcggcaaatttttattcacctaacaaaacttcgctcatctgaactttactgatgacgactctacagcggctgtggcctgctctgcactatgtagatgtcctccccgaccatgcagccctccacgtcctgggcgctcccgaacctctgctccaggtactgccccacggcggcgagccgctgcccgaacttctgcctgaaggtccggtccacggagagcggcttcgtgctgtagtcgacggtgagcctcaccacctcgccgtcggcggggcctgagccaagcaccctcatctcctcgctgaagttggcgaaggccagggtggcgacgtcggtgtcgaacttgtcgcacgagagacg

SEQ ID NO: 311 - DNA, 827 bp, Triticum aestivum
  Clone ID: PAT_TA_311
gccggccgttcccgggatacttgttgctatcgaattcagatcagatcaccgaatcccaatcaactcgctaccagtcaagcagctatcaacaccaccaaccgacatcatgaagtactccgctgtcgccctcctcgctgccctcactgcctacgctcaggcccagtccatcgaccttcctgacccctcttccgtcattggtgacatctctactcgagttgaaggtgcttcctctatcatcgacgaagtctcctctgccgtccgggatgcctctacccgaattgaggacgaggtctcttctcgcctgagcgatgcctccactgctgtcgccggtgccaccaccactttgaccgacgcgtctactgtcactgagtctgctgagaccggaagcgagactggatccgagactggatccgacactgagactggatctgacaccgagaccggatccaagaccgtcgacaccagctctctcaagagtgttaccgaggcctttgccagtgcctccgagtctgtccaggaagagcttgactccctcagctccgttgccgccactgccaccggcgctgctagctcctccatcgctgaccagatcgctgaggccacatccaagattggtgccattggcaacagtgccagtgccgctgtcagcagtgctactgatgacaacgctggtgccatgcccaccgctgctgtcgctatgggtgctctcatgggcggtgcagctatctttgtcaacatgtaaaatgggttttgtgcgatatgacagaatacacagcaattaatgaaacggacttgacattatcaaaaaaaaaaaaaaaaaggcccct

SEQ ID NO: 312 - DNA, 806 bp, Triticum aestivum
  unsure (1)..(806): unsure at all n locations
  Clone ID: PAT_TA_312
tcatcacgtaccatgtggcgtagcccacaaactcccacaccgcctgtctggcgccatcgcctccctcctcctcacctgccccccgccatttgcactcaccaaaaccttcactacgtcatcacgtacatctatcgagcggcaggcggacgactcttttaccgccagcgccccggtgtctcccctcgtcatcgctcctcttctccttccgtgcatcgctccgtaccctaccgaacgagcagcagggaggcatctcttccgccgcaggccggccgctggagcctgcccctgccaaccatttcttcggttgccctggcgtcgactcggtgatgccgtcgcggccgtggcatgcagacaacgccgtgccagccgacagagagctgggcggccaacgaagtcttcgagacgttgcgcaggccgccgatagagatatacgggccgtcgcggaagcacaacgccgtcggcctcgacagccagctggagaagccgtgaagcaaggagatggtgcgttggccgctcgatagagatatagtagaaatagctcatagatacgtgtatgatgatgacatatggtgtagattaatgtttacgtagtttgtatgggnggtaaggttggcgtgtaacaactattcttggagaggttccttcgtttcttacctttggtttggagccggcagagttgtcgatgcttcccaactttccttccttccttccttccttcctttgcaaacgcggccctcttttttctttcgataaagntataaaggatgattgatatgtgagaaaaaaaaaanaaaaaaagcccctan

SEQ ID NO: 313 - DNA, 639 bp, Triticum aestivum
  unsure (1)..(639): unsure at all n locations
  Clone ID: PAT_TA_313
gtgcggcgctcgaggcggccgggccgggatccttcccattccttgactctcattctcttttgtcgagcacgctaagacaataataattctcaatctcaccatctcaatcctccatcaccgctattcccaactccccgcattcgacctcacagacaacaacatggacatggctacaatggcggctcctcaccagccaagatacagcctcgaagacccaggctccggcttcgaacctcgcaacaacgcccgcgacgccagagaagcagctcgcgctgtgcgaaacggtcagagcccgcgatacagacgcacccaatctcccgaacaactcgtcgacgattatcgcttccagagtgaggagggttccgagatgcgctctcccacgtctgacgtggcattgcaggacgccatgcttgcacaagcacaacagcagcaacaggtcgcgcgaaacgcagggcaacgaagacaacctccccaaggtcaacaagttccccccaacatcaacatcaacggtcgaggtccccaaggtttaggtccaggtcaaggtcaaggtcaacccatgcctgctacgtacaacggtcccggttcaatggacgctcaacagcaacccaacggncctagaggcgaagctgggcggtacag

SEQ ID NO: 314 - DNA, 812 bp, Triticum aestivum
  unsure (1)..(812): unsure at all n locations
  Clone ID: PAT_TA_314
gccggccggttcgggatatcagaccatcctacaggcctctctctctctctcccttgctgtctcacacacacactccaaagggaaacatacgctccaaaaatccacaccaccgatcaggagttgaagaaatcgttgccaacatggtcggcgccggaaccaacaccgccatgggtccccggaagacgcgggtggtgctctacccgtcgccgggcatggggcatctggtctccatgatcgagctcggcaagctcttcgcggctcgtggactggccgtcaccgtggccctcgtcgactccccgcacgataccagcgccacgggccccttcctcgccggcgtctccgcggccaacccctccatctctttccgccgtctaccacaagtcaagcacctcgggtctgagccgccggagatgctgaccttcgaggtcgtccgcctctccaacccgcacctccgtgactttctcgccggcgactccccagccgtcatcgtgctggacttcttctgcagcgccgccatcgacgtggccacggagctcggcatccccgcctacttcttctgcacctcaggggcccagatcctggctttcttcttgcacctcgcggttctgcacggcaagagcacgaggagcttcggggagatgggccaagaactcgtgcacgctccgggaatcacctcgttcccggcgacgcacgccattcagcggcttatggatcgtgacagcgcgccctacaaggcatttctanacatgagcaccaacctgttccggtcccnaggcatcatcgtcaacaccttccgctcgctggagccgcgc

SEQ ID NO: 315 - DNA, 1117 bp, Triticum aestivum
  Clone ID: PAT_TA_315
gccggccggttcggggccggggccggggtcccaataagctcaattccatctgaccataaaggtgtcgagtcaagatgcgtctgtcaactatactcaccggagcggctctgttctcctcttcgcaggctctcaacatcctcctcaataatgatgatggattcggctctggcaacctccgtgagatgtaccgtctcttcaaggaaaagggccataatgtctggctcgttgcaccagccaccaaacagagtggcaagggtggtacctctgatttcactgccgagggcaatttgactggtccttctcagtatgacctcattcccaagggtgcaccatcggttggaagtgatcccaaggacagccagatttggtactacaatggcactcctgcggcatgcacatttgttgctctcgactatgtgctcccgcgatacgccaactttagcgttcccgaccttgtggtaactggtcccaattatggtaccaacctaggtggtttcgtttggactctatccggtacggctggcgccgcatacgctgctacaaaccgtggacttcccgcgattgccatctcagcgagtaaccaagaagtcccctacttcgacgtcaaaaaccgcaccaacccggctacatgggctgctcaagcctctgtcaaattcgtcgagaacttcatcgctactgctggcaagaacggtcctctcttgcccatcggttacggagtcaacgtcaatcttcccgtgctgacggagaaggaccatgaccccgaatttgtacagacacggttcacaggcaacgcgcacgttaacgaagcggtccttgatcccaagaagggaacgttcacgtgggccaacatcaagccttatgccgcgggtgtgaatgcttgcatcaatggcaactgctctctacctggcgagacgtatgttgttgagaatggaaaggcgtctgtgtcgttttatacagttgattacagtgctcctgagacagagtacactgaatcacttatcgaccgggttgcttctttcattgggaaaaaataagaaggaactagttcggacttgataggatagtaatggcatatatcatagaatataatgaatagtgtatactgttacatagtccc

SEQ ID NO: 316 - DNA, 1822 bp, Triticum aestivum
  unsure (1)..(1822): unsure at all n locations
  Clone ID: PAT_TA_316
gccggcctcctccggttcgtagctactccgcgcttgccttctctctactggctcgtggagctcctctccgtcctttgcttagtcgtcttctactacccccatctacggcccaaaaaaaggacgtatgcagagcggactgcatggccttcccaccgccaaggtttgggactggtcgccagccggtcccactcgcaccaccgtgcaagcggaatcccggccggcccgcgccacagccttcaagctcgcggccggcgcccccgcgtccgattactacacccccgcctccccccccacgtacgaccccaatggaggccccgccgccccaggtagcctaagggacgtgatctcccacacatcctacgcctcctgggcgcggccatctagacaaccggcggagcgtcgtgggcgcgcctggctgccaagtcctatccgttcctggctgcccatcgcctccgcgccttctcggcgcggttaagccgcgacaaggtagcgagggggctactgcctttccacgcccaagccggcattgccggttcgaccgacgtcgatctgcacggcgtcttcctgcgcctgacgttcgacatgacctgcaacctcgtcttcggcgtcgaccccgggtccctgcagatgtacctccccgtggtggccttcgcgcgcgccatggacgacgtgctcgagtcgctcttcctccgccacatcatctcgcccgcgtgctggaagctcatgtaccgatatgtattcatgtgtgccctaaatagaaaacgcacctctgggcaccatcgaccggttcgccgcggacacatcgccaaacgcagggccgaccacaagctcggcgacgagggcgtcaccgactcgtccgacatgctctcgtccttcatctgcaacggtgacgcgaagcgagtacagcgacgacttcttgcgtgacaccacgggtgaacctcctcctcgccgggccgggacaccaccggcgcggcgctgtcctggttcttctacctgctctccaagaacccgcgcgtcgagcagaagatcctggacgagctggcgccgatcgcttcccggaagaagcagaagctggccggcgacgacggcatggcggtgttcgacgtgagcgagctgagcggcatggtgtacctgcacgcggcgctgtgcgagtgcctgaggctgtacccgtccgtgcccttcgagcacaaggcggcggtggccgacgacgtgctccccagcgggcacgagatgaaggccggcgacaagatactcatcttctcctactgcatggcgaggatggagggcgtgtggggcaaggactgcatggagttcaggccggagaggtgggtcaccgccgacgggaagctgaggtacgagccgtcctacaagttcatctccttcaacgccgggcccagaacctgcctcggcaaggagatggcgttcgtgcagatgaagaccgccgccgccgccgtgctgtggaacctcgcagtcgagaccgtgccgggccacgtcgtcgagccgaagctgtccatcattctccacatgaagaacgggctcgccgtcacggtcaagcggaggaacatcactggagtgcatggctagctagtaccgtacgtgcgtgcctagtgcctacacgtctcggccgcaaggtatacggggccgtacgtagctacgcgtagcggccacgtaagtacatgtatacgtattttatgtgtgcaagagtgccatgtgtgcttactactagatgtgcgttgtgacatgtgtgtaagctgtatgtatgtgtgccctaaatagaaaatggacgtatgggcaccagncttggatgcgnatctatacaggt

SEQ ID NO: 317 - DNA, 604 bp, Triticum aestivum
  Clone ID: PAT_TA_317
cggatccggacctgaacgggatgatgcagtgcatgttcgggtgcttcacgtcggtgatgagctgcgcgttcgggtgcatgggcaagggccccgacctgccgctctgcatcatcagctgcaaccagaagagcatcgtctgcatgatccgctgcggcctcacgccctcgccgccgagccccaagccgccaacgccaccggcgccgcccgcgcccaagccggcaccccccaagcctgcacccggcccgccgccatacgcccgtcaaaacaccgagacctccccctagacgtacgccgacaattgccatgcatgcatgatgccagtaatatggtatgcgaattaactaaagaagaagccacatatatcatggaggtacccggatatatagatagtgctcgatccataacttatagctggatttcaacacttatatatctagatttacgcccctcaaaaaatatatttagatttatgttattacagtagaaacaatgtcatgtatgacccacggtgattgtacttatactattcatgcaatatatatgtatatatacattcgtgtaggcgtgcaaatatgtaatgatagctctattaaattatgttcac

SEQ ID NO: 318 - DNA, 858 bp, Triticum aestivum
  Clone ID: PAT_TA_318
cccacgcgcccgacccaccgcacgcccaccccccggcgcaggcttgccaaccgcccgatcaccacacacagcagcagcatggctaccaccagctgtgccctcctcgtcgccctcgtcgtcctggccggcctcgccgacctgcaggccgccgcagccgccccgaggcccgttcacgccgcggagcacttctccatggcggcaatgacggcggagcacccaatggcggacgaggcggacccggacctgaacgggatgatgcagtgcatgttcgggtgcttcacgtcggtgatgagctgcgcgttcgggtgcatgggcaagggccccgacctgccgctctgcgtcatcagctgcaaccagaagagcatcgtctgcatgatccgctgcggcctcagcccactccccgcccgcctcccacggccggcccaccaccccccgggcccgccccgcacccaagccggcaccccccaagccctgcaccccgcccgccgccataccgccggtcaaaacacatagatcctccccgctagatcgccgacgattgaaattgcatgcatgatgccagtattatggtactatacgaattaactaaaaaagaagccacatatatcatggaggtgcccagatatataaatagtgctcgatacataacttatagctggattccaacacttatatatctagatttatgcccctcaaaaaaagaaatctagatttatgttattacagtactaatccaatgtcatatatgacccaatgtaaaattgtacttatactattcatgcaatatatatgtatatatacacttggtgtaaaaaaaaaaatatgtaatgatagctctattaaaccaaaaaaaaaaaa

SEQ ID NO: 319 - DNA, 925 bp, Triticum aestivum
  unsure (1)..(925): unsure at all n locations
  Clone ID: PAT_TA_319
gccggccggtccgggatacctccatctctctcccatacctaattcctttgagcccacttctagagagctcagagcgtttcctctcttcgcagtcgctgataccttatttggttcccccagcgcttcataacttcaactctcccacctccaccacatcgtcgagctcgatattcacaatggctgccgcttcctctaacagcctgtcggccaacgacaacattcagcgattcacggcttccagccggccgttgagcccccttcctgaccacgctctcttcaccgacaagacgcgatgcctcgtctacggtctccagcctagagccgtccagggcatgctcgacttcgacttcatctgcaagcgatccaagccctctgtcgccggtattgtctacacctttggcggccaattcgtcagcaagatgtactggggaaccagcgagactctgctgcctgtctaccagcaggttggaaaggccatggagaagcaccccgacgtcgatgttgtcgtcaactttgcttcttcccgaagtgtctacagctctaccatggagctcatggagtactcccaggtcaagaccattgccatcattgctgagggtgtccctgagcgacgagctcgcgagatcgcccacgttgccaagaagaagggtgttaccatcattggccccgccaccgtcggtggtatcaagcccggcagcttcaagatcggtaacactggtggtatgatggacaacatcgttgcctccaagctctaccgcaagggttccgttggttacgtctccaagtctggtggtatgtccaacgagctcaacaacatcatctcccagaacaccgatggtgtttacgagggtattgccattggtggtgaccgataccccggtaccactttcatcgaccatcttctgcgataccanggcgatcccga

SEQ ID NO: 320 - DNA, 825 bp, Triticum aestivum
  unsure (1)..(825): unsure at all n locations
  Clone ID: PAT_TA_320
ctcacaccgctatgagggaccagaggtcaacacaaggttggctcattcagaggccaaattactacatgagaagattgagcataaggcttatggtgatgatgaggtcatcagaattctcaccactaggagcaaagctcagctgcttgcaacattcaataattacaatgatacatttggtcacccaatcactaaggatctgaaggctgaccccaaggatgagttcctcaagaccctgcgggctgttatccggtgcttcacctgccctgataggtactttgagaaggtggccaggctggccattgcaggcaatggaaccgatgagaactccctcactagggtcataaccacccgcgctgaggtggacctgaagctgatcaaagaggcgtatcagaagagaaacagtgttcccctggagaaggccgtcgcaggcgacacctccggcgactacgagagcatgctcctcgccctcctggggaaggagtgagccttgcccctgtatccaccccctgttacccttttatatctcgaccggagaataaacccctggtatgcaaggttagatctgctgcaccttgcataacagtgagaataaggtagagagagatatgctttacgatgagtcatgcatggtacctttcgtacttagatgttcgcgtgtgaaatgcagaagagatattaaagttgtgttttctgtaagcctgaaaatctatcttgtgtctgtaactctgtattgcctccgttaccgattgcccctgcagtgggcttgaattgaatcgggtaatagccgcagtgtgcgagtcttccgnnnnaaaaaannnnnnnnnn

SEQ ID NO: 321 - DNA, 1255 bp, Triticum aestivum
  unsure (1)..(1255): unsure at all n locations
  Clone ID: PAT_TA_321
gcacccncgtcgtcgcccacgcaccaacaaatccatccacctccccgaatcgcgcccaggcgcacaccggaccggacgaaacgagatcccacttcatcgctccgcgtccgatcccggcaggcgcccgatggcgacgctctccgtccccgccgccgtcccggccctcgccgacgactgcgacaacctgcgcaaggccttcgcggggtggggcacgaacgaggccctcatcgtctccatcctcgcgcaccgcgacgccgcgcagcgccgcgccatccgccgcgcctacgccgacacctacggcgaggagctgctccgcgccatcagcgacgagatctccggcgacttcgagagggcggtgatcctgtggacgctggacccggcggagcgggacgcggtgctggccggcgagaaggccaagaagtggcaccccgggggccgcgcgctcgtggagatcgcctgcgcgcgcacccccgcaagcagctcttcgccgccaggcaggcctaccacgaccgcttcaagcgctcgctcgaggaggacgtcgccgcgcacgtcaccggcgaattccgcaagcttttggtgcctcttgtaagcgcataccgctacgatggcccggaggtgaacacatcgttggcacactctgaagccaaaatactcaatggaaagatcaacgagaaggcctacagtgatgatgaggtcatcaggattctcactacaaggagcaaagctcagctacttgcaacattcaacagctacaatgatcagttcagtcaccccatcactaaggacctcaaggaagaccccaagaacgagttcctctcaaccctgagggcgatcataaggtgtttcacttgccctgacagatactttgagaagatcatccggttggcccttggaggcgtcggcacagacgagaacacccttacgagggtcataaccactcgcgccgaggtggacctgaaggtgataaaggaggcgtaccagaagaggaacagcgtcccgctggacaaggctgtttctaaggaaacaagcagagactacgaggacatgatgcttgcacttctgggggcagagtactgaggcatgtgcctgatctaccatatgcttgatgatggggggaataagagtgcataaaactgtcaagtgtgttgtttttcatggatgattataagttagcctgcatggcagtactcgtccgatgaattatatcatttcgtcatttgagctgcagaaatatcattggtgttttttgaagttt

SEQ ID NO: 322 - DNA, 1463 bp, Triticum aestivum
  Clone ID: PAT_TA_322
cgcgtgcgtgcataaaacgccctccgcaccgcgactcacggcgcctgctccccgcgcgcaccagcacatccagctccccgaatcgcgccgggacgcacacgggcagacacacgaaccggaccggacgaaatcggcccgcccgtcccgccactccccgcccggtctcgagatcccacatcgcacgcaccgcttcctccgatccccggccggcaggcgcccgagcccgatggcgacgctcaaggtcccctccaacgtcccggccctcgccgacgactgcgacaacctccgcaaggccttcccggggtggggcacgaacgaggccctcatcatctccatcctgggccaccgcgacgcggcgcagcgccgcgccatccgcaagcactacgccgacacctacggcgaggagctgctccggagcatcggcgacgagatctccggcgacttcgagagggccgtgatcctgtggacgctggacccggcggagcgggagcgcggtgctcgccaacgagaccgccaggaagtggcaccccgggagccccgtgctggtcgagatcgcctacgcgcgcagcgccgccaacgcaagctccttcgccgtccggcaggcctaccaggaccgcttcaagcgctggctcgaggaggaagtcgcagcccacgtcaccggcgacttccgcgagctgttggccgctcttgtaagcgcacacctctacgatggaccagaggtgaacacaccgttggctcattcagaagccaaaattactacatgaaaaaatagcgcaaaagcctaacgctgatgatgaggacataggaattctcacaagaggagtaaaacgcagaggatcacaagatcctccatcagaacgatgtcgcattcgacactccagccgataaggagtgcatgctcgaccccaaggaggggttccagtaggccctgcgggcggtcatacggtgttttacctgccctgatagatactttagaaaagtatccagggtgtgcaatgccggtggtagtccggatagaccctgtgcaccttgagtaaggacaaaacgagccgagggggacggtaggcccatggaagaagcgtaccaggagaggaaccatgttccccaggagaatgccgtaggaggcgacactttccgtgacgacgagagcatggaccctgccctcggggggaaggagtgaacctttccgctgtatcaaattccaacccctgttgccttattatatctcatgattggtgattaaaggatgatgagtaagtaggttgtcacactggttttgtccttgcataacagtgagtataaaatagagatgggcattacaatgagtcatattttagaaacttttgtacttagatgctggcgtgtaaaataccgagggcatattgaaaagtaaagttttctgtaagcattaaaaatacgagaaaaaaaaaaagagaggtcgtgggctcgacctcggggttcgg

SEQ ID NO: 323 - DNA, 923 bp, Triticum aestivum
  unsure (1)..(923): unsure at all n locations
  Clone ID: PAT_TA_323
gtgcggcgctcgagncngccgtgccgggnnngccggccgtactctgaatcgaatttaagcgatagtagagagctcctcctattgcaaataccatcatcatgggcgcccccgaagttcaccacctcttccacaaccccatcgccgaccactccttttcggccgatcagtctaccctggctgtcgctcgggatacttctgtcgagctctatggcaaggttggcagcgcttttaagctgaaggactcgctcaagggccacgacaagacagtcactggtgttgatattgcccctaacagtgggcgcattgtcacatgctctcaggaccgtaacgctatcgtttgggaaccttcccctgaaggctataaaccaactctcgtccttcttcgaatcagccgagccgccactttcgtgcgctggtctccctccgagaacaagtttgccgtcggatccggtgacagggtcattgctgtctgctacttcgaggaggagaacgactggtgggtgtccaagcacctgaagaagcctatccgcagcaccatcaccagtgttgcctggcaccccaactcagtccttctggctgctggatccaccgatgctcatgcgcgagtcttctccgccttcatcaagggtatggacgctcgtcctccccctggagtttggggcgagcgtctcccattcaacaccgtttgcggagagtatctgaacaactcggctggatgggtgcactccgtttctttctcccccagcggagacagtcttgcctttgcagctcatgacagcagcatcactgtcgtttacccctctggccccgaccaagcccctcgagctgttgttactgtctctactcagcagcttccttttcagagtctgatctggacccagtgagatgagattatcgctgctggttacgactgcgaggctttc

SEQ ID NO: 324 - DNA, 819 bp, Triticum aestivum
  Clone ID: PAT_TA_324
gccggccggtctcgggaattgatcctttcttttaattatcttgtcttgcggcgacattgctatcgcaactccacattgtgacactcaacacgaggtccataagagaaccaactcccgcccaccttcctacgattgacgactctactctactttatcattcctacaactacaaccaattctctcctcttcatcctccccttcaaacttcaatcgcagcaaaaatgtccagcaatctctccttcgtcctcaacaaaccaggtgacgtctccttcgaggaacgtcccaagccctccctcgcaagccctcacgatgtcctcgtcgccgtcaactacaccggtatctgcggttccgacgtccactactgggtccacggctccatcggcaagttcgtcgtcgaggaccccatggttctaggccacgagtccgccggaactgttgttgaggttggcgacaaggtcaagaccctcaaggctggtgatcgcgtcgctcttgagcctggatacccttgccgtcgctgccagaactgcctcgctggcaagtacaacctctgccctgatatggtctttgccgctacgccgccttatcacggtaccttgactggtttctggtctgcccccgccgacttttgcttcaagcttcccgacaatgtttctctccaagagggagccttgatcgagcctctcgccgtcgctggtcacatcgtcaagcaggcgcgcgtcaagcctggtgactctgtcgttgtcatgggcgctggtcccgtcggtcttctctgcgctgccgtcgcaaaggcctacggtgcttccaaagatgtcagcgtcg

SEQ ID NO: 325 - DNA, 656 bp, Triticum aestivum
  Clone ID: PAT_TA_325
ctagagccaagctgattaatgcccttaattacacgatcgttattggcaaaagaaagacaaaaattgattgatctcagaattagggaatgaatgttcccctaatacaaaaacaatggcatataaataaagaaaagaaaaggaaaagctttgggcggcgtacgtgacacatatggatcagcacgtacgcattattattacaactgatcgagggaaagaggccatggcgacggacggacggacggatggatcattgctctagacccatctcatctcatctcatctctgtccggtggatcctcagtcggaggtgctggagctgctgggctccggtgcatccgcagcggagggctcggaggctggcgagtcggcggcgggcgcgtccgcgggcgcgctggcggagggcgccggcgcttcggccttcttctcggccttggccttcttgcccttggcttcggcgaatggcgccaccgcgacggcgaccaggaggagggcgacgatgaagacagctgcgcgggccattgttggctggctggctttgttggtccggtgggagcttactagctgcgggcaggcgcactgcttggcgatggatggatggatggatgcttgttgggttgagagatggagatggcgggaaggtgcacccgcccgcgtgc

SEQ ID NO: 326 - DNA, 1220 bp, Triticum aestivum
  unsure (1)..(1220): unsure at all n locations
  Clone ID: PAT_TA_326
ccgctgcgcgtcgcgccgccggacgtccgagacccgaagacacaaacttaccgctctccgttgaccaggagaggagaactcctctcgcaggacgcgacccccctgcgcgccatggccggttcccgtcgcgccctccgcttcgtccggctcctgccgaccaggctcggcgccctcctcccgggaccgacgcgagccccccgcgcgccatggcccgttcccgtcgcgccctccgcttcgtcctgctcctgccggccatcctcggcgccctcctgccgccggccgcgccgcggggccgcccaaggtatccctggcgctctactacgagtcgctctgcccctactgctcgcgcttcatcgtcacccgcctcgccgggatcttcgacagcggcctcatccacgccgtcgacctcctgctcgtcccctacggcaacgcccacgtccgcggcgccaacaacaccatctcctgccagcatggccccgatgaatgccttctgaacaacgtggaggcttgtgccatcgacgcctggccggatttgaatgtgcatttcggtttcatcaactgcgtggaggacctggtgatgaaccgcaagcgcgaggaatgggagtcgtgcttccagaaacaggggcttgaccccaagcctgtcatggagtgctacaacagtgagcatggccacaagctttcgctcaagtatgggaaacagactgatgcgcttgtgcccccgcacaagtacgttccatgggtggtggttgatggccagccgctgtacgaggactacgagaacttcgaagcttacgtctgcaaggcttacaagggccatcctcccaagatttgccaagggctgggccgtgactacccaatcgtacaacaggtggtggaggctggcaacggtgtcacctacaactccggcgatttcgagctggatgaaggggtcgacgacaagattaagatggtccagggtgatgacaattgataaattgtatttgtctcctttcggggatcctataccgatacacatgaacatagggctgtttcatctgtctgttcaggttaattatgatgtaagttataaaagaaaagcttaattatgatgtacatcggtaataaagtgatttatggtgatgtaaattcatgttcaagttaatatgtagatataaaaaaaccccgtcaaatgtcctttnantgctctcganggggggggggnccnggtaaccccaattcng

SEQ ID NO: 327 - DNA, 809 bp, Triticum aestivum
  Clone ID: PAT_TA_327
gccggccggccgggggtgatagggacggtattggggaacttcaaagtcctcatcataatcgcaatgtcggcactcgcttttgcagtacttcttgctagcatcgggggcacgtctggcaagacagttaggtctccgactcctccgatgggatggaattcctacaaccactacaactgcaatccttcggaggagattatcaagatcaatgccaaaggattggtagatctggggtttctagatttgggctaccgtattgtcactgtcgactgtgggtggccttcgagagaccgggacagcgagggaagactccagtggaatgagactttgttcccttctggcccaaaggctcttggcgactacatccacgacttgggattggagtttgggctttattctggagcgggatatcttcaatgtggatcccaggatatccctgcgtcccttggatatgaggaaattgacgcaaagtcatttgctgagtggggaggcgataccctcaaatacgacaactgctatgccacgtccaagactgatatggttgactcggactctgccgaagcaaagagcccagaccgttttatcaagatggctgcagctatcaacgagactgatcgtgacatcaagtacttcctatgccagtggggtattggtgaagacgtcccgcaatgggccaccaaggttggcaattcgtggagaatgagcaacgacatcttcaatgcatggagagcaatctggcgcatcaccaatcaggctgttgctcactccaaagtacatcacctggcgcgttcgcagacctgatatgctcatta

SEQ ID NO: 328 - DNA, 1450 bp, Triticum aestivum
  unsure (1)..(1450): unsure at all n locations
  Clone ID: PAT_TA_328
gccggccgttccgggatctagctatccgaatctcaaaggctccctcttgcaccctttctcttcttctcatcgatcgcttctttgagcatcctcacctttcacaaatcaggccaaccaacatgtcctactttccaggtcaagggtataacggaggcggaggcggcggtaatggctatgggtacggtcctccatctggccctcctcctccccagcaacaatacggtggttactctggggacaactccggatcgcgaagataccctcccccgaattaccctccacctcctcatctcgatgcctacggatttcctctcccgcagggcctgaaccatcacgcccaacacgctcgatcaggacctcctcccccctctgtgccccagcagttcggtcatggagcccccgaaggctatactttccagtactccagatgtactggtcgtcgcaaggcacttctcatcggcatcaactactttaaccaagaaggcgagctgcgaggatgtatcaacgacgtacacaatgtttcggctttcttggtagagcgctatggctacaagagagaggacatgattctgttgaccgatgatcaacaagatccagtcatgattcctaccagagagaacatcattcgggctatgggttggcttgtgtcgaacgctcagcccgatgatgctctcttccttcactattccggccacggtggtcaggtcgaggacctagacggcgacgaggatgatggatatgatgaatgcatttaccctgtcgatcactcccaggctggtcccatcattgacgacgagatccatttccgtgtcgtcaagcccttggcccaaggtgttcgtctcactgccatctttgactcgtgtcattctgccaccgtcatggatcttccatacgtctactcaaccaagggtgttctcaaggaacccaaccttgccaaggaagccgcattgggtctctttgacgccttccaagcgtactccagtggagacgtttctggagcggctaagtcgatgttcagcatggccaagaatgcctttaacggcggcgatgaggcttatgaaaagaccaaggatactcgaacatcgcctgccgatgttgtgatgtggtctggaagcaaagacgatcagacatcggccgacgccacgattaacgctcaggccaccggtgccatgtcgtgggctttcatttcagcaatcaaggccaatcctaagcagagctacgttgagttgctgaacagtgtccgtgatattctcgagacaaagtatactcagaagccacagctttcaagcagtcaccctattgacactgaccctcttgtttgttatgtaacgcggtggagctgaagacacgtcggggccttttgcatgaagcatggggaagattgngtcagcgcacctgcatttttatgactagctctatgaacccgatggacgatacnatacccgtactg

SEQ ID NO: 329 - DNA, 1050 bp, Triticum aestivum
  Clone ID: PAT_TA_329
gccggccggttcgggaacaacgcttccgtcatcttcctcgaccagcctgtcaacgttggctactcgtacagtggtggttctgtcagcaacactgtcgctgccggcaaggatatttatgcccttctcaccctcttcttccaccagttccctgagtacgccaagcaggacttccacattgctggagagtcttacgctggtcactatatccccgtctttgccaacgagatcctctctcacgatgaccgcaacatcaacctcaagagtgttctcattggtaacggtcttactgatggctacacccagtacgcctactaccgccccatggcctgcggtgatggtggttacccctccgtgctgagcgagagcgagtgccagtccatggacaatgcccttcctcgatgccagtctttgatcaagggctgctacgagtctggcagtgcctggtcttgcgttcctgccagcatttactgcaacaacgccatgatgggtccttaccagcgcactggccagaacgtttacgacattcgaggcaagtgtgaggatggcaacaacctctgctactctggcctcggctacatcgccgattacctgaaccgcgaagaagtcaaggaggccctcggtgccgaggtcagcagctacgacagctgcaacatggacatcaaccgaaacttcctcttcgctggtgactggatgcagccttaccaccagctcgtccccaacgttttggacaagatccccgttcttatctacgctggcgatgctgacttcatctgcaactggctcggaaaccaggcctggaccgataagcttcagtggtctggccagaaggacttcagccacgccgacctcaagccccttaagcacgccggcaaggagtacggtaaggtcaagtccagcggcaactttacctttatgcagatctacggtgctggccacatggttcccatggatcagcctgaggcttcttctgacttcttcaccgctggctcagtggtgagtggttctaagctggatcaccctctgtttcttaatgtgtgactgtacactaca

SEQ ID NO: 330 - DNA, 962 bp, Triticum aestivum
  Clone ID: PAT_TA_330
gtacagctagtttctaaagagcagtacagcccggagagaatacttcatctccggtgaaacctccctctcgccttggcgcctcaaatcatatctatatctacctgcttgcttgcatcttaccagaagcaaagctctggcctggtaaacaaactgcaagagaggagagcttcttggggacaggcagagggagtacctttctttgggaggggaatttttccttgccttgtttcttcttcttcttcttctggtccgaggtggaaaaccaaaacagagattggagatagacacagaaacacttgcagctagcattttccaagagatggacagagaggagatgaagatggttatcttggggcaagaacaaacattcagacaacaggttcatgagatgcaccgagtttaccatgttcagaaacaactgatgagggagatgcagatagctgggctgaaccgggctcatgctgagacgaaacataaacttgaggtctggcgcgacgacaaggctaccgaccgtcagcaactctacagcttctcaaacagctgcatccctgcctctgctgcagaagaatgcgaccttgagctcactctggcaaccgggagcagcagaagccacaagggcaagcaagtcggcaagtcctcaaactcagactccgggatggcggtgtcgtcaacatcgaccgaatctgatctggctcagttcaaggagtttgacacaagggtggtgaggcttcagatcgagagcaagaggtttaccattgccgatgagacgaatcggtctccttggccgcaccagcctgtgatccttagggtggcacggtgaccgacttagctaggatttggtgttgtagatttcagagaaagaagagatgttgtcacttcacagagctaatttggttcaacaatttgcaatagacaagaggtctccatctttcggaggcatatgtaacatctaaaaaaaaaaa

SEQ ID NO: 331 - DNA, 454 bp, Triticum aestivum
  Clone ID: PAT_TA_331
gccggccggtccgggaaactggccgcttgcacaagtctgtggcactcttcatctcctgccatggcacgttccttggcaatcctcgttatcatattcatatgctgctccctgccgccatgctcaacggccacacaagttcatctggatggaagccgtccgagctctggtcctccgtcgccgcagcctgcgggtacgcacggctgcgttggtagatgccataacgggcgcccagacgcccttacaccgcaccgcaagaccctgcagcaggctattctaaattgatgtgtgtatatatgacaaatgcaagtgctccgccagagtcttggaaagtttatcattgactattacgtacacctattgtcaagggagtgtgagccataaaaaaaaaaaaaaaaaaggcccctaaaataattaggaagatggtgtatgacaatcaacaaatatcaggatggct

SEQ ID NO: 332 - DNA, 667 bp, Triticum aestivum
  unsure (1)..(667): unsure at all n locations
  Clone ID: PAT_TA_332
tccagcggcctcgcgctctgcagctccccccctcccgcgttccgtgccaatccttgttatcattttcatatgttgctccttgccatgctcaaacggccaactcaaagttccatctggatcgggccccgtccacaagtctgtggcgcagcttatacaccgttgagtagaggacgatggaacgctcttcatctcctgccatggcacgttccttggcaatcctggttatcatattcatatgctgctccctgccatgctcaaacggccacacaagttcatctggatggaagccgtccgagttttggtcctccgccgccgcagcctgcgggtacgcacggctgtgttggtagctgccgtaacgggcgcccatgacaccgcatctccggcgacggcaagcccttacaccgcaccgcaagaccctgcagcaggctattctaagattgatatgtgtatatatgacacatgcaaagtgttccgcgagaagtcttggaaagtttaccattgactattgcgtacactttttgtcaagggtgtctggaaatgattacgaagatggtgtatgacaataaataaatatgaggatggttgtactgtttttataaatacttaattgtgaactctaattaaccaaagaaaaaggcggcaccgcgccaatngccnaaatgatcct

SEQ ID NO: 333 - DNA, 337 bp, Triticum aestivum
  Clone ID: PAT_TA_333
tgttcggcaaaaaggataattacccctttatttaaatagcaaaacataggccggtcttatcacaacgctgacaagaacataggcatcttattttctctttttttttgaaaaggagtatgcccggcctctacatgaagcgatgcacacaaccgttcttatttgcctttagtaggacacgatatgatacatgtaccattcatcaagtctcaatggcaacaccaggtaccacggtgttcatcaccccaggcttgttgctacctcccacagcgaccgtgtcctgctcgtaggctgagagatggactccaagcgctgctctcccagaggggtccaggttccc

SEQ ID NO: 334 - DNA, 1218 bp, Triticum aestivum
  Clone ID: PAT_TA_334
aaaataataaccatcatgtaaaaatgttttgagggaagttgccaaaaagggattagaaatcatccggtctccgatttcataagaacaatagaaacattaatgcacaatcttcactcaaaccttaggtctgcaccactctaatggcaagaccaggtacatcttatttcttatcagaaacggcaagcaggacaggacaccatcaactctcaattgcgacaccaggcgccgcaacctcgatcatcctcggcttcttgctggttcctgccatgatggttgctgggagatgctcctgttcataggccgagagatggactccaagtgctgctctccctgagggatccaggttccctgaccactgggcatcccactctaccgccttcgccgtgctgcatgcaacgcttggcccacctggcaccgtcaggatcgccgagttctgggggaagaacctctcaaatatcatcctgtaacagtaggcctcttttgtagtcggggtgttgtgtgggtagatgaactttgcatttgacatcatcttatctgtcagatacctatcagggaatgtattagttcaacataaagttaaaataaaaaaatcatttacattcgattctgcgtgagcctttaggccatcaatccagctatacccaacaccatcactaaactgctccttctgcctgtacagaatatgctacatgtataaaaaaagaacatgttaataactccactactccagctggatctgactgaagtgtataaaaatgttattcggcaggaagggtcgctcctcatcatcgaacgctttcctcagtatccatttctcaattcttccaagatcaggccggatctgtgtgattaaaagttagaaaacaacgcagtccattctttccaacttcccattcgtttgaaatgttttttcgacgtgtattcttttgaaatgttttgggctttccccgtgaaatatatattttgtgcttaccatcttccattcgggatctatgctcatagcctcattgatgaactccttgtccaagaatggcacacgaacctcaaggccccatgcagatgttgctttgttggccctcaagcaatcgtactgatggagagcttttatctgcagaacaattcatgtcagagcacagtgctattatggataagtcctattctttctgttcctctgcaatgtttgcattttaaataccttccgacatgtttcctggtgga

SEQ ID NO: 335 - DNA, 2030 bp, Triticum aestivum
  Clone ID: PAT_TA_335
gctatgttcccccgctgtttttttgggaattcactatgtgattagcgtggtcgcggccgaggttttttggattagaaatcatccggtctccgatttcataagaacaatagatacattaatgcacaatcttcactcaaaccttaggtctgcatcaatctgatggccaggggcacggaaaagtttactatttatgccgtcgatttcgctgtcagtcctaccagatagggcgcataagcatcatggctctaaatgcaagctttttccataatttgtccctaactccgtgatccgggaaaccatcacttccatccgaacttggccagccgtcgtttttatgttcgcttaagcgacgatggtgctggcagtagcggactcgtacttccaggtggggggaaggacaccgacggtcttgtagtaacgggccagacggtgaattcgggactcaatgagaatgagacggaacttggagtccttgtccttgcggttgcgctcaaggtgctttcggacggcaacagccttcttgataagcatgtacagatcctcggggagctcgggggcgaggccgctggacttgagaattcggagaattcggttaccagtgacgtgcttgacctgggcaataccgtgagagtcacggagaatgacaccgatctgagaaggggtggcacccttacgggcgagcttggagatctgctcgacaacctgctcgggggtggtcttcaaccacgcaggggaagatcgagagtaggggagagcggaggcagaaatgccctttcccttgctgtgaagacggcccatcttgtcggtttggcgtggtgatactggataaggatcggttacggagttgcgcgcgtctcacggtggagctcctctttgttgggtgccttgtggaagtagaggtaccctccgaaaatctcatcggaaccctcaccagagatgaccatcttgaccccaagtgacttgatcttgcgtgacatcaggaacattggcgtgcttgccctgattgtcgtcacatcatatgtttcggtgtgataaatcacatcctcaattgcatcaatgccgtcctgaacagtgaaggtgaactcatggtgcatggtgcccaggtaattggctacctcctttgcagccttcagatcaggtgacccctcaagtccgacacaaaaagagtgaagcttagtcccccagcgctttgcagcctttgttcctgccaggtgacgaactgtaacggctgcaaccaatgatgagtcaaggccaccagagagtagaacaccgaatggaacgtccgtcataagcctcttgacgacagccttttcgaaagccttcctgagagcaagtgggtcatatggcactgaaggaatgacctcggagaaccaaggtgggttgtaccatctcttgaagcctccctgcttgctggagtagagatggccaggaggaaagatctcaaagtgctcacaatcatcattcaggcccttcatctctgatgatatccacaccgacccatcaattccccagccaatatagaggggtgtgacgccaatggcatcacgtgcagcaatgaagctgttgtcgcgtgtatcgagcaagacgaaggagaagacaccatccagcatgtcgatgaagttctccccatgctcctcgtacaggtgtgcgatgacctcgcagtcgctgcctgtcctgaacgtgtgggaggagagctgcgcccggagctgttcatggttgtagatctctccattcactgtgacgacgatggacttgtcctcgttgtagagcggctggtcgccagaggcagggtcgatgatggcgaggcgctggtgggagaggtagcagtcgccaacctggtgcatgccgctccagtcggggccgcggtgcttgagcctgcgcgagagctcgagcacgcgcactctcttcccctgggtgtcatcagcgcagcccagcaccgccagtatgccgcacattttcctggatcgacggcaacagtatgtagctagaagatctctctctgtgcttctgaaggaggatgggcctcgtgc

SEQ ID NO: 336 - DNA, 679 bp, Triticum aestivum
  Clone ID: PAT_TA_336
gccggccggtctcgatcagcaaaatggctggcagcgaaacgactgctctccaggtccccgtggcgttcaaggacgccgacgacggcaccatcccagtgcgcccacctaccgagtatgccgccgccgtggcgtccctgccgttgaaccctgccagcaagctcaagttgcgctgctatcagggcgtgtgggtgctggaggactgggtaccaggcatcatatccatgcagcgcagcttctcaacgcgccccggcgacgtggttcttgcgagctttcccaagtgcggcaccacttggctcaaggctctgatattcgccacgatggcccgtgctgcgtaccccccagccagccccgcccacccgctccgccgcctaaacccgcacgactgtgtgattctagtggacaggctcttcgccgtcggccgtgaggcagtgctggacaagctgccctcgccgaggctcatgtgcacgcacatgcctctctcggtgctgccgccgtctatctctcgtggccccgactgcaaaatcgtctacatatgcagggatcagaaggacatggttgtctccatgtggcatttcgccaaccgtgttcgacctgacatatcactccaagaggtgttcgagacggtgtgtgagggcacatgtttttgccgggcctgtctgggatcacatccttggatact

SEQ ID NO: 337 - DNA, 1983 bp, Triticum aestivum
  unsure (1)..(1983): unsure at all n locations
  Clone ID: PAT_TA_337
ngggccggnattaaagcatctccggcgaggccccagcacccacctccagctcctcctcctcctccccccgcctccggcgatccaggtaacctcgcccaacacacccgcgcggtcgattcccgctctatctcggcgagcggtgctcataccgccgtgattcgctgccgcagagatggagcgcgggcggggcgggagggacggccccttcggcggattcggccgcctggggggcgccccgatgcccggcctcttcggcgggggcagggaccccttcgacgaccccttcttcacgcagcccttcggggccaggatgggcggccctggaggaatgttcgggccgatgggcggcggccccggcatgttcggcgccttcgggcccggggacgggttccttgagcaagctcccgcgaggagcggtgctgtcatcacggagattgatgaggacgaagaggggggcgacggggagcgcggcggccgggaggcgaaccgcggggcatatgttcaggagccggatgatgggaatgatcccacgcgtccggggatgcaaggggggcaggtccagatgaggcgagatcccagcagggcgaacgggggcggccagccgcggtcgcgttcgttcacctaccagagctccacggtgacttatggtgggattaatggagcctactacacagcttccaagacccggaggagcggcagcgatgggatcactgtcgaagaaagcaaggaggcagatactacgactaaagaggccactcacaggatctccaggggaattcatgataagggacactcagtaacaaggaagctgaaatcagatgggaaggtggacagtacacagatactgcacaatctcaatgaagatgagttacctggatttgaagaatcatggaagggcagtgctggacaacacttaccaggctggaaccagaatgccggtatatctaatggtgacaactctggtaaccgtggtgccaacggtaccaggcagcctgcacagaactgggcgctccccggaatgcagcaacagcgcgatccaaggaggcacgacaacgggcagccaaagccgaagtcatcgcggatcatcccaatctcctgaagggtgaagagaggcctgaggaggcgcgatgggcgggtcaaaatcacatctcgtgcagagggaatggccgaatccacggagcagatgaataaagcgctgctggtttgtgcaagcagttcagctcccggtgtacgttcctctcctctagctagatacgagtaggaagctaaactgaacgtgatggaggcgtggttgttgggatgcgatctgctatgtgctaccgctgcgtcgcgccctgtaccgtgaatacattctcaggattgagtccattctctaactaagatgtcttactttgaagagaaagtatcatccctagtcaatgcagggcagcacttaccaggctggaaccaaaatgctggtatatctaatggtgacaaccctggtaaccttggtgccaacggagccaggcagcctgcacagaactgggcgctccccggaatgcagcaacagcgcgatccaagaatgcagcaacagcgcgatccaaggaggcacgacaacgggcagccaaagccaaagtcatcgcggatcatcccaatctcctgaagggtgtagagaggcccgaggaggtgtgatgggcgggtccaaatcacgattcatcccgcgatctcgtgcagagggaatggccgaatccacggagcagatgaataaaccgctgcttgtttgcgcaagcagttcagctcctggtgtacgttcctctagctagatacgagtagaaagctaaactgaaagtgatgaggccntggaggtccggatgcgatctgctatgtgctaccgcccgcgtcgcgccctgtaccgttaatacattctgtgatttgagtctattgtgttactgtctgatctgcctgtaaagatacgctattaactctaaaaaaaaaaaaaaaaaa

SEQ ID NO: 338 - DNA, 1124 bp, Triticum aestivum
  unsure (1)..(1124): unsure at all n locations
  Clone ID: PAT_TA_338
nnngtgntnnnnngnattctcnnatgnaancttcttagctcgaanttaaccctcactaaagggaacaaaagctggagctccaccgcggtggcggccgctctagaactagtgggatcccccgggctgcaggaattcggcacgagctagtctcgagttttttttttttttttttggaggccaaaacagacatctcacatcaagtgaggcaagtcggaatctgaatgaacatatattctggcgatgcgatttctccacaaaagaaaggtcaagctcttgatttacaccgctatgtgaaaccacagtaaccgaaagaagaaaactgctgattatacaggataagaattgtacagcctacagaacagcaaattgcatggagataaaaattccacacgaagctacctagtgacatggcttcctttccctatccctagctctttggcgaggtcccgcgtgagggtgatggcatgcgtgttatgccatgggaaaagggtgcgggtaaccggaagtttcctccgaagatccttgaacgttgcgtcggagagattcaagtatgattcctcgagagatgaaaaatactcggactcgtgatgccgaatgatgttagcgactgtgtgtgcagtgtcttcaggcgactgcattattgtggagtccttgcaatcaacgtcagtatccagctgcacatttccctcttcaaaataatgagcatctacctggatctttcctttaatttctacaagttgaaacgcataactgaattccaaagtccaaatggaacgccagctgccattgcaaaagttccgtgggcttcgtctagcagcagaaataactactgccaaaccaaaatcagctcctggttcctctagatcctttccattggtacaataaacggcagaaacaccttttggataagcttcaccaacatatttggacacttcataatctatagcactcctaaattcttcaatatatcctgacggaagctcctcatctgtagcaggcctcaattttgtacaagtctgcttaacatggtccacggtagcaatttgtgcggtcctagggtccagatagttgttcctgtcaatctccccataagttgtgatgattatatcgccgctgcggtctgg

SEQ ID NO: 339 - DNA, 1716 bp, Triticum aestivum
  unsure (1)..(1716): unsure at all n locations
  Clone ID: PAT_TA_339
ccaagcctcgcgctatctcgtgctcctaccagcgacaccacacctccgattcacgtcgtgcctttgaccggcgcgggagagcgaggaccggggatggccggcggcgttttcctcctcaacggcgccgacgcgccggactacggcggcgcgctgaccgtccccgtcgtggtgacctgtctcatggcggcctccggcggccttatcttcggctacgacattggcatctcagggggcgtctcggagatggagtctttcctgaagaagttcttcccgggcttactcaagacgacgaggcacgcgagcaaggacgtctactgcatgtacaacgaccaggcgctcacggccttcacctcctcgctctacgccttcggcatggtgggcacgctggtggcgagccgggtcacccggcgggtcgggcgcaaggccatcatggtcatcggggggagcatgttcctcgtcggctcgctcgtcaacgccgccgcggccaacctcgccatgctcatcgtcgggcggatgatgctcggccttggcctcgggttctccggccaggccacgccggtctacctcgccgagatgtcgcccccgcggtggcgcggcgggttcatctccgcgttccctctgttcatcagcgtcggctacctcgtcgccaacctgatcaactacggcacgtcgcggatccccgaatggggctggcgcctgtccctcggcctcgcggccgtccccgccgccgtcatggtgctgggcgccgtgctcatcacggacaccccgagcagcctcgtcctgcgcgggaagcacgaccacgcccgcgccgcgctccagcgcgtccgcggcaagggcgtggacgtcgacgcggagttcagcgacatactggccgccgtggagcacgaccggcggaaccaggagggcgcgttccggcggatcctgcggcgggagtaccggccgtacctggtgatggccgtggcgttccccgtgttcctgaacctcaccggcgtgaccgtgtcggccttcttctcgccgatactcttccggaccatagggttcggtagcgacgccgcgctgatgggcgccatcatcctcggcctgatgaacatcggcggcatcatcgcctcgggggtcgccatggaccgctacggccggaagctgctcttcgcgatctgcggcgcgctcatgttcacctgccaggtggcaatggcgagcattgcggggacgcacctggggcacggcagcaagatgcccaaggggtacgcggtggccgtgctggtgctcacgtgcgtcttctccgccagcttcagctggtcgtggggcgcgctgtactggaccatccccggcgagatatacccggtggaggtgcggtcggcggggcagggcacggcggtggcgctcaacctgggccttaacttcgtgcaggcgcagtgcttcctggcgatgctctgcagcctcaagtacggcgtcttcctcttctacgcgttctggctcgtcgtcatgaccgccttcgccatggcgttggtgccggagaccaagggcgtgccgctcgactccatggggccactcttccgcgcgccactgggtactggggcaggttcgtcaaggacacaattcgngaatgatcaactgactgcgtcgcntgctccttggcatatggatgggttcccattgtgtgatggatgtanaanccaaattanatgctntagaacaaaaggcgcgcttngctgcacc

SEQ ID NO: 340 - DNA, 711 bp, Triticum aestivum
  Clone ID: PAT_TA_340
ggccgcttcgaaggccggccggtttcccggaagggaaaaaaaaatgccaaacacattcacatcatctttctcaaccttcaaacacatccctcaaacccaacaacaacaacgccaaaatgtccattgtccagatcgataccaaggctcagtttgatgatcttatcaagagccaccaactagtcatcctcgatgcctctgcagaatggtgtggtccctgcaaagccatggccccaattttcgaaaagctcagccacgaaaaccccgacagtgaaaaggtcgtatttgccaagttcgacacggatgatgtttctgatcttgctcaagagctcgggattcgctcaattccagctttcttcattttccgcgacggcgagcgggttgacaacttgaacggagctaatcctcctgcgctgacgaagcttgtcaaaggggcaattgaggatgttacggcataagacttgatataagttggtttactatactatatcgattagtcaagcaggctagttgagtgctgttacaacaatttggatgatgggacactgcaaagtgaaagcagcgatggaaaagcaggagatcccacaggcgcatcagcacatgttttatgtcaaagaaatggaccatcattcaagtctcccgacatttatactacacgtaacaatagtaatcagtcagttccatatctcccacaagcaactacaggccttgacc

SEQ ID NO: 341 - DNA, 480 bp, Triticum aestivum
  Clone ID: PAT_TA_341
aaaaacaatgaaaaaaaagcaggcgactcgcacgcacgagcgagagtgccctcgagcgaggcctccagatttcgccgccgctctcgcacttgccgtcgccgatgcctgcgctacctcgacggaagccatcgcaaatccatcccttcgccgccgccctcgcgctcgcatcaaggatcgaggactccagagtgccctaaatccctgcgctacctccgttcgtcgccgccgatctcgtcgctacgtcgctcgccacgggcagggatcggcgtctcgccggcgtggagcgtggcaggggagagaagggtgggtaagatcggcggggcagagttcatccggaaggacggcgcggtggacgacatgtacggatacctcaactacctgtcccttgagtatgactcgtctcggacaccaatcctgcttggctgatctgctatgtctaatatgagtttctgcacggcaatttcaaagttacatgtacca

SEQ ID NO: 342 - DNA, 739 bp, Triticum aestivum
  Clone ID: PAT_TA_342
gccggccggtccgggaagcctccacccattgctccctcaccgcaaaaaaacagctaatctcgctcaattgatttcacagagcttgacccagcttataccgtatgggggtctctggctgcagcaacaacaacggcaagacgctggtgctcctggcctgcttcctcctcctgctggcgttttccccgtttctgcatggagtcgggtgcttcgccgccgcggaagcgacgagtccggaggaagccgccgagcagacgctgatggttgggagcacgccggcgctggagacggcggcgccgcagcagcatcggcatggccagggttcgggcgcgtctgccatctcgagcaatgctgccggtggtctctggtcggccgagctcaagccgaccgtggctcgcaggttgccgccggaaggagctgtggatggagccggccattcgtgcggctccagcggtcgccagggctgcaccccgtccccgtaagatatatccatggcactctgcactctgccgatactactactgtattcctaccttagttcgtcgtggctaaacacaagtgctgctcctactatatatgttggttccttaactagctagctagggtttggttgttgtttgccaagtacgtagccatcattcagcaaaaaaatggatgcctacatgtactttgtatgaattgtaaagtgtttaaacagttgtatatatcttgtaagtaaaaaaaaaaaaaaaaaaggccccta

SEQ ID NO: 343 - DNA, 715 bp, Triticum aestivum
  unsure (1)..(715): unsure at all n locations
  Clone ID: PAT_TA_343
ggcggtttgtggtaaagtagtgtgtggagcaatccggagtgattccaaggttcttgtgatgccttcgggagagctagctacagtgaaaatcatcgagcgggactcctctcgtctcagctcggcaagagctggcgacaacattgcgattgggctgcaagggatcgaccctatccacgtgatgtcgggtggagtcctgtgccacccagattaccccgtgtcggtggcgtcttccctggagctgaagatcctggtgctagacatcacagtacctatactgccgggccttcagtttgagctccacgtgcaccatgcgaaggtgtcggcgtccctggtgaggattgtgtcgctgctggaccagaagactggcaaggcctcggcgaggaagccgcggatgctgaccgcaaggcaggccgccgtcgtcgaggtgaggctggagagggaggtgtgcgtggaggagtttggaacactcaaggccctcggccgcgcgttcctgcggtcgcaggggagcaccgtggcggtcggcgtcgtgacccgcgtcgtgcaggtacagggggagcgagcagagcaggcttcttagggcgcgttggttaggtccatcctgtaggagcagagttgtatagacagacacacgcatactcgtcgtcaggggtgcgtgagcctgaatttttggcggagcagaccagttactggtngaggatcggtcgaactcgaagca

SEQ ID NO: 344 - DNA, 722 bp, Triticum aestivum
  Clone ID: PAT_TA_344
atttaatgaacacatctcagcttgaggatcaacacagcacccggcttatacctcctctgctggctctcgttgccttcctttaagttccaactgcaattgctgccatgagactcagcctcctcatcattgccgcgatggccgtcctaaggaccgcgtcggcagcagtctacaatgttggcgaaccgggcggcgcgtgggaccttaccaccaactacggcacctgggtatcctccaggaagttccaactcagcgaccagatcgtcttcaagtactcccctcaggcgcacgacgtccttgaagttagcaaggccgactacgactcttgcagcatcgtcaaccctattgcgaccctcaactccgggaacgacatcgtcaccctcaccgccgctggcacccgctacttcatttgtgggttccctggccactggactagtggcatgaagatcaagatcgacgtcgtgcctagctccttctcaccatcacccgccccggctagtggccccaatgcaagcaacgctcctccaaccacacctgtctctaccgccacctccgtgaaggccacggggtttggcttcgccatcctgcttgcctttatcggtttcatggcttgagtacatctgtatagccccacacacatacctaatttatgtaaagtcaaataatcattcctagtaaatatatgtgtgtatattccaccaaaaaaaaaaaaaaaaaggccccta

SEQ ID NO: 345 - DNA, 890 bp, Triticum aestivum
  unsure (1)..(890): unsure at all n locations
  Clone ID: PAT_TA_345
gcggcgctcgaggcggccgtccgagaaagctataagagaaagaacatagagaaacacacagcgtcaccggcgaactcaaagcgatggacaccgctcccgctcccgcgaagccgtccttgtccaagaagccctcgccgtcgttccgcctccgcaacggcagcctcaatgccctgcgcctgcgccgcgtgttcgacctcttcgaccgcaacggcgacggcgagatcaccctcgacgagatggcggccgcgctcgacacgctcggcctcggcgccgaccgcgccagcctggaggccaccgtcggcgcctacatcccgcctggcgccgccggcctcggcttcgaggacttcgagggcctccaccgcgctctcggcgacgcgctcttcggccccatcgtcgaggaggagcccggcaagaagggcgaggccgaggacgaggacatgaaggaggcgttccgggtcttcgacgagaacggcgacgggttcatctccgcggccgagctgcaggccgtgttcaagaagctgggcctggcggaggcgcggaacctggcggcggtgcaggagatgatctgcaacgtcgaccgcgaccgcgacggccaggtcgacttcggcgagttcaagtgcatgatgcaggggatcaccgtgtggggagcttgacgtccctctcctgtttctcatattccaagcactggaggattggagcgaggaacaaccacaagatccgtagatcgcttcagaccttaaaagtgaacgtcagttctttagggttgtgtaattgtgttggttttttcagtgctgggggatggggtgttggtggttagctcctcaggctgcagctcccggcttgcaattctagcttattctaatgtgntgtaagttttatccttcgttcat

SEQ ID NO: 346 - DNA, 1371 bp, Triticum aestivum
  unsure (1)..(1371): unsure at all n locations
  Clone ID: PAT_TA_346
gagcccggccgggacggcgctcaaagcctgcaaaccagaaagaacggacaccgctcccccgcccccaccgcgcgccctctacgcgatggcctccgctcccgcccgcgcccaccacgccgggcccaacgcccccccgccgccccgcggcctcgacgacgacgacctcaaacgccgccgccggcgaactcagaccgatggacaccgcccccgccccccccccggttaagccgtcctcggccaggaagccctcgccgtcgttccccctccgcaccggcaccttcaacgcccggcgcctgcgccgcgtgtccgacctcttcgaccgcaacggcgccggcgagatcaccctcgacgagatggcggccgcgctcgacacgctcggcctcggcgccgaccgcgccagcctggaggccaccgtcggcgcctacatcccggccggcgccgccgggctcggcttcgaggacttcgagggcctccaccgcgctctcggcgacgcgctcttcggccccatcatcgaggaggagcccggcaaggagggcgaggccgaggacgaggacatgaaggaggcgttccgggtcttcgacgagaacggcgacgggttcatctcggcggccgaggtgcaggccgtgctcaagaagctgggcctggcggaggcgcggaacctggcggcggtgcaggagatgatctgcaacgtcgaccgcgaccgcgacggccaggtcgacttcggcgagttcaagtgcatgatgcaggggatcaccgtgtggggagcttgacggcgtcttcccttggtcccatctcctgtttctcatgttctaagcatgggaggatcggaacgtggaacagccacaagatccgtagatcgcttcagagttcagaccttaaaaatgaaagtcagtctttagggttgtgtaattgtgttggtttttcagtgctaggaagttggtgtgttccttagaagctcagaatgcagctcctggcttgcaattctagcgtgtcctaatctgttctactaagttttatccttcgttcgtgttaccatgtaggtactgtgcgtctgatgtatgtgccttatagtccgataatctcttaatctcttgtcaagactgtagaatgtatttgacttccctaatatattggatatttgttaattcctgtaaaaaaaaaaaagagtatgtatcattcctagacattttagtttaanggtgtgttttttttcatgatcgagctttccaccgttgactcgatctggcggtaggtcttcaggattttgcttgacaacatggtccatcacagcaagcagtaattagntccttcatttattttacaagtcttggtaattcggaactgtactatcagggacctttgacagcctcc

SEQ ID NO: 347 - DNA, 784 bp, Triticum aestivum
  unsure (1)..(784): unsure at all n locations
  Clone ID: PAT_TA_347
ccgggcgcatctccgggngaaaactttgctcctgtcttctcggnaccggcgacggcggcgcccgcgggtgccatgatctttcttgaagcggcgtcgttgagttgtgctcctcctccccagggtttggctccagnaggnaaacctcagatccgctatcgggcgatggaggcgacttcgcgtcttcctcctccttgggggtatcgttttgaagccggctacgactgggagactggtggattgcggcatcttcgccgtggatggcggcatcttcgccgcgtgggccgcgtggtttggtgaggcggggcgctggtttttgtttggcaacgatgatggcgtcgagtggagctcgggtcgcggcgtggacttcggtagtcggttcttcccggcgtgtccgaggtgctctcccgtgggttgcttggttgctttgaagtcggagctgcggtggagcgggtccaggtggtgacgatgacaggcgcccggtggtcgtttgcggtgtgcacggtcggcgcaagtccagcatatttcccttgtgaggctcgttgtcaaagtcggagctgtcggttgcttgtgcgtgtggtcatccggtggcatgtgccgtcgtggtttgtccatgtcagtggccaggttggccggtggtgcccatgtcatgtgggttgagttgtatcgattttagcccggttttccgtcaattaaccaggcaatgctcttcttcttaatcaatgaaaatggcaaatcttttgcctcgtttcaaaaaaaaaaaaaaaaaggcgccgttaaggaccaa

SEQ ID NO: 348 - DNA, 1331 bp, Triticum aestivum
  unsure (1)..(1331): unsure at all n locations
  Clone ID: PAT_TA_348
ctggcgtggnagcggtggtcctgctgcggcttggtgacctgtagtggttcggcggcttggcggtggcagcggggctcgggcgactcgatggggcggcggcccccgatctgacggagtggatccggatggtggaggtgctctcgcggctcttggcagcatggatccggcggttggggctgcggctggaggttcctggctcttcggcggcgccgcccctgctgctattgtggttgtggcagatgtgctcgggtttcggcctggcaactctgctcggtgagatggggtgngggtggcggccccccctccctgcctggtgctgcggtgctggccggcttgctagcccagcatggctggcggcgtggtggaggctgccggggcggcggccccggatttggtggaagcagcttcggctggggggtggtgcgcgcgtctgggcgtggtgggtcatgggatcccacgaccagtgcgaggttggccttggcaggatggggtttgttggttgcgttgatgtgggcaggtggtggttgagcatcttcgggagaaatcctgtgtccggcctttgccggatcgggcgacggcgatgtccgtgggcgtcgtgctctttcttggaagcgttgctgttgtgtggtgctcctcctccctccccgcggccttggcttcggagggaaacctcagatcttcaggatcgggcgatgaaggcgccttcacgtcttcttcctctttgggggcatcgtctcggagccggccacaacctggagaccagtggatggcggcatcttcgccgtgtgggttgcggcatcttcgccgcgtggtttgcggcatcttcgccgcgtagtttgctgaggcggccatttcgggggcgtggatttctgtttggcaacgatgatggcttcgagaggagctttggtcgcggctcgggcttcggtagtcggatcttcccgacgtgtccgaggtgctcttccgctggttgcttggttgctttgaagtcggagctgcggtggagtgtgtccaggcggtgacgatgacaggcgctcggtggtcggtttcggagggcacgggcggcgcaagtcctgcatatttcccttgtgatgatcatcgtcaaagtcggagttgtcggttgttcacgcgtgtggccttctgttggcatgtgccatcatggttttctgtgcagctgtttgtagctctatgatcccatgtcggtggccaggttggccgatggtgcccatgttatgtgggttgagttgtatcggttttagcccggctttcagtcaattaaccgggcaattctttttttcttaatcaatgaaaatggcaaatttttgccttgtttc

SEQ ID NO: 349 - DNA, 1177 bp, Triticum aestivum
  Clone ID: PAT_TA_349
ggtttgtttaacttatatatgacgagccactaatccactattattacaattggtaattaagttagagatcctcttccagtagcctcgtgtgtattagaactgacttattctgaactaaatacaattatttcatggtcctatatataagcaacaagaaacaacaaaacgtctagaaaacgctaactatagaagaagaaaaaggaaacccaattggccgtacgtctagatgcatggctctgggtgctggtagccaacataggtggcattggcgttctcgcagtgtgacaaggtgcctgcctgtccgttgtagctgaggtcgacgttctgcagcacgacgtcgcggcacggcacgccgcaccggagcagcacggccacgggcaacgtcgatgttcccttgatgttcttgaacttgatgtcctcgattgtgaccccggagacgtacctgtgctcgcagttgtagtaagggcagtacttctggtcgatgatgatgggggtctgcacgtccttcatcaccatgttctcgaacagcatgcgcgcggcgaagctcttggtaggggagttctcccatgtcttgatgcggacgccgttcatggtgccctggaaggtcatgtcggtgacgtggatgctagtgacgtcgccctcgccgacgtagcggccgaggctaccaacgctcatgccgtggcccgggccgcagtggacacgggcgatgtatatattgtggttcccctggccgatggagatgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcaggcttaatctttgagacaagcatatactacggccctcgt

SEQ ID NO: 350 - DNA, 748 bp, Triticum aestivum
  Clone ID: PAT_TA_350
actcacttcttagcatcacggttaaaaggccggccttgatctaacatctcgctagaacggtcactaaaactcaaaccatcaattcatcaaaaatggaacgcagcacaattcaagccaagtcaaagcctctccctccaggagtctatactccggtcgtcacactttacaaggcagacgaccccagtcaaaaagtagactatgaagctatgcacacacagtgccaggccctcatcaaggctggtatgcatggtctcgtctacctgggaaccaatggcgaactagttcttctttctcgagaagagcgaaaagccatcatcaagaccgctgctcaagctgcagctacagttggcggaccaaattacccaattgtggctggtatctcagcacagtccacgcaagagtcgatccagaacgccaaagatgcagctgaagccggtgctaactctggtctgcttctccctccgagttactgggccaaggcactacccagtcctgccattgtcgcctacttcaaggaggtggcggctgcttcgccgatccccatcgttatctacaacttccctgcggtcacctcagggattgatctagacacagatcaactagctacactagccgctgagccaaacattgtagcggtcaagctcacatgtggaaatgtcggaaaggtcaccagattaacagctctcttctccatgaaacaatcggtgtatacggtggaagtagcgattatcttgtgcccacccctcta

SEQ ID NO: 351 - DNA, 947 bp, Triticum aestivum
  Clone ID: PAT_TA_351
cttacatggtcgatccaaacacaggagttgctatgtatgaatcagatgacatcataaattacctggcaaaaacttacggtgatggaagtgttccaattatgctaaaacttggtctattgacaacaataacggcagggcttgcattgagtgggcgtagcgggaagggatcttcctacactcctgcaaagcttccatcccagccaatagagatatgggcatacgagggatctcctttctgtaaaatagcgcgtgagacccttgtcgaattggagttgccacacttgctacacagctgtgcgcgtggcagccccaagcgacaggattttttcaagaaatatggccttttccaggcgccttatatcgaggatcctaacacgggggtaaagatgttcgagagcgccgacattgtagagtatctgagggcaacatatgctgcttgagaatccctggcactatcttttctcagtaaatattgagctcatagcctgccatgtctcttctcatgtagttgatcacattctttactaggaaaatggtgcatcctagattatataaggtgtaaattctattcgctgcagctgagacagcgtctatctaagaaacactgaatttgaggctgtagaaaagtgaaataaaatccagaaatgggagtcttgttgtttctttcctcagtaccaaaatctctgaagtgtcgatatatgatggcgacttggggttatatagtagagaagcaagaactgggccaagtattctcaagtaccggcaattgtcaccctttgagatttttttatagtggtgcgaaaccatgtggagatgattttgtagcatgggaaacatgttggatttatgatgcaaaggaagacatatgtaatgtgtgtaatcatacataggcaaatacggtagtcgaaactagaaatacttttttgcagagagaaactagaaatact

SEQ ID NO: 352 - DNA, 1307 bp, Triticum aestivum
  Clone ID: PAT_TA_352
ccccgttgaaataccctccgccccaccccctccgtcttccctccctctcccggcggcgcgggctccacgggtacatctctccgcccccccggcctaccccctcccgccgttccactttccacgcgcgccagctagaaccaccgacgcaaacggccaccgcgggtcggtcccagcctccctcagcgtccccccgcccgcccgaacccgcccccgtctccgcccccgccttctccacccgggtggggcacgagtcctgcccgccagcggtgttcgcgcatcccgggcccgaccacctcctgcgccaggatggccagctcttcatccttgcccgtgcggaccccgttcttcgttctagcctcgggaccgccatcttttgccgcttataatcgctatcactgatctacatgcttaaaattttccgaggccggaaggctctggaatttccaggtctaaaggttaagcagacctcaaggaaagattagtgacatcgaccagaaagacctattgatatatacgagttagatgtgtgaccattttgtcgtaagggaacacaggtgttatccgtaccggaccctgatgggtaattttacccttgtcctcaaaaggcgtcaacatttcgtccaaaggttgtagagatgggtgggaaagaaacacactcccttacatggtggatccaaacacaggagttgccaatgtatgaatcaagatgccattattaaaataccttgcagacacctacgacttatgggaagcagaaccggagtatcctgtcgcttggtcaatttacgaacaattaacagcacgggctagctaactacattggttgtgtctccggcagtgatcgtcctaacactgggcgccagggctttttcccgaaacagggcgtgagcccggcgcctgaaatggagtctcctcactcgcgactcagccgggcggcgtgcgctgacatagcagcatgcatttttgcagaaaaatcccggtctcttccatgccaaattatctggagggtcgcaaaaatagtgtgaatttagaacacattctcgacatcgtacagcagcggccgaaaacctatgctgcttgagtatccctgtccctgtcttttctcagtcaataactaaatattgagctcagagcggccatgtctcttctcttgtagtagacctcattctttactaggaaaaatggtgcatgctatatatgtaaggtgtaacttatattcgcggcagctgagaccgcgtccttgctatcaaacaaacaatgactctggtgccgtggaaaatctttgttaaaaaaaaaaaaaaaaaaaa

SEQ ID NO: 353 - DNA, 684 bp, Triticum aestivum
  Clone ID: PAT_TA_353
gccggccgggccgggctccccacagcacccaagcagagcacagcagagcagagcattcggctcctccatttcacggcgtgaaggcagggacacggcgagcatggggtcgaggtacgaggtggaggtgacggtgggctcggcgcgggacctcaagaacgtcaactggcgcaacggcgacctgcagccctacgccgtgctctgggtcgacgacggccccaagtgctcctcccgcgtcgacctggacaacggcgagagccccgagtgggacgagaagctcaccgtcccgctcccgccgtccaccacccgcctcgaggacgcggtgctccacatcgacgtcgtccacgccaacgccgccgagggcaccaagccgctcgtggggtccgcgcgcctgccgctgcgcgacgtcctcgacgacgccgggctcggcggccgagcgtcccgctcgctccgcctcaagcgcccctcgggccggccccagggccgcgtcgacgtccgcgtcgccgtccgcgagaccgcccgctactacgaccccgcctacccgccgccctacggccagagccagtcccagtcccgcgacccctacgcggccccggcgccgtacggctcgggcgggtacgggtacggccagcagcagcagccgtacgccgcgcccgccgtccggctacccgggcgcctacggcgcgg

SEQ ID NO: 354 - DNA, 854 bp, Triticum aestivum
  Clone ID: PAT_TA_354
agatcttgtatccgttcattcattcattcactctttggaacaccacggtctttaccaccagtcactcattcatttatttgacattagccaattgttctgcttcaccaattaatcgcagtaatttcaccatcagtcatcatgatccccgccactattcttgcacttctgagcatcgcttccgtctctcaggcggcagctgctcccaagattctctcctctgacgacatcatcgttctcaagaccgatggaacttctcaggtcatgaaggccgccgacctggaggctcttgagactgcccctgctgtcaagaacatcgctggctccgccaagaaagatatccagcgccgcgattgcgaggacagcaccgagatccaggtcctttccgacaaggagtttgtcaactgggacgtcgccatgtcccccgtcatcagcagtctcggcggctccaaggcgaccgtcagtgtgaccaacggctacaccatcaccaactccctcaaagtcggcgcgagtttcagcattcctttgatcaaggacatcttgactacttctttgagcatcgactacaccgagacctggtcttccagccaaacgcagtcgctctccttcacggtccccgagggtcaccacggtatcattgtcagccagccttatgttcgccgtattgagggtaacgtcatcgatggatgcacaggagatgccaagggagggattcgtgtcggattcttatgagagccaggcttatggaaaccttcagtgggtcaggggtatcattcgtctttgcagcagtgagacgtaccctattccttactggtacggagagggcgagcacagtaaatgcggacggaggtctgatg

SEQ ID NO: 355 - DNA, 896 bp, Triticum aestivum
  Clone ID: PAT_TA_355
attcggcacgaggcacgcacctccacgactcgatccaaatcactccggggagcgtccaactcggagcagaagaaatcgcatcgcccgactagctagctccgggccaagcaagcaagctagccatggcgccggtggtgtcggcgctggccaagtacaagctggtgttcctcggcgaccaggcggtgggcaagaccgccatcatcacccgcttcatgtacgacaagttcgacgccacctaccaggcgaccatcgggatcgatttcctctccaagaccatgtacctcgaggaccgcacggttcgcctgcagctatgggacacggctgggcaggagaggttccggagcctgattccaagctacatcagagactcttcggtcgcggtcatcgtctacgacgtaacagacacgcaatcgtttctgcatacatcgaagtggatcgacgaagtgaacacggcgagaggcaaagatgtgctgatcgtgctcgtcggaaacaaaacagacctcgttgaccagaggcaagtgcccacggacgaaggggaagccaaggccaaggagcatggcgccttgttcatggagaccagcgcgaaggccggcttcaacatcaaggcgctgttccgcacgatcgccacgtccctgcctgggatggacgctctcccgtcggccaagcaggaggacatggtggacatcaatctcaggcctgcctccgggccagcaggctcaggcgcgcctgggcagcaggagcagaaagcaggaggatgctcttgctgagttttgtgttcttttattagaggagagatttgtgcatcccttgcaggattgcagtggtacatcgcagggctgctgcaagaatgtaattttgaccaaaacagattgcggacagaatgcaaaaattgctag

SEQ ID NO: 356 - DNA, 737 bp, Triticum aestivum
  Clone ID: PAT_TA_356
gccggccgggtccggaacaagctaccgaacaatacaacaaaccgcaaccatgtctccaggaatgacccttttcgcggttcaggccgtcctgatcctcagcacagaggacggctccaggatattcgcaaagtacttccagccgcctcactcagcacccaatgctccctcaagcgcctcagccaacccttactccgatgttaaggcgcaaaaggctttcgtgaagggtcttattgagaagactgccaagcagaccggcgacattattctctacgacaacagaattgtgctgtacaagatggagtcagatgtcatgatgtacgttgttggcagtgtcgacgagaacgagattcttctgtacaacaccattcttgctctgcgagactctctccatctgctctttaagcaatccgtcgataagagaacaatcgtcgagaactacgacctcgtttcgctcgcaattgacgagattgtcgacgacggcatcattctcgagaccgaccccaccatcatcgttcagcgtgtcagccgagcacccacacaggacatgcctgtcggtcgcatcgatcttagtgaacagggtgtcaataacctggcgcagctaggaaagtcgaaactggcggattggcttcgacagggtctgtaaaggggatgaaagcgttacgtctagagattcaggagttttgtcgttattctagcgccgcatgcaaaccaaaattcaaaagaagaagacaccgcgc

SEQ ID NO: 357 - DNA, 453 bp, Triticum aestivum
  Clone ID: PAT_TA_357
ccgcccgcacccgacccggtcgtcgcgtccgttcccggccccacgcgtccggccggcgccggcccccctcctacctacccggacgagatggaggacggtgtgtcaacttatactgtcgatgaggcgctggtgtccatggggttcggaaagttccaagtgttcgtgcttgcctattccgggatggccaagatctcagaggcgatggaaatgatgcttctgtcgtttgttgggcagtcggttcacgctgaatggggcctttctgcacaggaagagagtttcatcacaagtgttgtatttttagggatgctcgtaggagcatactgttggggcttagtttcggacaactacgggagaagggttgggttcaacttcacagcccttgtaaccggtggggcaggtcttttcagtgccttcgcgccaaactattcatctttgattgtactaagatttttt

SEQ ID NO: 358 - DNA, 666 bp, Triticum aestivum
  Clone ID: PAT_TA_358
ttttttttttttttttttgaacacaaacaaacatctcttcaaatgtctttgtaactgagacaactctagtctacattttatgcaaacattgcttattctggtttttacatacaatgacagcaaaattaaatagctgatcacacaccgattctgaatggcatgacctttccgatcacgcacagaacctcgtctactacatcttttcttctcttttcgagctagagtccttcagcctaacaagtcttgctgcttctacatcgccgccagcaacgacgactagggtaaacagaaagcaaaagaagaaaccctgtaactgtaagagaataacaacagagcttgcggatacttctaccattccatcgagttggtccttctaagatcttgcgatggttttttccttacgacgacttggaatgcttgttccttgagctcgttaagcctcttctcgttttgctcctcctgttctctaagcagttcggcatgttcctcctcaagctgtgtgacctgtgcctccagttctgcgatgtaagcctgcttcctctccctggacctggccgcagactcgcggttcttgatcatgcgcttctggcgctgcgtggccgcgcggtccatgggatccatcagcgccctctccccgccccccccggcgccccggcccccgcccca

SEQ ID NO: 359 - DNA, 834 bp, Triticum aestivum
  Clone ID: PAT_TA_359
cggccgctcgagcggcgggcgggatcccgtctcccaccttcgacatcaaactcctgcagcccacaatcttctccacttacaacgccatgaaggataaatcgaaaaacgctcttctatcggacgtctgcatcagcacgtccgctgcgccgacctacctccccggccaccacttccggacagagcaagaggatggcaaagtccgggaattcaacctcatcgacggtggcgttgctgcaaacaatccgaccttgctggcaatgacggacgtaagcaagcagatcctgatgggaaacccagacttcttccccatcaagcccgcggactacggcaagttcatgatcctttcgctgggcaccggtaccgccaagatcgaagagaagttcgacatagccgagtgcagcaagtggggcctccttggatggctctacaacaggggcgccacgcccatcatcgacagcttcagtcaggccagtgccgaccttgtggacatccacgcctctgtgctctttcaagcacatcactgcgagaagcgctacctccggatccaagacgacgagctcaagggtgagacggcctccgtcgacgtgtcaacgccggagaacctcaaccggctcgtcgacattggcaaggcactgctcaagaggcaggtgtgcaaagtgaacgctgagacggggaagaatgagcccgaccaacataggggcacgaacgaggaggagttggtcaatttccaccatttgtcggaggagccaaagcagactccgaaggaggcatttgaactcagagactggggcatcctacatcgaatttgtagacgacacatactactatatattt

SEQ ID NO: 360 - DNA, 812 bp, Triticum aestivum
  Clone ID: PAT_TA_360
gccggcctgtccgggatccacagattcaggatctcagctctcaaccatctcttacccaagctcgctaaactgtgatctggagatatcggattctcgcttctgtcaattctttaaactttgcaatctcgctagtttcacgtcaacatgaagattacctcggttttcacagccgtctttgccactttagcagtcggctcgcctctcgagacacgcgatgcacacatcaagcgtcaggccgctgaagcatgcagcgttggatactgcactcagaacggaggaactactggtggtgccaagggcgaaactattaccgtgaccaccctcgccgctcttcaggaagctgccaagcgttccggtcctctcaccattatcgtcaatggcaagttcactggtagtgataccattcgtccttcgtctgacaagactatcatcggcgcggccggcagctcactcaccggtgttggattctacgttcgtcgtcagaagaacgttattctccgaaacctcaagatcgccaaagttgatgcttccaacggcgatgctattggtattgatgagtcgaccaatgtctgggttgaccactgtgatctttccggagatctgagcctcggcaaggatgaccttgacggtcttcttgacatctctcacggtgctgattggatcactgtatccaacacttacttccacgaccactggaaggcttcgctcatcggccactccgataacaatgcttctcaggacaagggcaagcttcacatcacctacgccaacactactggaagaacgtcaccagcgtcagcctctcatccgct

SEQ ID NO: 361 - DNA, 869 bp, Triticum aestivum
  unsure (1)..(869): unsure at all n locations
  Clone ID: PAT_TA_361
aatcgccgaaaaaaagatctaattcagactcaactcaactcacttcaacatttataatcgagatgcctcaagtcaggaacccaattcttccaggattcaacccggacccttctatcgtccgggttggagatgactactacatcgccacgtccacatttgagtggtttcctggtgttcagatccaccactcgagagaccttgccaattggaagctggttgtgcgtccgctgacgcgcaagaaccaacttgacatgcgtggcgagcctgatagctgtggtgtttgggcaccttgtttgagccacgacggcgagaagttttggctagtttacacggatgtcaagcgcaaggacggttctttcaaggatgctcataattatatcgtcactgcaacatctattgaaggaccatggtcggatcccgtttatgccaactcttctggcttcgatccctccctcttccatgatgacgacggaaagaagtggttcaacaacatgacctgggatcaccgctctcgcccaagaacgtttgaaggcatcttccttcaagaatttgacccaaaggccaacaagctggttggtcccaggaagaacatcttcgaaggaacggatttggcctttgttgagggatctcacatttacaaacgcaatggatggtattatctttcgactgcagagggtggcacggggtacactcacgccataacccttgctcgatctcgcaacatctggggtccttatgaggtgcacccccaaaagtatatccttacttcaaaggatacgccgcacgctgcccttcaaagagctggccatggncagattgtcgagacacagatggcaagactacgtcgtgcaccttacaggtcgtccact

SEQ ID NO: 362 - DNA, 718 bp, Triticum aestivum
  Clone ID: PAT_TA_362
accgagaaaagagttccggtgcaaagaattaaaaacgacagcatatgcattgaagatctgatgaggaaatatggcgtcattgatcaaagtctcgtcggccatcctgacatggccactaaaatcttatcagatctgtttagtagcagtggcataacaattgacgctaatttacccagcaagaagattcgagcacatctaagatctttaaagcctggagatgcttgcaagcttctagagaatttagcggacgcgtggggatcaagatctggtagcgctgagcttgttttgcgttggatatactgcttactagtaattcatggtcgttttatcccctcggagaaatcaagaaaactaattagcgacctggagaagatgtgtgcagaaagatacacagcaactgaagatttactgaagctttctggtcgtcttcggctgataatggcacaggttgacaaggatgtgaaagatgtatcggcgaaggccgcagtccaatctgatgaagaggaagaagatgaaattgatgaaatggatggtgaagacgtggatttgtctgaaaatagtgacgatgatgctgagtagaatcgccgcattgttggcatgtctccaagagacttttcgactttgtgtacggtcaagatgtatttttcaagctttccgtccatagtcgtgtaaaaccgcgcaacgacggaaggttgcactaatttgacagcaggaggta

SEQ ID NO: 363 - DNA, 703 bp, Triticum aestivum
  Clone ID: PAT_TA_363
gatgccggcaccaagtgcacaattgtgagccaggtcgccaatccaagtagaaacacagcaaggaagcaaagagccgaccgaccgaggatggcaaagaacaactcctctgcgacctcggttcggctgatgctcatcctcctccttctgctggttttcgttggtggcatcctggcaaacagtgggccgtccgaatgcagcaaccctgcggctcagcgagactgcccgcggatccctaatggcggctcataagcacgagatggaccatttctgcgcagcaggattcggtaggatcttgtgttggcaggcgctggaagctttctattatatatgcgaaacaaacaatatacatgttcttgaggtgttggttttgtgatgtttgttcgtattgatatgtttgtactgtgacctggtttacatataaataatatggcctaccccgtacattaaaaagtattagtcagatcctatatctaaataggtgtctacaatatcattttattacccaacaatgccctgttattatgtatcagtatgatttttttggccaggtcttagaccctgcataaaaccaacaaacggactgttcacaggacatcgactctctttattgatttccaccggtgcctacaatatcatgttattctgtatcaaatatattttgtttcccatcaaaaaaaaaaaaaaaaaaggcccctaactcgag

SEQ ID NO: 364 - DNA, 852 bp, Triticum aestivum
  Clone ID: PAT_TA_364
gccggccggttcgggcccccccaaaatcgaaaacaaacgcgagcagcccccaaatccagatctcaacatctcccggcgagttgagcagaaatcagatcaaccgatggccggcgtcgagtgtgtctgccctggcaaacgaaaggcggcgactttttccggcgagtgttccccgacggccaagaggacggccggctgttccggcggagataagaaggcccatccccgaggagaggaggagattccggcggcgaagaagatgtggcggctgccgcgggaggaggtcggccggatcgtcgactggccgccgtacttccctcccgccctgtaccgagacctgaagcgcgacaacccgtcgcttctgccatcgccggaggaggagaaggacgagcgcagggtgctcctctaccggcgcgcgcgcgagtgctacgagcatctggataggttcgccgggttccaggccagggtccgccgcgagtacgcctccaaaggattcgtggaggtcgactacgactgcgtcggcgccgaggccgtggcgcagaggcggatcgaccaggcacgtggtgaggctttcagagccatcgttgctcatcttaaatcagaggtcgtcgtcgacgccgacacgttccggcaactcaaaaggaaaatgatggacggtttctgactgtctgaaaccaaactcatctggcagtcaggctaatgactcctatgtaccgtcccaacacgactatggttctatctaggtgctcgctcggtctatgttctgccttgtctgatcatttctgatccaatgtcactggccacgggattatttacgattaaaaaaaaaaaaagcttttcatcattgattaacaa

SEQ ID NO: 365 - DNA, 1054 bp, Triticum aestivum
  Clone ID: PAT_TA_365
gccggccgttccgggacgtcacctatccgtccccacatccgtcgccttctcgagcagatcaccagttcagttcaggacgcgcagatggcctcctacgagaagcagcagccgccgccgcagccgccggcgaacgcggcgccctactacgcgtacccggccccgcagcagccgtactacgcgcccccgcctccccctccgcccgccccgcgccggagcggccccggctgcctcctctgcttcgtcttcaaggtcatcgccctagtcatcatcgcgctgggcgccgccaccctcgtgctctggctcatcctgcgcccgggcgccgtcagggccaccgccgtctccgccacgctctcccgcttcgacctggccgaaggcgtacgcggcggcgagggggtcctccagtacaacctcaccgtggacgtccgcgtccgcaaccccaaccgctaccgcatccactacgagtacgccgaggcgcaggcgtcctacgacggcgagcgcttcgggtacgaccccgtggagcccttctacctggagaggaagggcgagcgcaccgtcacggccgcgttcggcgggtcgtccgtcgtcgacgaccgcggcgcgctgcgctcgtaccggagggagaggggcgacggcttctactacgtcaaggtgaggctgtacgccgacctcgggttcaaggtcattcaaggtcacgcgcgccgcaagagcaagatcagctgcacgctgcgcctgccgccgccggacgcgagcgcgacgcagcgcgagacggtgccggacgatgctggggacgaggtgcgccgaggacttctgacccgccccgattcgtcacaacgggatatgcttccgccggctgccgtgccaaagattatattttgtttgacgctgtagtatgtgtttgtcattttgaaaccgtgcattagagagggtggccgtgcttaaattattcctgtaagcgcgtctagattctttcgtttttcatttgatgtgcatatatctttgaataattcgacaccttgaattcgtctgtcaaaaaaaaaaaaaaaaaaaaaaaaaa

SEQ ID NO: 366 - DNA, 824 bp, Triticum aestivum
  Clone ID: PAT_TA_366
tgtccctcttgagtcattcacactactgctattcttctgcacagccatcatgcgtttccccagctcaatcgtcctagcactcgctaccctgaccgcagctcacccaggtgaagatcaccacgatgagcttcaacagcgtcgctcattcgagaccactgctgagcggctgtctctgcgtcactgtgctgagaaactgaaggcacgaggtgtgactgaccgcaacatcaagcgccgatccgctttgatccaagagcaccgccagaagcgtggtatcaagaagcgtgatctcgaggacgtgctcaacacggaccacaataagaccgacctgggttatacgcccaacacacctgccgagactctgtttgctggacagaactcgtgcgttctgacccccgaggttactatcggtccctactacgtcagtggtgagaccattcgtcgcaacctcaaggaggaccaagagggtgttgacctcatcctcgactaccaaatcatcaacgtcgagacctgcgagcctgtaccagagctgtatctcgatatttggcactgcaacgcaaccggtgtctatgctggtgtgaacaacccaggcaatggaaacaccgacgacaagaccaacattaacaccacctttggtcgtggtatccagcaaactaacgaggatggcgttgctcagtttgagacactcttcccaggtcactacaccgatcgtaccacccacattcaccttctggctcatgcaaacgctactttgttcgagaaacagacactcggaaacgacatctacagcagccatatcggccagacctacttcgaccaggacttga

SEQ ID NO: 367 - DNA, 1453 bp, Triticum aestivum
  Clone ID: PAT_TA_367
cgtccgctccgatgggtcctggtccaatgccagcatacggtatgcctccaatgggaagctactgagtcaaccagcctctgttgtatgaatttgaagagtacagatgatgtgaagtatttcagttgatgcagagggagggaagaatcatgaatatctatcccagagaggtatcttccaaggtgtatatctgcgtcattggttgttccagttaatattcttttggtaccaggacaattttggcaagcgaaatctctagccgagtttgagttaattacaggattgctatattatacgtccgcccacgcgtccgcataggcgtgggcgtgcagttgatgtgacacattctcttgatgtcatgctagctgcggagtaagccaatgtataccatgatttggtcaagtacttgttgatggtaaggcaaaaggcaagggagcccaaagtcgacagcgaactcatctttgcatatgctaagattgataggctcagtgacattgaagagtttattctgatgccgaatgttgccaatctccaaaatgttggcgaccgtctgtatgatgaagagctctatgaagctgcaaagatcatctatgccttcatctcaaactgggctaagctggctgtcactttggtcaagctaaagcagttccaaggtgctgtagatgctgctcgcaaggctaacagcgctaaaacatggaaggaggtctgctttgcttgtgttgacgctgaggagttccgtctagcacaaatctgtggtctcaacattatcgttcaggttgatgacttggaggaagtgagtgaatactaccagaacagaggttgtttcagtgaacttatttccctcatggagagtggtcttggacttgagcgggcacacatgggcatctttactgaattgggagttctctatgctagataccgccctgagaagctcatggaacacatcaaactcttctccacccgtctcaacattcctaagcttatccgtgcttgtgatgtttaacagcactggaaagagcttacatacctatacattcaatatgatgaatttgacaatgctgctaccactatcatgaaccattctccagatgcatgggatcacatgcaatttaaggatgtttgtgttaaagttgcaaatgttgagatttattacaaggcagtgcatttctatttgcaagagcaccctgatctcatcaatgatcttctcaatgtgcttgcacttcgtttggatcataccagagttgtagatataatgcgcaaggctggtcagttgcatcttgtgaaaccgtacatggttgcagttcagagcaacaatgtctctgctgtcaatgaagctttgaatgagctatatgtcgaagaggaggactacgagaggctccgtgaatctgttgacatgcatgataactttgatcagataggtcttgcccagaagcttgagaagcatgagttgcttgag

SEQ ID NO: 368 - DNA, 880 bp, Triticum aestivum
  unsure (1)..(880): unsure at all n locations
  Clone ID: PAT_TA_368
ggngaaagaaagaatgctttgcttcttgcctcttcatttgctacgacttgattcgtgcggatgtcgctcttgagcttgcatggacgaataacatgctggatttcgcgttcccctatctattacagttcatccgtgagtacacaagcaaggtagatgatttggtgaaggacaggatagaatcgcagaaggaagagaaagctaaagagaacgaagagaaggaactagttgcgcagcagaacatgtacgctcaattgcttcctctggccttgcctgctccgcccggcatgatgggcggtccacctccgatgggcgggatgggcatgccgccgatgggcgggatgggtatgccgccgatgggtcctggtccaatgccagcatacgggatgcctccaatgggaagctactgagtcaaccagcctctgttgtatgaatttgaggagtacagatgatgtgaagtatttgagttgacgcagagggagggaagaatcatgaatatctatcccagagaggtatcttccaaggtgtatatctgcgtcatcggttgttccagttaatattcttttggtaccaggacaattttggcaagcgaaatctctagccgagtttgagttaattacaggactgctatatattatatatattatattacggttggataggatgagcagcagcatgagtggttaggcccctggtaccatttgtataggtgttatattgaaagtttgtagacattctgcatgtacactcgtcggtgttggtgttgctgccagccataaacacatcaaatactgtctgtatgttgttaattaccggtttcgatctcttggccagtgcttagattttttttgtaactgaatgaacgtttttgttgtactttctg

SEQ ID NO: 369 - DNA, 2775 bp, Triticum aestivum
  Clone ID: PAT_TA_369
cctctcttcgatcacagtaagcagttcttcgacccacttgtttctgccacatgccctgaaaagaggagccctgctgtcgctcttgttccttgctgacgcgttcattggggcggacctcccgcctgagctgcctgcaattactcacaggattggcctccagatttctatgttctggggaaacttgaatctgcacaaccggctcatcttggaagccatgaaggcgaacacagacagggtcttggacaacattaacagtctgcacaactgccaggacccagctgtcctgcacaacgttttcgcgccattgctgcctctggacctgcttgccacgctcaggaagttcctcggacctgctccgagggttggcatccgcatgccgccgatcggaggcatggatatggctccgatgggtccaggtccaatgccagcatacgggatgcctccaaggggaagctactgagtcaaccagtagctgttgtatgaagttggagagtactgatggtgtgatgtatttcacgtgatgctgaggcagggtagaatcatttctatcgatccaactgatgtatcctccaaggtgtttatctgcttgattatgtgtaccagataggaatgtgagcgcaccatcaatattgtggccatcgaaatctcttcccgagtttgagtgcatagcaggattgctatattatttatattatcttacggtccgattcgatgagcagcagcagaactggttaggcacgaggaaccatatgaagaggtattatattgaaagtccgtagacactcagttggttcacttggcggtgcctgtgctgccgcggaagatgggccgaccacctccggtgggcggattgggcattacgcggatgggcgggatgggtatgccctccgatgggtcctggtccaatgccagcatacgggatgcctccaatgggaatgctactgagtcaaccaacctctgttgtatgaatttgaagagtacagatgatgtgaagtatttcagttgacgcagagggagggagacaatcatgaatatcttatcccggagaggtagcctctgaacgtgtttatatgacttgtagtcctttacgctagataccgccctgagaagctcatggaacacatcaagcttttctccacccggctgaatattcctaagcttatccgtgcttgtgatgaacaacaacactggaaagagcttacgtacctatacatccaatatgatgaatttgacaatgctgctaccactattatgaaccattctccagatgcatgggatcatatgcaatttaaggatgttgctgttaaggttgcaaatgttgagatatattacaaggctgtgcacttctatttgcaagaacaccctgatctcatcaatgatcttctcaatgtgcttgcgcttcgcttggatcacacaagagttgtagacataatgcgcaaggctggtcagttgcatcttgtgaaaccatacatggttgcagttcagagcaacaatgtctctgctgtcaatgaagcattgaatgagctttatgttgaagaggaggactatgagaggctccgtgagtcagttgacatgcatgataactttgatcagataggtcttgcccagaagcttgagaaacatgaattgcttgagatgaggaggattgctgcctacatttacaagaaagctggcagatggaagcaatctattgccctatcgaagaaagacaacatgtacaaggattgcatggaaacatgctcacagtctggtgaccgtgagctgtcggaggatttacttgtctatttcatcgaacagggaaagaaagaatgttttgcttcttgcctcttcatttgttacgacttgattcgtgcggatgttgctcttgagcttgcatggacaaataacatgctggactttgctttcccctacctattacagttcatccgtgagtacacaagcaaggtagatgatctggtgaaggacaggattgaatcgcagaaagaagaaaaagccaaagagcaggaagagaaggacgtagttgctcagcagaacatgtacgctcaattgctccctctcgccttgcctgctccgcctggtatggggggtccacctccgatgggcgggatgggtatgcctccaatgggcgggatgggtatgcctccgatgggtgggatgggtatgcctccgatgggtgggatgggtatgcctccgatgggtcctggtccgatgccggcatatgggatgcctccaatgggaaactactgagtcggcttttgaagaacatagatgatgtcgattgtttcagtctttttttacacagagggagcatgaggatcccaaaggtatctttcaagttgtagattgatttgggctattggttgtttcagttaatattcttttggtaccggggcaattttggcgagcaatatctctagccgaggtagagtaaatttactggttgctatatattatgatcgggtaggatgaggatgagattaggttccagctgaagaatgagaggtggaagactggtaccatttgtatagcttgtgtgataaaaagactagacattttgggtgtacactcctccgtgttggtgttgccacccgtgaacataaacactgcttgtatgttatatgttacactttgtgttcagaggtttgggttttgtacctggaagaatgcttttgttgaacgatacattgaaattgtatatgtattttgcatgtacactcgtcggtgttggtgttgctgccagccataaacacatcaaatactgtctgtatgttgttt

SEQ ID NO: 370 - DNA, 831 bp, Triticum aestivum
  unsure (1)..(831): unsure at all n locations
  Clone ID: PAT_TA_370
gccggccggttcgggaacaccccccgcccgcagaggcagccaaacctcgcccgcccgccgcccgcagcctccgctcccctcggttccgcagattcccccgagctcgccgacgggactgctccggccgcctcgctctcccgccgccgttgccccatggctacgccgctggtagctgggctgtcggtagctgctgctgcgatggggagcagattcatgattcaggcatggcaggcctttcgaatccgggctgcggtgccacgtgtgcgtaaattctatcctggaggatttgagagggagatgagcagaagagaagccgcattgatccttggcgtaagagaacgtgctgcactggacaagataaaggaggcccacaagagggtgatggtagccaaccaccctgatggtggcggcagccattacattgcttccaagataaacgaggccaaggacatgctcatggggaaggggaaatccggctccattttttagacagtggatacatacgagatggaagttattttgcattgttcgcgatgaggtagtgattcgctttccatcgacatcattaacagtgttgtgctgataccgtgcatctgaacaaagatacaccgtatggaaacagagtaacttgagatgtggctgatgtaagtttacccagaggctccagatattatgctaaccgtcgtctgttgtgaccattgngctgtcttacttgaaagattgtatatttggggcttgttgcttactgatgtgtgtgtaagatatcagnttgtttctcattggttaatgtcactgctgataaagcaaaaaaaaaaaaaaaaggcccctagg

SEQ ID NO: 371 - DNA, 462 bp, Triticum aestivum
  Clone ID: PAT_TA_371
ctttcgcggactcgtgggttgtaatccttcctccctcccttccctccgtgtcgcccgcgctccgcctaccggatcgcaattccgcatcgccccgccgcagccccagccccagccccggccaggcccccatggcgaggcgatccgccccgctcctccgccgcctggtctcctccgcgccgcccctcccgggccacggcggcggcgcgcgccgcacggtcacctacatgccccgcccgggcgatggcaccccgcgccccgtcacgctcatcccgggcgacggcatcggacccctcgtcaccggcgccgtggagcaggtcatggaggccatgcacgcgcccgtctacttcgagtcctacgacgtccacggcgacatgcccgccgtgccgcccgccgtcatcgaatccatccgccgcaacaaggtctgcctcaagggcggtctcgccacccccgtcggcgggggcg

SEQ ID NO: 372 - DNA, 1729 bp, Triticum aestivum
  Clone ID: PAT_TA_372
cacggcgccgcgggcatccacccagccaccctacccggtctcaccatggcgcgccgctgcgcccctctcctccggcgcgtccccgcccccgccgctccagccccccccccaggccccggcgccccccctcccgccaccgccgcgccgcgtcctgcgggcggcccctcccgcaccgccgcgcccatccgcgccgcagggtgacctacatgcgccgcccgggcgatggcaccccgcgtcccgtcacgctcctccccggcgacggcatcggccccctcgtcaccggcgcccttgaccacgtcatggaggcgatgcacgcgcccgtctccttccagtcctacgacgtccacggccacatgcccgccgtgccccccccggtcatcgagtccatccgccgcaacaaggtctgcctcaagggcggcctcgccaccccccgtcggcgggggcgtctcctccctcaacatgcagctccgcaaggagctcgacctcttcgcctccctcgtcaactgcgccaacgtccccggcctgcccaccaggcaccagaacgtcgacatcgtcgtcatcagggagaacaccgagggcgagtactcgggcctcgagcacgaggctcgtccctgggtgtcgtcgagagaatcaaggtgatcacgagattgtactccgagaggcttgcaaaataagccttcgagattgcttatcttaactaccggaagaaagtcacggcagtgcataaagcaaacatcatgaaacttgctgatggtttgttcttggagtcttgccgtgagattgccgctaaatatccaagtattgagtataatgaaatcattgttgacaactgctgcatgcaacttgtttcaatggcctgaatgaatttgatgttatggttacgcctaacctttacggcaatttggttgccaacacagctgcaggtcttgttggaggaaaaggtttggtgccgacaggattggtggatcagaagaaacctaatccagttgctctgtttttctcgtccgccatgatgttgaggcatttgcagttcccgtcattcgccgaccggctggaatcagcagtgaagagtgtcattgcagaaggcaaatacaggaccagggatttgggcggcaccgagcaccacccaggaagtcacggatgcagtaatcgccaaacttgattagccgcgaatcgcgtgcttttcgagactagtttttttgagcccctgagagtaggccggtagtcaggaatgattttccatgactgtagcattagattgttttttgagttcagcgaaacactgtaacatctttggtacgttctttttggtttggcttaactaagattgggcaattcatatattacatggaaataatttgagaaacccacgaggattattcttccatatgatactttgtagcaaggcaaaacaccttgtgttgcagagggggtagctggctaccttcaatttaaacggcatgcattgaaagtttattctcagttcttattcgtggttgtcactcccatgtaaccggaatccggtcctcttttctttggaaagggaatctggtcttctgaattgctatgcatgtcactgtcagattttgtatggtactccagctatacccccaaaaaagccccccccccctgttacttttaccccaaattcgccaagttataactggaaacaccaagttatagctggaaataagatcgaaaatataaagaaacgttctcttttgcatcc

SEQ ID NO: 373 - DNA, 1246 bp, Triticum aestivum
  Clone ID: PAT_TA_373
gccggccggtccgggatcttgaaatcgttgcaacgtctcagaacactcctgagtatcatcgtctcgactactcataccatcttgcagctaatacccgggacaagacgaagccgttacttgatgagacagatccggccttgaaactatcgccaccaccgttcccagagacaaccaaaccaacactattatacgatgttgtgtgcatgctagaaagtcgagagcgtggatctgccaaccaacttccgcgacatcatcggcttcacaaccatccgtcaacatatcgtctcacgccagtgtctcaaagctcaagtatccgcttgatccacattatcttagccaacatcagccttaacgcatcgttatattcatcaagggccctctctctcagttgatattacctgcccttcgccctttcatcgttgttgtctgatcattcgtttctttctgtctgctggtctgacagttacctttcgtttaataattttctttcattctttcgtttgttcattcttttcaccgctggccggtctataataccatatcaaaatcaagcccggacagcagtgttggagcagcatacgaacagaagacgaatcgacgagaggaaaagacaaagacgcaaggaaaccggcaatcgacaacaaagaaagagcaaggcaacttaattcagtctcgacaaccactactcatccatcatgggaaaactcatcaagaaccactgggcccgcctcatcgttttgagtgctgcagcctaccaagtcttggctgccatcgagtgcttcttctggcccaagatcttctgggacttcctcacacgctccctggacggcgcagtaaaacctgttccggctttgcagataataaacctgatatttgggctgtccatgctatgtcttgaatggcctcttaatttcgtcgctggttcagcccttcaccgctcgcttgagttccggctggccatcattccacttacggcactcagcgctgccctcatctatcaaggcacaaactccgccatctactatctcatcggcatggtcgtctatttctggggttacagcgaaggagagatgatatgtgcaaagccttggacacttcccactcgtggacgcagcggcggacaatctcgtgcatagtcgagacttcccagcatgaatgtattatacacatacatactacaatacacaggcgaggtacagaaagagttcttgggtgaacatcttctgggcttcgattttctcagggg

SEQ ID NO: 374 - DNA, 990 bp, Triticum aestivum
  Clone ID: PAT_TA_374
gccggccggtccgggaccctcatcaccaccgcccaccaccagtcccgcccgcccccagctgccatggcgcgggaggagctgtcgacggagatcgtgaaccgcggcgtggagccgtcgggcccggacgccgggtcgccgaccttctcggtgcgcgtgcgccgccggctgcccgactttttgcagtcggtgaacctcaagtacgtgcggctcgggtaccactacctgctgagccacggcgtgtacctggccaccatcccggtgatcgtgctggtgtgcggcgccgaggtgggcagcctcagccgcgacgagctgtggcgcaaggtgtgggacgaggccacctacgacctcgccaccgtgctcgccttcctcgccgtcctcgccttcaccatctccgtctacatcatgtcccgccccaggcccatctacctcatcgacttcgccacctacaagcccgccgacgaactcaaggtgtccaaggcggagttcatcgacctggcgcgcaagtcgggcaagtttgacgaggagagcctggcattccaggcgcggctgctggccaagtccggcatcggggacgagtcctacatgccgcgctgcgtcttccagcccgacgccaactgcgccaccatgaaggagggccgcgccgaggcctccgccgccatgttcgccgcgctcgacgagctcttcgacaagtgccgcgtccgccccaaggacgtcggcgtcctcgtcgtcaactgcagcctcttcaaccccaccccctccctctccgccatgatcgtcaaccactacaagatgcgcggcaacatcctcagctacaacctggggggcatgggctgcagcgcgggggtcatctccatcgacctcgcccgcgacatgctccaggccagcggcgccgggctcgccgtcgtggtgagcaccgaggccgtgtcgttcacctggtacgccgggaagcgccgctccatgctcatccccaacgccttcttccgcgcgggc

SEQ ID NO: 375 - DNA, 2117 bp, Triticum aestivum
  unsure (1)..(2117): unsure at all n locations
  Clone ID: PAT_TA_375
cctagctatatctcacctcgaggtcctcccactgccccatgccctcaccaccaccgccgcccggccatcggtcggctcggcgccaccactcgagcccgcccgaccccggctctggcgcgtgaggaggtgacgacggcgatcgtgaacggcggcgtcggcctgcggggcccggacccggggtccctggcctgctcggggcgcgtccgccgcccccggccgggcatggacgcctcgatcaccgcccgagcgagcggaagcaggcgcacgtgttaataattaagcgaggtaacgggacacgtcccggtcatcgcacccggcgtgggtaagggcagcgctgactggaaccgagcccacctgatttgcatgtaaccgcatgcacgagtgacggtagctttaacgtgtgagctttggttaatgtgtgctggtgttgtagctcttacctcttcttaaccggtttgatcatagactacctaatggaaatgatgctatcggattcgcatgtaactgcaagcagtgccgatggtttaaggtttgagctttggttaatttgtgctagtgttgaagcggttatctattattattaaggggtttaatcatagactacgtaccttggtgcgcaagtgtatgtgcccccccgcgtctaccttacctgcacttgatgctctacgtgcaatttcattagcgccgaggcctccgccgccatgttcgccgcgctcgacgagctcttcgacaagtgccgcgtccgccccaaggacgtcggcgtgctcgtcgtcaactgcagcctcttcaaccccaccccctccctctccgccatgatcgtcaaccactacaagatgcgcggcaacatcctcagctaccctcgcccgcgcctggcccccggcccgggcgtccgcgcccgccgccgggcgcggcaccggcgccgggccggccgcccggggcgccccgtcgcgccgcgccccgcgccccccccacgcccgcggccccccgggacgcgcccgtcctgccgctgccccaccgccttcttccgcgcgggcgccgccgccgtgctgctgtcgaaccgccgcagggacttccgccgcgccaagtaccagctggaggccgtggtgcgcacgcacgcggccgccgacgaccgcgccttccgctccgtgtaccaggaggaggacgagcagcggatcaagggcctgtccatcagccgcgacctggtggaggtcggcggccacgcgctcaagaccaacatcaccaccctcggcccgctggtgctgcccttctcggagcagctcctcttcttcgccggcgtgctgttccgccacctctacccgtccaagacgtccaccccgccgccgccggccgccaacggggacacctcggccgccgcgccctacatcccggacttcaagcgcgcgttcgagcacttctgcatgcacgcggccagccgcgacgtgctggagcacctgcagcgcaacctgggcctccgcgacgccgacctggaggcctcccgcgccgcgctgcaccgcttcggcaacacctccagcagcagcatctggtacgagctggcctacctggaggccaagggccgcgtccgccgcggcgaccgcgtgtggcagctcgccttcggctccgggttcaagtgcaacagcgccgtgtggcgcgccgtccgccgcgtgcgccgcccgtccaggagcccgtggctggactgcgtcgaccagtacccggcgcgcatggacgcctgacccgatcgagatggcgaagcaggcgcacgtgctaataattaagcgaggtaaaggaacacgtccgtcgtcgtcgcgcccgcgttgggtaagtgcaggctaatggagatggtgctatcgatttgcatgtaactgcatgcatgcagtgccgctggtttaaggtttgagctttgcttaatttgtgctggtgttgtagcggttatctattgttaaggggtttaatcatagactacgtaccataatgcgcaagtgtgtgtgcgcgctcttgtgaaacttatgtgaacttgattatctacgtgcaatttcattactttggactttggactaaaaaaaaaaaaaaaaactcgagggggggcccggtacccaattcgccctatagtgngtgtatta

SEQ ID NO: 376 - DNA, 1105 bp, Triticum aestivum
  Clone ID: PAT_TA_376
gccggccgggtcgggtagaatttgtcctgaggaagccgttgtgaatatcccagcaacccattgttagcatccatcatgttatcgaagcttatcctaccggctctcgccagcattctgtttcagaatacggctgtccaagcagctggagatatcgactatctcatcacatttggagactcgtactcacaaacatggttcgatgtcagcggcgagaaaccttcctccaagaatcccatcggcaaccctcccttcccaggatggacagcatccggtggacccaactgggtcggtagcatcgtcacagaacagaacaactcactcgttctggcatacaactatgcctatggaggcgctaccgtcgatgcaaacatcatcaagccttaccaggataccgtcaagagcatggtcgatcaagttaaacagttctccgactcaatcgccagcaagcctagctatgcaccatggaatgcgcagaatgccgttgcaggcgtttggatcggtgtcaacgatgtaggaaactcgttttatcttggaaacatggcggatatcactgagagagcggtttcgagatactttgagctgctcaaggttatgtataacgctggactgcgaaagtttgttctgctcagtgtaccgccaactcaactcaccccaaccatgatcaagcaaggtcccgattccaacgcgatgttggtcaagtcgatcaacctctacaacagcaaaatcgcttccaagctgcaggcattcaagcaggctaattccggcgtcaaagctatcgttgttgacacctccgtttcattcaacaaggcaatcaagaatcccactgcttacggggcaccggatgctacatgctttaacaacaatggaaaatcatgcttgtggttcgatgattaccaccctggcatcgcgattaacaagcttgtcgcagaacaggtggcgactgcccttgaaaacaacggctttggatggtaaattatttgttcaagggtgctccagtggatttagtgtagcagatacttgtcatcaatcggggtatttagtcaagggatccgttcagttagttaagacatcccatgtaaaattgatcccacaatcggattacagg

SEQ ID NO: 377 - DNA, 319 bp, Triticum aestivum
  Clone ID: PAT_TA_377
gtcacccgcgatgcaaatcactcctgccaggaggacgcacctgccatttccagtagttcgtctttctctctgactcggaggggcatcagccatgggagatcaggaggagcaggggaagaagattggcggcgatggcggtgggaggacgaacaagtacgcagtcgcctgctccgtcatcggctccatcatctccatcctcatgggctacgacaccggcgtgatgagcggcgcgatgcgattcatcaaggaggacctccggaccaacgacacgcaagtgcaggtcctggccggcatcctcaacgtctgcgcgctcgccggc

SEQ ID NO: 378 - DNA, 902 bp, Triticum aestivum
  unsure (1)..(902): unsure at all n locations
  Clone ID: PAT_TA_378
cctttcttaatctacaaatggtcttggatctaaaattcgttccttaatcaaatggagtctaaataagctcgactgtcccgtgcgaactagtttagttgccgtccttagttgtttctcaacaagctactcataccaactatcgtccatcttttacatattcaccatggctgtccgcgatagtctcggccccgtgatggtcgcattcattgccatcgacggcgttattgtccttgctcgtcttggtgtacggactaaattgactacactcggatatgatgactatgttatcgtggtagcaatgctcgctttcattctcatgtgcgcctttacattcgtttctctccactacggattcggtgtagcagatcccgcagtcattgccggcatggcccactacaatgtcatggaagcccagcgatactttaccatcgcccagatcacatacgtcgccgggtttcccatcgttcgaatcagtgtagccctggtccttcatcgaattgtacagggctggcctcgcacgcaacaattacttgtggggagcatggtagtcatcggcatctacgctctgggctgtcttttggtcgatgttttccaatgcatcccactcaaagctgtctggggagatggtaccggcaagtgtcttagttcgaagcaactggcaggtctaggctttgccgtggccgcactggatattgcatccgctcttttctacgccatattgcccgttttccttctcaagggcttgcagatgggtagaagaaccaaggttgccatcatcatactacttggtcttggtgcttcgaccgtggttatcagtttcattcgaatgaagagtctgatccagatttgtcatgccaagaatattccccngagcatggacaagcagctggagtctttcatct

SEQ ID NO: 379 - DNA, 1536 bp, Triticum aestivum
  Clone ID: PAT_TA_379
gccggccggttcgggagatcatcacacaaacacttcccgttcccacgcacgcacgcgatggccacctccgccgcgcctgcgtcgccgcacccgcacgccctcttcctcccctacccggcgcagggccacgtcatcccgttcatggagctcgcccaccgcttcctcgaccgcggcttcgccgtcaccttcgtcaacaccaggttcaaccaccgccgcgtcgtcgcagccgccgccggcgcgacgacggcgtactcatcagaaggaggaggacggctgcgtctggttgcggtcgacgacgggatagacgacgccggggaccacgagaacctcatcctgctcaacgccgccatgcaggaggccatcccgccgcagctggaggcgcttctcgacggcgaggacgcgaccggcgaggggctgggaaaggtgacatgcgtggtcgtcgactccggcatgtcgtgggcgctggatgttgtgaggcgtcgggggctcccgtcggccgcgctctggccggcgtctgcggccgtgctctcggtgctggtcaacgccaagagactgatacgcgatggcgtcatcgatgacgacggagcacccgttaacttgaagaacaactcattccatctcaacgagtccgcagcgtccatggacgcgaccttcctcgcctggaattacatgggcaaccgtgacgccgagcgcctggtgttccactacctcacctccaccgcgcaggccgccgctgagaaggccgactttctcctctgcaacacattctccgacatcgagccggccgtcttcaccggccccacgccggctaccatcctcccaatcggcccgctccgcacatggcaacggccgacgagacatgcgcccgtggggcacttctggcacgccgacgacgacgcctgcacgtccttcctggacgggcaaccccgcggatccgtcgtgtacgtggcgttcggaagcatcagcatcatgaccgcggcgcagcttcaggagctcgcgctcgggctcgagtcgtccggccggccgttcctgtgggtcgtcaggccggagcaggccggcaagctcccagccgggtttgcgggcgccattgacgggctcgggaagggcaaagtggtcggctgggcaccgcaggagcaggtgttggggcaccctgcggtgggctgctttgtcacacactgcgggtggaactccacgctagagggcgtccgcaatggactgccgatgctgtgctcgcggcactggtccgaccagttcacgaaccagacatatatatgtgacatctggagggtcgggctacgggttgcgtcggccgagggtggcgggctggtgatgaaggagagggtggtggagctgctggataggattttcgaggacgaaggtgccaaggaaagggtgctgaggttgaaggagatggcggagaaaaacatgagcgaagaaggcgagtcgttgaacaatttgaatgtgctgatggagtccatgggaaggtagaatctgtacctgcccgggcggccgccccgtgtcaacgttgtgtcggct

SEQ ID NO: 380 - DNA, 837 bp, Triticum aestivum
  Clone ID: PAT_TA_380
ctgtgcggcgctcgaggcggcgggccgggaccttcatcttgtcttctcgattgaacattgctattttcccgcaaaaaagaagcttcttgtcctgactagagaaccgttacttgttctcacgtctctacaagatggcatctctgcggtcgttgactgcttcccttcgctgggtagcccccgcgaggggcgtcgccgctgtgcgatatagctcttcctcgacctctgccatcgcctacaaggcacttcgtcgtcgctctgctcctcttcccgtgcgcgacaaccctcccgcctggtccgcccagtccgccgtctccaacatcctctacgagacccccgttccatctaccgttcctcctaagcgacatatcctcaactgccttgtccagaacgagcccggtgttttgtcccgcgtctctggtattctggctgctcgcggtttcaacattgactcccttgtcgtgtgtaacaccgaggttgaagatttgtcccgcatgaccattgtcctcacaggtcaggacggcgttgtcgagcaggctcgccgacagcttgaggatctggtacccgtctgggccgttctcgactacaccgccgctgctctcgtccagcgcgagcttctcctcgccaagatcaacattcttggacctgagtactttgaggagcttctcaaccaccactgtgagattgctgctggcgagtacgatgtccacaacgctcatgaggccattgagcgcagcatctccgataccgccaaggacttccacccctagcagttggctgtcagtcaggctctccgacacaagcatgagcatctcaagttcatcacttactttgctcatc

SEQ ID NO: 381 - DNA, 1594 bp, Triticum aestivum
  Clone ID: PAT_TA_381
atttgatcttatgggccatatcatgaaacacaccatgatgagagcaaaagctgctcttcaaagccttacaagggatgcacatggagttgatggttcaaaaatatacttgtatggtgagggatgggacttcgctgaagttgcacgcaatcaacgtggaataaatggatcccagcttaatatgagtggaacagggattggtagcttcaatgatagaatccgggatgctgttaatgggggtaatccatttggtaacccactacagcaaggctttaatactggtctgttcttagagccgaatgggttttatcagggcaatgaagcagataccaggcgctcgctcgctacttacgctgaccaaatacagattggactagctggtaatctgagggattatgtactaataactcatactggagaaactaagaagggatcagaaattcacactttcgatggattaccagtcggctatacttcgtccccgatagaaataataaactatgtttctgctcatgacaatgagactctgtttgatgttatcagtgtaaagaccccaatgaacctttcagttgatgagagatgcaggataaatcatttggcctccagcatgatggcattatcccagggaataccctttttccatgctggtgacgagatactaagatctaagtccattgatcgagattcatacaactctggtgattggtttaacaagcttgattttacctatgaaacaaacaattggggtgttgggcttcctccaagtgaaaagaacgaagataattggcccctgatgaaaccaagattggaaaatccatctttcaaacctgcaaaaggacacattcttgcttccctagacagttttgttgatatcttgaagatcagatactcatctccgctttttcgtcttagtacagcaagtgacattaagcaaagggttcgctttcacaacacagggccctcctcagtcccaggtgtcattgtcatgggcattgaagatgcacgagatgagaagcccgagatggctcagttagatgcgaacttctcttatgttgtaacggtcttcaatgtgtgtccgcacgaagtatccatggatattccagcccttgcttcaatgcggcttgaattgcatcctgtgcaggtgaattcatcagatgctttggtggggaaatctgtgtacgaggccgcgacgggcaggttcaccgtgcccagaagaaccgtgtcagtctttgtcgaacctcggtgttgatgcctccttggtttcaacgcaaggatctgttctacaagttgtcgaagcgaccgaagatctttctgttttcgtgttgaagtaaataataactgaagaataagagaggagaggcgctgctgcctgcggattacactgctgaaggaacaaacccaggaataagaagcctggcttatgtatatgtatgtatagtgcccaagctgccaagtcatggctttgttttctgatccattttgattttatatatcaaaaggaaaacatgtatatcgtgttataacttataagttttgtataacatgcatctattatataaggaagcataatgatttgtaaaaaaaaaaaaaaaaaaaa

SEQ ID NO: 382 - DNA, 440 bp, Triticum aestivum
  unsure (1)..(440): unsure at all n locations
  Clone ID: PAT_TA_382
ctctctgttgtccgagccgagatcctgctggatgaggctggtgacggtgaagtggcggaaatcgatgctgtgctcgaggaagctgctgagcttgttgatgactcccagcccaagaagcccagttattacagtacctatgaagttcagtacacgctgaggaggcaggacgaccgatcgtggaaaatctgcgaggctgctgtccgggacctgtcgtgatctctgccagaaggacgactaacgcatcatctcataggacacggggcagcgtctaaacaaagttccagcacattagatatctgtaggtcactagtcttaggtcagcattgaaccaattcgaatgcacgaaaccgttcgatgatctgcgttgggatgctgtagctgctcgtggtgactttgcatcaggatttgacaaatacccgcnattgctacgttagtacaga

SEQ ID NO: 383 - DNA, 1450 bp, Triticum aestivum
  Clone ID: PAT_TA_383
ctccgcagattctccgcccactgctcactcaccttcctcttcgccctctattctcttaatcaccactcaacaactcgagctaacttgcgtggcctccttgaaacaatccacacctgtttgttgatcatatgctgtaccttctggcggcgtgggacgcagctcctgcccttcctgggcatcccagagctggcctctgccgccaagatgcgcccccaggcggcgcccgccgtcgggggcctcgttgaggggggccatgcccgccaccaccgcccagggccccgccaatgccgccgccatgatccccacggtctggcaccggtgcttcgtggaggcatgtaacgggccagtcccccgggacccgacaccggccacgccatcatcggaaaagcccaccgcgcccatcaagccctccctgcgggggcttccgtccatcgacgcccgcccgcacgccccccaggcggcgtgccccgccgtccgctcctcggccgtaccctgccgcggccttcgccctgattgacgcctatcaaagacgccctcgaagggggcatgtcgaggtcgtggtctcctgcgcagacatcgtcgcctccgacgcctgtgagccgctctggttcctcatcccgcccacgtccaacctcagcgtgccggccggccgcttcgtcggcacctgccccaacacggccgagccggtcatcctcttgggcgcgcccacgatcgggcgctccgaccgctcctccttcgtcgccgaccgcctcaacaccccctccgacatggacggcggcctcgccgcgttcctgagcgggccagcgcccggcccacccgacgccgggcggcaccgacccgacggtgatgcgggacgtggtgacccccaacaagctggacaggcagtactacaagaacgtgctatcgcacacggtgctcttcacctccgacgcggcgctcatgacgtcggcggagacggcgagaatggtggtggagaacgccaaaatccccgggtggtgggagggacgggtcagggagggcaagggtgagagggcccgcgtccaggacaagaacggccgaccagcgcaagaccaggtagaggtgccgcgccatccactacgaccactaagtggattgctggcgccgggatcgcgactggtggacagggccggatgcaaaaacactggttctcgatcaataactgcttctatccgcaactgtactccaattgatgatgtaagttttggcatgtttatcaatgcctccatttttatctttggtttttccttgcgttcaattctatgtaagatactgtccggttcctgtagctgtgtgtgtgtatggccaattgcgttcgtctctgcttagttctagcaataaaatggactcaatcgggaatgttttagcgaaccaatgtacttttttgagagaatatgtgtcatgcacgttgcgtgttttgaaaaaaaaaaaa

SEQ ID NO: 384 - DNA, 824 bp, Triticum aestivum
  Clone ID: PAT_TA_384
gccggccggtccgggaaaaaacggaagcacccggttctaattccttcacttcatttattcattctctcttttaacttatatacaccctctttcaaatacattcatttcaaaccaagcaatcttttgccaccatgcgttctttcgctctcctcgccctggtcggccctctcgccgtgagtgctgcttctggaagtggtcactctactcgatactgggactgctgcaagccttcttgctcttggagtggcaaggccaaagtcagcgcccctgctttgacttgtgacaaaaaagacaaccccatcactaacctgaacgccgtcaacggttgtgagagtggtggttctgcctttgcttgtactaactactccccttgggctgtcaacgacgaccttgcttacggtttcactgctaccaagcttgctggtggcactgaggccagctggtgctgtgcttgctatgctctcactttcacgaccggtcccgtaaagggaaagaagatgattgtccagtccaccaacactggtggtgatctcggtgataaccactttgaccttatgatgcccggcggtggtgtcggtatattcgatggatgcacctctgagttcggcaagcccctcggtggtgctcagtacggcggcatctcttcccgaagccaatgtgacagtttccccgagctgctcaaggatggttgccactggcgatttgactggttcaagaacgccgacaacccagacttcactttcgagcaggtccagtgccccaaggagctcctcgccatcagcggctgcaagcgtgacgacgactctagcttccctgccttcagg

SEQ ID NO: 385 - DNA, 874 bp, Triticum aestivum
  Clone ID: PAT_TA_385
cggccgctcaggcggcgggccggatcgcttcatccattctacacatcatctgccacaatgtcctcaccaaagccaccaccaagcggcgtatgggcgcctgctatcacattttttgatcatgacaccgatacactagacaccgtttcgcaggcggcctattactcatatctttccaagacgggtctagcaggccttgttgtcctcggtacgaacgccgagaccttcttgttaacgcgtgaagaacgcaaagagttattgcaaacggctcgtcaagcatgtgggccagactttcccatcatggctggtgtcggtggacactcaacgaagcaagtccttgaattcatcggtgatgcagctgacgctggggccaactatgtcctgcttctacccccagcttactttggcaagcaaacgacaccagaggttatcaacaacttctttaatgatgtggccaccaagagccagcttccaatcgtcatctacaactttcctgtcgtttgcaacggtatcgacttggactctgccactattgctaccttggccaaaaagtacagcaacatcgtcggcgtcaaactcacttgcggagctgtagccaagatcacacgtctttcagctgagcttccagaggaacgtttctcgatctacggcggtcagtctgacttcttgatcggtggactcgcggctgggtcccatggcaccattgccggcttcgccaacgttgtccccaagacgatagtacacatttacaacctctatcaagagggcaagttccaagaagctatggctctgcataagaaagcagcactcgccgagcaacccctgcagggcggtatcgcagcagtcaagtacgcagcaacacttagcactgcaaagg

SEQ ID NO: 386 - DNA, 838 bp, Triticum aestivum
  unsure (1)..(838): unsure at all n locations
  Clone ID: PAT_TA_386
acctcaactcaccctctttcggccacgcaactattgcatttggacctgtcgcttttgatcagcgcgggatatttttggtcgttcagctcctactctcccagcccagaacaacctcttagcgatcaaccgttgttatcacaatcgagatggatactgttatcaacatggccgatgccgcacacgcactggatcttgctcggatccggttccagctaattcgactcgaggacaccatcaccttccatttgattgaaagagtgcagttcgccttgaacagtacaatttatgctcctggagctgtcgagctgccagaatcgaacctgagcttcctcgactggtacttccgcgagcaagaaaagctgcagtcccttatccgacgtttcgaatctcctgacgaataccccttctttcctgacgctctacagaagccaattctcaagcctctaaactaccccagaatcctgtacgagaacgacgtcaatgtgaacgacaagatcaaggcattctacaccgaaaagttccttcccgcagtgtgccccgacttcggccgggaggagcggggcgagtcccaagaaaactacggctcaaccgcaacttgcgatattgcttgcctacaagccttatcacgacgtatccatttcggcaagtttgtcgccgagtcgaagttccgttctgagcaagagaaatacatccgtcttatcaaggcagaggaccgagagggtatcgcagagtccatcaccaatgctgctgtggagaaacaggttcttgagcgactacggcttaaggctttgacatacgnaaaagacccagtatcccagatgggacagaaggagcggca

SEQ ID NO: 387 - DNA, 856 bp, Triticum aestivum
  Clone ID: PAT_TA_387
gccggccgggttcagatcttcattccatccatcaccctcctatctcacaacatcattttatctgcctaccagactggtttctgttggctccaattgtgtctgatacataaacattttacctaagaatacataccaacaagtcaacatggctatcaagaaggtcttcgcccgctccgtctacgactcccgtggaaaccccaccgtcgaggtcgacgtcgtcaccgagactggcctccaccgtgccatcgttccctccggcgcctctaccggccagcacgaggcttgcgagctccgagatggcgacaagtctaagtggaacggcaagggtgtcaccaaggctgtcgagaacgtcaacaccgtcattgcccccgctctgattgagaagaacctcgatgtcaaggaccagtccgctgttgatgctttcctcaacgagctcgatggtaccaccaacaagaccaagcttggtgccaacgccatccttggtgtttctctggccgttgccaaggccggtgccgctgagaagggcgttcctctgtacgctcacgtctccgacctcgccggaaccaagaagccctatgtcctccccgttcccttcatgaacgtcctcaacggtggttcccacgctggtggccgcctcgccttccaggagttcatgattgtccctactgacgcccctactttctctgaggctctccgccagggtgctgaggtctaccaggctcttaagggtcttgccaagaagcgatacggccagtccgccggcaacgtcggtgacgaggggtggtgtgccccctgatatccagactgctgaggaggctctcgagctcatcaccgacgccattgagcaggctggcta

SEQ ID NO: 388 - DNA, 1037 bp, Triticum aestivum
  Clone ID: PAT_TA_388
ccgcgccgcttcgagccggccgggccgggatccttcaccttttatccctaaaggcaaaaaactaatccaacaacccacttagaatacataccaacaagtcaacatggctatcaagaaggtcttcgcccgctccgtctacgactcccgtggaaaccccaccgtcgaggtcgacgtcgtcaccgagactggcctccaccgtgccatcgttccctccggcgcctctaccggccagcacgaggcttgcgagctccgagatggcgacaagtctaagtggaacggcaagggtgtcaccaaggctgtcgagaacgtcaacaccgtcattgcccccgctctgattgagaagaacctcgatgtcaaggaccagtccgctgttgatgctttcctcaacgagctcgatggtaccaccaacaagaccaagcttggtgccaacgccatccttggtgtttctctggccgttgccaaggccggtgccgctgagaagggcgttcctctgtacgctcacgtctccgacctcgccggaaccaagaagccctatgtcctccccgttcccttcatgaacgtcctcaacggtggttcccacgctggtggccgcctcgccttccaggagttcatgattgtccctactgacgcccctactttctctgaggctctccgccagggtgctgaggtctaccaggctcttaagggtcttgccaagaagcgatacggccagtccgccggcaacgtcggtgacgagggtggtgttgcccctgatatccagactgctgaggaggctctcgagctcatcaccgacgccattgagcaggctggctacaccggccagatgaagattgccatggacgtcgcctccagtgagttctacaaggagtccgagaagaagtacgatctcgacttcaagaaccccgagtccgacccccccaagtggatcacctacgaggagctcgccaacatgtactctgagctctgcaagaaagtacccatcgtctccatcgaggaccccttcgctgaggacaactgggaggcttggagctacttct

SEQ ID NO: 389 - DNA, 849 bp, Triticum aestivum
  unsure (1)..(849): unsure at all n locations
  Clone ID: PAT_TA_389
gcggccgctttcgaggccggccgggtccggggatacttttgctctaacttacaacactgagtggcttgatgagcctttccgcgatctcgaagaagcatcgagcgcattacgaagactagatgttgagacggtcgaattgatagcacaaatgccttgcgatgacggtgtttccggaggtttcgaaaatttggacgtggttgaaaaagcactcatggaagcatcatgggaccagcttgaacaaaggttccacgcgtggagcaggcggtttgaattgaccaagaaacacatcgctacgtgggaataccaagagtggacatcaccacatcttatgtatctcaatttgcagcagcagttctggaagatgagcatgactctcgagctggacgacgattcagagccagatcctcggaccgtcgaggcttacctcgatgctgcggaaacttttgcacaaaagctgatcataccgggccagcctagcttctccctcgacggagatttaatctccagtctatcctttgtcatatggtgctgctccgagtcccatcaccgctaccgcgcactgaatatccttcgaggtctgaacaggagagagggtatatgggacagcaaagacctcaccgagctgcacgaggcagcacttgagatggaaaatccaaggagtggtataataagatgattcctggtggcgtgcctggctttatggccgaactagccaagagatcttcaaagtacgggctgcataggtctaggctattgatggagaatcatgatagtgngtatgatgccttgtattaatgtacaagtctcaaggatcagatggaagcgcaataattcaagatattatacccc

SEQ ID NO: 390 - DNA, 855 bp, Triticum aestivum
  unsure (1)..(855): unsure at all n locations
  Clone ID: PAT_TA_390
ctgtgcggcgctcgaggcggccggtcggaaagcaacaccatcgaaaatccctacaacacagctcccctcctcgtaaccaattcccgcccgatcccctcctcactgtcgaattacactttatcaacctgaccagataaatcattcatcatgacgtcgataggcacgggttacgatttgctcaactccatcttctcccctgatggacgaaacttccaggtcgaatacgcagtcaaggcagtggaaagcggcggtacttcgatcggtattcgagctaaggacggtgtcgtcctagctatcgaaaaggtcgtctcatccaagctcctaaaacccggtgccaacaagcgcattgctacagtcgatagccatgtcggtgctgtatcatccggtatggttcccgatggacgtcacttcgtcgaccgagcccgtgacgaggcccagagctggcgacagaacttcaagactcctattcccacatccgatcttgccagccgcatgggtggctacctccaagcctacaccatgtacggatcagttcgaccattcggtatcaccgccatcctgggcggctacgacactcccgaagagaccccagtcgatggcgaggtgggatcaggacccaaggtcggagctggcggcaaggttgagggcaagcacggcgggcccttcctctacatgatcgagcccagcggaatgtactggggttactacggagcggccacaggcaagggtcgacaggtcgccaaggctgagcttgagaagctcgacttggccgnccgncacatgtctctggaggatgccgtgaagcaagcggngcgcatcatctacatcgcgcagaaggataacaaggataaggac

SEQ ID NO: 391 - DNA, 908 bp, Triticum aestivum
  Clone ID: PAT_TA_391
gccggccggttcgggcgcgctcgccaaactcaactcaactctttaaaacacattggtttcaacacacatataatcaatcaatcaatcctattcaactactccctcacataacacacttcccaccaaaccgtcccaactactcccttcctcattcaacatcatgtcttcccaaagcactgcccaatacttccccaagatctattccctcacctctgttgatcatgctcgctccgtctacgacgagtgggcaaagacctacaatgaggaaatcactggcaagggtcaagactatgtcggccctgccattgctgctgcccatgttccccaagccctaggaactcccaccatcagccctgacgtcgagattctcgacgctggctgtggtactggcctcgtcggtattttcctcgctcgtcttggcgcaaagaagcttgacggtgtcgacctgagtcctggaatgctcgacgaggcccgcaacactggagcataccgcaacctggacgtgacagacttgtctcgtcccttgtccgcaaagaatgactcttatgatgtcgtgacgtgtgttggcactcttacgcagtctcacgttggtcccgaggctctcagtgaattcgtgcgtgtcgtgaagcctggcggctacatcgtggccactgtcatccgtgagatctggcagaccggaggctacgagagccacgtgaaggcccttgccgagcagaacaaggtcaaggtcttgtccgctgaagttcaggattaccgaaggggagccggagcccaagcttactacctcgtcctgcaagtgtctgcgtgagtgactcgctgacggtgacgctgatggtgactctgatgatgatcatgacgacgacgatgatgatacgtgtgcctggcctcggtttcttttacctcttttg

SEQ ID NO: 392 - DNA, 905 bp, Triticum aestivum
  unsure (1)..(905): unsure at all n locations
  Clone ID: PAT_TA_392
nncgtccggaaaaaaaaaaaaactcgcaaagctcacgcgcacacggcagaacccaatcgcagcgcaccccccctgacccgaccggatcgagcctcggccgagggcatgggcggagcaggcgacggcgagggggccgggagcgagtccccgccctcgggggcgcgggcgacgctcaacatccggtgcgccaacggcgccaagttcaccctgcaggccgacctgggcgagacggtcggggcgttcaaggaggtcgtggccgggagctgcgacgtgccggcgccgcagcagcgcctgatctacaagggccggatcctcaaggacgagcaaaccctagaaagctacggtgttgagacagatcacaccattcacttggtgcgaggcgttgcccaaccagcagcatcaggagcacctgctgcagcaagcccccaagcttcaaccactcctaccagtggccctgcaggtggtcttggaggcttatttccaggccttggtgctactggagctgctagtggcaggccagcaggtttatttggggctggacttccggaattagatcaaatgcagcaacagttgagccagaatcccaaccttatgagggagataatgaacatgccaatgatgcagagcctcatgaataaccctgatctaatacgcaatatgattatgaataatccacaaatgcgtgatattattgatcggaatccagatcttgcccatgtcctcaatgatcctagtgttctccgccagacccttgaagctgcaagaaaccctgaaattatgagggagatgatgcggaacacagacagagcaatgagcaacatcgaagcttcccctgaagggtttaatatgctccggcgtatgtatgaaactgtacaggagccttttcttaatgcacaacaatggga

SEQ ID NO: 393 - DNA, 695 bp, Triticum aestivum
  unsure (1)..(695): unsure at all n locations
  Clone ID: PAT_TA_393
cgtccgctgacccacagtcaatgaaccagttgcttagcatgaacccaaatgcacgtagcctgatggagtcaaacactcagttgagggatatgttccaaaacccagaatttcttcgccagatggcatccccagaggctttgcagcaattactctcattccagcagacactgtcatcacagcttggccaaaatcaacctagccaggctggtaacctaggaggcaatggcacaggcacgcggggaaatgttggcctggacaccttgatgggcatgcttagtgggcttggtgctggaggtggcttaggtgtaccaaatgcctccaatgtgccaccggaggaactctatgcaacgcaactcggccagctccaagaaatggggttcttcgacaccgcagagaatatccgggcgctgatggccacttctgggaacgtacatgctgctgtggagcgccttctcgggaactttggctagtagataaaacgagccagatactgcccgtaatctccctgttttagccaacaggcagtgtccgtctacagtaaaaaagacagaataatacagttaactttttcccgtacatggtcgtcatgcctttgttttttcagtgttgtattgacaatttggattgatgtacatacatcagatgatccggtgttaccgcaaagaatgtggctctagttttccttttaanaaaaa

SEQ ID NO: 394 - DNA, 3975 bp, Triticum aestivum
  Clone ID: PAT_TA_394
cgtccgaagtgaagaagaacctgttgtttatgctactaagttggaagcaaagaatgcattcaagtccctgcttgaatcagcaaatgttcagtctgattggtcatgggatcaggccatgagagttattataagtgacaaaagatatggtgctctgaaaactcttggagagagaaagcaagctttcaatgagtacttaaaccagcggaaaaagattgaagttgaggagaggcgtgtcaagcaaaggaaagcacgtgatgattttctcacaatgctggaagaatgtaaggaccttacatcatcactgagatggagcaaagcaattactatgtttgggcatgatgaaaggttcaatgctgttgaacgccccaaggagcgtgaagatttatttgagaactatctcgtggagctgcaaaagaaggaaaaagcaaaggctgctgaagagcacaaaagacgcatagcagaatatagagaatttcttgagtcatgtgatttcatcaaggcaaacacccagtggcgaaaagttcaagatcggctagaggatgatgaacgctatgcccgacttgagaagattgaccgcttggatgtttttcaagactatataaggcatcttgaaaaagaagaggaagaacagaagagaattcggaaggagcaattaaggagacaagaacggaaaaaccgcgatgagtttcggaagatgatggaagaacatgttgctgatggcacacttaacgcaaaaacttactggcgtgactactgttcacagataaaagattcacgtgcttacctggcagttgcttcaaacttgtctggctcgatgccaaaagaactctttgatgatgtcatggaggagcttgataagcagtatcaagatgacagggctttaattaaagatgaagtgaaatctggaaagattcctatgttggcctcatggacattagaggacttccaagctgctgttactgaggacgaaaaatataaaggagtgtcgaacataaatatcaagcttatttatgaggaccaaattgaaaggctcaaggaaaaggatctaaaggaggccaagaagcgtcagcgactgggtgataattttctggatctactgtattcaatcaaggaaattactgctgcttcaacatgggatgattctaaatcactatttgatgatacccaggaatacagggatctgggtggcgagacatatgctaaagagctttttgaagagtatattgcccgcctcaaagaaaggcttaaagagaaagagcgcatgagggaagaagagaaggcgtccgtctctccgagcaagggaagggagtcggtaagagggaaaaaaaaactcgcaaagctcacgcgcacacggcagaacccaatcgcagcccacgccccctgacccgaccggatcgagcctcggccgagggcatgggcggagcaggcgacggcgagggggccgggagcgagtccccgccctcgggggcgcgggcgacgctcaacatccggtgcgccaacggcgccaagttcaccctgcaggcggacctgggcgagacggtcggggcgttcaaggaggtcgtggccgggagctgcgacgtgccggcgccgcagcagcgcctgatctacaagggccggatcctcaaggacgagcaaaccctagaaagctacggtgttgagacagatcacaccattcacttggtgcgaggcgttgcccaaccagcagcatcaggagcacctgctgcagcaagcccccaagcttcaactactcctaccagtggccctgcaggtggtcttggaggcttatttccaggccttggtgctactggagctgatagtggcaggtcggcgggtttatgtaggtctggcttccggcacataggtcggagcatctgccgaaggtttggaggaggccaccaagacggggacagctctagggtacctaaattacattgcctaaggaagaaactgaacctgaatcccaacctgatgatggagatactaaaaatgccaattatacagaatcgcaatactaatcttgctcaagtcctcaatatgcctatggctcttcggcacatgcttgaagctgcaagacaccttaaaattgttagggagctcctaaatgatccaggcagagtaatgcggaacatcgaagctgccagtaacgcaacattgaagcttcccctgaagggtttaaataggcctccggcgtatggaatagaaacgtgaaggggggagcctgttccgtcattgctataacactgtgaaggcgcttcttggtaatgcagcccctacccaagcgggcggtgaaggcaccccggcctctaacccgtttgcagctcttcttggaaatcaggggcctaaccaagccggcaatgctgctacaaatgctccaactaccggcccagagtccacaacaggaacccctgttccaaatactaatccacttccaaacccctggagcaacaatgctgggggtgcgcaaggaacaccacggtcaggtcctgctgctagtaccagggctggtgcaactggtggcccaggagggctgggttcagcagatttgagcagcctgctcggtggtcttggtgggaatgcaagaactggtgctgcaggtggtctaggagggttgggttcagcagatttgaggagtatacgtggtggtcaaactgatgctgctattttgagtcaaatgctgcaaatccctgctgtgatgcagattcagaaaaacattatgtctgtccctccctcaatgaagcatttctttggcatgaacccaaaccacacgcattctgacagtttctcacactccagcaggcgatgtcttcacaacctgacaaaaatttacctaaccaggcaggccaacctggggggcaatggaactaggcacgctggagaatgtcggtcttggcacaccttgatgggcatgattacgtaggcatggtggtgtaggtgactaagctgtagcacatccgtcacgcgtggggcaaaagggtcggtattcaacacccttcggtgggcatgcatagaaaggggcttcgttgcacgctgctggataatatgtgggcaatggatggccacttttgggaacctacatggtactgtgtagcgccttatctggaacttcgcccaatgaaaaggatgtgccatgtgcagcccgaagacaacctgctttggcaaacatgcagtgtccgtctaaaggtaaatactgacggagtaataccgtttacggtatcccgtcaagtggacaaaaatgcctttctttttacaggtagtgtagaagaaataggaattgatgtacatacatatcaaataatccaaagacacagcaagacacgttgacttggtcccggacatggaaaaagaaaaagaccggtcaagaagtgatgaaatggatattgatgatgatgtggaaattcatgcctcgaaagataagaaacgagagaaggataaagaaaagaagcataaaaggcgccaccatgacaccacagattctgaaagggatgagaaggatgaatcgaggaaatctcgaaggcatagcagtgatcgcaagaaatctaggaagcacacccatgcttcagactcagatagtgaaaaccggcatagaagacacaaaaaggatcgagatagttcccgcaaaaatggtgggcatgaggagcttgaagacggtgaacttggagaagatggggagatccattaggctttgcttttacctccaagatttgtcagtacctaccactgtcccttgtcatgttctcaattgctgctattttgtcttattctgcttaataactgactagtgttataatgaccgaaaacaaatccttgggccgcaaagtcgagcgtctcaatagcttcccgacggttacccaccgccacgcccacgatcttctgagccttagcgaccaagagaccagggaaagcaccggcaatagcaacaaagtcgccctcgggaataccaacgcagaccagggtacctcggccgcgaccacgcta

SEQ ID NO: 395 - DNA, 811 bp, Triticum aestivum
  Clone ID: PAT_TA_395
gccggccgggtccggaatacttaaccatctgaagccgaattaacaattgattaactagaattattttcatacccgcaaattcaaaccgatatcatggctaccggagcgcagtctttctacgagctttaccgacgaagcagcatcggtcttgctctgacagacacgctcgatgatctcattagtgaagagcgcatcaacccccagctcgccatgaagatcttgggcaactttgatcaagccatcaccgaggcgctgcagaagaacgtcaaggcccgtcttcagttcaagggaagcctcgatacgtaccgattctgcgatgaagtctggactttcctaataaagaacgtgacattcaagatggatagcggaagtcagtctatcacggcgaacaaggtcaagattgtcagctgcaatgccaagaagcctggcgaaggacaataggatatgccgatgagtaatggtggaaaacgaagcaatactcggaagggcaaaaagcaacaatgagattaacaaatctcacgtccaacgaccaccgatcatgagctacgagaatgcgggtatacagcagtcaaagattgggcaactactgaaagattggtttattagcattgggtggcgtctcggatatggctattctcttttaacaacatggacgcaatattggtggtggtggcataagatacggagctcagcacacgcaaagacaggctcgttggacgcattgttaagacagaaatacctaagaatgacatgatgatatttgattaatttatttcttcatttgatagaaaaaaaaaaaaaaaaggcccta

SEQ ID NO: 396 - DNA, 515 bp, Triticum aestivum
  Clone ID: PAT_TA_396
gccggccggtttcaaaagctactcacggagagcctcgcgaatccggcaagatgctgctgcccaattctcgccgcttccttgctcggcttcttgccgtcctcacgttgctactgctaaccttcgtcggtggccatgcacgtggtctaggtcgaagctgcgatacttttcagaacccaaccggctgctcaagtttgccctctccaaactgtcctgaatgtggtcgacggtaagcgccttccgttttccttgataatgggacgtgcgaagattcttcagaccgcccaagtgaggatagagcagggctcactccgatcggagcatatgtggacggccatggtttactatgatgatttgtacgtacaaatgaaatgttgatcgttctacaaaaattgtttctatttctcgataatatgataagagaatatgaacttatgaaagccttaattttgaatacacacgagtgtgcgtactaaaaaaaaaaataaaaaaaaccaaaacaaaaaaaaggcccctaa

SEQ ID NO: 397 - DNA, 1479 bp, Triticum aestivum
  Clone ID: PAT_TA_397
gccggccgggccgggatcagaaaaatgaaagaggccggcatggttggcgtcctgccctgcctcctcctcctcctcttcctgaagccgcgcgccatcgctgccgccgccgccgcctactcggagtactcgtgcaatggcaccaccggcaactacacggcgcgcgacgccttcggggccaacctcgcgcgcctcaccgccgagctccccgccgacgcctccacctctccgtccctctacgcctcggcggccatcggcgcctcccctgacaaagtcttcgccctcgcgctctgccgcggcgacatcacggacgccaggacgtgctccggctgcctcgacaacgcgttcacgcagctgcgggcgctctgcgccggcgagagggacgccacgttcttccacgacctctgcaccctccgctactccggcgaggacttcctggcgcggccggacgacaacaacccggtcatcaacgccatggacgtgaacgggtcgacgtacgccgcgtgggacagccggaacgccacgtcccggagcttcttcctgtctctggtcggcacgctgttcggggagatgtccatgtacggcgcgtacaactcgtcggtgcgccggtttgccagcgccgtcatgtacatcaacccgcagctgcccacggtgtacggcctggcgcagtgcacgccggacctctccccggggcaaggctggcactgcttccagggcctccaggagcagacccgccagtggtacgacggccgcgagggcggccgcatcgtcggcgtccgttgcaatattcgctatgaaggctaccagttctacgacggcatggccaacgtcaggatcggcacacccggtggctcatcttcaccaacagaaagcaatggaagcaagcacatgcagaccctaataatcgttttatgcgtgtccgttacggtgctctgttctatgttggttggctgccttctcctcatcagaaggctaagaaaaggagctggaaacacgaaattagaacaaggtcataagaggaacaactcgaagacagaggaggcgctgaagctgtggaagatcgaagagagcagctcagagttcaccttgtacgacttccctgagctcgccgctgccacggacaacttctccgacgagaacaagctcggacaaggcggcttcggtccggtttacaagggaaagttttctgacggagccgaggtggcggtgaagaggctggcggcgcagtccgggcaggggcttgtggagttcaagaacgagatccagctcatcgccaagctgcagcacacgaacctcgtcaagctcgtgggctgctgcgtgcaggaggaggagaagatgctggtctacgagtacctgcccaaccgaagcctagacttcttcatcttcgaccaagagcgaggtccgttgctggactggcagaagcggcggcacataaatggaagggatcgcgcaggggctcctataccctgcacagcactcccc

SEQ ID NO: 398 - DNA, 778 bp, Triticum aestivum
  unsure (1)..(778): unsure at all n locations
  Clone ID: PAT_TA_398
gccggccggtccgggacttattcttacacaaggggcgtggctgtggtctggattcttgacgagtacgtacgtttggggcgccatggccggcgggggagggaaagccaagccgctcgagttcacgccgacatggatcgtggcgttggtctgctccgtcatgatcatcatctccctgctcttcgagcgcttgctccaccgcctgggcaagaggctgataaggagtcgcaagaagccgctgtacgaggccctcctcaaggtgaaggaggagctgatgctgctggggttcatctcgctgctgctcaccgtgttccagggccccatggggaagctctgcgtcagcccgagcgccatgctccacctgcagccctgcaagccgccgccgcacgagacggaccacctcggcggcgccgtgttcaccggcgggtgggcggcgggggagggggctcatggccggcggaccctcctcctccgacgaatactgcctcaagaaggacaaagttccattactttcatctgacgctattcatcaattgcacatatttatcttcgtgttgacggtcacccatttccttctcagtgctattacagttcttctaggaattgcacagacaaggaattggcgacattgggagaccaagatccaagaaaataatgacagtgcacctcaaatgatcaagcatgttcaagaattcaaatttattcaagaccacttcaaaagtcatagaaaaacggcgagaatatttggttggatgcgnttccttcttcaacaattctatgg

SEQ ID NO: 399 - DNA, 866 bp, Triticum aestivum
  Clone ID: PAT_TA_399
gccggccgggtcggccctgaatacggcggtcgaaaaaaacgacagccatttttctggaccaactcgatcattgagttgcgcagccagcaagatgctgaacaggtcaatcatgccggcccttaggccgtttgcgaatttgcgagtgtctcttgcacaccctgcaccccaataccgacgcttcagtgcaactcctacccgatgcttgagtgctgtcttcgcagagacagaaaaccccgagctgaacaaagtccttatcgatgttcaggagaagatcattcttccagcatacctgcccgagacacagagaaagattgtctacaacactagcaagggcgactacatgcgacgcaaccccatcgttatcgagcttgatggccttgagcatacattttcgccaatcgatataaagaaagacatcccaaattcaaagacggcactcacagacgcgaccaagctgatgaagaccaaggaggaatgggacaacatcggtacattccttgctggctaccagaaggctgggattaagctagatcaggagcactatatgtccttgattcgaagggcatgcgcctcccagcaggaatactctatcatcgagtgcgccaagcaggctgacaagactggccttactctacaccgcgattcctcaattgccctcttattgtcatccatcaaccaaaagatctacaactcagcgcgagaagatggagacacgttgcaggcttttaaatggaaccgcctgatctgggatattatacaacggccagagcacgtacagcgccgtagctcagacagtaagctagcttgcggaagccctgttacccgaggacttcttctcttcactcaagcacatgcaatccaagcac

SEQ ID NO: 400 - DNA, 813 bp, Triticum aestivum
  Clone ID: PAT_TA_400
gccggcctgtccgggctctcgaccagatcgagcagcagctcgggcagggcagagcgaacgccgccaccaccactcaacgccggcctcccccacagccgccgccaccacccgcgccctccaccacatctggcgcacccaccccttccatcccctcctcaccttctccccaccaacgacgacctcctcccctcttcctcgtcacagatcgaccagcgggtccggatctgatgcaggctcagatccggcacacccgcagcgcttgttccacttgaggacgtcatggacatggtgctctagcactggtgctgcagtcatggacaaggagattatcactctctacctctctgtgttgaattaagttggtgttgctgcaacctcaacgcccaaataatcagccctaaccctagcccttccttgggcatggaaaccaagcagacgggaggtgcatcacaggttgctaccatctaatgtgtggagagagccgaggagaatatgctccgttaccatcttgtgaaggaggatgttcaccatccaaggtgctcaacatcaccatcatctctcgcttgccaagggccaatgcacagcggcccaagctgttcattggaatgatcctcatcattatccttaccgaagctctttgccctgtacgacctcatcgtcggcatcatcttctcttctacggttctaccttgtgtccattactatctggagcatttgttttttaggataaaatacaagaccaaacaagccagcccaattgtcgggatgctggatatagtggttggagtggtgcagcggcgtcgtggcagcgga

SEQ ID NO: 401 - DNA, 549 bp, Triticum aestivum
  Clone ID: PAT_TA_401
ggttggcaaaagcatcaccaaggccggcaagtttgtcggccggactgtcacagggccttttatcagccaaaggcgtagcgccgcaagcgtttttttggtgaatgaagaacaaatctttctacttatgttgcggacgcgtgggtttttttttttttttttttttggcaaaagaaaggaagacaaaaattgattgatctcagcgaacaattaattagggaggcataattaaataaagcaaaagaaaaagaaaagcgtgacacatatagatcagcacgtacgcattattagtttattacaactgatcgatcgagggaaagagaccatggcgacggacggatggatcattcacctctctccggcgtccgggcatgcagggcgggcgatcatcgatcagtcggaggtgctgctgctgctgctgggctccggtgcatctgcagcggagggctcggaggctggggagtcggcggcgggcgcgtcggcgggcgccctggcggagggcgccggcgcttcggccttcttctcggccttcttcttgcccttggcgtcggc

SEQ ID NO: 402 - DNA, 705 bp, Triticum aestivum
  Clone ID: PAT_TA_402
ggaaacaaattgtaaagaagtggggaattttctgtttattgttcacaatcgcttcacggtacaaggctagaattgaagatgacaacaagccttatgttgagaggcaagtataactacgtacatgacattggcaaaagaaagaggaaatttgatctcaacaaaattaaacagggacgaactattcccctgaaaagaatgccataaaaagaaaagaaaagaaaatcttggatggggcggcgtggatcagcacgcatgcattattacaaacagagaaagggagagctccggttcatcatcaccagacggatcgttctctgtccggcgtccgggcatgcagggcgggcggtcatcgatcagtcggaggtgctgctgctgctgctgctgggctccggtgcatccgcagcggagggctcggaggctggggagtcggcggcgggcgcgtcggctggcgcgctggcggagggcgccggcgcttcggccttcttctcggccttggccttcttgcccttggcgtcggcgaatggcgccacggcgacggcgaccaggaggagggcgacgatgaagacagcggcgcgggccattgttggctggctggcttggttggtccggtgggagcttgctagctgcgggcaggcgcactgcttggcgatggatggatggatggatgcttgttggcttgagagatggagatggtggtggtggtgt

SEQ ID NO: 403 - DNA, 748 bp, Triticum aestivum
  Clone ID: PAT_TA_403
ttttttgaaaactttttgtaaagaactggagaattttgtcgttatgaatcacaatcgcgtcaatggacaaggctaaaaatgaagatgagatcaaatttgatattgagaggcaaatttaactccgtacaagacaaaaacaaaagaaagagcaaatttgatcacaacaaaattaaacagagacaaacaattcctcagaaaagaaaaaagtcataaaaagagaagaaattaaaaatcgtggatgcggcgatcgtgccatatatggatacaacacgcatgcattattataaacagagaaagggagagccccggttgcatcagcaccagacgcatcgatcactccgattaagaattgttctagagcgatctctgtccggcgtccgggcggatggatgggtcatcgatcagtcgggggtgctggagctgctgggctccggtgcatccgcagcggagggctcggaggctggggagtcagcggcgggcccgtcggcgggcgcgctgggcggagggcgccggcgcttcggccttcttctacggccttggccttcttgcccttggcttcggcgaatggcgccaccgcgacggcgaccaggaggagggcgacgatgaagacagcggcgcgggccattgtgggctggctggctttgttggtccggtgggagcttgctagctgcgggcaggcgcactgcttggcgatggatggatggatggatgcttgttgggttgagagatggagatggcggtggtgtgt

SEQ ID NO: 404 - DNA, 787 bp, Triticum aestivum
  Clone ID: PAT_TA_404
gccggccgggtcgggaatccgatactactcttggctttcatacttctcgtttaaatactccctgttcctcgacatctcttaggatccatccgtccacagcaactcaatcaattccacccctcatcactcacattaccccgcctccatcatgtcttacgccgatattgctgccaagggccccaagcagagccccgaggatgctgctgcccctcaacctcctcaaatcctgactgacgagtctgcttccaccgcctctctggtcgacgttgatatgcctagcgtgcacaccgtccccaacgacttccttgagcaggagatccagaccgagactcaagcagcccgcatcgagcgagaggaagaggccaagcaagagaagcgaaagcgtgactcagccgcctcaaaggccaagcagaccgacaactggctgatccagcagttctccaagctgtccgacggcgaagctaccggtctgaccgtcgccaacctggccaccgtcgtcagtctcggtgccttcctcggctacaagggctggggcctgtacgagaagggcaggctcgactggaaggccgtctcctacggtgtcggcatcctcgccagtgcagcagctgcccagggtgctgtcggacgatacctgtacaagggaaagaagggtggttcttagaaagatgatgatgaaaagtgtgaaagtcaacaaaggaacacaggttgcaaaagcccctggtgaaaactactacagagctcagatcccgaaacggccaataactctgattatgacgagattacgctg

SEQ ID NO: 405 - DNA, 171 bp, Triticum aestivum
  Clone ID: PAT_TA_405
gccggccggtccgggacagctcccttcttcctctctctgcagtgcaagctaagggacatgccgggtgtgctgaggacaacgtggccggagctgctgtcgacgacggacggcttcgccatgagggccatccaccacgaccggccagagctgcggatcatcgagatgatgggc

SEQ ID NO: 406 - DNA, 618 bp, Triticum aestivum
  unsure (1)..(618): unsure at all n locations
  Clone ID: PAT_TA_406
ctcgtgccgaattcggcggacgcacgcagtggtgaactacgagtgtgctacctaacactaccacgtaccaccatggtgcatcaagctcagggcctgctcgtgcaggaggtggccgccgacggggagctgccgagccgctacgtgctcaaggagcagcagggccgccccgccgccgccacggccgccgccgcacagcgtgccgctccatccatccccaccgtggacgtgagccgccttgccgacgctgaccccggcgaggccgacaagctccggtcggcgctcggctcctggggcctcttcgcggtgaccggccacggcatgacggacccgttcctcgacgcgatcctcggcgcggcgcgagggttcttccacctgccgacggaggcgaagcaggagtacagcaacgtggtcgacgccgacgacggcggccgcaagtttccacccagagggctacggcgtcgaccgcgtcaacaccgacgagccggtccgccgctcgtcccaccgccgccgcccaccgcggaatcgctctgcgacaccgcggactgccagtcnaaaantaagtgaggcanaagngcaaatctctacgcatgcagtgctaactnagatggtntctgcagg

SEQ ID NO: 407 - DNA, 998 bp, Triticum aestivum
  Clone ID: PAT_TA_407
acggctgtggccttttcggccaaaatcatcgtatagccgtagcaatacaaagacacgttacatcaacaaaagaagatggttcatataaagaccaaagccggcttgctctgtccaattattagccattcaaattccgtcaacagaagaaacacacacccattgcttcaacaaaagaagatggttcatataaagaccaaagccggcttgctctgtccaattattagccattcaaattccgtcaacagaagaaatacacgacgaatgctcaagtatgtattcctcgtagcaaattttggggtatccaggtctgaaagccttattcatgccctcaaggcacgatgccatcctcgatgggctgaagcaagaccttggaccttaccaaacctccggacgcagctcaccggttgcaggaggcatccatttcccagaattgtacacgctctcaccaactttccatccaggaacatttttcatgatcctcgcttcctcctcaagatacttcttccattctttgacaaatctttcatcctcttcagcttggagcatcggcagtatagcactacgggcagcaattttctcctccttgagtgcacggcggaccttgttcccctgtccgacctggtacatgccccaggagaaggcgccgaaggtggtgaggaagagggcgatggcgctggggcccttgttggggatgcggcgcgcgtagcgcacgggcgcgaacccgcccggcggcggcccgtcctgcagcaccggcatgtccttgacgctcgccatccccggcttgttccgcaccatcgactccgtcatcttggctccgatccgggaaggtcaccaccagcgcgggaggaagcggccgcggatctggagctccggcgagaggccgagcgattgggagcgcagatgtcgctagggttagtggcgggtgcgagcgatttgggggaacctggtggtgggaggaatcgcctcttcccagtgactctctcaccggctgtggctag

SEQ ID NO: 408 - DNA, 642 bp, Triticum aestivum
  unsure (1)..(642): unsure at all n locations
  Clone ID: PAT_TA_408
cgcagncctctcaagggggncttatngttcgcattcncaaggcgttctgagtancgagcgtgactcataccgagccatcagctcgcggntnggacactcggantgantacaaccggatagagtccggggccggatcacagcgtcccgtagggtgagcntggctcggctttaccgccgatgagcgtgcgcttgcggagcgggtccatccacccgtccttggcccatatgatttgctccggatttaggtccggagcggctgcaggggtggtgtcccgaatactgtccgacaacagatttaagtcatgctcatcgcggctgttcggcactcctgatgtgggcccgaatccgttgaagatcaagtctccgcggatatcgttcgtgtaattcaagtttccaaacctgacctaatggccaggggcgtagctgtcgatctactccagatggccaagcgaattggcccgcagtgcgaagccgccgaacacgaaaatctgtccggggagaaaagtctcaccctagaccgcattgttgaagattgaaggggccatcaagccttatagcgacgacacagaggaactctcaatgaaagcaccaatgtcggtgtcaaaatcggcggatcttgggtaggaggtcccgaactgtgcg

SEQ ID NO: 409 - DNA, 776 bp, Triticum aestivum
  Clone ID: PAT_TA_409
actggaatctttggaaaagcacttatacaagagcagccaacttcaccagctgatggaagccctagatttttcgactgcaattcacatgagaaggtttctcctagagagtcgctttctcctcccagcacaagttcacatgtagatgagttggatgatagatatgagggtttctccttgcttcatcttgcatgccgtgttgcagatgtggggatggttgaattacttttgcagtatggtgctagtgtaaatgtgtctgattcaagaggtcggatgccccttcatcactgtattttgaaaggaagacatctgcatgcaaagcttctgctctccaggggagctgacacacatgccatagaccgagatggcagatcagcattgcagtatgcaatggaccgttccacaagtgacgaaggcatgcttgcgttgttagaggagcacttcagataattgctgcaggcagccttcacgtcaggagtatgggcccagcaaacaaacacagagtaggctgtggcgctgtctgagttactcagctccatgttctgataagcccccagcttgtcttgctgatagtccgaagctcgtggcatgaatggaacctaaatcttcttctggagatcccgcaacatgatgatgcggtttattctcttgtccggttgttagttttagcgtgcgccggtcttatttatcatattgcaagcccgccggttggtgtttgcagatggtgcatagttattctcgatatggagtagcttcttgttatatacatcatttttcca

SEQ ID NO: 410 - DNA, 422 bp, Triticum aestivum
  Clone ID: PAT_TA_410
ggcagctacaccgggcaaggtagatgcagcagtacagctctgaagatggattggtggcaggtggctgcggcggcctcatacccggcaggcgtcctggttgagtagtgcgccggaccggtgggtgccccatactcggcatgcgtcctggttgggacctcaggtcttagatgttaggtttggctgcaaggtatgtctggtattaggtccagactatcagcatcccttcaacaactggatatgaatagcaacagatgttgcctagacggtggatttagtcttactgttgtattactttgtaaggtcttgtgtgaattattaataaagtggctgcatgcatcgtctaaatataaaggccaggggtctttctccttttctaagaatatatatttctttgcatgatcatgtatttgacatcgtatttg

SEQ ID NO: 411 - DNA, 672 bp, Triticum aestivum
  Clone ID: PAT_TA_411
ggctcgtgcttcgaggcggacatcctggccgccttcgacgccgccatccacgacggcgtgcacgtcctgtctgtctccctcggcaacgatggtgagccctacgactacttcgacgacgccatctccatcgggtccttccacgccgtccgccgcggcatcagcgttgtctgctcggccggaaactcgggccccaagcccagctccatctccaaccttgcgcccggacgcgtggccgtcggtgccagcaccatggaccgcgagttcccgtcttacatcgtcttcaacggcacaaagatcaaggggcagagcatgtcggagacatcgctcaagggcaaggagtcttaccccatgatcgattccgccgaagccgcagcgcccggcagagcggtagatgacgccaagatttgcctgcaggggtcgctggacccgacgaaggtgaaggggaagatcgtggtgtgcctgcgtgggacgagcgcgcgtgtggccaagggcctgacggtgctccaagccggcggcgccgccatggtgctcgccaacgacgccgcctccggcaacgagattatcgcggacgcgcacctgctcccggccacgcacatcaggcacggcgacggcctcaccctatacaactacctcaaatccgccaagtcaccagagggctacattgagaaagcc

SEQ ID NO: 412 - DNA, 957 bp, Triticum aestivum
  Clone ID: PAT_TA_412
cgggtcgacggctgcgagaagaagacagaagggctgattggcttccccgattttctggtggaaagaacacggtttgaagctgctgttgcgcagaactggactatcagagataagtgcagaatttggtgggcgaatgatgacggaggaggaagttggtgggagggacgtgtgttggcaataagacctaagtcacctgattttcctgagagtccatgggataaatatgccatacaatacaagaatgatggttcagatcatctgcatagcccctgggagctccatgatgctgatagcccattggttccatggaaacatccacatattgattccagtattaggaataaattgttatcagcagtgaccaatttacagaacaagtctcgcagaaaccaggattgctatggtgtcctgaagttggatgctgttgcaggaaaatcagagttcataaacaggtttcctgtccagttttccatggaggtgatcaggacaagactgcaaaatggttactacagaagcgtggaggctggccttcggcacgccgctgtgatgcttgccaatgccgagtcttacttctcaaagagcgcggacatgaccaagaagcttctcaggctatccgagtgggtcgaagataacatcctatcactttaggggaaggtggtcttcttccttgttcttgttgattgagaagatgacatctgaagcaagcatagttttgttagaggaatgggccaaagtaaaggtagttcgctggttggaaggagatagagattcatctttactaacaactgtcgccatagttttctgaaagaaaagcaaaattagaaagagaagatgctagcgttgtgaaatccgtcagaaaatgctctagcagatcattggatttgtatagactattgtgcatcatcagtcaatcaataaaaacgcaaggcaaataatcggttgggtagaaaaaaaaaa

SEQ ID NO: 413 - DNA, 432 bp, Triticum aestivum
  Clone ID: PAT_TA_413
caggacatcaacaacaacgacaaacatatgcagctatcttcccttggcctggccagctactgcgacggggatcgtgacggcatcgccgatgggcgacatcaccggcgatgacaacagatgcggcttcttcatctcatcatcgacgcatggatattcttgtattgatttccatgcattcattgtaattgatatctcacgagctagttcaatgaaacagtataatccatccatgcatgccatggcgaccaagatggaggcatgcgcattgctagcgtttccatcatcaacacacatcggcgctcacacgcgtggcaatacacagccgcggttcttgctgatgtgcagaatacacatgcatgcgtgcgtacctgacatgcatgcctaacatattgttttattttacatgatacctaacatgttgttggttgtgac

SEQ ID NO: 414 - DNA, 1178 bp, Triticum aestivum
  unsure (1)..(1178): unsure at all n locations
  Clone ID: PAT_TA_414
tcaagtgggcccgcgagnagctcgaggaggtcgaattctaccgcggcctggaggttatgcgccaacaggctgatgcggctgatagccctgcggcacccccgccggcgaggctaaccgcgttgccgcagaggaagggggaggttaagttcaagatctctgggttggacttgtcagacccaaagtgggctgaggtggctgagcgggcggctgaagctgaggcacactttgtgccggaggaggccaaggctgtagatgggaaggcgaagaaggccgaggagcaactgctggcggctgagccgaggaaaggcaacccagttcctgccatggaggagtggaaggaggagctccgaccaaagcgcgttgactggatggcactcctcgagcgggttaaggcccgcaatgttgagttgtatctcaaggttgctgaaattcttttggatgaagattcatttgctgcaactatccgagattactccaagttaattgatcttcactctaaagcaactcacgtgcaagatgtagaaaggatacttggtaaaatgaaagagaaggatattgcacctgatatcctcacatccatcaccttagtccacatgtatagcaaatctggcaatcttgaacaagccacgcgggcgtttgactttatccaaaaggagggcctccaaccagatacgaaactctttacatcaatgattagtgcctgtattaacgctggagatccgaaacaagcagagaaattggtaaagaaaatggatgagctttccatgaaacccagcagggaaatatacatggatgtgatgcgggcatatgctgagcgtaacttagtagatggagctcaatcggtgaaaacaaaaatgtcatttgctggaatcgagcccccgttggagtgcttcacattgcttatagaagcaaatggacgggctggcaaccctgattatgcatatgaagcgtttgaacagatgaggaagaatgggcatgaaccagatgaccgttgcctggctggtatgattactgcactcatgaagaagaaccagctggaccaggctttgaagttgctgctgagtttagagaaggagggggttaaacctggagttagacaatccgggcctnccgggattggctgtcangttncnattggtncaagangctgaacaacttgttnaaaaggataagaaagg

SEQ ID NO: 415 - DNA, 1609 bp, Triticum aestivum
  Clone ID: PAT_TA_415
ttttttttttgcacccaaccataataattaaccacgtgattccaggatcccggcataatcaacagcatttcgtagcatagcacagcacaccaacaccggtctataacggtgtcaaagagagagaacatcctgatggtgcgtggggagcgatatacccaaagaagcgacctctttacacatcatctccgcctcggatacccaaattcagttcaccagcatcacccctaagctaacacctcgctcgggcctgtccacggcatatctcaggccaccttacttggcgtcgccatgcttcgccctggaatgatctccaagacccttcaaggagctgaaagtcctgttgcatgagttgcagacatgaccagcggattgcttagacttgtcatcgttgttttcaggtgtcttccttgcatgttttgctgctggatgaggggtcgcgacgtggacgtggtcacctgacttacgagcctgttttgctgccggatgaggggtcgcgacgtggacatggtcacctgacttatgagcctgttttgctgccggatgaggggtcgcgacatggacatggtcacctgacttatgagcctgttttgctgccggatgaggggttgcggcgtggacatggtcacctgacttatgagcctgttttgctgccggatgaggggtcgcgacgtggacatggtcacctgacttaccagcctgttttgctgccggatgaggggtcgcaacgtggacatggtcgcctgacttacgagcctgttttgctgccggatgaggggtcgcaacgtggacatagccagttttgttgcccgtagttggtgttgctatctttgccctcttcccctggggtgtattcagaggtgtttccattggattataatcgtcctttgttctctttcgaggataatccacatcttgatcagaactctcattatcaaggccatcactggaattctgcataccagtcttatccttatcatctcccttttgctttccaggactatttgtttcctcaactttagcctttggtatagaggatggagcatcagcaggccttggtgcaataagaagattattggcaccatgtgtagcttcattgtttttgtaaccgtctgtattgatgtctagtggaatagccaatggaacctcctcatcagaatcagcatcttgtttagtacatgagtgaaatcttttgataatatcaaatttgtagcccataaagctgatgttgctggtcattgaggagtggaacagctcaaactcctctttgaacaccagatcagctaaaacatgaggatgattatcaactgaaagtgtgccaagcataatccttgtatcgtcaattttgacaaaaacttgcacatcctcttctgccttgccaggctccaatgctatcgtcgaaatgtgataatgtgaatctcctgggtcacacttcactgtctctccaggcttgacgacaactccccagaagcggtggttctccgtcatcttcccgggcgagggaggccggctgcttccgccgcgccttccccgtgatttccctagggttctggcggagacggtggccgcgcgacggaggggaagcggggcgaggggtgtggtggctcggacg

SEQ ID NO: 416 - DNA, 1264 bp, Triticum aestivum
  unsure (1)..(1264): unsure at all n locations
  Clone ID: PAT_TA_416
ggaagctctcaagttgatcggggagacgccctcggtacaggagtttgtctttctaaagctttagagaatgtataggttgattgatttctatataacatctcctgctttactagtatgggtggtttttgcaagcttatttagtttctatgtagaattgtaattttcagcccacctggagaagctgctggtagatacatcttacgaacaaatgcgcggaatgtgaggcctgttccttgggcctggtgtcctactgccccaatcgtcgctcctgcggttgctgccgagttatccccatatgtcatccttgctgagaagttgggacgtctcgccgtgcaactcgtggctggtggcagtgggatcaaggcagtcaagattgtctactcatcagctagagacccggatgacctggacacaagaattctccgtgccatggtcacgaaagggatcgtcgaacccatttcaagtgcatttgttaacatggtgaatgctgactatgttgctaagcaacgagggctccgcataatcgaagagcagattctcctcgacggctcccccgaggtccctataaactccatccaggtccagcttgccaatgtggagtccaagttcgctggcgcgttgtctgacgacggcgacatcagggtggagggcaaggttaaggatggcacgccgcatctcacgctcgtcggccctttcagcgtcgacgtcagccttgagggcaacctgttgctgtgccggcaagtcgaccagccgggcatcatcggcaaggtgggatcgattcttggggacgatgaacctgaatgtcaactttatgagcgttggcaggattgctcctgggaagcaggcatcatggccattgggattgatgaggacctgacaaggaactctcaatttgattcggggaacccgtccgtacangatttnccttcttaactttanagaataactgctggtaaatacacctacgaacaaatcccaaaatgtnagcctntcctggnctgcttcctacttttgttcngatgntctacgttctatcctccgnactttgggtaaacatatcatcacacaagtaattatggctcnaattcctggaactaacaaaaggggggccgtaccaattcccnaatnagtcttacccccnacggcctcttaactctacnggaaacctggtnccactannctgaaaacccttcaatgtaacaaagccncttcctcaattncctaagangnccccttgganaccggggntgntcccnccacnccc

SEQ ID NO: 417 - DNA, 406 bp, Triticum aestivum
  Clone ID: PAT_TA_417
cccacgacgcgtgggttcccggagagcgacggtgagaggggtaaaatggcgaggatcctgctgcatgggacgctgcacgtcaccgtgttcgagggcgaggggatcaccaacaacagcaggcccagcagtcaggcgccgcagttcctccgcaagctggtggaggggatcgaggacacggtgggcgtcggcaaaggcgcgagcaagctctacgccaccgtcggccttggcaaggcccgcatcggccgcactcgcacgctgaacgacgagtcgtcgaccccgcgctggttcgagtccttccacatctactgcgcgcacctcgccaccgacgtgctcttcaccatcaagggcagcagcaccatcggcgccttcgtcgtgggcacgggctacctacccgtccgcgacatct

SEQ ID NO: 418 - DNA, 595 bp, Triticum aestivum
  Clone ID: PAT_TA_418
gtactcatgcataatcctgctgatatgatgacaaagccagttccgaccaataagtttgagctttgctcaggcttagttggtatttctcactagtcctatggactttgacgcacaaggtgtttatgctgatttggatggagttatttactttcttctgactactggagggaatttggatcaaggtggagattgttaaattgtgatctaaattataccgtgttgaactagacgtagtacaactggtgtgggcctttgcgttgacgtcgacgcgtacgagtacaactcgtttacttgtcctccaaggactctcatgtattgccctcttatatatcccatgtagtcgcacctcagacggtctgtcgtctcgtgcttgtaatactcctcctcatagtgattgcgccttcatgcgtccgtggttttctcccgcaagggtttccacataaaaatctgtgtgcttccgtgtcacgtttatctcgttattctaagatgggccgtacaatattctgtcgtccatgtgggccgggtccttgtggtcaattcgtagccgatctggagacctcgtcgggcagcgcgagcgcctgggcgtaccgtaata

SEQ ID NO: 419 - DNA, 475 bp, Triticum aestivum
  Clone ID: PAT_TA_419
gcaagtgatcaatgtcatccagatgaaaacagctgcagatgcttgtgtggcgtacgattcgaaaagaggcaagtgagcaaaaaggaccatgttttagttttcatttgcgcgggcatattcaagaaaaacatatcgtcaggcgggcttggttgtaaggcacatatggcacatatggtagctccttgatgtatcttttaacatgtctccggtccgagggtcgacattctggggggaaagcagcatgtggaaagaaaagggagaactgcttttttaacaaaaacacagggatcgacaagctctgtattgtgtatgtcttttctacatgatgattcgatctttctttgcgtagcagcctcgtgctttggttactagtactaggccagaaatgatgatggtgcctcccctcccgttgtagcagtgtagatgccaacatttacttggttgttttcaaaaaaagggaggggaaagagaaaaa

SEQ ID NO: 420 - DNA, 790 bp, Triticum aestivum
  unsure (1)..(790): unsure at all n locations
  Clone ID: PAT_TA_420
aatgactacttgtccatgcttgaatttacatctaggttgccgatacttcgctggaagcaagatacataaccctccacgtctgcgacaaggtcgcggagagaggcgcgcgcctggctgccgccggcatatacggcatcctgaagaagctgggcagggacagagcgccgagtgacggcagtccgaagcaaaggaccgtcgtcgccatagatggcggcctctacgagcactacaagaagttcagctcccgcgtcgaggcgacgctcgcggagctgctcggggaggcggcagcctcgtcggtcgtcgtcaagatggccaacgacggctccggcatcggcgccgcgcttcttgcggcctcacactcccagtacaatgtcgtcgagtagtcctaaggagagggagtgagctcctggcgcagcttcttgctttcgcctggatcacttattttgccatttctctccaccgatagctagtcttgtgccaatgagtttcgtttgcaaccgcgggaaggcggaaacggagacggaggttagaatgacgccgctcctttcctgccaattctttttccctaaacctgcaagtttctgttgcgatgccatgtcgcgaaccaaacagaggagacctgcctgcatgtgagatcttctataattcagaataaggagggtggtatatatgatcacataatcgaaacatttatgatttcttctgtttcgcgatccacatactatatatgtatgcaatacatgttcagtttttctaaactgaaaatggctcctccaccatgagcagctna

SEQ ID NO: 421 - DNA, 833 bp, Triticum aestivum
  unsure (1)..(833): unsure at all n locations
  Clone ID: PAT_TA_421
gccgccctcggctacctactgtgtaacggcctctcataggccacaaaaccagcggatgctagcacgtaggaagtggtgctgccgtggtgagttactccatcagagtgaggacaacgacacttcttgcaggaaaaaactgcagcattgttcagtatctttccataaatatttgagggaatttgtctgtatcagttcaacagaaaaaattggcagcagttccaccgatacatgcctggaaggaaacttcgtatgagcacaagtcgcagcaccactacagcgagtctccggcttctaagggagtcgacgaggtcacctgggctcctgcgagaaaggtgacagggtcagcaagaatgcagatatcgccaagatggccagaattggtgcggcttgatttggctcactacagcggctcctctcctctgtcgctcttgccggccaagccaagctggacatggatgtgtgggtgtgcatgctcactgtgaagtacgttctaggcgacctctttcagtttgatatgtgtgctcactgtgtgggtcgccatctctctatcctgccaagctacaccagcacttgttgtttcctctccctgctgcaatcagtgttgtgagggacggatgagatggaggcatggagctggcgactggatatgggaagggagctgctactgcacttggtctgcttgacagctgccgttgtgcctgtacttggacggctgcagatagtgcaaccgaacgtccgtgtgtgtttttggcatcccttttttacaatgatgctaatgaacattcgtccacggtcttttgtagtgttgctatctactagaanaaatcattgat

SEQ ID NO: 422 - DNA, 616 bp, Triticum aestivum
  unsure (1)..(616): unsure at all n locations
  Clone ID: PAT_TA_422
gcagaacgaacagcacggtctgaagctcaacttaaggaaaaataccagttgcgcctgaaagttttggaagatggactgcgagggccaccaagtggctctagtcgaccgcctactgaagggaagagtttcagcaacggtccttcccgtcggttatcactcggcggagcagataatgtgtctaaagtctcaccaaatggcttattaacaaggagatctccatctttccattcaagatcctctctttcttctagcagcagcttgatactaaaacacgctaaaggaacttcaaagtcatttgatggtggaactaggtcacaagacaggggaaaggtccatgggaatggatcacatttacttaacaaatctacagatgcagttaaagatcgtgaagcgaatgatggttggaaagggactgtggatgagggaactaatgaaagtccaaatagcaatgcagatcagagaagtaatgaaaccacaaatagcaactcaattgaaatggtctcgggtttcctgtatatatagtgcaaaagagtggactttaggaacatccanaaaagtnaatcaaagcaagtatcatgaattacaagaantntnctacaagcatgatgnggtaaan

SEQ ID NO: 423 - DNA, 882 bp, Triticum aestivum
  Clone ID: PAT_TA_423
ttagcaaggttagctattcttccatgaggaaattgtaagacttattctataagttgttcctgatggatcctttttgtttccaaagtctgatcttcccctgttgaccatgtcaatgctatctcgaagcatgtctcgagaagacggatgaagggtaagagcatttgaagcacaatgctaagttctccttatcaattatccaaacaccgttgtatgggtaatgtcatgaaatttctctccccttacctaaagatttttctatgttatatcctgtcatggatatcatgccctgcttgtccttgggaaggaatacccccctgaaatatgtgtttaaacacattttcctttccattcttctgtttaatctgataatcatattttcctttccattgtgtggtttaacctttctggtgaactatatgatctaagcagtaatattctcctgcttatgtaaacacctcggtgtacaactctgtcagtaagaccctgttattattgttggtgacatttcggtaaccaccgatggacgagaactttgcctaatggtccgcctcgtttcaacgagcaggaaaatggttctcttcgtccctcgcccttggtaccgacgatgttgctgacatataactgacaggctaccctctgccatgccttgctatcatgatcgtgcaagatgtcaccgcccttcctacattaaccacatggtgggcccataacccacagttccacgggatcgaaacctgactctcttgtacaccccctgttcccaaggttattcctcacgcttggcttcgtatgtaattcacgtgccccctttcgtgagatcatcaattttggtatcagacacaatacttattcccgttgctcagaacccttcaggcatcaaac

SEQ ID NO: 424 - DNA, 640 bp, Triticum aestivum
  Clone ID: PAT_TA_424
ttcagcgtcgagcgtgtgccgggccgccgcccggggcctggtgcggacaggataaagaaactcgtgacaggcctgctcaccgaggaaggcttcgacgacaagcattgcgtataaaaagcttgatgattccagggtaggttactttggtcaaaatctgaggggttgagccactagctagtcattctactagccgaagaagcggcacatagtgcccacgagtccgcacacgcgtctgataggtgttccttatagactaccacttctgagttgagttaccgtacagcaggagaccacggccgccgtagcaggcagagtttatacaccactaatagctcattaggttatgttagaagattatatcagcccaaccattattaataatatcggaatttttcggtctctcagcgctgcgggctgttgtccaaggtggtccgttcttcttgtagaaaccgcttgggctcgatctaccttaggaaggagcctacaagtgcatgagatttcgttgtattaattgtggattcctccgggcaaactgctacgttttggttgcgtacatgtattctttgattatttttctttctcccacggctgagtatacaaaattatcttatgcactgtttcttcttattctttctttggt

SEQ ID NO: 425 - DNA, 1572 bp, Triticum aestivum
  unsure (1)..(1572): unsure at all n locations
  Clone ID: PAT_TA_425
gcctggtgccgaatccgctcgagcgggcatcctccccatatgacacttccccgcaagacctagggtaatgtggcgccctccacctggtcggcctccgcccacctccacgtcccgggacgccctccccggggaccctattgccgcgggtacagggaccacccgcggcgccgctaccagggggccgtacggtgctcccgccgggtcgcacatctcgcgacagcaaggaaacaggtcgtctccgatcgtggcgagggcgactactccgtcagccgccagaacggtcgcagctgtcgtggaagcccgtttttagcggtgagcacaacgtccaccaccatcgcgaatggacttccgcaacacccgctagaagtccgtgatcgctgatccgaagggatcactgcagactggaggcgaaagaaaaaggggcaagccgcagagcggccgatgcaggtgatagctaatgccccccgcgaccctgacctggtctgcaggatcgccgcgtgggcgcgggtcaccgggcaaacaaccttgcgattgtgaggctgtggttctcactttctcgaggcagtagagagttttggcctggtgttattctttttggctgtgtaaacactctgaaaactagtttcgcgtagtgattaggttctcgcctagtgtatggattgctctgacactgtactcggttgttttacaaagtgagatattgctgatgagaatatgcccttgcaagacgcgtttctccttgcagatgatgtccttcgacagggtgtccaaggaatatcagacattatcacgatacctgggctcgtgaatgttgattttgctgatgtgaaagctgtgatgaaaaattctggaactgccatgcttggagttggtgtttcttccagcaaaaaccgtgcccaagaagctgctgagcaggcaactcttgcccctttgatagggtcatccattgaggcagctactggtgttgtgtacaacatcactggcgggaaggacatcactttacaagaagtgaacaaggtctctcagatcgtgacaagcttggctgatccctcggccaacataattttcggagctgtggtcgacgaccgttataacggcgagatccacgtgaccatcatcgcaacaggatttccgcagtccttccagaagtcccttctggctgacccgaagggagcacggatactggaggcgaaagtaaaagcggctagccttgcaacggctgctgcggtgcaacaaccggcagcggccgtcccgacatggtcccggaggctcttctcctgaacactgtttagcaggcaaacaaccttgcgattgtgaggctgtggttcttactttctcgaggcagtagagagttttagccggtgttattctttttggctgtgtaaacactctgaaaactagtttcgcgtagtgattaggttctcgtctagtgtatgtattgttcagacacttgactcggttgttttagaaagtgttctgttcgttgacagctttggcaaccccagggctcgtctgggccggngnaaatggcntataaggggggnntanggggcgaaanggcggngttttaaa

SEQ ID NO: 426 - DNA, 796 bp, Triticum aestivum
  Clone ID: PAT_TA_426
gtccggaattcccgggtcgaccacgcgtccgcctcgccctgctcggctgcgagtgctccggctccgtgttcttggcgatgcccctgctccagcgctgccgcctcgacttcgtcggctccggcacctgctcgctcgcgctcgccgcgccccttgtcgagtccctcgaggtccagggtttcaactacatcaccctgcacggcggcgaccgcctcaaacgcctcaccatttccaagaacactgggagggtgaatactgtcgggatagacaggctcccggtgttggagcagctgtctctgcgtggcgtccagtggagctggggagccgtcagccatgtgctgcaatgcggcgccgaggcgaagcatctggtgatgaaggtggagttctgcggtgatttcgacactctccagccgtttcccgaggtcgacctcgttgagttcttcaacagccacccgaagctctgcaagtttgaggtccacggcgccatgtttgcgtcgctctgccaaaagaacagcctgaaaaatttggactcgaggttcctgatatcttcattggaggaggtcctaatcactgtgcgctcacccttgaatgctgagcagaagctgatcaccattgagtcccttgtcaggtacagtccaaggctgcggcggatggtccttaggatctcgcagatgaagaactgccacgaggctgcagatgaattctttgaagaggtttccaagtttgcgcatatgagtaatggcagagtgcggattgaataagaggggtgccgctgcatggctcagtgccttggctcttg

SEQ ID NO: 427 - DNA, 1162 bp, Triticum aestivum
  Clone ID: PAT_TA_427
caggcaagcggaagtaagcttgggtcctttaaaagggcccccccctttgggttttttttaatgggttgccaatctcttttcttccctctatttattaattttttttttaagctagtgacaaaacttcttttgaatgcggttgaaaaaaaaccagtccaatatatattagcataactgaagatttatcacggctgacagggccttaacctgacttatcatggggattgcatattatccatccatgcaatgcaccatcacataaatgctagagaaaaattacaagaaggaattattaatgcaatggcactgtgtcgatcgcgccgctaaatgcatggacgaagggaaagggaaaagctagcttgcgccagcagctcacagattgtagccgcctgcggcagcaggtttggtcgcggcatcggcggcggccttgtagccagatttgccatctgcgggcttggtagccgcttccgcagcggggctcggctggcgcatcggctgcggggctcgggaccggcttcggcccgggccctgctaccggcttcggccccccccgggcctgggccccgcccccgccccgggcccgggagccgcatccgccgcccgcgggcctgcgggcggcgtcgccggcgcgcccgcgggcgccggcgccgcctggcccggcagcgggttccgcagcgggcgcggcggcggcttcggcagctggcgcggcagcgggctcggcagcggatttgtcggcggcttcggcagctggcgcggcagcgggctcggcagcggatttgtcggcggccttgtagccggcgtcggcagctgcagtcttggtaccggcttctgcggcgggcgcggcagcagtttcggcgccatccttggtggcattggcaatggtggtgatggacttcgccaaggcgtccgccacgtcggtgtccttagcctccggcttggaggtggcggcggattcgacggcctttttgaacgccgcgtcgagatcggaggtcgtcttgctcccgtcgtagccgggccccatctgctcttgagtggccttgttgagggcggcttggaacacggggatcctgtcggctttcggagcttctttggcagcagcggaggctgccttgatgaccgtgtcgagcttcttgatgacccgtgtcgcgccgtccgcggcttc

SEQ ID NO: 428 - DNA, 1341 bp, Triticum aestivum
  unsure (1)..(1341): unsure at all n locations
  Clone ID: PAT_TA_428
tcccgggtcgaccggctgcgaaaagcgacagaagggtacatttcagtggccttcattcaaatgctcaaggctttgatgcctgtggcgacatttataatggccgttctatgtggtactgacaaattaagacgggaccttttcttgaacatggtgctggtcagtgttggtgttgtagtttcatcatatggggagattcattttaatgtaataggaacattataccaagtaactggcattgttgcggaagccctcaggctggtcctgacacaggtcctcctccaaaaaaagggattaaccctgaatcctattacaagtctgtattacatagcgccttgcagtttcatcttcctatttggtccatggtatttactggaaaagccagaaatggacatctctccaattcagttcaattattggatatttttctcgaatgcacttgctgcatttgcattaaacatatccatattcctagttattggaagaacaggagcagtcactgtcagagttgcaggagttctaaaggactggatacttattgccctctcgaccgttatctttcctgaatctactattacaagcctcaacataattggatatgccgttgcgctctctggcgttgtcatgtacaattatttgaagatgaaagatgtgacagcaatccaacttccaattgataacactgctgatagagctaccaaggagaagaaggttgtcaacatatacaaacccgacagttccattgacagtattgatgaaactgttgttggaggtgtggcagttggaagtctggcaacagaagctgcagctgttgacgaggaagccccattgatcccttcatcacgcatctcccatgtaacccggacacaaacaggcggtctcagtagcagatgaccacagttttctaaagttttgagtcggttgaggtagcaaacttcatcctattatcttcctcctggatagtccgagaactacgagaagaccctctttggaagctccgccgatngagcgattggtcttgcacgttccttttctccacgacacgtttgcttggatgccttgctaagttggcgcggaaagctgtttcaggagacacctgggaggtgaattaagaaaaagttgcaagtgataaaaagattcaatactttttaatcctgtacattccgggcaacgaagcccgatnggagggccctcaagattgaattaatcctgaaagaaacaagacaagaccaatggggtggtttttgaaaccttgaattgtttgttanaanggaaactaatattgaaagaaggggggtcccgcaaatggccttggctccaaaagggttggaatgttaaacctaa

SEQ ID NO: 429 - DNA, 786 bp, Triticum aestivum
  Clone ID: PAT_TA_429
gcacgaggctctttgaggcattgtgatgtactaataacagttcagtttccaggattcgtgtgattcagttgaacccctattctcatcgccaggataacgaaagaagatctgggaataatgaatcgccgttttgtgaatctgctggtcagtaaatcgggcgactgccgcccggccttcaacctgcatcgcatcaatccggcgagcttattctgccctactagatctctaaaaccagcagatccagcagcaacaaagaagaagactctgtctcggctgcctcctgcggccatatccttcgaattgccctgcccgtggaagaagttcgggtggatggatttcatggcccgcaagaacgacatcattgctgtcgaccatgagggccacaccctcctctacaacggcacggttggcgccctctgcgccatgaacaggatggtagacccctgtcacagctcaatctccgtcgttgttggggacgagctgtatgccatggccatcaaccgtggcctgctgcccaaggtggactattttaaggctcttacctatggccgctcgttcggccactgccagccagaggactggcactggcgccctctccagccgcctccccttgaatacgaccacgagaaggatcaacgctacaaccccactgcggcgcctgtgacacacccctgtgctattggcgcatacacggttgttcgtgattcacagatctggatatctacaacgggcgctggcacgtactcctttgacacaactagcagcgtgtggagaaagattggcgag

SEQ ID NO: 430 - DNA, 1130 bp, Triticum aestivum
  unsure (1)..(1130): unsure at all n locations
  Clone ID: PAT_TA_430
ctcaagcagacggtagccctttgtgccgtttgtcgatgtanccgagagcgtgggtggtgganccgtggtcgaggtagccgtgcgaagaatgccgtggtcgatgtcgagtcggggtagccggtgtcgaggaagtcgccgtggagccgcgggcgcaagggggcgccgagttagcatgggcgcagtggtgtcgaagtagtggtgcgccaggaagtagatgatgttgacgacgcgtcgcggcgggtttgccaagcccggggacacatcgtggacgaagccacgcaccggtgttgccagcaccgggcatgcgtagacggacgaagacgaagttgacgaagcgccgcgccaggcttgccaggcccggggacacgtcgtggacaaaggcacgcggcggtgttgccagcaccgggcatgcgtagacgagggacctgcacgagctgtacgccatgtcggagaagtcggagaggccagcagagaaggactcgacgacggttgcggcgccaatcggcgcggggccaatgtcgcccgcggttgtcggagtagatgaagcggtcggggtagatgacagcgacgctggcgacgagctggtgctggacgaagacgaaggaggtggacgggcggcggcggcggctacaaaggtagcggcggcggcggccaaagaagagcggcagcggcggcctgacggcggcggcggcggcggctaagttaggagcgcggcgacggtgctcgaagtaggtgaagaacccaacagcgtgacgaagaccggtgcggacggtggcattcctgcgccaagggagtgctgcggtgcatgccgcaggaagtcttgctagcaccgggcatgcgtagacgagggacctgcacgagctgtacaccatgtcggagaagtcggagaggccagcagagaaggactcgacgacggttgcggcgccaatcggcgcggggccaatgtcgcccgcggttgtcggagtagatgaagtggtcggggtagatgacggcgacgctggcgacgagctggtgctggacgaagacaaagggggtggacgggcggcggcggcggctacgaaggtagcggcggcggcggccaaagaagagcggcggcggcggctaggttaccagtgcggcggcggtgctcg

SEQ ID NO: 431 - DNA, 697 bp, Triticum aestivum
  unsure (1)..(697): unsure at all n locations
  Clone ID: PAT_TA_431
tttttacatnactanctcggnaaggnaatttttgaattaccntggnttgtgaaaattcncagttnattntanccntggaatttgaatgccggtttttacgggcttntcaaagacnacttntggttgtatttatgtgantatcatgcctaaccttggcacgacttgtcgtcccgagggatgttatgatgattttatcctttgaggttgggactcattggggaaagaantggaaaattgtgacaggatctcaaagatcgttcgatgtanccgagttgggtgtgcagtaggtgattctcgagtgcacgctgaccaaccctattctgcggcccaagatgtcagaagttctccaggcccttgaatctaatgtgacgctggcggagaatggtgtggacttgaatagagaagcgctgctgccttatggaggctcttgcagtttctctgtgagacatggggatcctcacgactcatcgtccttcataatagagccaattgagctatccggtcctagatgatggcaagtgctggtttcacgagagaaaacagaggaaagcgatgatagttgtacaaaacatgtatagactggatgtagtccaacttgggaggagcttcctcaggttgcgtctcacaaaccattttcggctagaaactaggaagatcatatgtttccactgcaaatctgtatgccaccacaaactgc

SEQ ID NO: 432 - DNA, 871 bp, Triticum aestivum
  Clone ID: PAT_TA_432
ggtcggcttttagggacaggttgccagcctagcctgcatccatatggttgtcgtgttattcagagaatcctcgagcattgcagcaatggttcagatggtttagtagatgaaatcttgcagtccacttgcatcctggcacaagatcagtatggaaactatgtcacacagcatgttttggagaaaggaaaagcgcatgaaaggagccaaatcatcagtaaattggctaggcaggttgtgtccatgagccaaaacaaatttgcatccaatgtcatagagaagtgtttccaacatggggatgtagcagagcgggatcttttgatcaagaagattctggaacagacggagggaaataattatttgctggtgatgatgaaggaccagtttgctaattatgtggttcagaagatacttgaaacatgcaatggacaacagagggatgctcttgtcagtcgtatgaagggtcacttgcaagcgctgaggaagtacacctacggcaaacatatagccagccgaatcgagcatttctctggtgacggtgctgtgccgccgggctcccagaagaaagcctgaaccgaagactacctggatccttcatggaaagtgtgccggccacccctggtcgaccctgtcagtggagaatgtgggaaaaaaaaggggcggcaatcgtgcttttcagcagtctgaacataactgactccagatcgtacagatagtcgttgtcgcccgtgtctgggtgtagttatgctaggatgattgagtgatggtgatcgtgtcgtgtggctgctcatagagatttcccagaatggtggtgtggtagagtatacatgtctagacctgcttggtgatgtgatttgctgaccctgcgtttcct

SEQ ID NO: 433 - DNA, 907 bp, Triticum aestivum
  Clone ID: PAT_TA_433
ctgtgcggcgctcgagccggccgtcaaacgaacaacaaggacaacccacagagcatcagccggagcacttcttcctcccctccgttcttctccggctccggtgctctcgtacgcgcgttcgtccgagaccaccacctcgaccaagaagagatggagatgaagaagatcgcctgcgccgtccttgtcgccgcctccgccaccgtggccctcgccgccgacgccccggccatggccccggcccccggcgccgccgtcgccggctccgccgccgccgccgtcccggccgtcggcgccgtgctcggggccaccgtgctctccttcttcgcctactacctgcagtaagcgcgccccggcccgagtcagttcgctgcgaggaggaggaaggcagggaagaagaagatcactaattcgctatgtatggctctacgctacgctgattcgaggcacgcgcgtgcgttttgatcgatgcatgcgcgtgctttgatttatatgtcttgattttattttgtttctcctccttttggcgaatccatttgcaccggtccgatacatctggtgctttattattgttctgttcttccttttgagagagggctcgatggatattgtattattatttgccatttctttggcctgattaatttaaagatcggattcaatcacatcgtgaatttattcaagcctaatgacttctacatgtcttgatttcgatcgaggcagtacgttacttgtacgaccgattcgcgtgtgtgtatgatagagttatgaatctgcggagcacacacatttttcatcggaaaatgattaagttgtaacctcatttttgtattcttttgatttttacgaatgtttggtgagtgatatcgtcgtgaaaaaaaaagaaaaaaaaaaaaaaaaaaggccccta

SEQ ID NO: 434 - DNA, 1563 bp, Triticum aestivum
  Clone ID: PAT_TA_434
tcattcgacactactcctccgacgcgatccaggggcggagctcctcccgctcgcctcccgcccttcgacccacaagacaacccaccctccagctcggactgagctttgcaggggattccgctgcggaacagttctgccccagccttgcccgcctccctgagatcgcgcaacccgctcctccccaggcttcctgatacgcggccccctccgccgccgccacccccacccctttctctgccgtcgctggcattggtgcccgcgggctcgtcgcaccgtcccatgcgtcggcggcgaggccggcggcgtgggcgcgggcgcctagcgagccggcccggaagatcgagaggtactcgcccgcgttctacgcggcgtgcacggccggtggcatcaccagctgcgggctcacgcacatgaccgtcacgcccctcgacctcgtcaagtgcaacatgcagattgatccagccaagtacaagagcatctcctctggatttggtgttctcttgaaagagcaaggggcaaagggtttcttcagaggctgggtgcctactttgattggttacagtggtcaaggcgcctgcaaatttggtttctacgagttcttcaagaagtattactcggatattgctggacctgagaatgcagccaagtacaagactttgatctatcttgctggatctgcttcggctgaggttattgcagatgttgccctctgccccatggaggctgtgaaggtccgtgtgcagacacaacctggttttgcaaaaggtttatctgatgggttccctaagtttgtgaaggctcaaggatatgctggattgtacaagggaattgttccgctctggggccgtcaaattccatacactatgatgaaatttgcctcctttgagactattgtcgagaatatctacaagtatgcaattcctgcccccaagagcgagtgcagcaagtctctccagctcggggtgagctttgcaggcggttacgtcgctggagtgttctgcgcgatagtttcgcacccagctgacaaccttgtttcattcctcaacaatgctcagggagcaactgtgggcgatgctgtgaagaaacttggcctgtggggtctgtttacgcgtggtctccctctgcgtatcgtgatgattggtaccctcactggagctcagtggggcatctatgatgctttcaaagtcatggttggactgccaactactggtggagttgctccgactcctgctgccgctggagagcagctcaagggctgaagctttgattctatactgcatataatatctgacaagactttttggcgccgaattggatgagatgacgaaatagctcatctttcatccttttaagagcaaaatttgatatttttttttcaggaatgcctagttgcaaccctggtaattagatgtcaagacagattaggaacaattttcggcacatgatcgtctggcttaggacgattgcctgaagcatagcatacttgtctatttttaactgttattatatgtctcggctctggcagtaaaagctgttagtaggcgttttgcctatggttatacg

SEQ ID NO: 435 - DNA, 1283 bp, Triticum aestivum
  Clone ID: PAT_TA_435
ggtgcggacgacgcttaatgggtcgtaccacttcattccccagctgatcttccttagcagctgatgtggtttccggtccttcctctttattattaagtagtgcacggtgccacaagcagtgctacaccttgttctggtatatattttccgtagccctaatccggagctttgtgtgtaccagtggtgtagtgtccaaaagtccttgccacctgcttatctcgtgcttgagtctgtctctctacctagttttgcactgcgttctgcgcttaagttctccttctaacgtcggggtacaacaatatttttatcctcgctattggtgtcgttgtcttcatctgtgccactgtcggtgtgttgcttgttatggagaccctaagcgcattccttcacgccctgaggctccattgggtggagttccagaacaagttctatgagggtgatggttacaagttcgcaccattctcgtttgctctcaatcagtgaggatgaagagtgagctcgtccaaactcttgtatctattgtagtctctgtaatatcttgcgggtggccttgttgccaagaacaatcattgtttgtcacggatcgatcataaaactccgagccccttgttcgagcaagggaggtgcaacatcaattttctttagatgtggcattaccttgcacactcggagttgtccactgtgttctatgataaagttctccttctgcacgctggggtacaacaatatttttatcctcgctattggtgtcgttgtcttcatcctgggccactgtcggtgtgttgcttgttatggagaccctaagtgcattccttcacgccttgaggctccattgggtggagttccagaacaagttctatgagggtgatggttacaagttcgcaccattctcgtttgctctaatcagtgaggacgaagagtgagctcgtccaaattcttgtatctattgtagtctctgtaatgtcttgcgggtggccttgttgccagaacaatcattgtttgtcacggatcaatcataaaaccccagccccttgttcgagcaagggaggtgcagcatcatttttctttagatgtgtattacacgaagggtaggaatttttttgtggacgtttggcagcaaaactctagtggcatcacccttatttcggtgtgatgctaataacgagttgtgcactcgtggttgccgtttgggtgatgtgcattctggacataaataagcatgtaataaaaggttatttccattgtggttaaaaaaaaaaaaaaaaaaaaaaaccgagactagt

SEQ ID NO: 436 - DNA, 562 bp, Triticum aestivum
  unsure (1)..(562): unsure at all n locations
  Clone ID: PAT_TA_436
agcatacaagcactgcgangcactagtctgagtacggcactagaagaagaaggcttcttgaagcttgtctatctacataggtccctccatggccaggatcaccacttgggtggctagtcactcgttgacgtcaaggtctacgtagaacccatcggagggggtggtgttgtcgtctgaaaacagtaattaagcaaacatgagtacaaaggtactcagcaagtcttacaacagaacctattatacatgctcattctcaagaaggtggtggggttattgcagcaagccagctttgactcttggctaggccatcctacggaactccactagtaaaatagttttcgcacacgagtccactactcaccaacacaatactccaccggggatcctccctcgtcatcctatgagagggccatcctcggtactcacacttatcttgagtcttttattagtaaccattaacttgtctatgaactgtataggaaaccaagtagtcctttatcgcggacgcggctattcgaatagatgatgttaaccccgcaggggtatacttcttcatacatgc

SEQ ID NO: 437 - DNA, 892 bp, Triticum aestivum
  Clone ID: PAT_TA_437
ttacccgcactgaaaaccttagtgctgctacctagcttcctgtgtagctcgagggagagagaatccaacgagcgcgagcaatggcgaagccgcagcaggaggtctacttcgtcttcatgaacttcgaccctgtctacgagcgcctaagggccgatcggacgaagcaggggtcggcgacgctggacgcgtacctgagccagaagcacgataagctcctcgccaagctcctccagcccgacacctactggaagaagtcctcgctggccatcgtcgacggattcgccgtcgagatcaccgacgctcaggccagcgtgctgaggtcggccaaggaggtgagggtggtggagaagaaccaggagcttgcttgaccagccaacatccaggcgaagttataagcataatcatttagatgctttgagcatctgccatagctatggaagcttggtttattataagctaaggccggagtacgttgatcagttgctactagtcaattgcttttgcggcgtaagtgtatcgatcggtgtgtgtttttgtgtgatctcccatggctttgttgactctagtgtcagctcaagcttagctactatctttatataccacgtactactacttaattagcactagccgcagtaatatagatatataaagttcttcatcgatcgatcttactagctagggtctactgatattcagaggacgactttgaagattgaaccctgcaatgtaatggtgattataaatgaatgagcaattagtcaaaaaagaatctgtgtagcggtagtattttataagctcatgcgtgtactctctttcgctgtccaacatgcatggcagtgtgtgtctgacttttgggtcatgtttctatatgcatgggtagaggctagacgca

SEQ ID NO: 438 - DNA, 1324 bp, Triticum aestivum
  Clone ID: PAT_TA_438
ttcggcacgagggtttcctatatccccgcgttcctctccgctctcgggtttcttcaccattagatcccaccgattccacgctccactgatcctgctggtccggcggctcgccgctaccgattgaacaccccaattcggccccctccattcggtcgaattgggaggttctttggaagcgcatccacccacgaatcgaggattggagctttcttgcagttgcattcaggaatcatgaataatttgttgcaagactgaagcgggtgttgaggtaactactggaggaatttgttattatggccaatgccctgattctgtccggggcttatgagcttgctgaatatctgaagcacaagtaaccatggatagaaaagtcggagtggttttagtctgcctgctcttcctactcattggggaagtttcggcggttgcccagaccgaggttggtcatgtgcgtgtaacacaggaggcaccagatctgaagctagaggatgctggtagacatgatgtgtcccaaagtggaagggtgtcggtgtatgttgttgcatggtccacgcttgcgatggctgcagcaacagggttgggagcacttcccttctttttcctggagctagaggcccaatgggcaggcctttgcaatgggttggcagctggggtgatgttggcagcaagttttgatcttgtgcaggaagggcagatgtacggcagtgggagttgggttgtttttgggattttgagtggagggatctttatttggctttgcaagaagattcttgagcaacatggagaagtaagtatgttggatataaaaggtgcagatgcaagtaaagttattcttgttgttggaataatgacactccattcttttggcgagggttctggtgttggtgtttcctttgttgggtcaaaaggattatctcaaggtcttttagttactgtagctatagcagtgcacaacatacctgaaggcctggctgtaagcatggtactatcatctaggggtgtctccccacaaaaagcaatgctatggagtatcataacatctttaccacagccaattgttgctgtgcctgcattcctttgtgccgatgcatttcagaaggtgcttcctttctgtactggttttgctgcagggtgcctgatatggattgttattgcagaggttcttcctgatgcttttaaggaagcgactccctctcaagtagcctctgctggaacacttgctgttgcttttatggaaacattaagtaccgtgcttcagggattcacggatggccacggcttggaagatacatcaggctttttggtatcacttgtatttggtctt

SEQ ID NO: 439 - DNA, 1412 bp, Triticum aestivum
  Clone ID: PAT_TA_439
actactcccccgtccctcgtgccccgtccctctcttctcctcccccctatctctcgccctcgtccacgtctcgcctcccccatatcggcggaccggatttcaaacccgcgtcaggccgacgagggccaggtctccgccgccgccgccgccgcgcccctcgatccatcggccgcgcccgatccgcctccgccggggctgtagagacccaccatggaggccatggaggagctgtcgcagctctccgagtcgatacgccaggcggcctcgctcctcgccgacgacgacccctccgacgacaccgcgcccaggcgcccctccaccttcctcaacgccgtcgtcctcggcaacgtcggttcaggcaaagtcggccgtgctgaacagcctcatcggccatcccgtgtttgccgatcgggcgaagaatcggggcgaccaggggcgcccattgtggtggacctgcagagggaaccgggactcagcaccaagtctatcgtgctgcacgatcgatagcaaagtcgcagcaggtgtccgcaagtgctctgcggcattctctgcaggataggctcagcaagagtgtgtctggcaggggccgctcagatgagatttcgctcaagctgagaaccagcacagctccccccctaaaactgattgatttacctgggttagatcagcgagctgtggatgattcaatgatcaatgattatgctgggcacaatgatgcaatactgctagttgtgatacctgcggtacaagcagctgaagttgcatcatctcgagctattaggctggcgaaggatattgatccagatggttcgagaactatcggtatcttaagcaagattgatcaagcagatggagacacgaaaactatagcttgtgttcaggcccttctcttgaacaagggcccaaaaaaccttcctgacattgagtgggtcgctctggtaggacaatctgtagcaattgcatcggcacaatctggatcagttggttctgaaaactcgctggaaacagcatggcaagctgaagctgagacccttaagtccatcttaactggagctccccatagtaagctaggtagagtttctttggttagcgccattgctaagcagatacgtaaaaggatgaaagtgcgtcttcctaacctattgactggccttcagggtaaatcccagatggtgcaagctgagctggcaaggcttggggaatctatggtacaaagtcctgaaggaacccgagcagttgcattggagctgtgccgggaatttgaagataagttccttgctcatattacatctggcgaggggtctgggtggaaaattgttgcaagttttgaaggcaagtttccagacagaattaaacagctaccattggacagacattttgatctcaacaatgtcaaaaggattgtcctggaa

SEQ ID NO: 440 - DNA, 731 bp, Triticum aestivum
  Clone ID: PAT_TA_440
gtgaccttccaaagctaccgtgcaaatctgatttaccaggtttacttcctgacggttggagggacgcagctccacgccgacgcacggcggaactcgctggaggaggctgtcaggctgtgccgcgccggcggcctgcagggcatcgtgtcggaggccagggcggtgttccggcacccgtcggcggtagccagggtcaaggagtccgacctctccctgctcacctacgggcagctcaacaacgtgccggaggcggtgtacatgcagcacctgatgggggtggacggcgtgatcgtcgacctggtgcaggagatcgccgaggccgtttcggagttcgcggccgtggtcgcaccggagcccagccccgaagaaggccaggccggaaggttgggactggatagggctgcgccggcgaagaagacgcccaacttctcgcagcgggagatttccttcctgctgaggctcatacccgagctcgtacagtagcgcgtcttcttctcggatagtagtatccacggtgcgcccgtgtaggttgaccaatctttgacacctcggaactgaaaccccaaggcccggatgcggcatgtaaatcagggccaccacgacccgtccgattgtttgcatcaaggtgaaatccactagtgtttgtgcctgtgtaaaaaatgggcgtgtggccattgagtgttttgtattgtatattgctattttttcaaaaccaatgcaaaaaaaaaaaa

SEQ ID NO: 441 - DNA, 432 bp, Triticum aestivum
  Clone ID: PAT_TA_441
gccacatgccttgtatgggcgtgcccgtggcgccctgcactcaaggatggcgtggtggaggagtagctcgttggtggctgagctaaagaggaaaaatgaggccttgacactcctcgggcctccctcgaatcgattgtaggcgaggaatgtggtgtatggaggagcaggagggcgagatggtgttcataggagaatcgggtgtccgggaggaggaggtgggggctcatgtgcagaccaacgggatcctcttatgatgaccactggcgagagcaaccaagagtattcgtggatcaacacgatgatctcgagcacagcacggggcacaattagacagcagatggacaatagggggggtgttcttgaacataacgcacaatgacagcactgagaagggacggtcattctttacggcaccgagagcccgggacgccg

SEQ ID NO: 442 - DNA, 836 bp, Triticum aestivum
  Clone ID: PAT_TA_442
cgaccccgcgtccgggagttatactactctctgatataactcctgttcacaaaaaagtaaaggaagcaaagcatctgcagcagaacctgctagttccattctaaaatcttcaaacagaagttatatcagagactggtccatgagttgcttgagaaagagcagaatccgactgtaaaatcaaggctggcacttgctttccataacctgacaagttcaaacaatctctcaagcacccttgaccggccaaacaggcagaaattccggaaaaatctccgtgttttcttaggcgaggtctcgggcttcatgcagataaagtagatgcggagtgacatgaaagcattgatgtctggtcgatccccagaagatttttcgccgtcgtggccgagtccatgtgcggcggagccatgagcaggaattcttggcgttaagaggttgaaaacgcattcgccgttgtgtgttgaagggatagttgaaaattgaaacagaaatgacaggaacatgtcgacgtgttccaggatctgtgtctggctgcatttggcggtggagaattggacgccctgacatgagatcgtcgtgtaaatttaattgggtctcgatgtaatcatacagaaaaggcggacatttttttttaacggagaaggtggtcattttgttgcgactgctcagatggaacagtttttttctcccacgtgtatgggagatacagcttagaagaagcgattcggcaccttgtggtgcgtaacttttgcccgtcaggaaacgtgagacactgggcctggggcctgcttttgcaatgctcgatttttaccgaaaaaatatacatgcaattgaagaaa

SEQ ID NO: 443 - DNA, 973 bp, Triticum aestivum
  Clone ID: PAT_TA_443
gattaccggcgagcggtggccggagctctcgacaaaaagatgccgcctttccctctccccgtcctggccgtcgtcctcctcctctgcctcggggccccgcacgccgccggcaacccgccggacccgcccccggccccgaccccatggccgcaccagttccacgcgaagctgctgatggactacaagggcaacctgtcgctggcggacctgtggtacgactggccggggggccggaacctgcacgtcatccgctaccagctacctcgggccgcgccctactacgacgcgtagtggaacaagggtgggccaaggtcgaacacgccacctactacgaggttgcccagaccaggcgccccctcaaatgggtcttctacacagggcggacggcccacgtgatgagcttcgagccgggggcggtgctagaggacgccgcggaatggcaggcgcccgactactgcttcgccgccggaaatgaccgcgccgaccgggccccccgtccgggcgtcctcccccgccgcgcggtccccgcgcgtggcgagcctcgtccctcgggcggtgccgggcgaccccatggaatggcaggcgcccgactactgcttcgccactgagaatgaccttgcctccgcccctcattacgggtggggcgctggtgtctgcgcggcctggtgtgctgcggcatccggcgtctgttacactttgccggcgaaccggcagttcccctctgctatgcgaagagagcctccgctaccgttggttcactgtcaacttcgcgagttgctgcacagtcttgatcaaagattcaaaggcacgtacgtagtaagctgaaagtgccactgctccaagtaataagactaagaaaaggaaacgacttttccagctacaagtgtcaatgctagctgcttgacctcaccgagtacttgctaacgcagttggcgagagatcgatgttgcgtacgtaaaaaaaaaaaaaaaaa

SEQ ID NO: 444 - DNA, 909 bp, Triticum aestivum
  Clone ID: PAT_TA_444
ggacgtgctcaccgaccggcgggccgcgaccgagctctacttcgatgttaaatcggaggtggaggaaatcatcgcctacctgctggagaagagggaggaggacaggtacaggagcatcctgcccaggctcctctacagagctgtgagggggcccaaaactgaagtcccagccttcaacccttaacatatacagtactactagtaatgttgcacgtagcactaaatatggatgtatatatattctcaaaaactcatgacccataccataatactaatactctacatgattatactacacaaaagtggcgtgctcatttacaaactcttagctccaagctaactgcggcggcggaggcgcaggcgtccacaccgtcggcagatactcctccgagaggaggacggcgaagcggtgcgcgccgatggcggcggacacggccgagacgacgagcgcgctccagcccaccctgaccatcagcattggcacctccattagatccttgacaaactttgagaatatgaccttcagccttcggtccctcacgacctcctgtaacgacgacaccacaggtgaaatcggtgcttctttggacagggacatgcccaggtcgtcacccatgcggtccctggaccgtttcagtccggccgccttgaccatccactggcagacgacgtcggcgagagcccggctcaggagggcccggaatatcgccgcgtctttggagatcaggtcccgggcaagagacttgtggtttgctgtcattataagtctccttatcacaatgctatcccttgatagtaagagcctcagacaaaggtttgcagtatgcatcgccctttctggtgtggcgcggtcgagggaaggacgcgtcactgatctctgcaaggtttgagacatccagaccctttctc

SEQ ID NO: 445 - DNA, 1029 bp, Triticum aestivum
  Clone ID: PAT_TA_445
gatttgatgtgataaataaggttgtcaggctgcgagaagacgacagaagggaccgaggttttggaattacccttttaactcaatcaccagcttctgccctttggtggagttcatatggtggggctcaacatgctatctggaggagcttgggctacggaaatggtacgcagaagaaaccctcccatacagaacttgttgctgtgcaagcaacagctggaacaattgctggagcttgctcatcgattatcactacaccaatagataccatcaagacccggcttcaggtaatggacaactatggcagtggaaggccatccgtcatgaagactaccaggctgctactgcgagaagaaggttggagaggtttataccgagggtttggaccacgctttcttaacatgtctctttggggtacatcaatgattgtcacatatgagctaataaaaagactttctgtgaaacctgagcaatgaaccttttggcttctgctccgcctatctggtcatcatttccgttttggccatctagtgaattccttttggtacagggattggcatgtaacactggttggaaattcttgatgcaagtccccttataaagtctgacatgtttctgtacggaactaccctgtaaatacctccaagtgcaagggtgctcgtttcagatgagagccagaggatcgatctgggtactggagcgccttgtagttgttgagcaaaaatttccctgtaagtgctgaagggcgctcgtttcaggatgagagccagaggctggatctgggtactgagcaccttgtagttgttcagcaaaaattccggaaacatagttttgtgtcttcccatctaattggcatagttaccccacttgaattttcaatttcgcattacttttgtagctcacttcttgggatgagatgtggcatgtccaaatcaatttagcatcatcagtgaggtggtaggctgcaatgtataccttgtcgagtgtcgacattctacagtgagaggtagatacttgctttaatatttgtcc

SEQ ID NO: 446 - DNA, 495 bp, Triticum aestivum
  Clone ID: PAT_TA_446
attcaccagcccccagagcttgcgaataatccaccgcaataaacaaataaacccacctccatccgcgcaatctctcaatcttccacaggcatcaatggcgggcgcaaggaacaacgagctgcgcatgaccctgctcggcctggccctgctggggctcttgctgctgagccacaccgcggcgccggtggaagccgccgcgggcgtgcaggagaacagcttctccgtgaacagcgtcggcggccgcagtctcaaaagcttcagcatgaacaccgccgagaccggcgaggtcgccaaggggggggatgccaaacccgccgccggcgacttctgatcgacgaccctccatccgccgttgtcgagtattagttaaataatgagtgaattccattttttatcttgtagttgtacatttgtgacacatattaccctatttactggaacttttatcgaaatgtcagattttggagacttttaacacggttttaccccagttct

SEQ ID NO: 447 - DNA, 769 bp, Triticum aestivum
  Clone ID: PAT_TA_447
acccccgcgcgcccgcacgagcgaataatccacaacaaacaaataaagcaaacaccccacctccgtccgcgcaatctctcaatcttccacaggcatcaatgggcgggcgcaaggaacaacgagctgcgcatgaccctgctcggcctggccctgctggggctcctgctgctgagccacaccgcggctccggtggaagccgccgcgggcgtgcaggaagaacagcttctccatgaacgccggcgggtcaccgcagtctcaacagcttcagcatgaacagcgccgagagcgctgagggcgaagggggggcaggccagccccgaccccccgccggcgacttcccatcgaccaccctccggcacgccgcagtcaagtactaattaaataatttatcctccggttacctcgggcttgcatgcatggcgtgcatggctgcgtgcggtgggcgcgcaggatcgatcgatccgccggccacccggagctcctgcatgcactgcgcgtgaatgctgcttcgtttgattaggtatcgtgatttttgtttgtgtgtgtaatttgggaggtgcagatgcagtgcttgtgctgcacccattccgttgtgttgcttccgctgtaagggccgtctgttcgttcgtacgtggcctcattgatcattatgaaagttattatattactaaaaaaaaaaagtgatcatttgatctcccgacacggcaaggcgccctcgttaacagctccctccatttttaccgacaagcccatttaaagaaaaaaaaaa

SEQ ID NO: 448 - DNA, 1210 bp, Triticum aestivum
  Clone ID: PAT_TA_448
gaccgccgttgtctagaatggtgacgtgcattcagcaaatgaatcggctaatgggcttggtggattgttgccgcctgcgaagctgaaggaaatgggatggccgacaacaagcacagagaaggcgacgtacgaagggctgagtaagagaacaagattctgtacgatttgccgtcggcaggggcacaagcggacaacatgcccggatcatggtgacgtgccaaagcaaccaaggaagccagcaaggtgcaaaaattgtggcgtggaaggccataggcgaaataactgccacaaagctgggcagctaaggttggatcaatgatgtaatatcttgttgtgtggctgtggtaggcagaaagaatgatgtaagttggcttagtaagcctgtatgtttgttagtctggagtattcaaatttcaaatcgcatgggcgggatcccatgagtggccatctacaaaaggggagtggaggcgtatgtgtgcattgtcctgaagtaacagcaagaccaattgtgaaggagttggcccgtatggatcgacatggttgcctactcggtgcatcaggtctcaccagttggaaagattgctcgatcggtggcttgccggcgtcagagggaggtgcagcttcagagtctcccgtcaatcaagcttcagaatctcacttaagcgagcctgaagaatctaccgtctcatccctctcggaagaagtacaaatggtatatgggttggtccatgcaagcactcatccttacggatccgttgtgatcgatgcaggtagagaagaatcctgaaacagagtgtggaggggatgatagtggagtcgacgccgggccagccgtcgctggcatatgtgaacaagggttatggcgaccatgatcctgacgctgaagaagtgctggagggcactgtacaaactccagatgggtggaagatgatgtggttgaggagagtaactacgccatatcagtatcattgcggaccaatccctgcagggcactagaggcaagatctcgtcatggcctactgacgaggaagaggcgggcatggctacgaagctttggagagttctggtggatctgggagagcaatcgggtggattgatggaattatgtagagaaggaccgtggtgaagaagattggtaggtccaacgggtggatgcattgaataaagtatatgacgacgttagcaaaaaaaaaaaaagagaaagaacaaa

SEQ ID NO: 449 - DNA, 589 bp, Triticum aestivum
  Clone ID: PAT_TA_449
agcgggctcccgccaaaccacaagtgcgcagacacaaagcaaatgcataatcaaaaaccttgcacaggagcgaacacagtgcaatggagggagcgatgaagaagggcgccagggggatcaataggacggtggcgatggcataccccaggtacgccggcacgcccgcgtcccagcctgcccctcctgccagactacagcacccgcctaccacgccaggtccgctaccgccatcgacgccgcggcgggcgccgcctacgccgcggccgctgatgtcgacgaggagggccgcgaggttcatactgtccgtccggagagcgcttcaatgaacgagcatgacgatgatgagttagatgagctccgtcgtggccggtcaggtcggtccatggctccagggacgaggttttatatttggatggaacatcttcttgggtagccatggatatatacatacatgtctctaattggtacaccatgtacttttcctttttttgtcctctccttttgtaacttcagtttgaccataagagtggaagaaagggatgataacataatccccatctccgaaaaaaaaaagagaaaaaaagcaaaa

SEQ ID NO: 450 - DNA, 712 bp, Triticum aestivum
  Clone ID: PAT_TA_450
ttcgcggcggagtacggggctgacagctactccaccacggaggacgagcagccgctgcacgtgtcgaggaactcgtccttcgacaccgtcgtcgcggcgggggaggaggcggcggcgcggcggcacagccacagcctgcaccggctgatggggtacggctcggcgagcgagctgctgctgcggcgctccccgagcctgtacgagtacgggagccccgacaagaggtcgacgccgccgtcggacgcgagcatgcggcacgacgacaggaaggggaaagccaaatgcgtggatgacttcaccggcgacgaggactcggacgacagttgcacgctgaggcgatcgaacgggagaagagccggctggacgcctggccatggggttccggcggcgggagccatcaggatcaggtagcagcggaggagctcgagctgctcgtcgtatatatactgtagaaaaagatagtttcagttcaggcgatggaattctgatggtatttttcaggtgttggaattctgatagacagagtgaattgtgttagatttaccatttggttagatgggtgaggtggtgtgcacatttggttgatttcttcatttttgagtgcaacaatgttgcagaaatgtagatactcagactctcaatgccgtgattatgaggataaggaatatcttcaggtcctttctgaaagttttaactgaccaagtacagttcc

SEQ ID NO: 451 - DNA, 420 bp, Triticum aestivum
  unsure (1)..(420): unsure at all n locations
  Clone ID: PAT_TA_451
cccacgcgtccgcccacgcgtccgagatcagaccctgtataggcccgatcaggtgttcccgagattccagaaaatgcccaccagtcccgcacctccctcccgcagctcgctctcccccgattcctcctcctgcgacgaactcgccgccccgccctcgatctgccccctcccccccgcgccctgcctcaagatcaggccgtcgcgccgacaccgacccccgggatcaggccgccccggcgccaccggtcttggatccggccgccgcgctgcctgcctctgtcctcacctgtccggctccgcgcccgcaacgaaggggatggcaaagccctcgtggtccttcgatcgacaggcaaaagggggggctcccgggggaactttcctttctcttctttcttnnccctcaaaacctttntntctggt

SEQ ID NO: 452 - DNA, 1949 bp, Triticum aestivum
  Clone ID: PAT_TA_452
accactcgtccgtccacgcggccgggacacctcctcccctggagcagctgccgtcatcaccgcgccggactcctactcccggattaggtggatgcttttgcaggctgataaagacaactaactttgttgatcctgtgggcaagaagtaatgatccgacccagctccaaggagtcacttaattatgacaacaatagccagaaagtttatcctcaacccattgatgaaaatatgaatcagaacatgggcagtatgattggaagaatattcaacaacatatcctctttaaaggctgcatacattcagctgcaggaagctcacaccccatacgacccagacaagatacaaactgctgataagcttgtcatagatgagctcacgagcctttcagaactcaaacatacttacagagagagaaatcctaagccagtggcagcatcacctcaagattcacgcttgctttctgaattacaggagcagcagaacttgttaaagacatacgaggtcatggtaaagaagttccagtccaccagccaagtcgaggcttagtggatttccagtgaacaggaacatacatgtgattgtcatggaggaggagaggagagtctacgagtggagtacgatggtgtgtaacaagtcggttctcaacttagctgggttgatgctcttttcaggctggcaaatccaactaaccttgctgatactgcgcgcaagaagtaatgagccggcccaggtccgaggagtcaattaattattacaaaagtagcccgaaagtatatcctcaaccaattggtaacaagatgtatcagatcatggcctgtatgagcggaagaatattcagtaagttatcagctgagaactcgatgaggcacagtatcggaaaacatagctcgagaaggaattgaaacaaaggggcttactcaacaaagattctgatgaatctgatgaagaagagatctacctctctattgagctaacgccaagtttatttacatctactgctggtattgcatacaaattaatacatgatttctcaaagccctggacaacaatagtgataacagctgtgcggggtctcgatacggctgctaacgtacttgaacccgatgtagtatactgaagatgacctctttacaggtataaatctgtgagctatatctgcgaaaaaatgatcagtggtttacatgaagagagattgtccatcatggcagctactgccagggtgtccaatgaggctttcgttctccagttccttggcgtgcgagccatggatcctcttgttgtattgagccagaacccggattcggttttcgggaagttctgcagaagcaaatacctgttacttgtgcaacaaaaaatggaaggctctttcttcggtaacatggatcagagaaactacgtcatgagcggtggccatccaaggacagctttctatcaggcatttctcaagttggcgaagtccatatggttgttgcataggctggcatactctttcgacccaaaggtcagggtcttccaagtgaaaaaggcaagcgagttctcggagattcacatggaaagcgttgtgaagaacatcatcttggatgagaatgccgacaggcctagagtcgacttgatggtgatgcctggtttcttgatcgggactagcgtcatacagtctcgagtgtacctttctgctgtaaagtgtgccgactgataagtgttcgggttgcctgagaagattccaggcgtctcacacatcctgcaagatcatcgtacgtcttgtatgtaatgccgcctctccaaaatgttattcgtatgaaatgtggtcgcaacacctttttcgtaagaagcatagtatgctttggtcattcgaagactgtaatgtgtgcttctgttttgtaatgcatgtaaatcctgtcccaacgtttggtctacatataagttatgaaaaattgtcaaatgtagttgg

SEQ ID NO: 453 - DNA, 869 bp, Triticum aestivum
  Clone ID: PAT_TA_453
cacatctgtaatggctgctagaggtgccttgtggaatgcctccattttctctgctaaaggcaaagtaccttgggaggatttcaaaacagagtatgtgagaaagactattttgtgggacaacgatattaagagcacaaagacaacgctaagagaaatcataatgcactacatttgccttgaagggactgaagggaaaggtgtgataaagtgtggtttgtcagcagatgtagcgagactttacggggaagaggattactataattttgttgtttcaaataggaaatgaacaaaacaggattttgctaacctctatgtgacccagcttctgcttggatccctcggttgggtttgttttgttttatgaatgttttctccggagatctttgcatgagtttgggagaaattcacatatcaccaaagaagagatgcagtttgggcttttgcactgtgccatcttggtatctgatcaagatcaactgaggattcatggattccttatttcgtggggtacagttttgcgccgtgttcttataggattttttttttgacaacaaaggccgttgatttagactgacaagaatctagaagcattttgagatactgtattctttccattactgacaaaatatataatccatgacttgctgatagacaccatttctgtaagcttacatatattttagttattcctgccaaatctggatcgccgaaaggctgtgtcatgtattattggatggaaatcgtgttatttggcaagtccaagaccttattgtgttccctgacacttgggttagatccaattggcctctcagggtccaaatgctttggagttgtttgataaaagaaaaaaacaggttttgtgagaaaaa

SEQ ID NO: 454 - DNA, 561 bp, Triticum aestivum
  unsure (1)..(561): unsure at all n locations
  Clone ID: PAT_TA_454
ccagcagcagnagcactcgagtaccttctaggctctccgttgccggttgcgtgacgtgccgtcgcccgcgcctcccaccgcagcacgccggccgagcgcccatggcgtcacccgaggacaccttccacccgccattctccttcaaattcgtcgggatccggcctgatccggatggatccggatgccgacggcccattcccgacctccctgccttgcctggttcgtcggcctctccgatgtcgtcatcttcgtcacgggatccagcgctaccgatggctggcctcctcctcgcctggatgtgaccccccccacgtcggagcctccaacatgagcagcagcagcgaacgcctcgacaagggcgtcttcggtgttgtctttattttaattttattttaaagaagtttgccagatcagtggccagggaaaagccatggcgatgaagtctgattgatgtctacggagcgctcggtgggcgcttgatgtggtggatgcaaaatagtataacttatattagtgggctcacatctgaaaaaaaaatatttggactttacatttttgctg

SEQ ID NO: 455 - DNA, 814 bp, Triticum aestivum
  Clone ID: PAT_TA_455
cgcgctcgagcgcctgcccggcacccccgaacacgagcaccataccagcagcaggcggccgcaccccagcagcgcactcgagtaccttctaggctctccgccgctgaccgccgccggctgcgcgacaggccgtcgcccgcgcctcccaccgcagcacgccccaatggaggccgagcgcccatggcgtcacccgaggacaccttccagccgccgttctccttcaaattcggtccggaccccgccggatccggatgccggcggctccattcccgacctccctgccccgcctggtttgctcggccactccgatgtcgccctcttccgtcacgggctgcccccccctcccgatggcgggtcctcccccctcggctgcagtcatcaccgccacaagctccagcgcacggtcggcctactccccagcttgcattgagacaacccccccgttcggcgcctccagtcaaaacagcagcagcgaacacctcgacaagggcatgacccctgatcggtggccggtgatgtggttgggggataagtttgcctgatcagtggccagggaaaagccatggcgatgaagtctgattgctgtctttccattgcttcgggggtcgctttatgtggtggatgaagaatagtatagcttagagtagtaggccagatatggataaaaattatatgtacttaattttttgctgtgtatttcttaatatatatgcaaactccttttttctaaaataaaaaaaaaaaaaaaaaaacacatacgcgggaccccctccccattttccctcaatgggcattttttaaaaaaaaaaaaaaa

SEQ ID NO: 456 - DNA, 436 bp, Triticum aestivum
  unsure (1)..(436): unsure at all n locations
  Clone ID: PAT_TA_456
caagagagataaagtggattgctataatatcgagtatgaacagatcccccacttttgcttttcgtgtggacgactggggcactctgatctcttttgtcccacgccagggactcgcgatgcaaagggcgatctccccttcaattctagcctcagggcggctgaggatcggaagaagggtttttctggtgagagctcatccaaggaacggtatgaaacaaggcaaagcacgaaggaatcatggacaccaagctctcagcagaacaagggagtcgaggttacttccccagtgaagaacccctcattgaacaagcgcaagggtgggccgcaacaggtttaccgtanggtggaaccagccccgctcgccatgacagaacatggggaagtgcatgcgactactgaagaagcatcaggaaaaagctcagctgcagattctgaa

SEQ ID NO: 457 - DNA, 373 bp, Triticum aestivum
  Clone ID: PAT_TA_457
gatgcttggagtgaaagcagcaacccatgggagagactagcaacccatggtgatggtgctgtcagttcaaggcaacgtctgacggtctgcgtagtctcaggacgtctactcggcgccgacatacacctgcaattggcagtttttgatctacattaacgtacaaaccaccgcctatggagcactctagatccatgtaatgtgtgtacgtgttcatgtacctagtgctaatggaagtggcatgtagtacttgtagtgttgatcaaataatcatcatatgcatagttaaagcaaaaaactttttgtacttgttttcaacagattcaagctttccagttggaccccggctttttaaaaaaaaaaaaaaaaaaaaaaa

SEQ ID NO: 458 - DNA, 309 bp, Triticum aestivum
  Clone ID: PAT_TA_458
gaagtcttacgtactcagggtggtggtcatgcaatccattgccatggaatgggttctgtgaagccagatcgtcatcactagaatgagaacgacatcctggtaaacctgcatcagaagacgcgtcagaacattggtcgcatgaaagttgccttctcaataatgggtatgtcgaaaacgtgtgtgtgaccacgagtgcacgaatcgcgtccatttgccggagacatcttcgcgatcaagatcaccgcgaatacttgcctgcgcatggcacacatctgttgctacttgatcaatgcgattacgcacagcttc

SEQ ID NO: 459 - DNA, 749 bp, Triticum aestivum
  Clone ID: PAT_TA_459
ggttcatcagccccttctctgaggccgactgcgcctcgccaatctgcccggtcaaacctattcagcccctcagagctagcagttacagctgaccctacagaagagatgacagaggaagagaagaagctgcatgacaaggttgagttgattagagtaaagtttctgcgccttgtctataaattgggggcgacccctgaagaaacagtagcagcacaagtgctgtaccgtctgagccttgctgagggtatccgacatggaaggcagacaaacagagctttcagccttgagaacgcacggaagaaagccttgctgcttgaagcggagggaaaagaggatttgagcttctcctgcaacatactcgtcttgggaaagattggagttggcaaaagtgcaactataaattctatatttggcgaagtgaagtccaaaactgatgcttttggtgcagccaccaccagcgtgcgtgaaattgttggtaatgtggatggtgtcaagatacggatcattgatacaccaggccttcggcccaatgtgatggaccaaggagccaacaggaaaattctcgcatccgtcaagaaatataccaagagatgtcccccagatatcgttctatatgtggaccgtcttgatagtctgagccgtgatcttaatgacttgcctcttctaaaaaccattacttctgttctgggttcttccatatggttcaacgccattgttgctcttacccatgctgcttcttgtgcctcctg

SEQ ID NO: 460 - DNA, 905 bp, Triticum aestivum
  unsure (1)..(905): unsure at all n locations
  Clone ID: PAT_TA_460
cgtccgcccctcggcttcttttcgtcccgccgccgcgcccctctccgcccctccatgcgcgagctggccctcgcgtgctccctgtccaaaaccctatcgcccatcgcccacccgctcctcttcatcctcgtctccccctccgcttccgacgatctctccacccactccttcgattaccgcgctttcctcctcgtcggatcccgccttgtcccggcctcgctcaccgtcgtcaacgtcggccccggcttccgggaccagtaccactccttcgccccggagtcgcccttcccgttgctgcagactaagccgccgccggcggcgccccaagcagacgatgcttacagcattggagagcagaaggcggtggatgcgatggtggagcggtttgggctggggaggctgcaagggctcgtgtgcgctgcagccgggcaggcggcggggatggatagcatgtatgccgggatgctccggaggatggagaagctcgccagggaggtggagaagagcaatcaccgcgtgcttgaccaggaaaggcggaacctggtgatgaggtgcaagacagcgggactgcaactgcaataaaagaccgaagcttctttcggtctcagcaagtgtgtatatgctccggaataccggagcagcgcgtctccagtcagggattgatcgtgcattgcacggcagcagttcagccattggagtaatggctctctagggtgaaagatggtgtgctccatggatggagttgggacgggcggcttgccgttcagaaactgatggtgctcggcaaagtgcagcngttgagtcgtggtcgtcgttgtgatgctcctcctattcgtttgtcgtgcgattgtgcacactgagtcgtaatgtatttcttcagacacaacatagcaacatttatgtta

SEQ ID NO: 461 - DNA, 616 bp, Triticum aestivum
  unsure (1)..(616): unsure at all n locations
  Clone ID: PAT_TA_461
tagcgtggtcgcggccgaggtacatggacttgctcaaaagcaaaaacatttctacgcatacatgaaaccactctgattctgatccatcgcattgcacagggcaatgaaacaaaacacacacacacacacttctaagtcacctagattcatgatcagcagcatcacatacatacgcatcattttactatttctcatccatcatattccatatgacagttgctgcaacaaaatgccataagattgtggctcagtgcaaatggactagggagatcctcctccggatgcatagttgttatcatcatgttctcaccgtcatattgcaaactcgagtgttgccattggcgatgtgatcatccatagcatcgtcaaagaggacatattacgaatcatcttcccagaaaaatagccagaggacttgaatctgtttgactggtagaaatccaactatgaaaccatccagctatgattctcactcgtctgttccggactcattgtctcctgaaagcagtgcatacacttcatattctgaagcagctagcaaggaaaaagagtcgacatcttcacgtcttcacatgcatacactgcatatcctnnngcacaatggagcannggangn

SEQ ID NO: 462 - DNA, 1530 bp, Triticum aestivum
  Clone ID: PAT_TA_462
cccgaagctcaaggccatcagttggggccatcactggcgagcccgcgccgtaagattcgccgaccccgcaggggtcaccctccagcagaggtgccccctgcccaggtttgagacgatctctggaaggcgtccgttctccaatgacactggcctcctgattctatgggcgcaccgatacctcaccggcgagaagcccttggcgggtatggtcgacccgaccctcagatcagtccccttggaggaggtcgcggcgctgacagagctggtgaaattgtgcataagagatgacccctggcggaggccgtcggttggggaggtaacccggagggatgcaagagatcactgggttctctcaaggatcagtcgaccccaaggaatagcgcgttgtggtggggctgagcttgaaatcctaacggtatagagaaatggtagcccattgtggaattgccttgaagccattctgcagtccatttggtagaaggatcagaggaaattgtacagtttggttttcttactctttaggcaggcatacagttgtacagatatgcctgcactgctcacactattctttcgttcttttggtagatgggatctgttctttttttccttcttaaatttgactagtgaaatcctgcagaagcttgtaaggcgcaaatatgtgccaaacgtttgtaaataaagtttgaaatgtgaaacaacttgtttcaacaaaaaaataagagaaatatactgcctgtaccacatgtaccagcagtatcctcctgtgatcctaagaaatctgaactcgtcgtgcatatacctgaccgaagacaacgctgcaaagatttcagacatcggtttcggcgatgactggaaagaaggcgaggacgaattcgatgagcctgaagagtgcaccatagtgtataggttgccttgcttcctgcttgagacgatctctggaaggctccgttctccaatgacaccggcctcctgattctgtgggcgcaccggtacctcaccggcgaaaagcccttgacgggtatgattgacccgacactcagatcagtccccttggagcaggtcgcggcgctgacagagctggtgaaattgtgcataagagatgacccctggcggaggccgtcggtgggggaggtaacccggaggatgcaggagatcactgggttctctcaggatcagtcgaccccaaggaatagcgcattgtggtgggctgagcttgaaatcctaacggtatagagaaatgctagcccattgtggaattgccttgaagccattctgcagtccatttggtagaaggatcagaggaaattgtacagtctgggtttcttactccttaggcaggcatacaggtgtacagatatgcctgcactgctcacactattctttcgttctttggtagatatgttcttttttttccttgttaaatttgactagtgaaatcctgcaaaagcttgtaaggcgcaaatatgtgccaaacatttgtaaataaagtttgaaatgtgaaccacttgtttcaacagttcagcggagacc

SEQ ID NO: 463 - DNA, 647 bp, Triticum aestivum
  unsure (1)..(647): unsure at all n locations
  Clone ID: PAT_TA_463
gtttggttctacatcattgccaatgagctggntgcactgttggttgcatttggagtgatacttgggattaatccttcaattctcggtttaacggtgttagcatggggcaattcgatgggtgacttgatgtcaaatgtggccttggcaatgaatggtggagacggtgtgcagattgctatgtctggctgttatgctgggcctatgttcaacacacttgccggcttaggaatatcgatgctgcttggagcttggtcgacagcacccaactcttacgttcttccgcaggaccgctctcttatttacacgatgagcttcctggttgctgggttggtctgggcgcttgtcacgctgccacggagcggcatgcggcctaacaagacgcttggggttggcctcattgctctctactcagttttccttttcattagagtaagcagtgctatggggatattgccactcccgggcttgaattagttgtttgtgtctattgtacatgaatgttgtttatacgaatgaaatgagttcctctgttctgttgttctcatgcctcaaatttagttgtaggctgtcaggtgttggaggcaataaaccagagcttgcctgcaactggtgtacttatctgtaaacttatcaccttgcatgctgat

SEQ ID NO: 464 - DNA, 406 bp, Triticum aestivum
  Clone ID: PAT_TA_464
ggtccacaaaaaatttagtgcggaaaatcacaaatagagaaaagaccagattatacatatacatctttttcacggagagtgtgctaatcatatattagtacacggtagcccaccatctatcggccacaatgattgactactctctactaacccacctacccttgagtagcccggcttgctgccatgtcctcccttcgatcacaattttcttgatgatcgtaagcacacaaagtgttgctccgccaaagacaatagcattgcggtgtttacaaagttcccaagtgatgagcgagagaatgatcctcgtttcatttcgcaaaaaagaaaataatggccctcgtttcgtttcccaagttattgtcaacagtgggagcttggtccggattcccaatagccgaccacacca

SEQ ID NO: 465 - DNA, 1476 bp, Triticum aestivum
  Clone ID: PAT_TA_465
ggcccgaacgcgggccgcccgagctcggcccgcccccccaccccacccgcccgcccaccgcatacccgcggggacaagccgccagccaacacaaaccaccggaccggagcagcagccgacgcctcacaaccgccgccgcgcaggcagtcgagccgaccggagggagccatggatcggtaccagagggtggagaagccgcgggaggaggtgcccatcaaggagaacgagatccgcatcaccacccagggcaggatgcgcaactacatcacctacgccaccaccctcttccaggataagggttgcgatgaagttgtattcaaggcaatgggaagggccataaacaaaactgtgatgattgcagaattgatcaagaggagaattgtgggtctccatcaaaacactgccactgaatccactgatattactgacacatgggagccactggaggaaggcctacttccgcttgagacaacaaggcatgtgtctatgattactctaactctttcaaagaaggagctggacacgtcatctgtcggatatcaatctcctctgcctgctgacaaggtgaagccgtttcttgaatacgagaatgaagaagatgcgcactcgcctcctgggcgaggaagaggccgtggccgaggccgtggaaggggaatgggaaggggtagaggtgcacgtgggaatggatacatggagtatgctgacggtggatgggaaaatgagcatgctcctgcctatgcaggcaatgggtatgctgaccatggtccagcttatgagggtaatgggtatggggccgtggcaggagagggggccatggtggtcagcctgattatcagcatgatggagggtattatgagcaggcgccggcggccaccccgacgtcggggccgtggtttcaggggtcgtggcaggagaggcggctatggtggtggccatgcctgattatcagcaagacggaggttattacgaggaggctccttttcctgcaccacgctggaggtcgtggtagaggccgtggccgtgggagaggcggcccagctcggggcagagggcgcggtggcaatgccaatggcaacatggtgtatgccgccgcttcgggcgcataagcagtccgcagctcgctgccgtcgttagttggatgcctgctccaagcatgaatatgtatcatctgtgttgtttatctgtgatgacatatatactttgtataagcctgtcattcattgggaatgaggccagattttgatctttgactagatttgtaggggtagcgccgttatgattgtgctttgttttttcaaagtagatgtcagactaattgtagctaccagttggtaaaggtttagagcagggcattctttcaatttttacataaacgatagagcagggcattccaaaaatagtcttgttttctgttacattgtgccaatttcgtttggtgtcctgtctttgaaatgtaagttcaatttagtggtcctt

SEQ ID NO: 466 - DNA, 715 bp, Triticum aestivum
  unsure (1)..(715): unsure at all n locations
  Clone ID: PAT_TA_466
tgtcgacccaaagaccaaggtgggcttggtattgagaatttaaaggttaagaacagatgccttcttagtaagtggttgtggaagctcgtgtccggtactgaagcaatgtgggcgcaaatcattcgcagcaagtacctccagactagaacgttatcgcaggtatcagttaggccgactgattcgcctttctggaagggactaatgaaagtcaaagtattactgtttaataggacaaaagtggtccttgggaaatggtgctactacacgtttctgggaagattcttggctgggtgactcgcccttggctatgcagtatccttctttatatcgtattgcgcaacgacgagaggtgttcgtggcaacggtatttcaaactatcccccttaatattcagtttaaacggtcgttagtgggcaccttgggaagtttggtccattnntaagggacaatggnggtcaatctctgacaacctgattnttacccgggaattgccaaaaagggnattacantgngncaagtacctgagtataanccaatttatcaactcaaaanggtggganttaantccttaaaaaaaggtttannggttgcaanaatntttccaaggnattttaaccttttggaanccaagggttttntttaaaaaaanaaaccntttttgcccaagggtngaggggaattctttattccccccccccntttgngnaagggttcc

SEQ ID NO: 467 - DNA, 1204 bp, Triticum aestivum
  Clone ID: PAT_TA_467
tcgggtcccgccctgcgcacgagctttctctcttctcttctctgctctccactgtccaggaacagcaggagcacgaagaaggaaaagaggaggaagaagatgtcgatcaagcactgcgacaagcacgactgcgagcggcggcggctgtaccgccagttctgcgctgccctggtggccgtcatcctgctcatcctgctcatcgtcctcatcgtctggctggtgctccgccccaccaggccgcgcttctacctcaacggcctcaccgtggcgtgcctcaacgccacctcctccccggcgtcctacctcaccgtgacgctgcaggcgacgatcgccgcccgcaaccccaactcccgcgtcggcatctacttcgaccggacggacgcctacgccgagtacaaggggcagcaggtgaccgtccccaccgcgctccccgtggtgtaccagggccacctcgacgtctcggtgtggtcgccgttcctggtggggtcgaacgtgccgctggccccgtacctggcggtggcgctggcgcaggacgagacggccggctacgtgctgctcaccgtgcgggtggacggctggatcaggtggaaggccggggcgttcatcaccgggcactaccacctccgggtcaggtgccccgccctgctcaccgtcaacggaggccagggcagctacggctccatcgccggcggcggcgggaacggctacttcaacttccagcgcgccgcgccatgcgttgtcgacgtctgaacccaaccgttctctgaaatccagagcccttttggttctgctgggccgtccctgaaactaatttaagctctgctctgctctgttcggtaaatacgtatagtacaatggatttttgtgtcattttgaccgttcttgtttttttgggtacttctttgatggaaataatccaataatatagtaggatggtatatttaagacgtatattcaggggaaaataagtcgttgctagtgttgtatctatactacatgtacttgtttttaaagaagcagagtttaatcagggagtaggcgcatgtgcgttgttgcagtcttcttgtgtttcatggagagctatagcacctataaagatccccccctcgcccgcccgctggctgggttgccttggcatgtaatgaaaggtcatcttggcaaaaaaagggggggcccggtacccaattcgccctatagtgagtcg

SEQ ID NO: 468 - DNA, 951 bp, Triticum aestivum
  unsure (1)..(951): unsure at all n locations
  Clone ID: PAT_TA_468
ggtttaggtttccccccgaaaataaaaaaattgggcccatatttggaaaccccaattgggaaacgggcgtggtggggtttaccaaaccttttctgcgccccgttttggtcaccccttggtttttgggatcaagggcctttccaagagggttttaaatggttggttcaaaaaagcaaagaacccatttctcctntgcattgcttcttgcactaggtagatggatctggccttgcaccagtgaaaaacggcatccttcctggtttcttctctctgaagaaaatgggaaaaattgcaatgcagatggaggaccccccatatgaggatcggtgtccagttgttccagtccgttttcatcaaaactaagcactgaagctgaattttcaccctatgctgttcacatgttgcccccattgtacaaagttgctgaaggatttgctgggaaagtcatcagtgatgaagttaagcagtcagcagaggtgaccagggacaaactacgtgatctcattggtgttgagaaatttgtggaaatttacaacagtgtccggaaggacctgaaagcaaagagggagagcagaaagcaggctgagaagcttgttgcagcggtcgacccagcgcggcacgccaagaggaagttgcgtatgtctgccaagcaccgagaacacaagaagcggaagataacagcgatgaagatgggaaggtggttgaggtagtttttgttggtgctagcttcaagcagaggcaagttcttccgccctcccctcccgccaggcagaggcatgttgtattgcgttcacttctgcgcggcaatgtcgttctgcttttggacttcgaaatttgggctagatggctggcagaaattttttgtatgcttatgtatacatgcatatatcaatcaagttacgctataccattgcaaaaaaaaaaaaaaaaaaactcgagactaggtctctc

SEQ ID NO: 469 - DNA, 561 bp, Triticum aestivum
  Clone ID: PAT_TA_469
gttcaactcaggagagggacacactctgggaaaaggttgcttgggcaggcttgcatctccgtatatttttccatataaattgtaaaagtgggcaactcgatgcttgttcctttgccattgaccgtgtccacgcgtccggctcagaaactgccgtgacagcactggatgcttgaacccaccggtagcatcatggagctaccaatgttaggaagggtaccacaagagatgattctgagaaggggtaaggggaaggtcctgaaaaggaacaagctggagaagatagatcttatcaccaaatatacgtggaggaagatgaagaagcaagaccctaagatggacgactcttagaacataactgacaaataagcagagaattgtaggtgctatggaatcgatgggtggtcagaattcttatcagtaatagttcatgcttgatgtatgtagctctcccctggcctactacattcaggacacctgccctgcagtcggtatcgagaaattatgtccattgctttttctactacattgagggctacatgtgtttcgaagagaggtttacag

SEQ ID NO: 470 - DNA, 706 bp, Triticum aestivum
  Clone ID: PAT_TA_470
ctcgcggggtggcaacctgcaagacagtctgaaaaatgaagcccgaaagaatgctgagggtgaagcagctcttctcatgataactaatctatattctaattctcaggaagaagtgaacaggttaaccattgagattaacaagctgaacagaaagttgaatgaagtggaaagcgtgtcttcggagctcaagaacaccatcttgctgctgaataccgaaaaggacacagctcttcttcagcacaagcagtccttggttagagtatctgatctggaatctaaactctctcaagtgcaggctgaactagagaattctgaacaaaaagggcaaatgcttaataaagaactcaaacagaagagagaagaggtggataccttgcagactaagctgaaagatgaagcacataagcacattgaagctgaagcatctcttcttatgatgacaaatatgcattctcagtctcaggaagaagtcagtgggttggttttgaagatcgagaggctgaatgataaattgaatgagatggagagcagtaagttggaccttgagagcatgatatccaagcatgcagaggacaaccgtatccttggtgaacaaaatctttcttctgaattaactatcagtggccttcacgatgaactggacatgttgaaggaaatgaaagtgaatctagagaatgaagtggggctccacattggtgacagggag

SEQ ID NO: 471 - DNA, 2314 bp, Triticum aestivum
  unsure (1)..(2314): unsure at all n locations
  Clone ID: PAT_TA_471
ggcgccacgagggtcatcctcccccaggggaacttcttcaagctgtcccagggggaatatgtagcagtggaggtcctggaaagcgcctacgcgcagtctcaacttgttgcatcggtttgggtctacgggaacagcttcgagtccttccttgttgctgtggttgtccctgagaagcaagccattgaggactgggctgcacttaacagcaagtctggtgactacgctgagttgtgcagtgatccgaaggcaaggaggtacatccaggatgagctgaatcaaaccggcaagaaactcgggttgagaggatttgagatgctgagggccgtgcacctggagccagtgccattcagcatcgacaaggacctgatcaccccaactttcaagctcaagaggccccagctgctcaaatattacaagaatcgcgttgatcagctgtacaaggatgccaagatgggaactgcacaagaaataatgatggttaaacatcagcaagtggatatgagctttctgaatgtttcctcaagagtcaaaactagtgtgatactatgatgttgcaacggtaagtaagttggctacggctcgaggcggtgacactttgtaccactactactgcattccagggccgtctccgctggggttacgaccacagagcacctcctccaattgacagataaagtggtggacgaatatgattcatacttttcctatcttccattagctcacattttcgatcaagtaatcgggaattactgcatctccaaaggggcttccattggattctggcaaggggacattaggtacctgatggaggatgtgcaagtgatgaaaccaacaatattctgtggtgttcctcgcgtttatgatcgtatatacacaggtatcaaccaaaaaattcagtctggagggctaatagccaagcacctttttcagtatgcttacaactacaaacttggcaacttaatgaacggattcaaacagcatgaagcatcgccattttttgacaaaatagtcttcagcaaaataaaggaagggcttggaggccgcatacgtctcatgctatcaggcgcggcacctttgccaagacacattgaagagttcatgcgagttaccagctgcagtgtcctcgcacaaggatatgggctcactgagagctgctcgggatgctttacgtcgatcgccaacgttatttcgatgattgggacggttggccctcccgtgacggcagtcgaggcacggttggagtccgttcctgaaatgggctacgacgcgctctccagtgcgccgcgaggcgagatctgcttgaggggacacaccttgttctctgggtactacaagcgccctgacctcacagaggaagtgtactcagacgggtggttccatacaggcgatatcggggagtggcaacccgatggcacgatgaagatcatcgacagaaagaagaacatcttcaagctgtcccagggggagtatgtagcagtggaggtcctggaaagcgcatacacgcagtctcaactcgctgcatcggtttgggtctacgggaacagcttcgagtccttccttgttgctgtggtcgtccctgagaagcaagccattgaggactgggctgcacttaacggcaagtctggtgactacgctgagttgtgcaatgatccgaaggcaaggaggtacatccaggatgagctgaatcaaaccggcaagaaactcgggttgagaggatttgagatgctgagggccgttcacctggagccagtgccattcagcatcgacaaggacctgatcaccccaacttttaagctcaagaggccccagctgctcaaacattacaaggatcgtgttgatcagctgtacaaggatgccaagatgggaactgcacaatgaaaaatggtggttaaacatcagcaagtggatatgagctttctgaatgtttcctcaagagtcaaaactagtatgatactatgatgtagcaacggtaaggaagttggctacggctcgaggcggtgacactttgtaccactactactgcattcaagacccggatccagcatagatctgcattcaaaagatacatgtcaaaataaaaatgtatttgcacataatgtgctactttttttttcctcgagcgaacataatgtgctagttagagccggtaaagttatcttagcttgtaatccttactacaaacaagattaatggataacttttgttatatataaaccactacaaacttgccggttttgagacaagacacctctattcgccggtttcgatctatggcgcgaaatatggtcgcggggtaacctgnctaccatatgct

SEQ ID NO: 472 - DNA, 1707 bp, Triticum aestivum
  Clone ID: PAT_TA_472
cccacgcgtccgcccacgcgtccggggcagggcagcgcggcttctgctgcacactacgggctccagtcacagatgatggcacagccaaggcaaaaaggcatggtacaaggtgcacaatttaatactgccaacgcagctcaagcgttgcaagggatgcaatccatgggagtcatgggtactttggggatgaaccagatgagaccaaatggaactattccatatgctcaacaacgctttgcccaggcccaaatgaggccgcagcaagcgtcgcagcaagctgcactatctccgcagaagggggttgctcaaggcttgtcgagaacagcatcgatcacaggattaaactcacaactgcctggagtgtcacaaaatgggcagatgatgcaaatgtcaccttcgcaacaacagcagcagtggttgaagcaaatgcaatcatctttggcctcgccatctcaacatcaaattcagcagcagcacaggatgctattgatgcaacaacttcagaaaggactgactccacaccagattgcacaagcccaacaacagcattcaccgcatctcaatgcccagcagttgatgcaacagcagcacattatgcagcagcttcagcagcagcaacagcaacaatctccaaggatgtcagcatctggctcccagaagtctgcaaacttgacaggatcgcagccgggcacgcctttgtcaggggggactatggctggtggaagtggaagtcaaggagcagaaggaactaaccaacttcttgggaagagaaaaatacaagacttggttgcacaggtggatcccctcggcaaacttgatccagaagtggaagatttggttttagagattgctgatgacttcattgaatcggtgactgcatttgcgtgtaccctggcaaagcacaggaagtcatccgttctggaagccaaggatgtgttgctgcacttacagagaaattggcatctgacagttcctggtttttcgaaggaagacaagcatccacagagaaattatgtaaaggcagtagtggatccccaacagccagagtcccacgcgtccgcaggaagtcatccgttctggaagccaaggatgtgttgctgcacttacagagaaattggcatctgacagttcctggtttttccaaggaagacaagaatccacagagaaattatgtaaaggcagtagtggatccccaacagccagagtgtgacgctgctggagttagaagcgcaagcaataaattagttgctaataattcaattgccaaccatcagacaagaggtccggttgcagatccttcaccaacatctacagtgggtcctctgtcaaaagttccccgtttctgagctctgtgctgttcccctcggtggaaggctctaggacatacaactcaccaatggtctaactcaagggacggaagcacagtggatatacgagcatctgcggacaaaacgatggccgatcgtttacctgtccaaaccggatgcttgtctcaaagtcgaaggaaaaaaaaaacagttgctagctgactgggtcattcgcaacgggcaattgcatgagtcgcctgtaaccttgttatccatgaatctttgtagctccccctcttcgttgtacatagcgttttgcaaacggggcagccccttctttttccgttttgaaaaagcttttatgcagacatggaggctatacatatatatattcgtgtgc

SEQ ID NO: 473 - DNA, 1701 bp, Triticum aestivum
  Clone ID: PAT_TA_473
ccgctcgttccgtccccctggcccctcccccctgctctcccccccgccgcagcccccgcaggccaccgccggcgaggagggaggcgccgtcggaggccgcggcgcgcggacgggaggaggctggcggcggtgaagatgggcgactcgtactgccaggactgcaagaagcacacggaggtggccttcgaccactcggcgggggacacggtgtgcaccgagtgcggcctcgtcctcgaggcgcactccgtcgacgagacctccgagtggcgcaccttcgccaacgagtccaacgcacaacgaccccgtccgcgtcggcgggccctccaacccgctcctcaccgacggcggactctccaccgtcatcgccaagcccaacggcgcccacggcgacttcctctcctcctccctcggccgctggcagaaccgcggctccaaccccgaccgctccctcatcctcgccttccgcaccatcgcaaacatggccgacaggttgggtcttgtggctactattaaggaccgggccaatgaaatctataagaaggtggaagatctcaagtctatcaggggaagaaatcaagatgctatattagctgcttgtctgtatattgcttgtagacaagaagatcgtcctaggactgtaaaagaaatttgctcagttgccaatggagcaacaaagaaagagattggtcgagcaaaagagttcatagtgaaacaactggaagttgaaatgggccaatctatggagatgggaaccatccatgctggagatttcctgaggcgtttctgttcaactcttgggatgaacaatactgctgttaaagcagctcaggaggcagttcagcgctcagaggagcttgatataaggaggagtcctatttcaatagcggctgctgtcatttatatgataacccagctttcagaggacaaaaagccgcttaaagatatctccttggccaccggagtggcagaaggcaccatcaggaattcgtacaaggacctgtacccctacgccgcgaggctcatcccgaactcgtacgccaaggaggaagacctgaagaacctgtgcacaccataggagccgagtggcagccatttcttcctttctctcgctctttttcttgttacataacttttgaaaattagatttgtcggaggggagtttcgttgttgcgagtgcttcaccaggcccatgtatatcccccgcctaattttatgtgcatggacctgtcggattcgggacgaagctaagttataagatctggctttcctttctggtaagctgatgcagaggttggtttcaaaaaaaagactaggtaattcgcaaccggcaattgcttgagtcccctgtaaccttgttatccatgaatctttgtagctccccctgttcgttgtacataccgttttgcaaacggggcagccccttctttttcccttttgaatgtgcttttatgcagacatcccggcggggcggcccgtccattccggtgcggaagataaaaggcgaccccccccgcgcccgcgggccctccgccccgccccgcaccggcggcggccgcgcccccgtcatcgccaagcccaacggcgcccacggcgacttcctctcctcctccctcggccgctggcagaaccgcggctccaaccccgaccgctccctcatcctcgccttccgcaccatcgcaaacatggccgacaggttgggtc

SEQ ID NO: 474 - DNA, 437 bp, Triticum aestivum
  Clone ID: PAT_TA_474
gtcgcttacgtcgctctccagtcgtgccatgggttggacgtagaagtagaatatgtgaatcatagctagaaatcaactacaaactggcaaaagaagtggaatatttagcaaaaagcaatgctaattagttatttcagatgtgcgattgttgctgaacattaagacaaaagaagtagaataactaaccaatcattaaagttaaagtggaatatttagcaaagtagtgaacccgttgcgcccaatgacgcatagacccgctaaatccaagtccgaactaaaaagaaaacccatgatttagttagtttaattatgggcaagcacatatagtaacaaactgaacactctttataataataataataaagaacgcttgcttgttctgtacaatacgatgtacacacacatttaaatttggcaacacaaagtttccatgaaaa

SEQ ID NO: 475 - DNA, 738 bp, Triticum aestivum
  Clone ID: PAT_TA_475
ggagaggcgaagaaaaataaaacgaacgaggcgtccgcctgattcgctaccgacctgacctcgccgccgttctccgattctccgctcgcctgctctgctccgccgcctctctggaaaaaaacacacaggtggcactgaataatagacaaggatggcttctactggcgtgaaagatttctaccggcagaagaagaaaggaggtgttggcaaaacttcagcatcttctaagaagaaaacacagaattacactggaggggcctctgttggggcctcaaataaggctcagacagcagcactaatttctcacggatccttagacctcaaagatgatttcagtgagcaagaggagcagctgcggcagtttgacatggacatgaagtttggcccgtgcatcggtgtcaaccggcttcagcgctgggagcgtgcttccgccatgggcctccagccaccgccccaccttcgtgatctcctagcgcgcgcctcctccggaaacaaccgcaacaacggcggcccctcccctgagtgcctctgggagggtaagatctagaatcaaatttcttccgccacgagtgctccttggcaactgcatggcttgcctactgtagtctgaaactctgagcccgttttaccacgcggaactcctgctgttgcaccgtatccttggttgtttgcttatcagatgttgctacctcaactcctgcgagtgtcatcttcagtttgccccgcgcaaaaaaaaaa

SEQ ID NO: 476 - DNA, 1115 bp, Triticum aestivum
  Clone ID: PAT_TA_476
ccacgcgtccggccgaggcaggagctctaccagtggcagtccgtggcgaggtccgcccggaacgcgctcggcatgcgctacaggatgctcccctacctctacacgctcaactaccaggcgcacctcaccggcgctcccgtcgcgcgcccgctcttcttttccttcccggacttcgcgccgtgctacggcgtgagcaaccagttcctgctcggcgccggcgtcatggtgtcccccgtcctcgagcagggcgccagctccgtcgacgcggtcttcccgccgggcacgtggtacaacctcttcgacaccagcaaggcggtcgtgtccacgggctccggcgccgccgtcaggctcccggccccgctgaacgaggtgaacgtgcacgtgcaccagggcacggtcctgccgctgcagcgcggcggcaccatctcccgggacgcgcgcgtgacgccgttcacgctggtggtggcgttccctctcggcgcggcggacgcggacgcggagggcgccgtgtacgtggacgacgacgagcggcccgccatggtgctcgcggaggggcaggcgacgtacgcgcggttccacgcggccgtgcgcgggggcaaggaggtgacgatgcggtcggacgtggccatggggagctacagcatgcacaagggcctcgtcatcgagaagatcaccgtgctggggctgcacggcgccggcacggacctcgccatccaggtcgacggcgcggacgacgccaccgcggtcgccacgtcgagcccctacttcgcggccgccgacgccgcgcaggtgctgcgccaaggagaagaagatgacgccgtggagggtgaaaagaggagcggcgtgacgatggaggtgggcgggctggcgttgccgctggggaagagcttcaccatgacgtggaacatgcgcatccaagcataggtccggcgagctgcgcttccctctgcttccgcctgcgtcccccgtctccgcgtgtgtgcgcgcgtgtctcttttcttggagcctatggggttccgcatctcgtcggggggggggcggctctccctcgtgcgccgggggtcggttccctgcccccccactccattcgcgctcctgccggatcccctgacgta

SEQ ID NO: 477 - DNA, 1048 bp, Triticum aestivum
  Clone ID: PAT_TA_477
ccacgcgtccgcaaagacaatcatccctgcatgcaatgctgtggtagatatgtcaactaattcgagagatcttattgagcgagaattagccgcgtttggtcaaagtctggagaatagcctatgcaggttaccggcaactcctcaggcccttttggaggctgtaggttctaatggtgctacagggtcagaagcacttgcatctgcagaaaaacaggctgctatgttaactgcaagagctggtgctagagatccttctgccataccatctatatgccgcatttctactgctcttcagtataattctgtttcaccaggtacagaaggcacggattctggcttagcatcagttttgagtgcattggagttttgcctaaaaccttgtggttctgaagctagtatactagaggatctatcaaaagctattaatttggtgcacacacgaagaaatcttgctgagaacgatcgtgttttgctaaatcgtgctcgtcccgcgcgtccggaatatgaaagggtggccaactattgtctcaaattagctggtgaacaagaaaaggtcgtggcagaacggtggttgcccgaactgagaaatgcagttcaagaggcgcaaaggtgtttttaagattgcaggcgtgttaggggccgccgccccgaatggtacgagcaaccagcagcgacaatagtagactgggtgacgattgatgggcaaagcgttggtgcctggatcaacctcgtgaagcaactccacatggagatctcaaggcgaacacttgccatgtcttcggcaggtgaagaatagggcagctgcagctgctaccgcgctttatttttattctttggaggctgttgggtctccggccgggtgtatctactcgatagcttttgtgccatatgctgttttgtaattgttatatgtacgcatcctttttggtttgggttgtaattaatttgtttatcatgtagtatatgtttttgtatgttttatcatgtgctaaatatctatttttaagagctttgctattaaaaaagaagaagaggggaaggaagagag

SEQ ID NO: 478 - DNA, 1405 bp, Triticum aestivum
  Clone ID: PAT_TA_478
tttttttttttgatgcaaatcgagcgactatatttgccttattaaaatgcgttagacacagtacaaaaattggttgcggagcagagagagaaaaaaaaaggcaatacactaagcctataataaacctcaaaagcaaatccattctcggatatctatcagttacagcgagctgatcacaccgaagccatggcagtatctcccaatcaatcaacaacaggcttatgcaactcaacacgaccatgggtgaatggcctcggatttggagctcaggctttactaatcactattaatcatgaaaagcgatggaaaaaaaaagcatctctcaagccgcagccgacttgcgcagttcactctcaccatgggcgaagtggcatctgtctccaaatgtgcaagagcctttgttgaagttgtcacacagcttggtcttgaagttgcttcccccaccaccacccgcaggccccctccctgggttctttgcttgaggaggggcgttgccgccaatgcggagaatcagctctttcaccattgcactcgcatggttgacctgatcaaacgacccctcgagctcaatgtttttatggttggggtctgcctcattatcccggatggccagcttggccccagtcattcgggatatgtgcttcgtgttgactccacccttcccaataatggcgccagcaagggatgcatcaacactgatcttggctgtggccgaagcgccaaaggttgagggagggaccatgtctgggccaggcatcggtgggggctggaagtgaccgttgggtcttggtcccattggaggtgccattgagttgttcaacagcatgggctttccgagctccctctctccatgagcaaaatgacacttgttcccccatttacaaccttctgctgtgttaaacttgttacacaagcgagtcttcaagctgggtgtaggtggcccatcaggaacaccaggtcccatgggcattcttccttgaggagctgaaacagctggaccacccaagttggtcatctttgaaacagcctggtgacctccagggaagttatggagaaaatggcaactcgatccaaagggacaaccagcagtgctgaaaaatttggtgcatggcttcgatttgcttcctacacccgtttgaaccgactccgattctctggcgcgcttgacggcagcgccgccgttggtgccctccggcacggccctcttgcggcccgcgtccatggcgagctcgggggaagggcgatgcggggtcgacgtcggcggcggcgcgtgaaaccctaggctagggtttctctctcgcgggggcggcgtcggtatagagagagagagagagaggaggaggcagcacggggcctcacaaccggagagcggcgtcggtcgcaacagacagagaggaggaggcag

SEQ ID NO: 479 - DNA, 579 bp, Triticum aestivum
  unsure (1)..(579): unsure at all n locations
  Clone ID: PAT_TA_479
gttacagcaatgcaaggtgattacggcaanaataatatcttggaatacaacctcatggacaagaattggatcaaagaaagtaacccgtgatgcgatttcagctttttcagtctcgcctgatggtacacttctagcaattggaactattgagggaagcatcagtgttctaggtccaagagacatgcgagtggttctaacagttaaaaaggcgcatcttggcattgttactacattagcgttttctcaagattcaagggccttgctgtcgacttcctttgactcaactacaagggtgacatcgactgaatcacccaagagcgatggtataagcctctggtccatggtactagctattatactcggaatcttggtatattactatatgcagcacaaagaagatctcttagcaatgttgccacaatgaaatttttgttcagcctctactgctacctcgctgcttacctctgattatctgatcttgtgctggagataaatgctgtatcgtgtcggagctagagcaatttttgtatttaagtgaaagaaaagcgactcaaaaacgttcaaatccttttatcaaaa

SEQ ID NO: 480 - DNA, 1377 bp, Triticum aestivum
  Clone ID: PAT_TA_480
cggccgccgcttcgcccagtcgcagtctttcaccgcatctccggcgaccaccgaccacccccggccaccgctactccttccctctcctgtgatggcgcctcgcgccggcggtcagacctacggcttcccgatctactgcgcctcctggctcccactcgcacacatcatcaagccctccccatccgccgacgacgtcgtggatgcggacgcgtccccggccccgtcctccccacctccgcgccccatggtggtccttggtggaggcggaggcgagggccggagcggcgtgcccaacgcgctggtcgtcgccgccctcgaacccgccgctgcaagggcgcctccagcgctctcccccgagcgcgtgtttaggctggggacaaaagaacagctacaagacagtacggccgtatacccctgccgtgatggtacactttgagcaattcgcaatatttggggaggtatcactgttgtaggttaacgagaaggggatgatgcacatagcctaattttgagatctgaccaggaggctctagtgaagctaaatgatgttggtttacagctggctgtgtcatttagtggagagggttcaatacttgccactggtggcgaggatggacatttgagggtcttcaaatggcctggcatggaaaccgttattgaagaacctgatgctaaaacatctgttaaggatcttaatttgatctcttggcaatgttgccacaatgaaaattttgagcagcggctcatctagagtttgggatttaaagtcatctgaagctgtggctaatctgccaagagaacaaggagaaatatttggcttctgccgattttcatactaagtctgacaatagccagattctctttgttacagcaatgcaaggtgattacggcaaaataatatcttggaatacaacctcatggacaagaattggatcaaagaaagtaacccgtgatgcgatttcagctttttcagtctcgcctgatggtacacttctagcaattggaactattgagggaagcatcagtgttctaggtccaagagacatgcgagtggttctaacagttaaaaaggcgcatcttggcattgttactacgttagcgttttctcaagattcaagggccttgctgtcgacttcctttgactcaactgcaagggtgacatcgactgaatcacccaagagcgatggtataagcctctggtccatggtactagctattatactcggaattttggtatattactatatgcagcacaaagaaaatctcttagcaatgttgccacaatgaaattggtcttccgcctcgcctccaaccccaccgctgacctcgatctgtcggagataatcgtactgacgaggatactattagtaaaaaaaa

SEQ ID NO: 481 - DNA, 815 bp, Triticum aestivum
  Clone ID: PAT_TA_481
ctcggcacgtgggcggaaccggggcccggacgggagctagggttttagccgccggccatggccctctcctcgtcttcctccaccctgctccgccgcctcctcggatccacccccctctcatcctcccgctcctctgtacttcgcgccgccttctgctcctcctcctccgcggccccctcccccaccttgccacctccgtcgaccatcttcggcgacgacaccgaggtcgccaacgtgccgccgctcaccacccccaagctcttcgtcagcggcctttcaaggctaacgacagatgagaagctcaagagcgcgtttgctcccttcggacagcttcttgaagcgaaagtcataacagatagagtttctgggagatcaaagggctttggttttgtaaggtacgcgagtttacaagaagctgagaccgcacggcaggaaatgaatgccaagtttctggatggatgggtcatttttgtcgaccctgcaaaacaaagggagcagaagcctgctcctcagccggatactgcttcctcgcacgctggcttcacgataaataaaactgtaggatggtgtggttagttgcttaggctcttgagtcctatagatcacctagcaagggcatggatatgctgttctcgtgtgtttagggttattaatctgctgcaagatgcttctgattgttgttctaaccatggaaagtttatggcatcactacctgtattaatacataaaaatgacaacgctgttccttttttgagataataatgttgctctttgtggcttcacacgaccaaaaaaaaaaaaaaaaaaaaagaaaa

SEQ ID NO: 482 - DNA, 535 bp, Triticum aestivum
  Clone ID: PAT_TA_482
gccggcggcggctggtatgaagcgcaataagatcaaagcaataagctccatctcgcagcaaagtgaagaataagccatctggatccaagctcaactaccaatctacgatggagatgaagaagatcgccttcgccgccctcatggtcgctgcctcggccaccgccgtcgtggcctccgaagcagcacccgccagcgacgccaacaccgtggcagccgcccccgccgccgccctcgccgccggcgtctccttcatcgcatatttcctctactgatggggagaaggcatgagggagatcgatattagcatcacctcagttgcacccgcgcatgcgtacatgcgaacaatgcggtgttggcttttcctctaatttcatttcatttgtaatccgattatgtgaactggtgatgatacgagttatttaaatatatatatataattttcattcggtcatgtgaactggtgatgatacgagttatttgaatatatataattttcattctgtcaaaaaaaaaaaaaaaaaaaaaaaaaaaaaaa

SEQ ID NO: 483 - DNA, 740 bp, Triticum aestivum
  Clone ID: PAT_TA_483
tagactcccagccccggaggcctcaacacctaccagactaacactaccaccagctgcatccaagcctagctaccactctcctccctccccctctgtctcctgaggtgctcatggcctcgagctcaaacccggtcagcatggacatggacccgcccgtcgtctctatcgccgtcgagcacggcccgccggagtcgcgcctggttcagctcggcgtcaggtcctggcccaagtggggctgcccgacggggaagtttccggtgaagttcgacgcgaggcagacgtgctatctggtgaagggcaaggtgagggcgcacatcaaggggtcgtccgagtgcgtggagttcggcgccggcgacctcgtcgtcttccccaaggggctcagctgcacctgggacgtcgtcgccgccgtcgacaagtactacaagttcgattcgtcttgactttgccgggttcgcggtgactaattcgcctcctgatttagattggtgactgtgttagcctcattctctagctaatttgctagaccatatccgtctctattggcttccttgtgtgtagtacggaaaaaatcggcgtgagtgaggtgaggggcatctatccctcctgcgtagtatgttcctagttattcagttgcctcgcaaaaccggtcaatgcggtggccgttcaaagtattcttatttattgccctgagtgcagtgcaaatccgttttgaatgccaaaaaaatgacagtatgtctaca

SEQ ID NO: 484 - DNA, 656 bp, Triticum aestivum
  Clone ID: PAT_TA_484
cgggaacggcgcgcgcgagaccatcaccagattgaagcgtacacccattggtaatccgcatccgcaaggagacgtgtgggtatagtaaatcgtcgcacacacgtacgtgacgatcgatgaggatcgttggggctgcgaagccggtgaggatgtcttccagggagcgggagcccaacacgctctccctcggcgagcgcaattacgccagggaagcagcgctgtacgtgctgaccacgcgctcctcgcaggacgcagcccggatcttcaccgagggtctgaagccggtgctcggcgtcaggagcaactccacggactctgactcggaggatgacgaggaaggggacgtgtttgatccggacgtgctcgtcgacgatcacgacgtgcgccgtcatcgccagatgcgtggccgcatcggcaagaaacgagacttcgctacagcgcccttctaattacgttcacatccatgcaacacatgtactaattggttgtcttcgatcggttttgccacctgttcatagagctttttctgtaacatatgtaaatggttgtcttcggctctgccacaaacaaacaacatccgatcgggctaattttttcttaaggctacattttttttattaaattacagaaatattacgctgaaaaaagaattttca

SEQ ID NO: 485 - DNA, 1360 bp, Triticum aestivum
  Clone ID: PAT_TA_485
cccgggttcaccagagcggcagcgccccaaaaatctcgccatgaggttgggatccatgccggtgctctccctcttcgtcaacgcgctccccctcttcgtcgtcctccggtccgacgcgaatgcgttcgccacccccacagataacatcgtgaggcagctatcgtcggtggtgaggtggccacgcggttctcccccccactcgcccaagcagtcctcacacccccagtatgatgggaatgtagcagtgcaatatgagagtggctactttgttgagacgcttgttgaaggagacaagctcggtgtcacgccccacaccattagggtgtcctcagttgagggtggagagcttcttgcagtagactcagcacatagcaacattgtgcgaataaccccaccattatctgaatatagcaggggaaggctagttgctggttctttccaggggcatgcaggtcatatcgatggtaaacctattgatgcaagattcaaacgccccactggtgttgctgtggatgatacaggaaatgtttacattgctgatacagcaaatctggcaattcgaaagattggcgagtcaggggtgaccacgttgctggggtgtttgcgtctccggacgacgcgacgacgagcacacccgcaggcgcagatctgagattgagtgagtgtgtgagagagaaatcggtggagatggccgggaggctgactgcgatgggatcccgcatcatgggcggccacggcgcagccgcgcgcgccggggcctccgccctccgcaaccgcgccggcatgggcctccccgccggcaggcacatcgtccccgacaagcccctgcctgtgaacgacgagctggtgtgggacaatggcacacccttccctgagccctgcgtcgaccgcctggcgccgcacatcggcaagtacgaggctctggcgtggctggtgtggaggtctgagcttcttcgccgcctctctggcctggccgccgttgtgaatgacaaggcctccaaagaatgccatatacaccaaaagtctacccgttcgacaatttgagagcggaacttggtgatagatcataaaatatttccccccaccttttcaagtgtcacgatgaactgaactcaggacactgccttttatcgggatgctgtttgttgtcgtttgtcatgttataaacattggtcttgtagtttggtgaatcgagataatcgatcccagtttgcgcatatctatgcattgatccatgtaataaacaatatcgggtatcttgttgatttcagatcaattgacgatggtactctttgcaaaaaataaaaaacaaaaaaaataacctgcatcactatgggctctaccaaaaaaaaaaaaaaaa

SEQ ID NO: 486 - DNA, 761 bp, Triticum aestivum
  Clone ID: PAT_TA_486
attcggcacgagctccggcccctgcatcccctgccagtacaccgagaagaatgatgagaactactgctgcagcgaaactggctaccgtttgcctttgaaatgtgtacaagtacaaaatggtacaaaagaagagaacaaaacaaaggatagaaagatgttggctgagacatccacgccaactggcccaaaacattatgttacttacaggagttgtgtagaattggaggatgaagaggtgctatctattcttggtttcgaggtcctcatggctggaatgttgcttgtaagtgggccgttcgtgtattaccggaaacggcaagcaagtctaatgcaaggggtttcaagaatcccgacaaacgctcctaggttttagcacggaccagttaatgggattcgacagatcgctcatgatgatccgtcatgccattttggctttgctgatttcccctgtgctattgtaatgtatctatcgacacatgtacctacagaggaagcttctgataggactagaaaaccacagtggctagccttcttacattgtgccttgggttgaattcgtgaaccaaatctcttgtatcatactactatgtaacaaattgtgcctttttctttatcacagcaccggaatttcccaaaaaaaaaagaaaaaaactcgagacttagacctcggccgcgaccacgctaatcactagtgaattccccacgcggccgggacccgggctccgcccaccccccccaacccgtccacggtaaaacaaagc

SEQ ID NO: 487 - DNA, 534 bp, Triticum aestivum
  unsure (1)..(534): unsure at all n locations
  Clone ID: PAT_TA_487
aacaaagtccaacttgaatatctgatttgaccctatgataataattttctgaacatgtaactgtttctgatgatatattataagaagcaacaaactaatggctggaaaaaactttttccagaacgaaaaaaaattccaattgtctactgtatcatcttttcccattcactcggtttcatcggcggcggcattcaggtcaatcttcggcttcttcccgctgctgtgggcggcgggcttggtggggagcggcggcccccttggacgcttcaccgctgagcaccgggggtcggccctcggcgatgagnncacgtacgtgaggncaggacgnggcacgcggacgcggcgcatggccgggttcagcggggggcgacgcccgtgcttgaaggcggcganngcgggctgcgctttcccagggagnnggggcacgacgacnngaggtgggacgccagacgaggnnaggacgaanngtgtnccggcgaagcgggctgaccgggcgcggcggcggcgcgctgtnagggcgtncgcggacaccga

SEQ ID NO: 488 - DNA, 430 bp, Triticum aestivum
  Clone ID: PAT_TA_488
cgccacagatgccttcgtagtcgataggaaagtcccctcccactaacgcacatcgccgaagatgctgaagtaaatttagaaataatgcgagtagtaatatcaagtctaagacttggaactttgatggactgggataccactgttctcctaatcatccaacagttcacaataaaaacaatataatgttcattaagtcatgtttctgagattattttatacgtgcttggcacgtgctttttactagtatgagtatgtacatgttttatattgtagtatatattactactatgttagtctggaagcatataccttttgttgaatatacactcttttttttcagtgggggtatatatataccgcatattgcgactctttttttgggtaaaggaacatatgctatttacatcagtatacttcacaatatagttta

SEQ ID NO: 489 - DNA, 714 bp, Triticum aestivum
  Clone ID: PAT_TA_489
gcccccaggcaacgctacgcgaccgaaggacacgacgccggtagccaggtagcggcggccgacgggagagcagaggggacgacgcggcggagcagaagatgggcgtccagagcctgagcctgggcgtccagcagcggcgcgaccgcctccccgtcgacgctatccccgtgccgccggcgatggcggtgacccccgaggaccgcgaggaccgagggcccggaacaattaattcataacggacagatcagcaaagcaagccaggacaaccggaccaatggaaggagtttgccttgggggatttggacctggttgaaattctaaacaagtgctacaagggatcaagattctgctagaattcgatgagcttcacagcggattcggggctttatggcgatttcttaaattttttcttaaatccaatggatgaactagtgttgtgtctctggtttgacttggcaatatccaggggattttgaaattggccgcatgatggtattggacattgtcagaaactagattatgtcgccagttcgtaattctggccgggtctttttgcggggggtggctatgtatgcagttcctggcatagtgcatttgcttgctattgtttctgaaacgccattagtgccttcaccgctgtaggcccgtcccccctggaggggttgaaacatgaaggcattcttaaaaaaaaaaaaaaagtcgacgcggccgcga

SEQ ID NO: 490 - DNA, 1043 bp, Triticum aestivum
  unsure (1)..(1043): unsure at all n locations
  Clone ID: PAT_TA_490
actntccttactcaggaacttatcgcggcacgccggcttggtcttcttgataccacgcaaggcgtagtagtctcgaacagcctgcacccgagcctcgtgccgtaagttctggagtaggcgcttgcagacgttctcgataacatgtgccgctgtcctcctcgtatccctcctcacacctgtagaatgtccagaacgtcctgatcaccatgtctgccctcgtgtcgcacacgacaccgtcgataatctcatccggcggggccggggcagccacgtagtgctcccagctcaacccaagctctggaagccgaccctcaccaggcaacgtgacaaaccccgggaagttttgccggcaaagaactccaaggacggagttggggccggcggacactatgatggtggtcccaacccctctccccatcagggaagatcaaccacctctgctcgcgggtcgccggcacggaccgggagccgtgtagcaccacgctggtagacggtgcccccctcctcctcaagatcagtcggctccccgccatcatcagcatggccactcggctcctcgggctgatccggccaggtaacccatccggacgtgtgctcctccggggtcacgtgggcccgaggctcgtgggcccaagacccgtggaccggaggctcgtggaccggagtccgtgtagcctcctcctcggacgagtccaccctagcagtcacgtgctcgggtgaaacagctgggggtggcggcgaggaaggcgccgtagcagtcaccctacctcctctcccgcgaccacgtgccccacctcctctcttcctacctcgtcccctgctgggcaccgcggtcgacgaggaagggcccggcggtgtggccatactgtccagcaacgctcggcggagaggtgcgtctggaatggaagacctcagaccacgagccgacgaagaaggggccttggcgcgctcccgaccagagcccaccatctttcaacacctgccatgacaaacagtaaacgaaattagtacaacatagataaaggacgacatgaataataata

SEQ ID NO: 491 - DNA, 561 bp, Triticum aestivum
  Clone ID: PAT_TA_491
gagcccccgggctgcaggctgaatgggttggggatcaagacaggcgtcgatctaagcaaggtaatcgcagccggcgagttcatctgcaagcatctggggcgccagtctgggtccaaggcagctactgccttgagcaaggttaccgcgagcgcctcaaagctatgaggctgctcttagtgctgttactctgtaacatcataatgctgtgcccgtttattgtatgtcgtgatcccctgttgcagaagatacatgtacagtaccaatgcagaaagtacgtaaatgaataaatggtgcatttcattacacataacttgtacaggtttagcgtgtccctttgtaacacgctatgaggccggccttgaggctcacggcagggtagttaggaggtttattctttttatgttttatctctcttatctcctaaaccctcctgtaatatctctcgatggttagccttgacgctgccatctcctgtaccgactcccacaatcaatatatactccgcgggtctccatgtatggagattgagacgcttacccaaaaaaaaaaaaaaaaaaaaaa

SEQ ID NO: 492 - DNA, 331 bp, Triticum aestivum
  Clone ID: PAT_TA_492
gtacgctgcaagtacggtgcgaaattcgcgggacgacgaggttctcatcgtcggcgttctcatcgtatacgccgttggaggtttacttgttcaatggagactccgggcagttgtctgttttgaataggcatattggatgagagctccactgctgtttcttgctttacattatactcctatagatagaagaattattaccggggttgtacagggtatattattactgtgtttgttgatggccaggtgattatggttgtgccgatgattcttttccccacccaccaaaatgagagcaggttttgtgtgacttcatccacattaatgaataagt

SEQ ID NO: 493 - DNA, 409 bp, Triticum aestivum
  Clone ID: PAT_TA_493
tcgccctggtgctcgtcatgctctgccacatgcccaagccccgccgcaacaactacgtcgtctaccgctgctagccatccacccagatgaaccagcaccggccgtggacggacggatggtggctcgcccgccggcggccggccgatggccgaggtttgaccgtcgatggccgtggatcgatgatgcccaagtaaaaaggtcctgtttcctctccctcaccctgctctggttccatcgttgctcaatcttttgtaataataaatagaaacgtactgtaattagctgagatttactgctgctctgaagtttggccatcgccatgtcacacgagtgtgcatgtactagcacgagaagcaagcgaccactgctggtcgacgatataaatgcagaaagattttagattcatgtc

SEQ ID NO: 494 - DNA, 766 bp, Triticum aestivum
  Clone ID: PAT_TA_494
gcagccgcgctccgcctcccgctcccctgcacgccgtctccgtccccgccgccgcccgtcaccatgatcatctccaagaagaaccgccgcgagatctgcaagtacctcttccaggagggagtcttgtacgccaagaaggactacaacctggccaagcacccccaggtcgatgcctcgaacctggaggtcatcaagctcatgcagagcttcaagtccaaggagtacgtcagggagaccttctcgtggcagcactactactggtacctgaccaacgacggcattgagttcctacgcaccttcctcaacctgccgtctgagattgtgcccaacaccctcaagaagtccgccaagcccccgtcccgccccttcggctctggcccaccgggtgaccgccccaggggtcctcctcgttttgagggtgacaggcccaggtatggtgacagggatggttacagaggaggcccacgtggtgctccaggggattttgctggtgagaagggtggagctcctgctgagtaccatggagtgaagaagcgactcttcagcaagtgggagcacccaacaggtcttcagatccaatgcgcgcgtggggtgctgtcctctctgttgatgtttgaattctgcaaacactgcgatgattttgtttatcgagattgtagcttaagaccatggtttatgggttcgtttgtgttagaatgagctctttgatattaagacagatgttggtcgactgagaatctaaagatggtcaacttgctatttaaaa

SEQ ID NO: 495 - DNA, 498 bp, Triticum aestivum
  Clone ID: PAT_TA_495
tgaagggaaagggggccgtcgccatggggtcgggatcttgctgctgcatcggctgcggcaacggtggcgacgacgacggcggcggcgatggtggcatggggctggaccccaaggggttcctgctggccatgatgatcgccctggtgctcgtcatgctctgccacatgcccaagccccgccgcaacaactacctcgtctaccgctgctagccagccacccacccagatcaaccagctccggccgacggtcgaggtttgaccgtcgaccggcggtgtactgtggaagatcgatgatgcccaagtaaaaaaggtccccttccctgccctctttctctcaatcttttgtaataaatagaaacataattagctgagatttactgccgctgctctgaagtttggccgtcgccatgccacacaagtgtgcatgtactagcacgataagcaagcaagcggccactgccggtcgacgatataaatgcagaaagattttagatcaaaa

SEQ ID NO: 496 - DNA, 1025 bp, Triticum aestivum
  Clone ID: PAT_TA_496
gtgcggcgctcaggcggcggtccatcaaaaaaaaaaaaaaaaaaaaaaatccacccctcccagccgcgctccgcctcccgttcgcctgcacgccgcggcgccgccgtctccgtccccgcctccgcccccggcgcccgtcaccatgatcatctccaagaagaaccgccgcgagatctgcaagtacctcttccaggagggagtcttgtacgccaagaaggactacaacctggccaagcacccccaggtcgatgcctcgaacctcgaggtcatcaagctcatgcagagcttcaagtccaaggagtacgtcagggagaccttctcgtggcagcactactactggtacctgaccaacgacggcatcgagttcctccgcaccttcctcaacctgccgtctgagattgtgcccaacaccctcaagaagtccgccaagcccccgtcccgccccttcggctctggcccaccgggtgaccgccccaggggtcctcctcgttttgagggtgacaggcccaggtatggtgacagggatggttacagaggaggcccacgtggtgctccaggtgatttcgctggtgagaagggtggagctcctgctgagtaccagccagctttcaggggtgctggtggtgctgccaggccctttggccgtggaggtggtggcggcacttttggttctggagctaccatggagtgaagaagcgactcttcagcatgtgggggcacccaacaggtcttcagatccaatgcgcgcctgtggtgctgtcctctctgttgatgtttgaattctgcgaacactgcgatgattttgtttatcgggattgtagcttaagaccatggtttatgggttcgtttgtgttagaatgagctctttgatattaagacagctgttggtcgactccgaatctaaaagatggtcaacttgctatttaattgtgttttctgtcctgtgctgtttctggttccaagaagttacgtttcactttcttttgcaaaaaaaaaaaaaaaaaaaaaaaaaatagcggccgctc

SEQ ID NO: 497 - DNA, 893 bp, Triticum aestivum
  Clone ID: PAT_TA_497
gccggccgggttcgccggagggttcttcgtttctccctcgcgccgccgcctcctctctcgtcccggcgcgcttggagctcgacctacccgcgcgccgcccactatgatcatctccaagaagaaccgcaatgagatctgcaagtacctcttccaagagggggtgctgtatgccaagaaagactacaacctggcgaagcacccgcagattgacgtgccgaacctccaggtgatcaagctcatgcagagcttcaagtctaaggaatacgtcagggagaccttctcgtggcagcattactattggtacctcaccaacgatggcatcgagttcctgcgcaacttcctcaacctgccatctgagatcgtgcctgccacgctcaagaagtctgccaggcctcctggccgcccactcggttctggcccacctggtgaccgcccaagggggccacctcgctttgagggcgacaggcctaggtatggtgacagggatggctaccgtggcggtcctcgtggtgcacctggtgactttggtggtgagaaaggtggagcccctgcagagttccagccatcattcaggagctctggtggtggcggctttggccgtggtggtggtggtggtggctttggccgtggtggcggcggcggtggctttggcactggcccaatggagtgaactttcccctagtttggatgtgatgtttttgagtttaagttttgcatgatggttttatgtagtgatgtttgcgagatcgaccagtctacatatctataatatgctatcttgattcactctagtaaaatagctctgtgaaatactttctgttggatcacgaaccacaaaaaaaaaaggcccctccgggtctctccgggccccccctctttcgcccggctttggt

SEQ ID NO: 498 - DNA, 1836 bp, Triticum aestivum
  unsure (1)..(1836): unsure at all n locations
  Clone ID: PAT_TA_498
gccgggctcggacagtcgaagcaacagaacatcacaagattcagagagatcagcatctctatctcccggtgccagtctctgaggtgaagggaaagggggccgtcgccatggggtcgggatcttgctgctgcatcggctgcggcaacggtggcgacgacgacggcggcggcgatggtggcatggggctggaccccaaggggttcctgctggccatgatgatcgccctggatgctcgttatggtctgcctcatgcccaaggcccgccgcaacgacgccccccccccccccccccccccctccgcgcccccgccccgcctcccgctcccctcccccccctccgcgcccccgcccccccccgtccccacgaccgtccccccgaagacccgccccgcgcctccgccagcagctcctccaagcagggagtcttgcacgccgaggaggactacaaaccatggccaagcaccccccaaagggacgaagcctcgaacctcgacggtcaacaagctcatgcacaacttcaagcccaaggaagtacgtcaaggggaaaggcttccacgtcgcatgcactactactggtacctgaccaacgacatgcattgagttcctacgcaagcttcctcaacctgccctctcagacctcggcccaaccactctcaagcactccccccaagcccccgtcccgccccttcgccctctccccccgccatgtccgccgcccccccgcgctcctccttcgtttttgggggagggagaggcccccggtatgggtcccaccgggcatggggacagggacgagggcccatgtggtgcgagaggggggttcccgggggaggtgcaggtggttgctcctgtggtactgggcggggcgttctgtgggggtttggtggtgagtaccgggcctgctgccgtgggggcgggggctgcttgctgggttccggggtggccgtggagtggagaagcgggtcttctggatgctgggagcaaccatggagtctagaaggtgggatttccgcaagggggagtcgcgccacactgtcgtcggttgaaatgtgctaaccactggtgttgattttgtttttcggttatagtatgtaatgcttcaggatattatgggttctatttttgtttcgaatgatctactttgatattaagagttatgggggttcggtttggttaagaatcaacgcttcgtctgcatattaatacagactgttgatcgactcacaatctaaagatggtcaacttgctatttaaaaaaaaaatcaaaagactattattattagcgccggccgcgcgtaccggaccggaatcctggagaaggcaccagcagcaaggaggccatcagtatatatgaaacgccaagagatttgtatggcagaataaggctcgcgccaaatatgatagacgagcattacatgcctagttacataagtacaatggagttattgttggaacagcttcagagcgataaccttgtaagtacagcaccagacgattcgtgaaactgttgtagaactcggtcatggttatatccatttcttttatatcaatcaaaatatggnccccgtgaaaaaaaaaaaacaggtcttcagatccaatgcgtgcgtggggggctgtcctctctgttgatgtttgaattctgcgaaccctgtgatgattttgtttatcgggattgtagcttaagaccatggtttatgggttcgtttgtgttagaatgagctctttgatattaagacagctgttgatcgactgacaatctaaagatggtcaacttgctatttaaaaaaaaaaaaaataaaaaaaaataaaaaaaaaaaaaaaaaaaaaaataaatat

SEQ ID NO: 499 - DNA, 858 bp, Triticum aestivum
  Clone ID: PAT_TA_499
caggtccggcgcgctgcccgccctagcctgtcgtctcgtagtccggagccgtgactactaacagccagcaccgacgcccaccatggccaacactacctcctggtccagtggcctgtgcggctgcttcgacgacgttggcggctgttgcctgaccttcttctgcccctgcgtcaccttcgggaggatcgccgcgatcgtcgacaagggagaaacatcttgctttgtgagcgggtccgggtatctgctcctgaactggttgacggggttggcctgcctccactccttccgctaccgctccaagctgcgggaacagtatggcctccaggagaagccctgccccgactgctgcgtccacatgttctgcgaggcctgcgccctctgccacggagtaccgcgagctcaacgacccgcggcttcgacatgagcgccggatggcaggagaatggcgccgcgaccgccgcgccccagatgaacccaagggatgactcgctagtgcgtccgcatcttccgatcagtcgactactgcacacactgcatgcatatcagtctgactactgcacacagtgcatgccagcttctacgccggtctcgtcatcagattatgtttatgatcgagtgtatcgtgtccgccttccaccatatgagtcgtttccatagatattcgaatcggtataattgtatcaatgccttctttatgtgatatatgcgtgttattgagcgtgtggactgtatgggcgtctatatccatgatcaatataacttccaacttctgcttcaaacaaaaaaaaaaaaacaaaaaaccccggcggcaaccccgctaccaacttcgcccgcccctcgaaatcacttagtgaattc

SEQ ID NO: 500 - DNA, 919 bp, Triticum aestivum
  Clone ID: PAT_TA_500
cgcctggtgcacgcgctactagccagcttggttcagtggagttctgtctctgacgattcgatttcggtaccgcgacggctccgaaatggagagcgactgccagttcctgctggcgccgccgccgcgcatgtacgccgcggcgggggacgtccaacacagcagagcagagtagcgaccggtcggagcagagcagtggcccaccgggtcggttgacatggattaccgccagctccttcagcagcagcagcttcctgatgcccccgcccgcgtcgctgccggcgcagcagcagcagctgtgcgcgccgatgatgggcatggacatggagatggagatggaggagcagctgtgcttcgtggggaggggcggcggcggcggcggcggggagaggaagcggcggttcacggaggagcaggtgcggtcgctggagagcacgttccacacgcggcgcgccaagctggagccccgggagaaggcggagctggcgcgcgagctggggctgcagccgcgccaggtggccatctggttccagaacaagcgcgcccggtggcgctccaagcagctggagcacgacttcgccgacctccgcgccgactacgacgccctccactcccgcgtcggctcacgcaggcgacaaaagctcccccgcgccgcgctgcatcgcggcgaaggatgagagcgcggcgccggcggcagacgtctcggacggctcaactccgggctggtacgaggatgacaaccacctggcgtatggggttgacctgcaggagccgttctgcgccactccggagctgtgggagacgtcatggccgctggtggagtggaacgcagtggcatgaaccaacgctgcatatgcatacatctgtgtacgtcgatgttgttgctggctggtctagctggttgatccggactatgtagatc

SEQ ID NO: 501 - DNA, 383 bp, Triticum aestivum
  Clone ID: PAT_TA_501
tccactgtccgccaaaactttgtctgacctaagtgcactatctagctatcaaagttttcaaagaaattgatggcggcggctcagcaacatcatggcgaatggcaaagcttctaaaatggacgggagagaggtggtgacgcatggctgggagacgtacagatttgaggaaatatgactcatgaggtttcatattaaaaaaatgatagcctttgtaagaaaagatatgacgtacatttgtgcaaattgataatgacatgcatgctatttctgaaaaaagaagcttctctgttggcatccctgatggtacctttagatacgcaggaagagaaatggtgtctcataattcattggatgtgaccagtaggtcatatcatcatgttttg

SEQ ID NO: 502 - DNA, 678 bp, Triticum aestivum
  Clone ID: PAT_TA_502
ttttttttttaaacaaaaatcaatgtgattcacgcttgaaatgaactgcgaagagcatcaatacacgctggagcagacgcggacgcctcagctcgtggtatcctcctggcggagggaaatgatcgaccaagtgtgcgctgacagagatacaagagggatacaccgtcgctcgccgggggagacggcacccctccggcgaccaacaccacaccacgtactgaaacaccacccacactcaccggacaaacgctgctgctgcctcgtcttgtctcgtcttccacctcgaattagaacaacacacgaacggagaaatgacccccacattgaacggaacggacaccgggcacaaagtggaaatgttgttagctcgctcgctccggcccggcctcgctcacacgaagccgacctcggcgaactgcgggcgcggcttggccgtggtggggccgggccgcgggaccggcaccatgccgtccgggagcgggttcttgcgcggccggccgcgcggtcgcgggatcttgggcggcgcgtccgggtcccgcggcttgggcgggcggccccgccggcgcggcgcggtggcgacggcgacgacggctagtccgtcgctagagaggggcgccgatggcggcgggggcccccccggggtagtggcctggcgggcgcaccttcgggggccggccg

SEQ ID NO: 503 - DNA, 608 bp, Triticum aestivum
  Clone ID: PAT_TA_503
attcggcacgaggagaagcatggcttcattgctgttcagatccgccgcaggcagcgctctccggcgatcgatcccgcaagggtccttccccgtgctccggccatcgatcccgcaggggtccttctctcggagcccagggcggtccctctgcgatggcgctgggaggatcgaacctaatgcgcattctagcgcaaaacccaacatgggacactccaacagattcgaggatgaaacagaattctgcactcatggtcaaacggaatttaaagagttggcttccaacatacgcgccatgcgggacaaagtgcgactcttggaaaaaacatatgaagaatcggaaagatcggacaagcgtagaaaagtgctggtactgtgttccacaactgctctcctcgttaccttttttgtatttggttgagagaacatgtctttttgaagtttcgatgaaagaccgatattctaagtttccatgggaattatctgttgtgaaaaaaggttgtaggaagctcatgtaagatggaacaatgatacaagacgtgcgaattagttggacccagcaaacaaaaaaagcagcccggaaatgtcagcaaaagcgttttagttggcgc

SEQ ID NO: 504 - DNA, 1492 bp, Triticum aestivum
  Clone ID: PAT_TA_504
aggtcgtctccccccgcttcgccctgcagctgcccggcgcctccacaccgccctcctatcgctgcggctgtgtggctacttggccgcggcggcgccagcctcgtctgggctggttctctggctggtggctcggacgtggccgtgggcgtcctggacgacgccgtcgcgctcccgccgccgcccgcgtccgacaccgacatcctctcctccatcaatctcgcctttgacgtggccgacgccgccgcctccgtcagcagcaacgacctcctctcggcatacgcgtccctgcaagggggccgcctgggggagatgctgccgggcgtcgagcattgaatgagcatgtttggttggaccgagaggttcaatgtggcggtaggtgttgctcatgcactggattatctccatggtaacggcaacagtcgcccagtgttccatagggatgtcaagtcgtcaaatatcctcgtctcagaggattttgagccaaagttatcatgactttggccttgcgctttgggccgctgatgcaacaccccagatcacatgcaatgatgtagcaggaacttttgggtacttggctcctgagtacttcatgcatggcaaggtgaacgacaaaatcgatgttttcgcttttggtgttgttcttcttgaactcgtctcaggcaggaaaccgctgtgcactggttgtccgaaaggccaggagagtctagttatgtgggcgaattctatcatccaaggtggaaagctcacgcaactggccgatcctagcttgcctaccgaaggccataccgatgaaattgagaggatgacacttgccgcttcgctctgcatcagaccaacacctcaacaccgtcctcacatcgcagtggttctgaagctacttgatggtgacaatgacattctcaaatgggctagatcgcacgtggggctatcatacaagagcgatggcgacgaagacatggtcacgctcgcacctccggagaacaacaccaacatccagtcgtacatcaatctcgcctttgacgtcgaggacgactccgccgcggtgagcagcaacgacttcatcacggcaaacacgtccctggaagagtatctgcagggaagatggagccggtcgtcgagctttgactgaccgacggatccatggcagagtccgtgcctcatttttgtgtatagagatcttctcctctcccacttcttggtaagtttaacctgttgctgctccttgggtgagaggtggcacatgcaatgcaattgccctcctcaaggcctatgttctggtcattatttcttttttctttttaccctagagttgttatgagagagcctgtaatgttctcacccaaaggatgagatgaggaataaagtagagtagggagaatggaactgtgggttgtttgcccacaccacacccctagtgcttgttccactatgtgctcgctcacttgttaagagtaaacttatcatgaaaaaaaaaagagaaaagacgacaaca

SEQ ID NO: 505 - DNA, 785 bp, Triticum aestivum
  Clone ID: PAT_TA_505
ttcgggtccggcgtccgcaaatcctctccccccttcgtcgtccgactcgttccccttccccttcctcctcccgctcctcccctttcaaacccctctgccccctccctataaacctaggcgagggagcgcccgcagactactcccagagcccagatctatccagcccctcttcgatcgccccggcgtcctcgtccatggcggctcggccgtcgccgccgccgcccacgcgcgcctcctgcggctcctttctccaggaactgcaggaactatggggagagataggcccggatgaactggaaagagataggatgatcttgcagttggaggaggattgcctcaatgtttacaggaagaaagtggaacaaactagaaagcaaaaggcagacctgcttcaagtgatgtccttgggtgaagctgagatagaaaagatactttctgctctgcgagagcgtgaatccttttctagggtagagaagcttgggggtacattaatcgaacaacttgcaaaactagagccagttctggacgatctgagacgccggagagatgagcgcataaatgaatttttggctgttcagctgcatatagttcgtctacaagccggatggtcagctcaagtgtattatggggatgtggcagctgatgtctcttatgagacagacctatctacaggaagactagctgaactgaaaacccagcttaatgagctccagaccgaaaagaatctcagactgcaaaagattgatagtcagatcaagtgtattaatgaaatgtgcaacatgatg

SEQ ID NO: 506 - DNA, 910 bp, Triticum aestivum
  Clone ID: PAT_TA_506
tacccacgcgtccggggcacgcactgggacggggtggtgccgccggactgcgcgccctcggccgccgtcctccgcctctccccctcgctgcggtgggagcaggcgcgcgagccgctgcaccagggcatcgacggcaaccgcacctgcggggtcggccccgggatgtccttcgccaacgccgtgctccgctccggcggcgcgcgcggcgccgccgtcgccctcgtgccctgcgccgtcgggggcacgcggatggccgagtggggcaaggggtcggagctgtacgccgacatggtgcggcgcgcccgggtcgccgtggagaccggcggccggatcggggccgtgctgtggtaccagggcgagagcgacaccgtgcgctgggccgacgccagcgagtacgcgcgccgcatgggcgccctcgtccgcgacctccggcaggacctcgccatgccccacctcctcctcatccaggttgggctggcatcagggcttgggcagtacaccgaagtcgtaagggaagctcagaagggcttaaaacttcggaacgtgaggtttgtcgacgcgatggggttgccgttccaagacggccatctgcatcttaacacccaggctcaggtccagctgggacataggctggctcagtcctatttgacttatggtacattcaaacactagttctccctgtacctccaaagagatccattatttatttgttctctactatggttaatttcctctctgaactaatcgctggcaccaccatttttgaaattcatggatttgattggtataaatatgccaatgtaattcagtacaagttcttcatgatcaatgagaatggagaaccaccggagtcctgcagttccataatggaagctgcttcctttcccgccaaaaaaggccccaaaaaaca

SEQ ID NO: 507 - DNA, 904 bp, Triticum aestivum
  unsure (1)..(904): unsure at all n locations
  Clone ID: PAT_TA_507
ccagcactcgactccatctactcctctccacctcccctgtctcgccctccttgttcacatcactactcccccttcctgtctcgccctccttgttcacatcatctcccttggctttcccttcgacgcttcgagagagagggagagagagaaggaacgagggaagatggcggacgaggggacggccaactgcatcgacatcatcctcgccatcatcctgccgccgctcggcgtcttcttcaagttcgcctgcgggatcgaggttctggatctgcttgctgctcaccttcttcggctacctccccggcatcatctacgccgtctgggtcatcaccaagtaggactgcaggaggggctcctcacctcctgccgtctaggtgatccatgtcgaacttgttctggtggtctggtacaagccgtttgtccgagacgcgagccacggttccatggtgctgcctgcctacatgtgtgtgttcatgctgttgtacatctgtgttgttgtccgtgcttgatgattagcctcctctcctgtcaccttcccttctccagtgtagtgtatccatccatccacttgtgttgttcctccgcgcattttcgtcgtccatgtactttgaactttgattaattaattaatcaatcaattgattggtggggaaaaaaaaagtaaaaaaaaaaaaaaaaaggccaccgagggcccccccattgggggaccccccctggggaaggggagggaaaaaaaaaggagggaacttgttctgtgtctggtacaagccgtttgtctgagatgcgagtcgcggttcatggtgctgcggtgctgcctacgtgtgtgttgatgctgttgtacatctgtttcttgttcgtgcttgatgattagcctcctctctcgtcagttgtcaccttcccttcn

SEQ ID NO: 508 - DNA, 869 bp, Triticum aestivum
  Clone ID: PAT_TA_508
ctacatatgaactaaaatgatgcgtggatgttgtcactattggcttgtactatagaataatcttaaaatatcagataacacaaagtgtcgacatttggtattagccagctgtttccagctgctgttgctgcttgcttcctatccgtctcggtctgggggttctgtccctttcggcctgctgatgctggcatgcttaagtctctgtttattttgagggtcgacatattatgttatagtgttacttccactgaatgttgatgcatgtttcaaatacttctgggagtagtagattatatctgtcctgccatatcatgttattagcatagaaaagtcagttttgctccatgtacttatggttatctaaaaaggctagtagcatttgtaagtgtgtgtttagttcctaccttaagaatatttttgtgtagactatgttcttgaccacatcatccttgttgttagttcatttgctatataaaagaaaataacaggtgtgatcaagtcaataggatattacttgcgagtgttttttctaagtattccctttctcttatgtttctcatgaactccttgagctttatgtggaacactcggtcaacaatatcagacctttctcctcgcaaaaaaaaaaaaaaaggaaaaccaacaatataagatctttctgctgctgcttggcctacttcctgtagcatagatagattgaatctccggccaagttgcgttgcatgtgagtgtcacaaataggtctgtgtatccaagcgactgacatatttacatagcttcttggtagttttgtgctttgtatcttgggctatctgtcaagctggatggcacatggcagttgtatctccttcatacctggtcaaccattg

SEQ ID NO: 509 - DNA, 658 bp, Triticum aestivum
  unsure (1)..(658): unsure at all n locations
  Clone ID: PAT_TA_509
ttccgggtgcctggactaccggaacccctcgccattcataaacatggagtacagctccggccgaatagaagcgaggcaggagcgcgacggtgacccttactcggtagcgtcgacgggcggccgtgtacaaaaaccagcaccccagagtagatcagcccctctgcaaatcaggaagctctccccgtctcactggtcaagaggcagcttcagcgagcatgggcggcggcctcgccattgatttgatataaactagcgttagaccaactgttagcttcggttttttagacttgatgagacaggggctggggggaatgccattcgctgattcgccccccgtcgattcgtgcctctggtcagtgtacagttttccgacagagtcccagccagtgactctctctctctggtagtctgatgatgtttgtaatctgccttgagctgccctgcttccctagaagaaacggcgatgggccggctgcgtggctggcaggtgccgtctaatttttggaaatcgcagtaagtttgtcatgtgtcaggtttgtgtgatcttggtagggggattattgccagaaatctgggcgatatcattcgtgttgttgtatcgtgcgtgccttgccggtgtactggactgttaaatgttgatgtagnatcttcctctcat

SEQ ID NO: 510 - DNA, 501 bp, Triticum aestivum
  Clone ID: PAT_TA_510
caacccatgaagcgtccggcacggggacaaatctttctcgccctctcgttcccgctataaagcatccgcgccgcgcggcggggctcgcctagtcgtcattccgcgcgcgcaccgccggccgtccgtcgagtcgatcgatcgttgcttcctccgttcgccatggacccctacaagtaccggccgtcgagctccttcaacgccccgatgtggagcaccaactccggcgcgcccgtctggaacaacgacaactccctcaccgtcggatcccgaggcccaatcctgctggaggactaccacctggtggagaagatcgccgacttcgaccgcgagcgcatcccggagcgggtggtgcacgcccggggcgccagcgccaagggcttcttcgaggtgacccacgacgtgtcccacctcacctgcgccgactttcttcgtgcccccggcgtgcagacccccgtcatcgtgcgcttcttcaacgtgatccacgagcgcggcttccccgag

SEQ ID NO: 511 - DNA, 1177 bp, Triticum aestivum
  unsure (1)..(1177): unsure at all n locations
  Clone ID: PAT_TA_511
gtccgcccacgcttnccgcccacgagtgcagtgagagtgagtgagctcgccacactccccccagcttagccgagctacctcactcaagaaagcatggatccctgcaagttccggccgtcgagcagcttcgacaccaagacgacgaccaccaacgccggccagccggtgtggaacgacaacgaggcgctcaccgtcggcccgcgcggccccatcctgctggaggactaccacctgctggagaagatcgcccacttcgcgcgcgagcgcatcccggagcgcgtcgtccacgccaggggcgcctccgccaagggcttcttcgagtgcacccacgacgtcaccggcctcacctgcgccgacttcctccgcgcgcccggggcgcgcacccccgtcatcgtccgcttctccaccgtcatccacgagcgcggctcgcccgagaccatccgcgacccgcgcgggttcgccgtcaagttctacacgcgcgagggcaactgggacctgctcggcaacaacttccccgtcttcttcatccgcgacggcatcaagttccccgacgtcatccacgccttcaagcccaaccccaagtcgcacgtgcaggagtactggcgcgtcttcgacttcctctcccaccacccggagagcctccacaccttcttcttcctcttcgacgacgtcggcatccccaccgactaccgccacatggacggcttcggcgtcaacacctacaccttcgtctcccgcgctggcaagtcccactacgtcaagttccactggaggcccacctgcggcgtcagctgcctcatggacgacgaggccaccctcgtcggcggcaagaatcacagccacgccacccaggacctctacgactccatcgacgccggcgacttccccgagtggaagctcttcgtgcaggtcatcgaccccgacgacgaggaccgcttcgacttcgacccgctcgacgacaccaagacctggcccgaggacctcgtccccctccagcccgtgnggcgcctcgtgctcgaccgcaatgtcgacaacttcttcaacgagaacgagcagctggccttcggcccggggctcgtcgtgcccgggatctactactcggacgacaagatgctgcagtgcagggtgttcgcctacgccgacacgcagcgctaccgcctgggggccaactacctga

SEQ ID NO: 512 - DNA, 2331 bp, Triticum aestivum
  unsure (1)..(2331): unsure at all n locations
  Clone ID: PAT_TA_512
tccagacgagatatagtttggtctcactttaccttttactaagcccttggatgtgatgctataagaatgcgtgtgtgctgacgtgggttgtatttgttcttgttttcaaaatgaatgagaccaaattatgtctcatctagatgagttctaggtactccctacagtggacaccagtagtactagttaattgactcctcgtcattcttggttcatggtgttcttagttcatcacagagatactacggcttatagtagtagttctcttctctctgaccacggtcttgctctggtgattaattaacatcgcgctctgcgtgtgtgcgtgtgcttggtgagctcgccacactccgtgagtgagcgcgccacaccccccccccacgcttcgctgagctacctcacccaaggaaggacggatcgctgcgagttccgggcgtcgagcagcttcgaccccaagacgacgacgccgaacgccagccaggcgaccgacgaccggccgcgcagggtcgtaccgtccggcgcccccaccccccggccggcgggacgcctaccagctgctggagtagcacacgcccgcgtcggcgggccacccgcagcccgggcgccggccggggccacggcccggcgcgcggccagccatggccccgggctgcacccgcaccgcccccggcctcaggggcgccgacctgcctcccccttccccccgcgccgcggggacgcccgccaggcggcgccccctccaccctccgcgacccaccgcgccacgccaggaagcgagacgccccgcccgggccgggcgccggtcaggtcctacacccgcgcgaccgcccgaacccccgtcgagcggatctgcaccgccaactagacgcgcgccggcggcacgctccgccccatcctccacgaccactaccgccccccgtcatctcatgcgcccacctagtggcgcgacgcgcatccccgcacccgcctcccgcccaagccccggcccctcctcacccacacaggcatcgctccgacttccacccctccacgcttgtgccccgcgtcatcaaggcgccctacgtatacctccacgggctgcccacccggggcctcaactcccagcccgggcagccggctcccactgtcgtcggcaccatcctccgccaagccacccaggacgccagaggatccattgcccgccagcaactacccgggttcggccctcccacatcgagaccatcgagccggactaggaggagcgagcccaccacggaccgcccggcctgccccagcccgtgacccgaacggacgtccagcctgctcacacgctccatggaggcgacaggtcctgaagcgcaaacagcccaccacttctctctccgaagacggggcagcaggccttctgccccgggatcatcgtcccgagggctgtactactcggacgacaagctgcctgcagccgaggatcctctcatcttccgacatcgccggggccaatgtctgggggcgaatatacctgcgactgccggccaccgcacccaagtgctcccacctcaacaaccactaagaccggcccactgaacttcaatccacctcctccagcgaggtcgactacttcactgctacgattccgacccccaccaagaacgggtccccgctttcctgcaccgcgcacgaggaggtcgagtacttcccctccaggttcgaccccgccaagcacgcgccccgctaccccatcccctcccgcaccctccaacggccgccgcgagaagagggtgatccgagaaggagaacaacttcaagcagcccggggagaggtaccgctccatggacccggaaagccaagagggattcctcaacagctggagcggtcaagtctctcggccagaagctcgcgagccgtctcagctccaagccgagcatgtaagatcagtccatggagtgcgcaaatcagaaatctgcttcagggccgtccaagttcttccctcttatcggcaaacaattacgtaccaaatgctaaaccagaatacttgcttctactgagcctatttttcatcgatgactcacatgtggtactacctcacgttatgcgcattgtcgtccgtcattcatgtactaatttgtacaaggcgtccgtttactactgaaactacatatgattccaacacacgttatgcgcattctctaccgtcactaattaaaaaaattgtacaagagcttgtttctcctcatacttcatgattattgtaaagtgaatgcatacttgattaatgaaccgaattaagaataaaaaaaaaacctcggccgcgaccacgctttccccgggccgcctcgggnggcggggancanngg

SEQ ID NO: 513 - DNA, 880 bp, Triticum aestivum
  Clone ID: PAT_TA_513
cccccccttcaataggggccctttttttttttttttttggccctccaacattcccctataacatcgcaaagccaaaccggcattaccatattaccgccctaacatacctcctgtacacagctacatctcgacaccacacatactgagaagcaacccaggtcctctcctaagataacctggatgctcctctcaactgatgttagtgaccagccatctaaccttccatcactcgcagtcgcagaccacatatgtatattcacagaaccgagccaaaagccggccgttatttacacatgatcatcgcgccccatccatattgggctgctctgttctcgacgtccggatcaagaacagagccggcgaggtgaaagacaaaccaagcattactttctgcatttcaccataccagtgctgcatttacctagccaagctcgtggcttcgtcgcatgaccagcgcgtcaccgagccatgctcgtagctgcgccgcctggtccggctcggcagccaccgcccccttgtcgctgttcgcgcaagtaacctagcaaggtctcggccttgtgcttggcacgagcagagccggactgcgagagcgcaacgagcggtgggatcgccccttctcggacgagaagcgcacaattgctggagcactcggagcacagctgaagcagagcgaccacggcgaactccttctccctcgcagggccgtcctcgatggtctcgaccagtgcgggtatcccaccggcttccaccacagcgtcgcggccctcggctatgctggcgaggctggcaaggaccaccattgccttctccgacgtcccggtgccgcgctcgccgatgaggtgcacgagcggcacgacggctccggcgctgctcgtgccga

SEQ ID NO: 514 - DNA, 646 bp, Triticum aestivum
  Clone ID: PAT_TA_514
ggcgtctccatccttcgccccactggtcgtggtcgtggtggaagcagctgcaacaagaagctcatcctgcagcaggcttgcggcgacgcgccgtgcatggtggtggcgtacgctccgattgacacggcagacctgaaggacgtgatgcatgggggcagacgtgcctctctctccctgctgccctccgggttctccatccttcctgacggcgtcggcgacatacagacggatccgcttgatgccaacccctccgcggtcgaccccatagaccaccagaggagctgcggatctctcgtctctgtcctgcggcagactcacctgattggagggaacctcaccgcacagaccgtcgacaacttcgggaataatgtctccggttccatcatgaagatcaaggatgcggtccatgccaagagggttatgaccgtctgatgcgccttctaccatttccggttcataataagaataagcactcagaagagaaactgagaataaatttgtggacttcgttgcaaattttatttcaataattgctacattgtagacattgaactgcaccaatgggttgtttgttttccaaatgaatttatgaatcactttgtttttctctaaaaaaaaattttctttaaaaaaaaaaaaaaaaaaa

SEQ ID NO: 515 - DNA, 1280 bp, Triticum aestivum
  Clone ID: PAT_TA_515
ccgctcccgccgtcccccgtcaattacaccaggtcttccctttaataataccccctgcaaagctgtcgcgatctggtcgtgtcgctcgcctcctcctcgtcggcggccatgatccaggcggtgatggtcatcagcactctgggcaagccccgcctcctcaagttctacaatttccaggattcggagaagcaccaggagctggtccgcggcgtcttccagttgttatctgcgaggcccgagggtgtgagcaatttcgtcgaggccgttgcaatctttggaccgggaacgagactggtctacaagcatttggcgacactatacttcgtctttgtctttgatagctctgagaatgagcttgccatgctcgaccttgtacaagtttttgttgaaacattgaataggtgcttcaagaatgtatgtgagcttgacattgtatttaacttcaacaagcttcacacagttttggatgaaatgatactgggaggacaagtgattgaaacaagttcagagcaaataatgaaatctgtagaagagattgcgaggctagagaaacaatcaagcacaactagcctcataccaaagtcaatatcggagcgtttcagccgttaaaatttttcgcttgtgtttcggaccgacagttttggagacttgagcaaatcaaattgatgatcatatctccaatggtctttcagttctctgaagtcttgagcatctgccattcaacatgaaaacctattggctgacgtgcacatcatattgtctccctccctagagttgttgtaagttgcaacctgaaatgtgaagctggcatgtccagtctatacagctgtatgtgtaaacttacaagtactactcgggctttctggccccgggagtcttgagcatctgccattcaacatgaaaacctattggctgacgtgcacagcagattgtctccctccccagagttgtaagttgtaacctgaaatgtgaagctggcatgtccagtctatacagctgttatgtgtaaacttatacagttggagtactagtctagttatgtggctctgtgacggtgtgcaaatgtagcaagccagagatttatttctgaccacatttctatggtgataaaaaaaaaaaaaaaaaaaaaaaaaaaaaaaaaaaatccatattataaaaaaaaaataaaaagtaattaaataaaaaaaatatattaaatattatcaatttatattaatacttcatttttaacttaattttttttttttattatattttatacatcctttctttatttattt

SEQ ID NO: 516 - DNA, 829 bp, Triticum aestivum
  unsure (1)..(829): unsure at all n locations
  Clone ID: PAT_TA_516
gggattctcagggttanntggnacccgggtttcccgtagactttaaagacgcctttngnggntaaaggatcactntaggggaattggtaccggccccccttgagggctagntgtntggttnaatgngtcgaacccctttaangttggcatggccccttttanatgctcaaggggtcnccgacaggtggcaaggcatgcaggggaaaaattaaaaagagctgccggtttggtacagttacntctaccagtgcatcntacccaaatttgatggcaggggacaggagcatttaatgcccgtntgcatcgccccaaacagtgcagaaaagcgaccgttaggggcgccaccgttcgcccangatggccatcttgtcatctccgcttgccacctcgcaccgcttggctgcacagcctctcgccacgtgcgcctggaacgttcttgtggcgacacatcgacgaatgcgctggagcatgggcgcagagtgggggcttcgccgcggcaagcgccttgccgcggtcattgtcttgtcgcacccgaaagcttgtcgctcgtcgggtcttgccgggacgcgcggcgcgtcgcggcaagtttcttgaaatgccttggttggccttcccggcaagctcctcttgccggggccttgtccttcccggcaagctcctcttgccagagtcttgtcttctcagtgaaaacactttgttcttgaatggcatcaatacgagctacggaggatcttggcggacgcccggcaagccctgccactgggtgctgcgactgcccgtgcacaagttcgggatactaaggtacccctactttagtacaccgacagtg

SEQ ID NO: 517 - DNA, 651 bp, Triticum aestivum
  Clone ID: PAT_TA_517
catggcagctcggtcgattggtggactcttggcatctttctgtatgaattgctctacggcaagacaccattcaggggacctggcaatgatgaaacacttacaaatgtggtctcacaggggctgaagttccctgatagcccagctgtcagctaccaggctcgcgatctgatcagagggttgctcgtgaaggagccagagctccgggctaggctcgaggaaaggagctgccgagatcaagcggcatcccttcttccaaggcctgaactgggccttgatccgttggactgcaccgcccgagaccccgaagagcgtcgacgcctcaacccttacggcagcggtggcacggaagaagaaggaaggcaagtgccttgagttccggatgaatggagacgacattgagttcgagctcttctagtggtggcagtagtagcagtagaagttgtagtggtagtacgttgtgttctgaagaatatccataccgtggtagctagaagtagtagtcccacagttccccagtccccactcccctgcagtttttctgttgaaaatgagttatcagtagagtaaggtcgggtgttgtgcctgtaactttattccttgttaataccatcagatatcagatgagcaatgtaataatgtccaaaaaaaaaa

SEQ ID NO: 518 - DNA, 1703 bp, Triticum aestivum
  Clone ID: PAT_TA_518
tccgtcgacgcagcaattcggcttggcttagagtttatctcttgcatttccccgcgcgtagcagcaagcacaagaggagagatcgcaggaggcagcagtttgttacagagctgttgggagaatccaggaggaagtcgaagtactccggtccggccaagaagggggagacagagtgggggagagggggctgagaggagatggagacggacagcccgcggagcccggaggcggagatcgggcaccgggtggaggacctgtgggaggtggcgcagccgcagctgtccccgtcggagaagctcaactcctgcttcgaggacatccccgtcgccgccttcccgcgcaaccacccctcgcaagtgatcgagataccttcggatgccagcctttctgatactgttgagacattatccaagaataaaattttgagtgcacccataagaaacgtcgatgctccagaggatgctacttggatagacaaatacatcggtattgtggaatttgctggtattgcaatgtggttgcttcatcagtctgatgcttcaggtaatggaacagctggttctgcagttggatcacctgtggccaatctagcatctaggttaggctctttcacattcagaagaacgtcatctggcagggtagaaaccactactgattcagaatcagatgaagctgcatcagtgggtggaagcttttttgaaacccttacttcctctgagttctacaagaacacaaaggttgggcgatatctcaggaagcttcccgatgggcgccatttcttgccctgcagacatctgacacattcctcactatgctgcttcttctatccaagtacaggatgaagagcctccccgtggtagatatgggggggaatcagattgagaatatcattacacaatcttccgttgtgcacatgcttgcagagtgtgttggactatcttggtttgaaagctggggaactaagaaactgtgtgaactggcccttcctctgatgaagccatacagacttgttaaggtaaatgaagaccagccagtcctaaaagccttccaactgatgagggaaaagggggttggtggtgtgcctgttattgacacaaatggaacaaaagcaattggtaacattagcatcagagatgtccaatatcttttgagtgcccccaagatatacaaacaatacaggacaatctcagccaaggatttccttaccgcggtccggcaccacctccaggagcaacacgaagcgtcgccgttgctgcacgacgtgatcacatgcaaaagagacgacgtgatcaaggaaatcatactgaagctggactcgaccaagatccacaggatctacgtggtcgacgacaagggggacaccgagggggtgatcacgctgagggacataatctccaagctggtgcacgagccacggcattactttggggatttcttcgacggcgtcgttcccctacccacaaacagtaccgtatgacaaactctgtactactatgtacaacaaaatgtacattatctttttgctcattcccaatcttcttctcaagttggggttggggatgctgttgctgtggagagacctctgtggggacgactaatgaaccaatggggtggatgacagtgtgcgttgaataatctgagaattgcctgagctttgcgatgagaatgatgatgcctctcttctttctaaaaaaaaaacgctc

SEQ ID NO: 519 - DNA, 1151 bp, Triticum aestivum
  Clone ID: PAT_TA_519
acccggtcaccgtgcgccagccgctctacttcgactacaccgagccgcagccgagcgccgccgtggccctcggccccccggcgggacactccgtgagggtgtccatgtcgctgctgctgccagactccgaccacaaccgtcagattggcgtgttccagattaaaacagaggcgatcgctccaagtggaagcaccatcgcttcagccacccagccatacatgctgaggtacaagagcgctccggtgcggctagcgcagtccacgctgacaatcgtgccgctcgccttgggcatgcgcagcgagagccagtcggcaacgctgaagctgctgcagtactgggaaggccacgaccgtcacaggaggacacggctcatcagagtctctctgcagccaagagccatgacagtgcacctgccccaggtgtacagagcagagatcaccgtgcagacggcgcttccatggttcaaggccgtggcgcgcagcttgaaatggacaatgtgtgtgtggctatctttctgggtctatgtcattctctccctgctcgcggttcgttgggtctggccactagcgctatctgcatcggacagtcacagggggttatctgatcatcaagtcaatgggaagacaattgctgctaatctgggtggaggagatacaggccagagctcacatgagggatcatcaagaggtggtgctgtgaagtggagggacaggagaggcaggaggaaagcacagcaaacgacgcatggcggcatggttgagctcaagcttcgccgagggctcgtcttctagctctgcagtggcttgagactgatgaagtcgtcgacgacgatcatggggagccacttgctgctcgattgcccgtgtccgattcttgttagttcagtcagtgcagtgtgctgtaaagtttatgctgaccgttgatcacagtttggtacacgccatgtgtaggagatctgaagggcttccatacggaacggcatataataacgcaaataaatggcaaagatatatatatcatgtattaatcgataaaaaaaaaaaaaaaaaaaaaaaaaaaaaaaaacaacaaaaagaaacaaaaaacgaaagaaaaaaaaacaagttgaatacagaagagaaaaaaaaaaaaaaaacggggccccccaaagg

SEQ ID NO: 520 - DNA, 982 bp, Triticum aestivum
  unsure (1)..(982): unsure at all n locations
  Clone ID: PAT_TA_520
cggcacgaggtttgaaatgcacctggacaatgtgaattggggcctgtatctgaacactctgttttggaacctcaactattgggattcaatcagtacattggctggagaggttgagaatccaaagagaaccctccccagggcactttcttatgctcttgttttagtagtcgggggatacctctaccctctgatcacttgtacagcagcacttccggttgttcgggagtcgtggacagacggatatttttcagacattgcaaaaattcttggtggtttctggttgcactcatgggtgcgggcggcggccgcattgtcgaacatggtccgctttgttactgaaatgagcagtgattcataccagcttctggggatggctgagcgtggcatgctccctgagttcttcggcaagagatcacgctacgggaccccactgatcggcatcctgttctccgcgttcggtgtggtcctgctgtcctggatgagcttccaggagatcattgcggctgagaactacctctactgcttcgggatgatattggagttcatcgccttcatcaagctgaggatgacccaccctagcacctcccggcctttccggatcccgctgggcaccgttggctccgtcctgatgatcatccctccgactatcctgattgtcgtggtgatggtgctggcttccttcaaggtgatggctgtgagcatcctggcggtgctcgtcgggtttgcgctgcaaccggccctggtgtacatggagaagaagcggtggctgaggttctccgtcagagaggacctgcccgatctgctggacccctcggctggcgccgccgaagatgagacgaccccgcttgtggtatgatttatgatgcaaagtgtaatanaaggataggaacatgctgccctgtataatgccatgtggcatcatatatgctgttgtataccaacttgntcgtcatgaaaaagaaatagaagagcatgctgagcg

SEQ ID NO: 521 - DNA, 198 bp, Triticum aestivum
  Clone ID: PAT_TA_521
cccacgcgtccgcccacgcgtccggtgcactgatgtggtggacattcatagaaattctttcttgtaaattatacttactagtcacttgatcttatgaagttgcgattctttccgatcgggtgaggactacaaaatgcatgtagggtgattgataaagttgtatttgtttgtgcagtgcatgtcatctagtagaagaag

SEQ ID NO: 522 - DNA, 1392 bp, Triticum aestivum
  Clone ID: PAT_TA_522
gaggcctcgttaaaatagaaagctgagaaaaacactgaccttaaggatgcaagacaaggggagacaattaacattttttctgttgcttctggtcatctgtacgagcgtttcctaaaaattatgatcttgagtgttttaaagaaaacacaaaggccagtgaaattttggttcataaagaattatctatctccacaatttaaggatgtcataccccacatggctctggaatatggattcgagtatgagcttatcacgtataaatggccaagcgtccgcccacgcgtccgagagaagcaacgaattatatgggcatataaaatcttgtttctggatgttatatttccactttcgctgaggaaggttatttttgttgatgctgatcaaattgtgagaacagacatgggagaactgtatgacatggatctgaagggccgtccccttgcgtatacaccattctgtgataacaacaaggagatggatggctaccgattttggaaacaaggtttctggaaagatcatttgcgaggaagaccataccatatcagtgccctttatgttgttgatttggcgaaatttcgacaaactgctgctggggacaatctacgagttgtttatgaaacactcagcaaggaccccaatagtctatcaaaccttgatcaggatctcccaaattatgctcaacatactgtgcccatattctcactcccacaagaatggctatggtgtgaatcctggtgtggaaatgccacaaaggcaagagcaaagaccattgatctttgcaacaatccaatgacaaaggaaccaaagcttcagggtgctaagagaatagttccagagtgggttgatttcgacgctgaagctaggcacttcaccgcgcgcatcttgggggagaatgtggaggagattgcagaggccactcccccatcctctgagtctgatgcaccaaagcctgatcatgaagactcaagccaggactcgaaagacgagctatgagcaccagctgaaacctagcttgatcattttcaggaaagaacaaaactatacttactggtttgatgccccagcagaaaacatggtgcagaggataaccaagcacaggcgcaggtatcaacccaattgtagacgggccatacccggaggccggggcatattgactgcgtccctgaggaactcttcaacatcagtaaagctttttgatacacccgtaatcccgtagggataggggtctagtaatcaatagcaagaaagcattgtaacagtcgacaatttatgtactttatgattatgttttccatgaggcaccataaactatttttggcaccgattgatgatcgagaatgtacttggaaatttttgacatgatttttctcacgagccattctccaaaaaaaa

SEQ ID NO: 523 - DNA, 411 bp, Triticum aestivum
  Clone ID: PAT_TA_523
aaatatttctttgcaaaggatcatatggccgcctctgtcgagatcaacgacacatatttctgccaagaacattttgcagaagtttgtgaagaatgcaacgtagacttccgtgaggaaaacgatgccttttatgggttcgattcacgggaccgcgatgccctcacatgcccacctgctagtataaataacaatggcgtggttgtatgcaatgagcacgatagcgcaacctgcggtcagtgtttcaactggaaaaggcagatcgccaggaagtctagagacgccgcaaagcgctagtcgagattagtgattccactgttttacttcggcttgacatcgcgtctcctagacaatgatgtacacagattagaagtaaatagcacataaatacatcgaaagatgctataactaggg

SEQ ID NO: 524 - DNA, 472 bp, Triticum aestivum
  Clone ID: PAT_TA_524
cccacgcgtccgaaggaagtggatggcgtgtgcccttcaccatccgacatggcggcacaagtgattacttatctcgaggacaaaggctttctgcacgagtagaccgtgatggaagccatgagcctgttgtcatgctatagttgctagagggtatttccaccagattagcggcgcggcagaataagtcaagcgctggcagttttttttttgtgtgtgcttgttcagattggttgtgtgcgttgatctgtctactcgtagtttctgtcgtgttaacttctgttagcttcgccaggaaaatgtagtgtgcaaattgcaatggcatccagagcagggtagtaggagtttgttgctaatttatttgccctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccg

SEQ ID NO: 525 - DNA, 782 bp, Triticum aestivum
  Clone ID: PAT_TA_525
gagagaccgagagtcttgtcgtgcactgttgtcagacggtagttttattgaagttttcttgaacatgtccttggaattgtgtgaagcaagggatccgaagggcctttataagcttgctcgtgcaggaaaaataaaggggtttactggtattgatgacccatatgaagcgccattaaattgcgagccgcaggagacactcgaaacaggctttcgccccgctttatatataaagcaacatcagaataaagtacacggtggtgatgtcttcggatgctctttcctgccgttgacaagcagttgccagttttgtccttcacctagaagcatgaagcctttgctttgattgcagattgagatcaaggaagtggatggcgtgtgcccttcaccatccgacatggcggcacaagtgattacttatctcgaggacaaaggctttctgcacgagtagaccgtgacggaagccatgagcctgttgtcatgctagagggtatttccaccagattagcggcgcggcagaataagtcaagcgctggcagtgtttttttgccgtgcttgttcagatttatgtgtttaattgtgtgcgttgatctgtctactcgtagtttctgtgtttgttaacttctgttagctgcgccaggaaaatgtagtgtgtaaattgcaatggcatccagagcagggtagtaggagtttgttgcttgctaatttattcgccctgcaacttgtgctgtttcctggttgttgcgatgaggtacaagagtgttatgctgaccatttcaatttcc

SEQ ID NO: 526 - DNA, 899 bp, Triticum aestivum
  unsure (1)..(899): unsure at all n locations
  Clone ID: PAT_TA_526
tcggcctgcatcaatgagagagatgtgtctcggagttcttgggctccgcgggctgtggagaggagggcggaggggacacatctctctcatttatccacgcctatcggcctgcatcaatctggtccgtagagagaggagaagcctgctgcattcctcgcccgatgatggcgagcaccagccgcgtccgcccacgcgtccggcgaaacgcgttcgccgctcccctccgccctcctctgcggagcccgcggagcccaagaactccgagacacatctctctcatttatccacgcctatcggcctgcatcaatctggtccgtagagagaggagaagcctgctgcattcctcgcccgatgatggcgagcaccagcacggcctccgcgacggccgtggccggcgcgttcgccgccgccggcgccaacaggccgcggggctccgctgcctgcccgagggtgcccgccggcgggcggcggcggctgtcctgcgtcgtgcggtgcgacgccggcccgggggcccaggcccaggcggcggccaaggcggccagcgtcgccgcgctcgagcagttcaagatctccgccgaccgctacatgaaagaaaagagcagcattgctgtaataggtctcagcatacacacagcaccggttgagatgcgtgagaagctcgcggtcgcagaagagctatggccccgtgccgttgcagagctaaccaatcttaatcatattgaagaggctgctgttcttagcacctgcaaccgaatggaaatttatgtggtcgctntatcctgggaccgaggcattagagaaatagtagattggatgtcaaagaaaagcgggatccctgtttccgagctcagggagcacctcttcatgttgcgtgacagcgatgcaacgcgccatctggt

SEQ ID NO: 527 - DNA, 773 bp, Triticum aestivum
  Clone ID: PAT_TA_527
gatgaattggtagtaaacccagatggtgcatactctcaactaattaggcttcaagaaaacaatgaagaagagcagaaagtagaccatagaagattggatccaaggtctaagagtacaagcttgtcattgaagcgatcgattagcagaggttctgcagggaatagtagtaggaattctttcaacctctcctttgggcttcctggcgcagttgaattgcctgaaggaaatgatacacatggggagaatcatacagagcaggatggtgaggttccaaagaaagctcctatgggacggctggcacttcttaataaaccagaggtacttattattctgttaggatccctagctgcagcagttcacggagtgcttttcccaatgttcggtgtgatgatttccagtgccattaaaactttctatgagccaccagataaactcagaaaggattctagcttttggggtttgatgtgtgtggtgctgggtatcatttcgataatctcaatacccgcagagctcttcttgtttggaatagccggagggaagcttatagagcgtatccgtgctatgtcatttcgaagcattgtgcaccaagaagtcgcttggtttgatgatcctaaaaattccagcggagcacttggtgcaagactgtcagttgatgctttgaatgtacggcgtttagtgggagataacttggccttaacggttcagattatctctacacttatcacagggtttgtcattgctatgatagctgactgggagctctctttgatcat

SEQ ID NO: 528 - DNA, 440 bp, Triticum aestivum
  Clone ID: PAT_TA_528
cccacgcgtccgattttggggctgttgttgctttgtgggatgaagaggaggacaaatggattgaaaagtcatatgtaatggatcattggacagaggagggctttgggccaaggatggattataatgtactcgatatgatattccataatgatgccttccaccttcttacggaagaggaggacatcatcagagtgcttccatatgctcaaggggtgcagaagttgcatgtgtggcgacgtatggacagagaagttgatgagatgtttgaagataaccttcatggcaccacaatcaagtaccttgtcgaatcgacaggaggttatcttgttatgtgcatcaagtacgtccgccgtggcagaacagagtcgattaacatgtacaggttatcagttcctgagaagaggtggcataactacagatcgcctgagggtgaagtgatc

SEQ ID NO: 529 - DNA, 685 bp, Triticum aestivum
  Clone ID: PAT_TA_529
ggccaagcttcattccaactagccgaacttgcattgcttggatacgaacagcaagaatgtatacaccacaagatcaaaacaaatacagaactgcgcgaagcctgctttcctcgcaagagtgtcgacgtgtgaagtatgcaacaccacagccatctttttccttcaatccagaggacatatctgacgacgagcccgccgagctgcgcgcaggagtaatggtttccacgcgcgcgtacaagaccggcaggccggaacgatgcctgtaccttagagggaacttgctctcgtagctctccgatcaccggacctcggaccacttgtccatccgtgtgctcgcgaccatggcctccttttcccagtcgcagcgaacggtcatgatggccaggatcatcgtctggacggcggttccgccgatcatccccgcccagattcccaggacgccaaggttgaagagccacccgaggaggacacccatggggacgccgatgaggtagtagctgccgatgttgacgtaggccaccgcggattgccagccagacccaacagccacacctgagagcacgggctggatgctgttgagcaggatggtgaaggccagcaggatggcgaggttgttgacggcgtccagcacgacggcgctggaggtgaagatgagcgccagcttgtcgtggaggcccatgatgag

SEQ ID NO: 530 - DNA, 593 bp, Triticum aestivum
  Clone ID: PAT_TA_530
ttttttttttttagcaattcagttgttaacatagattgtaaggtagacttattgccccccccccccccccccccccccccccccctcccctccttcttcgcttggggagaatgcttattttcaaagggctaacattctaatgtagataaaacaaaaggaatcacagcgccacactaatagacgcaagaactgtttactgtgcgcaaagccagcagcgacaaggtttattacatacacgttctacaatcaaggtttacgatttacatacacgacaaactatatcaagacacttcagtggttgtttcctttggcagaaccacagcgattagacactcagtcggttgaggcggaaggcctagcagtccaaacacctcggatgtgggaggaaggataaatagcagcctcgaccccatgggcttcacaggagcaatttttatgaccccggcgtacttgttcagcttcaaataggagatgaaatcccggaaccctttctgatcaccattcgaacaaggcaacaaccgacagactttttttttgttacggggaccattggaaatgattgtctttgcgtgctggaaagctgtgcgctttag

SEQ ID NO: 531 - DNA, 911 bp, Triticum aestivum
  Clone ID: PAT_TA_531
cccacgcgtccggtcaacttcggaagcatcacggtggtgactcccgcgcagctcgcggagttcgcgtgggggctggcgggctgcggccagccgttcctgtgggtcgtccggccggacctcgtcgccggcgagaaggccgtgctgccggaggagttcgtccgggagaccaaggacaggggagtgctggcgagctggtgcccgcaggagcgcgtcctctcgcacccgtcggtggggctgttcctgacgcactgcgggtggaactcgacgctggagagcgtgtgcgcgggcgtgccgatggtctgctggcccttcttcgccgagcagccgaccaactgccggtacgcgtgcgccaggtggggcatcggggtggagatcggcggcggcgtggcgagggaggaggtggcgcggctggtgcgcgaggcgatggacggcgagaggggcaaggcgatgagagcgagcgcgacggcgttgaagcagagcgccggggcggcgacggagggaggcggctcgtcgagcgagaacatggatcggctggtcgagttcttgcatgccgggtgtgacggtgctacctgaatgacttgtagtacgtgtttgagctgatctccccggtccttggatgttttctgtctcgtttcgcgctgtgccaggttccttcactgaatgaagagctgcgttcatcacaaagatggaagaaacaagacagaatgaggagatgaaattgtgcagtgtgattttgttgcgctgcaagtaatgatgcgtgcccagaatgcttgggagctgggaggagtagttttgctccagatgtaaattactccggtcttctcagagactctagtacaaactacatatagagtaaaataagtgaatctatgttataaaatatgtctatatacagttttattagaattttt

SEQ ID NO: 532 - DNA, 421 bp, Triticum aestivum
  Clone ID: PAT_TA_532
tatcctttcacccttccctttccagatctctcttccgtgggcggcggcggctgtagatcaaagcagcaatggagcaacgacgtggtagaggacggatcaaggtcgtccactgatctactcgtgccctccttctccttggcaaagcggcgcgtgccggccagaggaggtagcgccggcggagctgcctggcagatcaaggcgccggcgcggccggcgggcatagcgcgagcggccgcgactggtggagtagagctcgcaggagtggctgccgcagcagagtgcccttgcgtgttggcagagtgtggcatgcatgcgtggtgagcaagggcaagtgaggtgtacgtgcgtggttttccaatctcagatttttcttgttagttttctgcgacaggagcttcaagaaaaaagggactacacgagc

SEQ ID NO: 533 - DNA, 621 bp, Triticum aestivum
  Clone ID: PAT_TA_533
gctccacgaggttttacagtgaaaagctgaaaaagttgtgacggcgatgaaaggactgaaagatttgctcgaagcaaagacatctagccgagatacatatggcaagaatcttcagagattgacttcttttcagctgctattgagatatatacttgctcataggtcacaactcaagttactaacttacctgcacatacagtagtgataagtcgacataatttttctgagaacctatttttttaatatgacagcattctacctgccctgtgttctcttttatgatattttttgctcttcatgcattttgtagcaacgaagaggagggatcttatgtataatatgcgacatccatggtgctgaaggattcgtcgcacgccaaacagagcacccgaggagatgctctgaagagaggaaatgatatgttttttttttgttttaagagaagataggagtcgatatgttgtcccctgacttctatactgatccacaacacttcacaaaagagtatatatcaagatatgtagtcccctgacttctatactattactgatccacaacacttcacaaaagagtatatatcaacatcgtatgctacaaataaaaagcaaagtaatctctttt

SEQ ID NO: 534 - DNA, 731 bp, Triticum aestivum
  Clone ID: PAT_TA_534
gatctcgccaggatgtaataaaaaatcacacattagagtggattgagaagttttatccaggcttatttgagcagatccattttgggaatcattttgctttggaaggccaatcaaggccaaagtcggagatttgcagatcttttggtgctcaggtcttaatagatgataacccgagatacgctttagaatgcgctgaggatggaatgagggttctgctctttgattatgataacacgtatccctggtgcaaaactggtgtggatcaatcacatccgctggtgaccaaggttcataactggcaggaggttgagcaaaaacttctctcgtgggtagcacctgagagctgacattcttatttgtccgatgtgagcagcagaattatgctcagcagacaatatctcactttctgaaggaagatgttgcttccctttcaacatctcaatacataaacatgtcaagggtagaatactccatgtctttgtttgagagaatgacgattgaacatcgcctcactgcagtatgctgggtggaaggcaatcagactcagtctagtatgccctgagatgatccaagatctgcacacacagtcgcatgtcgaagattgaattctttttcagcatgttagcttctgtggtactgtggtgtatatactgccactgctatatgcatttgttgaatcaaatagttcatatcaattgatccggtgcacacaatcttatgaaaaaaaaaaa

SEQ ID NO: 535 - DNA, 500 bp, Triticum aestivum
  Clone ID: PAT_TA_535
cccacgcgtccgcccacgcgtccgaatcaatcaagcatccatcatatcagagatctccatggacaagcacaagagtcacacatgtgcaccagccttgctgctctctctgctgtttctcgcgtgttctccccttcatgcgcaatgccgcatcatcgagggcatggacgacgacaagatcaatataccgggcggactctgcgtccatcataaagattgcgcaccgggtaattgttgcttctggtgcctagtgctcgatctgtgctatgccacaatggccgagtgcaatacagagtgcaaaggccacatcgatgcgcgcctctttaaccttcggtcgccttcaaattgagttccttccttttgaaccggcaaccattggagcaaagacttgtagtttaatctgttgtattctttcgaagccgccggtagttgttctaataataagaagaagaatatatatctcaacgatttgtttcaatttcttattaggaaaatctctaatt

SEQ ID NO: 536 - DNA, 1623 bp, Triticum aestivum
  unsure (1)..(1623): unsure at all n locations
  Clone ID: PAT_TA_536
ccgggctgcaggaattcggnaccagaggacgataaaagtgaacttgagctggcaagtntagagcagcanaggaatgatcaagatattttgaagctagtcnaggnccagaagagggaaaaggaggatgccctcgcaagaatgcttcagctggaaaagganctgcatgagaaacgagaacttgagctcgaagtgacacgattgaatggcacactccaagtgatgaaacatttggaaggagacgatgatggggatattcatgacaagatggagaagcttagtgaaaagctagagcatgaaaggaaacgcctggaagagctgagcggagagctggtgaggaaagagcgtgaaagtaatgatgagttacaggaggcccgaaaagaattgataatgggtttggaggacatactcagcgggcggacagctatcggtatcaaaaggatgggcgaacttgatgaaagaccttttcagaatgcatgcaagagaaaatatggaaatgatgatcatgagacgagggcagcagagctggtctcgagttggcaggaggagataaagaagccagcctggcatccttataagtttgttaaggctgaagacggaagtgacaaggaagttgtaaatgatgaggacccaagactgaagcaattgtggatcgaatatggtgacgatgtgtgcaatgcagtgaagaccgctctgagcgaagtaaatgagtaccagaccgccaaggacaatggcgtcgagctgctcgacgacgagactgtgcgggagttcgccgacgcgtggggcggcgaccgccaggaggtcaagacggtgacgtacgcctcggcggcctcctgcagggcggagacggcggaggactggaagcggaggtcggtcttgaagtcctgggcgatctcgcggacgaggcgctggaaggggagcttgcggatgagcagctcggtgaccttctggtacctagattaatgctgtttgttccagaactgacatgatcagtaaactcaataatagcctttgggctttggctgctagcgtgtgtgtagattgtgcaggtgtatattacctccgtctcagattacttgtcttagatttggctgctagcgttagtacatacatatctatctagacaaatttaagacaagtaaatcggggcggatggagtattatatatgtatctttatttttctgtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaagaaccaaatttaaaaacccggggttgcaaacgaaaaatttttttttgggggccccaaaaattaattccgggggccgcgtttaaaaaacggggggagggaaaaacccggggggtacccaaattaatggccttggaaaaaaacccctttttcccaagtggggaaaaaacaaaaagggccccaacaaatcccctttccaaaaaggggcccccctaaaggggaaaagggaccccccctttaatgggctcttaaacggggggggggggggggtttccccca

SEQ ID NO: 537 - DNA, 770 bp, Triticum aestivum
  Clone ID: PAT_TA_537
cccacgcgtccgcgattccaactctgcaaactctaattccttcatgtcatctgcaaatggggggcttggtggaatcgggaataacaatgtgaattggggaacccctcctgtgcctgctcagggtgctaacgctggctcgggctatggcagtgggagctttggttatggatcgactgaaaacaacttcaatctgagtcccggtgcttatggaaggaacactggatcaggaggcgtcaatgcttcactcaaccagtcaagcaatggatatgggaggaactttggagattcgtcagcgggtggtggtggctccatctatggagacacaacttggagatctggatctgagcttgatggaaccagcccatttggatatgggcttgggaatgcagcttcagatgttacagcaaagagctcagcgggttacatggggcattaacagatagaggaatgacgccgcctaggaatctttttcgcatacagcaattcataattggttgagaagagaaccgcaggtgcatcaggtgcaaattttgaacttcacatgattaaaaggcatgggttagttaatagagctaaccagggagttggtcgaagagatcagatatatatcctcggaaaatcatttaagcgtatttgcatatgtaaggtttgagattgtggtttcggatttctacagcgactttaggttttggcaaccctgggttttttcttggttgagatgtgaagtaagattgcgggatatataattctgaagagttcaattaaagcgc

SEQ ID NO: 538 - DNA, 663 bp, Triticum aestivum
  Clone ID: PAT_TA_538
ctcccgcggtcccaccagctcaactcaagtcggcagatccgtccagccgcctgcgctcccacgccattctccgccgacgaaagctccgccgcagatttgctaccccggatctgctaccgagatggatagagaagccaagaaagaaggtttcaggaagtatcttgaatccagcggcgtgctcgatactctcacgaaagctcttgttgcgttgtatgaggagaacgacaagccatcatctgcagtcgagtttgttcagcagaaattgggtggtccatcgatttccgactatgaaaagctcaaagctgagaagttggatttgcaactgaagtataatgagcttttagagactcacaaggaaacaagtagacagttggaggaacttaagaatttgaagatcgacgcaccttggaactaatggaactgacaggtgttgacatagtaggtgttaccaagcaaatatatatgcctcttcagtttggatcaccaagtcatgtaaaaaagaaacatttcttggctaaactttgccaaccatgtgatgtactgcattatacgctccttagtccctttgaatgacgtgcgtgttccactcaagaccagaagtaccaacacctctatggtcacagctgaacttcagcactatgattcttactgaagagtggaatc

SEQ ID NO: 539 - DNA, 824 bp, Triticum aestivum
  unsure (1)..(824): unsure at all n locations
  Clone ID: PAT_TA_539
aacaccacacatagcacaactagattactactagagttcagttcagaccttggatcacacgcgcacacacaagctagtagtagagtactacaagatggccggaggcggagaagaagaggcgaagctgctgggcacgtgggcgagcccgttcgtcctgcgagcgcagcttgcgctcagcttcaagggcgtgagcttcgagaacgtcaacgaggacctctgcaacaagagcgacctcctcctgcgctccaaccccgtgcacaaggcggtgcccgtgctcatccacaacggcaggcccgtctgcgagtcgctggtcatcctgcagtacgtcgacgaggcctttggcgggccgcccctcctccccgccgacccctacgaacgcgccatcgcccgcttctgggcagctttcatcatggacaagctggtggcgccatggcaaaaggtgttcacgactaagatcgaggaggagaaggccgagtggatggagcagacgctggcggcggtggatgtcctggaggggggcctgaaggagtgctccaagggtgggagcttcttcggcggcgacaacgtcgggtacgttgacgtcgtgctgggtggggctgtgccgtggatctatgggacggaggcgctctgcggtacgaggctcttcgataccagtagggtcccgctcctggcagcgtggttggagcgcttcggcgcgctggacgtggccaaggctgtcatggcggacgtcccgacgaggctggtcgagctcgcaagatgaacggnnnnggnnaggccgcgnccgcagccgcggccggagcagcagcatcattgccatttgattg

SEQ ID NO: 540 - DNA, 1385 bp, Triticum aestivum
  unsure (1)..(1385): unsure at all n locations
  Clone ID: PAT_TA_540
cgcccccgcccccccacccccacgacaagaagagcccttgcgccaccgacgccacgcgagaagggcccctccatcgtagaacagacggcaatcgcgacgttgggggcggacgtggaggggggcggggccgcggcggcgaagaagcagcaggaggaggggggcgaggtggcgacgccgccgtcgccgcggcgcgagggggagcgggagcggccgcgcgggctggtgcccgccatcccggtctacctcatccccttcctccccgtcgccaactacaacaacaactcccccgcccaggacggcaagcggggccccgcccgccactccgtcgccggcctcctccaccgcttctccttcccgcccctccgccagaacccgctcctccggccctcctccgcaacgctggtgaaggtgggcgcgctcgtgtgggacaaggtggtgcacgggcaccaggggtggcgcctcgtgtcgtgcatctggctgcacgcccgcgtcctccgcctgcatgctcacacgcccggcctcctccccgtcggctgcgggctcggccggctgttcggctgcctgcgggtcggagctatctacctaagctcgcgggtgggcgccagcgtcctttcgtccccgctgtccaccgggtgctgggccgtcggccgctccgctgcgccttctcgggccgcggggggcgcggccccgggtccctccgccgattggtactgctaatgcgcccccgctgcggggggggggacccctccccccggtcccccggcagccccggcgccgcccggccgtcccccccttgccagtggccggcccctcgcggggcgcttccccgcgcggttgcacgggtcggtaccgctccggcttcggccttacgtcggggcggcgcgagcggcaccgccgcccggcgccaaggccgtagccccgtccccaccggcagcccctccagcgcccgctgatgtccccccccaccacaccgtcctcaggcccgccggcgagcgcgttgccctcggtcgtggggtgatccagcgggagcacccgcagcggatcgtccacctcatctgcgtgcgtaccgaccaagggagggacgagaaacgacctacgaccagatcggttactgacccacacaaacacggccacctgggacctacatcccttgtcgcgcttacacccttgatatgagatcttcaaactcctctataattaatccggcccagcggtgtacccaaagacaaattgtccggttcataggggttgagacagcggccagatgggctagttgcacacaacaaaaaaaggcctcgttggggtcttttatctacttgtccatttgattttttcttttgtagtgttgtataacgaaatttgtttcgaaaaaaaaaaaaaggggn

SEQ ID NO: 541 - DNA, 538 bp, Triticum aestivum
  unsure (1)..(538): unsure at all n locations
  Clone ID: PAT_TA_541
atcaagttcaccatccaatcccagttccacatcccccgctttgatatttgattcctactgcattaatcccctcccattcccaccgatgatgcacaagacctcgtcgctgtcggagctgggcttcgacgccggcgatgcttcgtcgggcttcttccgcgcggtggccgacggctgcccgctgacgcccacctcctcctccgccccgcatcgccgcctcaccaaggtctccgtgatcggcgccggcaacgtgggcatggccatcgcacagaccatcctcacccagaacctggcggacgagatcgcgctcgtcgacgccctccccgacaagctccgcggcgaggcgctcgacctgcagcacgccgccgctttcctcccgcgcgtgcgcatcgtctccggcaccgacgccgaagtcaccaagaactcagacctcgaagaaatnaaaaactccgccaggcagatccccggcgagaccaggctgaaccttgccccggggaacgtgaagctttgccgctagttggtgccaggcgagggcgagcac

SEQ ID NO: 542 - DNA, 1036 bp, Triticum aestivum
  unsure (1)..(1036): unsure at all n locations
  Clone ID: PAT_TA_542
atcccgccttctctcctctcccaactcaaaggcaagcgcagacccagctcagctcaggcaacaacaatcagatcacacacaggctgcctaatcctgctcttcgttggcggtttctgtgcagcccgccgagctcttgcgagaatattgcaatggcgtccacgtcgagctcgacggcggtggacgagagggagcggaagcggaagagggcagccgggggtgattccacagcgtccgccggcccggggacggaggcgcagccttccaagtggcggacgcagcgcgagcacgagatctactcgtccaagctcttcgaggcgctccgccttgtccgaggcgggtcatcgtccgcgtcgacggcgccggcgcgtggccgggccgtgcgggagggcgccgaccgcgcgctcgcggtggcggcccgggggcgctcgccctggagccgcgccatactcgcctcccgccgccgccgcctgcaggcagnccaccgcgcgcgcctccgcgccccagccacaccacccgcgcgccacccctccgtcgctgccgccgcgcagccgcagccggggaaggcaccggcgctggcgaagaaggcgaaggtgctcgggcggctggttcccggctgccacaagctgccgttcccggcgctcctcagcgaggcctccgactacatcaaggcgctggagatgcaggtgcgcgccatgaccgctctagccgaggtcctggcgagggtttccttgtcggcagcctccggcagctcctcctcgccggcatgacccacgcttcgtgcatgattcgtgtattcgttgtaaatttcaccccattttcctcgtgggttggattagttagcctctcctctctagttgtcctcttgtttctcaggttggttgagcggttagtggtgtgttggtgataatgatggcactctggtgatttaaaccgtgctgtaatgcctctttctctcgctgtctagttgtggaggcacattcgttttgttccattcgaaaaaaaaaaaaaaaaaaaaaaaaagtcgacgcggccgcga

SEQ ID NO: 543 - DNA, 708 bp, Triticum aestivum
  Clone ID: PAT_TA_543
cccccgtcccgggccagcaccgcggcaacggccgcgccgccgccccgctcgccgcgcccgtggaccgcctcgcggacgccggccccagccgccccgtcgtcgcgtgcacggcgctagctgtggcgatcccgggaggtgtgctgtcgccgggtccccgaggttccgcgtgtacgaggtggactttgggttcgggcggccgcctgggctggagatggtgtccgtggcggaggaccggtgccatggcggtggcagagggccggagcagcgccggcggcatcgaggtggggcatctctctgccggcggctggcatgcagaaggttccaaaagtgcttccaagatgccattgactcgcttcggtaccggtagacaagtgattattttttgctctgcaatatcaaggtgaaattaataggtagacttgatctcgttcagctttgttgcgtcaagtctgttttgttttgatattgagttatgataatgcttaatgtatccatgatacatatcctggatgttgagcagcagctatgtagcgtctagtcggttgtgtccagatactgagatatcacaatggtcactgaatccatcatgcatatgcttatccatagctagtgatgctggcacattaatttctccggtaaaaaagtaatatcaaggtataaaagacaaagggctacctcgagactagctcgtgccgaattcggcacgag

SEQ ID NO: 544 - DNA, 926 bp, Triticum aestivum
  unsure (1)..(926): unsure at all n locations
  Clone ID: PAT_TA_544
agcacctctcttttcgatccgccggcttggttctccggcgtgctcccttcccactataaccctcttatccaatgcgagctcctccattctcttccctccctccctcctacttcatcagccctcatttttctattgcgtgctgcaagggccggaagcgcagatgctgcgcccaggcgaccatccctgcaaacggcgagccaggggacaccgatgatgcaaccggtttcgcgggctgctacaaccggcatcgtgtggtgctactaccagcaccgcggggagctggaactggttacaccaaagctgcgacgacacgtcgctgtttgctggaaccggcactccgaggagctgcaaccagcttacatatagctgcaaccagcaatctgcggtgctacaaccaacagagggcggcgggcaagagaggtccacaacgacggcgagccaggggcagcggtgtcgtgctatattgggtggtgtgagttgctggaaccggcgtatggcagagctgcatccggcaagggcggttgaaacgacagcgagatgaggaaggcgtgtgatggcgaattcgggctgcggagagagcggcaagcagtggtgatccagcgggcagcggtgatccggcaagcggcgaaaattcgacagtcatggggcccgtccatggcgctcgcgcctctgtaggtgctccccttgattttaaagggaaaattaaaggaacattgatcgggacgaaaggtcatgtatctgacggtaaaagggttcccgactccggatcnacggccaaattggccgngnacgggccataatgcctttcatacatctctgtacatagattttcacaccttgtttgtgacatcaaaatttncactccaaaggggccgtncantcccaaagatcttaccccangnncttaactgangaanctgttcant

SEQ ID NO: 545 - DNA, 674 bp, Triticum aestivum
  Clone ID: PAT_TA_545
tcgacccacgcgtccggaaaaggaaagtcatcgagcttccaatccaggtcctcagtcctcaccagtgcaatacgtgcgcgagcacaaaaccgcacaaatatgtcgacggtggaggaggagctgtccgagtgcgaggtgctgtggccggagacgcgccacggcgctccggggagcgcgtgggggtcgtcgacggcggctcccagggcctccagggaccaccggcagtgttcagcgccggtggacataccccgtggccgtgggcgtgctggcctggacgacgacgaggaggaggaggacggcgccatggtgccgccgcacctgatggtgtcgcgcaggtggtcggaggggaaggcggcggcggcgttctcgctgcggtcggggcccgggcgggcgcaccgggacctcaacaacctgcgcaactccgtgctgcggatgaccggcttcatcgaagggtgacgtgacgaggcggacccgtcatttgtgcatatgtgagagaaaagtcagtcaccacgcgccttctccacggtgttggccagtcaattttgttcggctcgtcttctccgtgtttgccaatcaaattaattatcagtatcccttggttgatgcaaatcacccagtagtgagttaggatattttatttttcttttcggaatggaataagctacgtttgtact

SEQ ID NO: 546 - DNA, 1068 bp, Triticum aestivum
  unsure (1)..(1068): unsure at all n locations
  Clone ID: PAT_TA_546
ggcacgaggccgacgccgagctcctcgccaagctgttcgacgtcgcgcccttcacgcacgtcctgcacctcgcggcgcaggcaggcgtgccgcacgctctcgttgaccccatgtcgtatgtgcgggcgatcgttgctgggctcgttgcgctgcttgaggcggctcgcgcggccgacccgcagccggcgatcgtctgggcatcctcgtcttaggtctacgggctcaactcccatgtgcctttctcccgagcatgacaggacggaccgacccgcgtctctctatgcggccaccaagaaggctggtgaggagatcgctcatgtctacaaccacatctatggcctctcgctcaccgccctccggttttttaccgtatatgggccgtgggggcgccccgacatggcatactttttcttcacccgggacattcttgctggtcggccaatcacggtttacgagagttccggtggaggcacacaccagaccaccatttcccgggatttcacctacattgatgatattgtgaaaggatgtattggggctttggatacagctgggcggagcacaggcagcggcggcaaaaagcgagggccagcgccattcaggacatacaatttggggaacacttctccagtgccggtgacacagcttgtggatttactggagaagatgctcaaggtgaaggccgtgaggagggtggtcaagatgccaaggaacggggatgtgccgtacacgcatgctaacatcagccttgcacagcgggagcttgggtatcggccatccactgatctccaaacagggctcaagaatttgtgcgctgggtatcttgagtactacaatcctgagttgggctgtgaagcaagaagcagcatggcagtacaatgggcaagggttcacgccggtccggaatgggcagcacgagcagtgcaagatgactgactatcantttctgggatggcctcttccgacggtgttttacaaanttctatccattacttaattcatcaaattttgagagcctttttaccnacgccttcaaatgaaacgaaacagcatgaattatttatgttt

SEQ ID NO: 547 - DNA, 518 bp, Triticum aestivum
  unsure (1)..(518): unsure at all n locations
  Clone ID: PAT_TA_547
ccggccgggccgggatcagcgcatcgccaagaagatatcaaacatacagtgtagaaaagagataagtagctagctagctttgcatatcttggcatggcgtttaccatgaggaacacaggcgtggtatgcttggccgccctcatggtggtgatggccactgtgatgctgtccggtgatgccgaatcagatatctgctttgatattcccggaccatgcgtgcagtcgttatgcaaggatgcatgtgctaaaaataataccccaaatagaccccactgccagcccgtgactgatgaatgctgttgtgacatggccgcaaggcccgaggtcgacgacgtcgtccatcatgcttgataacataaccttgaatcattattggacaaacattgtcagtgatcaggatatgtatatgcatgcatgcatgcgtgcgtgtcagcaattgcattttgaataacaaaaaacacaaaagagtaaatcattattctggggggggnccggtacccaatttcgccctatagtga

SEQ ID NO: 548 - DNA, 853 bp, Triticum aestivum
  unsure (1)..(853): unsure at all n locations
  Clone ID: PAT_TA_548
cccacgcgtccgaggaaacagaaggtttcagcaacgcctttgcagttttatgactgtgaatccatatctatttctaatcatgatgatctggcaaagtctcgtaaaggattggaagagtttgagcagccgagcccagtgtccattctacagcccccaactgatgaagacagttgctgttctggattcttcaagaatgacttgcaagaaatgcccagtgtggagacacaaatggaccatcgtcgattccgagatgaacctgaagtctcctccatgtcatgtgatgatggcaatgattcttcttacaaatctttggaagcatttcaggttgaggaggacagggacttctcatatctccttgatattcttataagctctggtatgatagtttcaactgactggcagctcttgtgcaagtcatggcactcatctagtttccctgttggtccccaagtctttgagaggcttgagagcaagtacgccacaattacttcatggccaaagccagagaggagacttatgtttgatcttgcaaattctgttctctccgatgtccttgcaccttgcaccaatatacacccatgggtgagttctaccagacagtgcaggcctatctggggccctgaagggcctgttgaagaaggtctggcaaatgattgtcaggcagcaggaggagctggcgatagacaaggctgatgacaataaaaagattctacgggatgaaactgggtggggacttatatataaaaaggcaaaaatggggggatcatgatacatgctgacnaaagttnnaaagggggaaccccctggganaaaacanaattgggaattctggtcccnccnaaagggggggggg

SEQ ID NO: 549 - DNA, 982 bp, Triticum aestivum
  unsure (1)..(982): unsure at all n locations
  Clone ID: PAT_TA_549
gcagatcatgggttaccattacgaagtagccagaacacgagttcaagtgctgagcgacttcctgacctatagtagaggggcaagggagcatgctataccttttgtacaaacactttaagtaatgattgaacgagatgggtgctgcagtcccagaaaagttttggtgttgtatatcggtgggtattcagcatggcgaatggcaagcagatatagctggtcgtatcgctcgatatctaagctgcgaatgccatttaggagcagatatatagagttgagtatatataattgatgaaggcatcccgactggaggtgttcngttcngtaacccccccccactatcatcatcatcatcatccatccacccatcctctccctccggcctcctttcgccgcctctttccttacctcgaccagtcaagctcaagctagcaaccaatggagagcaacggcaacggcaataacagcaacaacgcgaaggtcgggaacggctgtggcggcggcgcggcggaggcgccgaggaggccgcactggagccaccgggaccggtcggccacggcggtgtacctcgtccaccccgaccagttccgcgccgtcgtgcagcagctcaccggcgccgaggctcccccgcctgtccatgggcattctggcggcaacggcggtgcggaccggggcgcggcaatggcggtggaggcgacgaagggcaggagtggcgctggcagcagcgtggagcagcggacgctggctcagctgcaccacgactgcttggcatgggccgacgagtgctagcaagcttagtgatgatagagtactgtataaaactggctttgttactagcaagcttagtgatatttttgtacatggacgtaccgaacctgctgtgtgcatgcagcagtatgtttgcagccttgcaggtaccgttcgtgtactataatgtactctttccgagtgcttttcagttcgcatataagatttgtctgaagtc

SEQ ID NO: 550 - DNA, 631 bp, Triticum aestivum
  unsure (1)..(631): unsure at all n locations
  Clone ID: PAT_TA_550
gcacgagggccgggttgccccttccacaccgctcaagccgtgcgtccgcctctggggagaagaactgctcggaggcttcctcacctcggaggagctccggccggcgagaagggagcgccgagggaaatccaatcagcgttggaatttggcatcctgtaccatggcttctttgctctgttcacagataaaacaaaacagagcatatgttaggaggcaggttcatgagaatagacttacgagattgcctaagtctcttcattggagccccttgcagtcaggccattttaagaacattgcattgcgttgcactaagaatttgccttgggaggcctctctaccatatgcctccacagaggacgatgccagcattatcatgggaacaaatgttgtcgaagctattgatacagaagaagctccagagattccaatcctccagagtgaccaggatgttgtggacgtgaggaatgaaccttctaagcagccagcaacatttaagctgccaatgtggctgttagggccttcagttctgttggttaccggtatagttccaactttgtggctgccattgccttcagtgttccttggcccnanatcgcgggccttctatccntnntgggactcgactgcatct

SEQ ID NO: 551 - DNA, 908 bp, Triticum aestivum
  Clone ID: PAT_TA_551
gcaccgctgtaagagcggcggtaaccggtcttctagacgccgggcgagtcaatgagtgggttgtcactgagaaattaggagatgccaacaagacaaagccagccatggaagtgttagatgctgtgaaggtgatagatgttgagctaacgacgcccctagtgccaaagctcaagaagaggagaataagattatgggacaagtacaactgctcagagatttttgttgggacctgcataattataagtggtttctacgatttgttctacgcaaacaaagggtactacatctacctcttcattcaaggcctagcattcctcgtcgtcggttttgagtatatcggcacacgccctcccactcccagcgccgaataagcagccatgccatgccattcatggcgctcatctgcatgcatggttatgacaaacctcgtgcaagtaaaggccctctcctgcacatatcgatatcagaacatagcggtatacagagaattttccctatgccccggtcagatttgatccaaccattcattctctattactgcagacaaggcgttcgaaatagcatggtagtagaacagttaataacatgcagtattatttactggagctggtcgacagaaagatgcattctaaacctttgctgccaaacacaagttgtaaattaaatagcatgctctgccattatattactcactgtagattgctccaaattttatatgccaatgtacttactgatgtagcttgctcagaatggaggatgatcagcagcagtttgtgcagttggcttggttaattacacaaaaaaaataaagaaaaaaagttggtgcccgccttcttactgttgctccttattcagaatagagcggatgaccagcactttgtgcggttgtgttgtgtagtcggccaaaa

SEQ ID NO: 552 - DNA, 975 bp, Triticum aestivum
  Clone ID: PAT_TA_552
ccgcagttcgctcccctctccccctctccctcctcctggtccactctttcccgagatacgtacgagcccaggacacccatcaagttcttcggttccgccacgtccaagaaggagaacaaggggaagaagagatccaaaaggagcggcaacggccggctccttcgcctcgaccgcgtcgtccgtcggcatcagatgaccaggtctgttacaacgctgagatccgtcctgccgtcgtcttcgggggccggcggtaccgtccggctccgggacgaccaaagaaaccggccctggctcgccgtgacgcggctggcagctggaggtgggcgctgcgtacactccgtgtcgaccgaggagggagctggccgcgatgctctgccggaggcggaggccgcgcctcccccgtgaagggtatcgtgggccgcggaaggcccgcgcgaccaagggcgactctggagggggacagcatttccgcttgaggttttcacgctgacggggacgggaggatctccgccgaggagctccgtgccgtgttggcctccctcggcgacgtgtggtgttccgttgaggactgcggccgcatgatcggcggcgtcgacacggacggcgacgacttcgtctgcttcaacgagtttacgcgcatgatgatgcttgcgccgtgaattattgatgatacgtgtccctatctaaattatactagcagcctagctaccgttgttcgttcattattagtgagtaaattaggttttgttcttgattttcgatgtggatgtgtactcatggtgatgaaatcactcgaccggccaactaatcacgacgaatgaggccaaaaaaagcactcggccggccttcttttcccgccgtcgccgccacatcggaccttaaggtatgtttgatttgcaactgtctccgggacctcccccgctcgtgccgttcgccccgcgagaaaatataaaaattaaagggctggccgtttta

SEQ ID NO: 553 - DNA, 749 bp, Triticum aestivum
  unsure (1)..(749): unsure at all n locations
  Clone ID: PAT_TA_553
ttctaccctgatcgtggagaaaaagagtatcaaatcaattccgcactgccaatgccttcgtctgcacccgccgtcgccgccgagccgtcgtcactgtcgtcccttcccggccgcgacggctgctactgactcgacctggatgtagtagctagctagctctcgattgacatgttgtaacaagccagaaacacaaactgagccggccgtttgccacgggctactgccaccaccatcacctgatggcgattgcggtcggccactgccacgacctcaagccgcccgccgtccgcggccggcactaccgtccgcactccgtcacccagctcgaccggtcgctgctcgaacgcgacaatcaggaacggaatgcactgtcaccgcagcgtcggtgtctctcctccccgtgcttcaccaccgtggccgaacccgcctctgacgacgcccaggacgacaagaagatgccccgcgtggagatcgtcgcgggtcgccacgcccgcggcgtgcacgagctcatcgcggaggccgcgggcgccatcgcgtcagggacgcggcttgtgccagcgcagagcggcctcggcggggctttgctgctcaaggacggccgctccggcgagcacgtggncggtgatcaagccgctagacgacgcgacgtcttctccatcgaccaacgtcggaggcggctacgagagcaaggccgtgctccgggaggtggccgcgtaccttctcgaccacgagggttcgccagcgtcgcg

SEQ ID NO: 554 - DNA, 318 bp, Triticum aestivum
  unsure (1)..(318): unsure at all n locations
  Clone ID: PAT_TA_554
cccacgcgtccgcggacgcgtggggtgcgcgcgcgcgcgcgtgtgcgtgtgtgtgtccatggttgtttttgttccggttttgatagttcaaggttgtaaagtagacaattttatagtttagtgttgtatactatactttggtgatagttcgaggttgtgatatggatttctcttctgtttctaggggaagaaaaagaagagatgtacactctgtagagtaatttgtcagctttgtctgctcaagcagctcagctgcttttgtaatctgataaattttgtcaaaattgtaaaataaaaaaaaaaaaaaaaaaanaaaaa

SEQ ID NO: 555 - DNA, 1080 bp, Triticum aestivum
  unsure (1)..(1080): unsure at all n locations
  Clone ID: PAT_TA_555
ctgcgggcgtgctttgcttgcttgcgttgcgtgcagggagcaggatgggtacgaggtgctgcggaaggtgggcaagggcaagtacagcgaggtgttcgagggattgcggaccgggagcgaagagaggtgcgtcatcaagatcctcaagcccgtgaggaagaagaagataaagagggaaataaagatacttcagaacttatatggcggacctaacattataaagctactcgatgttgtcagagatgatgattcaaagacgcctagtctgatctttgaatatgtcaacaatactgacttcagagtactctaccccaaattagtcaaaataactatggttcttggcacagaagatttccaccggtacctcgaaagaaagggtccacacggaatatcatgcatcgagatgtcaagccccacaatatcatgattgatcatgagaaacgccagcttcgtcttattgattggggtctcgctgagttctaccaccctaggatggaatataatgttagagttgcttcaagatgctataagggccctgaattacttgtggatttgctagactatgactactcattagatttgtggagccttggttgcatgtttgcagcaatgatattccgtgtggaccctttctttcatggtcaggctaactaccaacaattagtcaaaataaccaaggttcttggcacagaagatttccaccggtacctcgaaaaatacggtcttcggcttgacccacagcttgaaatgcttgttggaagacacaggaagaagccatgggagaaatttgttgactcagggaaccgacacttagtgagccctgaggctattgattttctagacaagcttcttcgttatgaccaccaggaaaggcttacagcaaaggaagccatggctcatccctattttggcccagtaagaagctctgaanagcacccggagaatgttcaatagtgatttgctacaccatcattgttcgaagaacatggcatatttgacaattttgaaacagcatgtcgaacacatagactaacagagagtgagtgtatttgattttgatagcgcatccatggtttatcc

SEQ ID NO: 556 - DNA, 1895 bp, Triticum aestivum
  Clone ID: PAT_TA_556
ccgccccgcccccccccccctcccgccccgcgccagagagagtcggggaccccgcccccgcccgctcccctccctcgcccccgcccccccgtccccctcccaattatacggcaccgcgccgtctccacggcccatccccggctgcgaccccctagagcaaaccctgctcctgcgtctcctgcccctctgctcagccgcgcaccccgcagccccactccgccgccccggcccccgtccccgcccgctcctcattgggccctcgcgtgcgccgcggcctgactccttactgaccgccgccgcgcgggttcttgcgccgtgcccgttgtttcttgcttcgttttctaggccggcgtccgtttcctgagtccggttcttgctgccgcgcggccgcgccatgggcaacgggccggaagagcactgttcgcgggcggcggtggggacgaacttctggacaccagcgacgccgaaatgcgttggcgcgtcctccacctggctctaggcttcctccatctcgtacgccaccgagaacgtcaactcgcacgagtttgttctcgacaagtacatcgacgctctctacgagaagaggggttctacaagagaggcagcgttggcttcattggttgatgcttttgaaagttttatgcttggtggtcttgttgagaacaaatatgccactctactgagtctattcaatacttcgatcaagaagggatctaccaaggaggcttgcctggcatctcgcgccattgggctactgtctattacacttggtgctggcagtagctcacatgaaacaatggtagaatcacatccacagctttctaaggtccttcaaacctggtcggatgcttcaaagatgatctctgctcttgactgcttggccgtcgtcacatttgttggtgcaactgatctggctgaaacagaggtatctttgaaagccatgtgggatgtgattcatccaaaatcaggttcaaatgtcggtactgtccggaaaccaaggccacctgtgttagcagctgctctatctgcatggacttttctgctaacaactattggttcatggcggataaacactgatagctggaaggagccaattgcgtttctctctactcttctaggagcagaggatcgtgctgttcggatggctgctggtgaagcattagctttgtgctttgagttaaatctacttgatatctccccttctgaagatgctgatgatgacactggagtacctggtagctctaagggcaaacttttcctggatatgcaagcattgaaagccaagatagccggtcttgcctcaaatctctctgcggaggcagggggcaaaggtgcagacaagaaaaatctttctgaccaaagagatctgtttcaacggattttggattttgtcaagtatggcgagtgccctgaagaatcaatgaagattgctggaaaacgtgatgttttaagggttgcatcatggtctgaattgattcagttaaacttcttcaaacgtttccttgggagaggcttcctgaagcatgtgcaggacaatggacttcttcaagatatcttcaacatcaaggctgacaaggctgaaacgctgtcatcgaatgacaagaaaatctttagatctggagaagagaaaggaagagctctgaagctgaacaaggatcgtcgtttagcacaggagaggaagaacgctggcatgtttgacgagtaacaagaaaggaaacaaaacctcatcggcccgtcattgtactccttttgagctggaatttatttatatctgtgtgaacaactacatgcagaatgtcctagagtctgctctccttgactgtcgtctaattatgattatgatggcttgctgtacttgagaaatacttggccgaaatgattactgctgttattat

SEQ ID NO: 557 - DNA, 569 bp, Triticum aestivum
  Clone ID: PAT_TA_557
caagcaacttcgagcgggtgctgagatgattcgcaacggggccctgctgctgatgagggccctcgccttcatcacatggatatggaggcgagggccacccatctagccaatgtcaaaaacttgaaaggtctgcaagctggggacgacatcaagcaacttcgagcgggtgctgagatgattcgcaacggggccctgctgctgatgagggcctgcgacgcgtccaagggtggaatgtgaggaagttgcactgggtgctatgtcgttggtctcttttggctactgttcgctgggtggcttcgtagttgtagcctcttaaactgaaaactgtttagccatgctctatgatggctttattgtaataggactagcgttattcgggtgctgatcaggttttcgccccatagcacttgtttcgatgccgggcgagtgcggtggatttcctagcagtgcgttgaactcgatctccccttctccctgctcctggattttgtttcaaactttgtatttccgttttaagtaatggaaagggggatagcccggttcaaaaaaaattgggatgtggtttaatg

SEQ ID NO: 558 - DNA, 768 bp, Triticum aestivum
  Clone ID: PAT_TA_558
gaaagctcctgggcccaggtaaaattattggagtgactgcaagctcaaaggaggaagccctcaaggcttgcaaagccggtgctgactatctcggcattggaactgtctattccacccagactaaaaaagacaccaaatccatcattggcccctctggtgtccgtgatatactctcggctcttcatgacgcaggctacggctctgttcctaccgtttgcattggcggcataaacgccagcaacacagcacctgttctcgcctcggctggttctccctccaaggctctcgatggtgtcgctgtagtgagcgccctcatcgctgcccctgacccggccgctgctgcccgagatctccttagtaaagtcgtcaccaccaagattccagaagttattcgcgcagtggtggacaaaacgcctctctcgcacaacatgacgaacctagtcgttcagaactttgccgctaatgtagctctttgcgttggagcaagccccatcatggccaactacgctgaagaagccgctgatctagccaaacttggtggcgctctcgtagtcaacatggggactgtcactccggatggcctcaagaactatctccaagccatcaaggcatacaacgaagctggccgacccatagttctggaccccgttggtgccggtgccacagtcgttcgacgcaacgccgtcaaaactcttcttgacgctggtcattttactatcatcaagggtaatgagggcgagatccaaaccatcgccggtgccaccatta

SEQ ID NO: 559 - DNA, 1179 bp, Triticum aestivum
  Clone ID: PAT_TA_559
catcgatgccctctcttctcccctctatatgcgtcgccccgtccccatctttcccaccgctatggccaccagcccgtacctcccaccccattccagatcacgccctcgagctgcggcgacagtggtggcagcgggtccaactgctgcggctggacgacggttgacgccgtctgcgcagatcagttcgccttcctgggtcgcagtcaagcagagcatgtgccacggcgatctacgctgcccatcttaaccagatcgacgctgatgagaggtctctaatgtcccttgcagtggccacgggtccatcttcggtccacggcaagctatggtgaggtacacatggcgctgatggatgcagtgtacaggggcgccaccgccacgcagctggccaccggcttctgcctgctgcggtaccgtgacgagcactgcttctcggctttgccagggccctcccgccccgtgtttatgtgctgatcctcgtcatcatcttcgtcggatggttttcttggaagttggtcttgtatcatttctacttcaaggaaatgaagccactggttatggtctctttggcacacaacttaatttgttatctctgaaactgtagccggctgtagccagtgctgatgtacttctcaagcgctccatcacgggctcaaagagtactccagccgaaccacactcccacggctctacgtcgatgacgagttctttggtggccgcactgttggtaatgccccgcaaccccattctcatcccattacagcgggctagacgtcgtcctcctcgatgcggccgtccccgacgagctatcttggccagaggaggcggagcagcaaggccttctatcatcgtgcatggaccgacagttgcatcctcctgctctcctagtgtggaagaataattcttgcagatgtgagggaagaacttgtggagaggcttgcctcgctcttcacagagggccaatgcatacttgttttacttctggatgaacttgtatctctatatatgtttgtaaatgtccccaatgtggctttagtgatgtcatctaggatgcttgttgtaatggatgattcttttagaaagggtcatggatgaaataacatggaaatttgtaaacttggtcaaactatgggcctggtacgtcaaaataattgagtcgtgtaaaaaaaaaaaaaaaaaaaa

SEQ ID NO: 560 - DNA, 1201 bp, Triticum aestivum
  unsure (1)..(1201): unsure at all n locations
  Clone ID: PAT_TA_560
ctcggtggttgctggccagtggggatccacgcgaaccccaatcctacaacacgtggataatgtaaccaagcgcgcgcgcagggctccccgcggcgttggcggccggcggcgcaccgtgcaccgattcccgctgcaccgccccactccccggggtcgggctttcggggcacctggagttttcctagtctgtcgagggctactccttcggcggtcgcctcctcgattccctcctcttcccttacctcgccgatctggaggtcggcggcggacattcgcggctcttggaggacctcttattcgagggtgtcatcggcggcgtgaccagcttggaacccacgccggccgactcccaaaagatgtggatcagataggcggagtacgtgaaccagctcgtgtggctgtggggccggttggtggatatgcattaaccatccgtgggctgaccaaagaccctcccagctttttgagagcacaaatgtgtacatgttctgtgtggtctgaggtcatccgtggaggctccctctttttccactagaccatgtaacaataaagcttgtcgccatacacaagcttttgaagcctgatggcaaatttgtatcaattacctttggacagccacacttccgtcgtcgatttttcgaagcacctgagtttacatggtctgttgagtggaacacctttggtgatggcttccattatttcttctacacccttcagaagggcaaaaggtcaccagagtccaacggtcaccaagttacattacctgctgctccaagcttcaatatgctgcatgaagagctcgaaagcgaggattacatattccgcacaaatgttgatgagttataagcagtaactcaataagtgagtgcgccggttcggaggtcttgatgctacgcaatacgcatgaaggggctgaccgcgaagcaacccagcgagtgatgcttttacatgccttgttgtgtggtgatgtatcattgcggcccagcaggctaggggtctttctaccatcagaactgacaatagacacctgttcccaatgttaaccttcttgcgtgttatttcagattatgaaaaggaccttcagttatctttagtgtgttgactacagatgacatagagataattgttttcccttattattcttctcatttccaggacatctgcttatatagccagttcaaactacagcagnataagagaa

SEQ ID NO: 561 - DNA, 868 bp, Triticum aestivum
  unsure (1)..(868): unsure at all n locations
  Clone ID: PAT_TA_561
cccccgcacgcccaagcaatgtatcccaccaccccctccgacgcgtacgacaggttcagcaacggccctccgcccacggcgccgccgccgcagcagcagcccacgtacaaccacgccatgaaccagagccaccacgcccgccccgccgccgggctggcgcgctggtccaccggcctcttccactgcatggacgacccgggaaactgtctcatcacgtgcctgtgcccctgcatcacgttcgggcagatcgcggacatcgtggacagaggaacctgctcgtgcgccgggagcggggcggcctacgcggccatctgcgcgacgacggggatggggtgcctctactcgtgcgtctaccgcaccaagatgcgggcgcactacgacctggacgagggggagtgcccggacttcctcgtgcattggtgctgcgagctctgcgcgctctgccaggagtaccgggagctcaagaaccgcggcttcgacatggggatcggctgggacgccaacatggagcgccggaaccggggcgtcaccggcgggcaggtcatgggggcgccggccacgcccgtcggcatgatgaggtagacaggtcacgcccgcgaaatctccggtgattttcatgcgtcatgctcccctcccatcccctgtgccatttctccttgtgttattctgggttggagatcgttcgattttttgattgactgtttttctagcggcgtgtgcattgtctactagtttgcttgatgtgccgaattctgggcatccttcgttcactgttgtcgcctgtccacgtgcgcatgcagttgggnttgattgaagttccgaatccgttgatccaagtaaatttccaaccattacgactaaanataac

SEQ ID NO: 562 - DNA, 1122 bp, Triticum aestivum
  unsure (1)..(1122): unsure at all n locations
  Clone ID: PAT_TA_562
gngctcctctgggcagcgagttggctctatcatgctacaggagatcagacatatctcagttatgtgactgtgcagacgggaaagatatgctgattggggaaggccaacatggttcagctgggatgacaagctcccagggacacagatccttttgtcaagagtaaatttctttggatccaaagagatatctaatgctgaaaacagtggactcaaaatgtacagagacactgctgaggcagtcatttgtgggcttctaccagattctccgtcagccactggtagtaggactagcggaggactggtgtggataagtgggtggaattctctgcagcatggcataaatgcagcattccttgctgttgtttacagcgactacatgctgacatcacaaacagctgcggtggagtgcagtggaaagtattttagtccgacagatattcgcaatttcgctatatcacaggcaaattacgtgctgggtgacaacccgatgaagcttagctacctggtgggatatgggagcagctacccgcagcaggtgcaccacaggggggcatccatccccgcggatgcgaaaacgggctgcaagggattcgagtacctccattcgtccagcccgaacccgaatgtcgccacgggagccgttgtgggcgggccatttcagaatgactctttcgtggacttgcgcgacaatgcggtgcagacagagtccagcacttacaacagcggcaccttcgtcggtctgctcgcgggcctggtgaccacctcgtccatcgccaagacattcacctagagctctttctcaagcaacgacaatggtggctttcatcaacccgggaagcatatacaactagaggaattttacttttttgctcgagtgacggtgaatgcgcaacccggtgagacctgttgcagatttgttcattggccgtctaatattaggtgggtgattagcagtagtcattagtgccacattactcttgcttgtataatacagtatatatggtgattgtcaccgtgtggtcaaactcctatctggtttgctggtgtaccgtacctgttgtagctatacagcgtgtttgtttgggggaaaatattattagggaaaaaaaaannaannannnn

SEQ ID NO: 563 - DNA, 1854 bp, Triticum aestivum
  Clone ID: PAT_TA_563
cccgcccgggggccccggcgccgcccgccccggcccccccccggcccggcacctcctcagttaagcgactccacggacggcgacgcgctcggggtcgcgctccaggccttccaggtccagaaggccgggaaggtggtgggccacccggtatccttgcggaggcgactatgcgctcagggaccagaaaaaaatcgaatccggaactctgtgaacggctgtacgacgccggggatcctatgacgttcacctgccccatggcacccccggcgacggtcctcacccggcgcgtgacccgctccggggggccgcggatcgccgcctcgcagctcgtcccaccgcctaccgctcccccattcgtctcggttttcctcatcgaggccaagccttctgaaaatgtgttctacattcaggttggtgatcctgatctagatcacgactgctggcgaaggctagatacaatgaccgcgaataaggcgcctgcacagattaccccagaaaccccggtgtcagatattacttgggagcagctacccgcagtggctgcaccacaagtgggcatcaattcccgtggatgtgaaaacgggcttcaagggattcgactaccccaaaccttcccgactcttcccgaagctcgccaaggcagccgttgtggccggtccacttcactatgaatctagtgtggtcttgcgcgctactgcggtgcagacatatcccagctctgtcaacggccgcaccgtcgacgatctgctcgatggcctggtgaccacctcgtccagcgccgagacattcacctcgggctctttctcaagcaacgacaatggtggcttttatcaacccgcgaagcatacacatcctgaggacagttgcttttttgcttgagtgaagattgatgcgcatgtcatacccgggctgatccgatatagaccggtacactggcggtgtagtattaggtgggggcttagcaggatcagtgggtgcaattctctgcagcatggcataaatgcagcattccttgcttgtgtgtacagcgactacatgctgacatcacaaacagctgcagtggagtgcagtggaaaatattttagtccgacagatattcgcaatttcgctatatcacaggcaaattacgtgctgggtgacaacccaatgaagcttagctacctggtgggatatgggagcagctatccgcagcaggtgcaccacaggggggcatccatccccgcggatgcgaaaaccggctgcaagggattcgagtacctccattcgtccagcgcgaacccgaatgtcgccacgggacccgttgtgggcgggccattccagaatgactctttcgtggacttgcgcgacaatgcggtgcagacatagtccagcacttacaacagcggcacattggtcggtttgctggccggcctggtgaccacctcgtccatcgcaaagacattcacctagagctctttctcaagcaacaacaatggtggctttcgtgaacccgggaagcatatacaactagaggaattttatttttttgctcgagtgacggtaatgcgcaacccagtgagacctgttgcagatttgttcattggccgtctcttattaggtgggtgattagcagtagtcgttagtgtcatactactctagcttgtaccatagtatatgctatttttaattctcacgggtgactccaactcggattgctggtgtacgctgtcctagctatgggtattgtatttgtagggcagatttcatttgttcattctcaggtggtttttggtagctgcgatgattggtctgtgtaatggctttggcttgccaatggaaaatgcatacattcacttgtatgcgcaattcttttac

SEQ ID NO: 564 - DNA, 1359 bp, Triticum aestivum
  Clone ID: PAT_TA_564
ccgccttcaaatctccacccctcacttggaacctcttcgagattccgcccgcatcttccatcagatccctctctgcactatattcctgcatctcttcgtccaaaccttcttggagctccgtggttcctcttgctttctgcggcctgatgggaagcagagatgacgatggccaaagcacagaaggccagggttatgccgcggacattaattccatcagggaggcgcagacgcgcatcgcgccatacgtgcacaagacgcccattctgtcatcaacgtctatccgatgccataccagggtagcaattgtccttgaagtgtcgctgcctccagtagccccgggagtgcacacgccagcctctctctctccattctctattgacccgtccacagggcaacttctggcgttcacatgtcaaggtcccaagcgtccgggggctttcaagatccgaggggcatccaattcaatatttgccctcgatgacaaccaggcggcaaagggcgttgtgacgcatagcagtggaaatcatgctgctgctgtggcactggctgcaaagttgcgtggcatacctgcttacattgtcatacccaaaaacgcgccagcatgtaaggttgagaatgttaagcgttatggtggtcaggttatctggagcgatgtcaccatggaatcaagagaatctacagctaaaaaagtccaggatgagactggtgctattcttattcatccattcaatgataagtatactatcagtggtcagggaacagtgtgccttgaacttttggagcaagtccctgaaatcgacacaataattgttccaattagtggtggtggtttaatttctggtgtggcactggctgcaaaggccataaacccttcaatacgtattctggcagcagagccaaagggagctgatgattcagcccagtccaaggctgctggaaggatcatcaaactgcctgcaaccaacaccattgctgatggactacgagcgtttcacggtgacttgacatggccggtggtgcgtgacttggtggacgatgtcatcgtcgtggatgacaatgccattgtcgacgccatgaagatgtgctatgagacgctgaaggtggctgtggagcctagcggagccattggccttgccgctgccctctccgacgagtccaagcaaagctccctttggcatgagagcagcaagatagggatcattgttccccgcggcaatgtgggcctccgcgtgccctgggaacccctatgtaaatgaaattgttgccgcgcaaaactgtttgaatttgaaatgcacgaggttaatggctgcagacgtgtaaaaacaccgattttttacagggaactgtctttgtttgctg

SEQ ID NO: 565 - DNA, 1482 bp, Triticum aestivum
  Clone ID: PAT_TA_565
tccttctccaacccgccgcagtactacccgcagtacgggaactactacccgccgccgccgccctccgtgcaggtgcccctcccggcgccctacgaccaccaccacaggggcgccgcgccgccgcccaacgtgccccccaccgagttcccgccctccgtccactcccaccactaccccggctgggccgggcggtacccttacgggctccagccgcccatgcccacgccctacgtcgagcaccagaaggccgtcaccatccgcaacgacgtcaacctcaagaaggagacgctccggattgagcccgatgaaggctgtcccggccgcttcctcgtcgccttcaccttcgatgccaccgtcgctggaagcatgactgtctacttctttgcaaaggaagagctcaactgcaatctaacagcgatgaagccagacttgattaagcctgttactgttagcttcaaagagggtcttggccagaagtttaggcaaccttcagggacaggaattgacttctcagcgtttgaggactctgagttgttgaaacaggggggaatggaaatatatccacttgcagttaaagctgaaacaacattggctgctgatcaaccatcggagggggaagaccagaaacccaaaactccaaactcgcagatcacacaggctgtgtttgaaaagaaagaaagcggtgactatcaagtacgagttgttagtcagatcctttgggtgaatggcaccaggtatgaattgcaggaaatatatgggataggaaactctgtggaaggggacactgatgcaaatgatcctgggaaagaatgtgtcatctgcctctcagaacctagggatactactgtccttccatgtaggcatatgtgtatgtgcagcgagtgcgccaaggtcttgaggtaccagaccaccaggtgccccatctgccgtcagccggtcgagcggctgctggagatcaaagtgaacaacaaagctgaagagccgccccagcagacgtcccaatcgcctccgctacctccaccccctgctctgcatcaggaagaggtgtagctgcagcctatcacgaacagcataaaaacactatatgcttctagattgcggccttcgggccttctccccctgcagggtgctcacttcgtttgagcatacgggatgtaactgttaaactcgcctcggttacctgtagtgtatgtaaagcatgttgtaaagcttctggcatcacgaagcggctcgccggctccggcgggggggccggccgatgccaagatgaggacatgtgataagttcatgcgtgtgctgttggctagctgaagaagttgcagcagggttgggggtgtgcctcgtgcctgcctggtttcctctgtcgggggaggggggaaagaggctcagaaggtgcctccagatttgtacaaagtctcgtatttctatcgtatcataaatttaccttgaggttgtcacaaaaaaaaaaaaaaaaaactaaaa

SEQ ID NO: 566 - DNA, 749 bp, Triticum aestivum
  unsure (1)..(749): unsure at all n locations
  Clone ID: PAT_TA_566
gaattcggcacgaggttcaaggcaatggttggcaaaggtcgtatcggagatgttcctatcatgcttgccaagccgcaaacatttatgaatgcaagcggtgagtctgttgggcagctggtttcatatttcaagataccacttaatcaagtcgttgtgatgtatgatgatctggatttacccttcgcaaaattgcgtctactgccaaaaggtggacatggcgggcataatgggatgagaagcattatcaaccatctcaaacaaaatcgtgattttccacgtctaagaattggcattggacgaccacctgggaagatggatcctgccaactttgttctcaggccattcaccaaaaaagaacaagaagagcttgatttcacattccataggagcttggaagcaataagaataatggcacttgaaggattcaacaagagcgctactttcgtgaacactgcccaatcatccgaaatgctgaatagatgacaggccaattgattcattttctgcgccaaagagatttgagtttaagtgatgaactaaagtcaaggagctagatatgggtgttcagttatttgtgttgcggccatctttcctgtaagaagaccccaccctgaaaagtgaagctttatttgtccatacgctgcttgggtgggatgattagtgtccatctgtgcctgcccgggcgcccccgcgcaaaaanagagttttgnggcaggganaagnanaacgattcaaaattgagttanttc

SEQ ID NO: 567 - DNA, 1215 bp, Triticum aestivum
  unsure (1)..(1215): unsure at all n locations
  Clone ID: PAT_TA_567
gcacgaggccgacccggacgtcctcctcgccgccgcctccagcgacggatccctcgcgtccttctcgctgtcctcctgcatcgcctcctccgcctccgcccacgccgccccacagctggctgccgccgcgctggtcgaccccgtctgcatcgtccaagcgcacagcggccccgtctacgacgccaagttctacaacgatccgattcagccgctgctcttcagctgcggggatgacggccacatccggggttggagatggcacgagatgcagagctgccttctgccactctctctgcaaggggatcatgttgaaccaatacttgacttggttaaccctcagcatgaaggcccttggggtgcacggtctccaataccagaaaataatgccattgcaattagcaaacaggatggatctcttttcgcggcagcgggtgatgcatgtgcttattgctgggatgtggaaagtggaaagtgtaaaatgacctttaaggggcatactgactatttgcatagtatcgcagttcgtgaggcaaaccaccaggtggtaactggatcagaggatgggacagcccgtatctgggattgcagaagtgggaagtgtacgcagacgatacgtccagtacagaacaagaaatttgagggctcgtgggtcggttgcattgccattgatgcgagtgaaagttggctggcttgtggtacttcttgtggtatatcagtttggagtcttctttcaaatgagtgcatcttcaacgcagattgtggtgctcctgttcaagatttgttgtttgacaaaaatcaaattttagcggttggcgctgaacctgcgctctcccgtttcacgatcaacggggttgttgtttcgcaaataaagtgcgctcctccgtcggcattttccgtctccatgcattcatctgggatggcagctgttgctgggcatggaggtctggtggatgtcatctttggattcgggagccatctttgcgcgtttcgttgccgtggcctggataggtaatcagttaccgagtgctgatgaagcgttactgtgcaatttccatttgccactcccacattagtcagtggagcgcgaaactgtatttcttttcccccctcactggtgtaatacttgnttcaattcagtctgcgggatgatttcctgacaaggatagattctttgtaaatgtccttgntctagatattctggtgggagggttcaat

SEQ ID NO: 568 - DNA, 523 bp, Triticum aestivum
  Clone ID: PAT_TA_568
tttttaatccaatgtggattgtattacagataatagtacagatatagtagaatgacttatattggtttacagcttatttaagcatcttcttagtctgattgtggtctttagagggtgtgagcgtacgataagcagtgtgtcattgtcgcataatgcttgcatgctacacttccacatgcacttgaaggcctgtaaaaggtagcatattgtcaaacacggatcgctgagatagcaaaatcatcagaacaaaaacactaagagcaacaaaaacatgcaccgatcggcataattatttgattcacatctttgatacaaccctgcctttgaactgcacatctgtgccacatacgactgaaagcaacacccccaacaaaaacagagaaataagcggacaaatattgtactccctccgtcccaaaataagtagtactaaatcagcgacactatttgggatggagggagtataaaccagctaatgggttcttaaatcaagtcagccaacaaaaatatatcttgatcgcga

SEQ ID NO: 569 - DNA, 2663 bp, Triticum aestivum
  unsure (1)..(2663): unsure at all n locations
  Clone ID: PAT_TA_569
caatgtggattgtattacagataatagtacagatatagtagaatgacttatattggtttacagcttatttaagcatcttcttagtctgactgtggtctttagagggtgtgagcgtacgataagcagtgtgtcattgtcgcataatgcttgcatgctacacttccacatgcacttgaaggcctgtaaaaggtagcatattgtcaaacacggatcctccagatagcacaatcatcagaacagccactctaagagcaacgaaaaacatgcaccgatcggcatgattatctgattcacatctttgaaaccgccctgcctgtgcactgcacatctgtgccacatgcgctctcaagcggcaccccagcacttaacagagaaagcagcgggctaatattgtgctccctccgtccccgaataagtagttctcaccgagcaagactattgtggtttctttgacctagagtgctggtgcagggaagcacatgggatcgaggcttgaaaataaagcagcaatctattacaccgccccgattaatacggcctcaacaaaccctagcaccgccagatctccacctcctccgccgccggagaggccacccaacagatctccccgatggcgttccgccgactcctctcggccgcagtgcgccgccgctacgccgcggcggctgcggcggcaaacgggaacgcgctcgagtccttaacgctcgtcgccgcgcgccccgcggcttgggctcccaccgcggccgcacgattagagccccgacgtaggcgaccgacctcatagcctttgatagtaccgcgtgcgtccgctgcttcgagcaccaggacggccggctccaccgaaaagctagcccagtacccgtgcacgtcaaccacgactccaagattgaggcgccggagaccaggatcaccacgctcgacaacggcctgcgcgtcgccaccgtatcctcgctctcctcgcgcacggccaccgtcggcgtctggatcgacgccgggagcaggtacgaggacggagaaggcggccggggtcgcccatttcgtggagcacatgctgttcaagggcacggggacgcgcagcgccgggcagctcgagcaggagatcgaggacatgggcggccacctcaacgcctacacctcgcgggagcagaccacctactacgccaaggtgctcgacaaggacgtgccacgtgccatgaatgttctcgccgacattttgcaggactctaagctcgaggacaaccgcattgaacgcgagcgcggtgtcattctccgagagatggaggaggttcagggacagtcggaggaagttatattcgatcatctccatgcaactgcattccagtatacttctcttggcaggccaatcttgggttctgctgataatgtcaagtctatcaccaaaaagaatctcatagactacattcaaaagcattacacggcttctagaatggtcattactgctgctggtgctgttaagcatgatgatattgtacagcaggcaaaagagctgttcaaatcgctgccaactgaccctacaacaactaacatgttggttgctgaacagccagccatttttactggttctgaggtacgaatcattgatgatgacatgccccttgcccaatttgctgttgccttcaatggagcatcctggacagatcctgattctattgcattaatggttatgcaaactatgcttggttcgtggaacaagagtgctggaggagggaagcacatgggttcggagcttgtacagagagtagcaatcaatgaaatagctgagagtataatggcattcaatacaaactacaaggacactggcctgtttggtgtctatgctgtcgctaaggctgattgcttggatgatttggcttttgcaattatgcaagagatgagcaaattatcatacagggttaccgaagaggatgttattcgtgcacgcaatcagctgaaatcctccatccaactccaccttgatggctccactgctgttgttgaggatattggacgccagcaactcatctatggccgtagaattcccattcctgagctttttgctagaatagatgcagttgatcccagcactattaggcgtgttgcaaaccgcttcatctttgaccaggatattgccatcgctgccatgggaccaattcagtctcttccagactacaactggttcagacgcaggacctacatgctccgttactagatgattcgaccagcggtgtaccatgtttacagtctgcaaaggcaagatgattgcttgttttggcatcagtatattaaggccacatccacgcacattatgtgccgaagtggaggaattttttgagtctttgttttccttgcccctctcttccttttgcaaacccacaaagctgtcaataatggtaggcaaattcgactgacgtggcttacttgggtggccatccgttgttttacgatgatgatgaatggtcacaatacttttccatcttgtgttcggatattgttgtcttttggccaataatttaaatgaagctgcttatgtaaaaaaaaaaaaaaaaaagaagcccaggtaacaatagaccgnctaacggcgtcnttaaactnngacnggaaaccngnttncactaacgcctgagaaaccccttccancgggtatacnaangcnccattcctnn

SEQ ID NO: 570 - DNA, 910 bp, Triticum aestivum
  Clone ID: PAT_TA_570
ctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaattctcgcctctcccccactcgctcttccgcatccacaacgccccacttccccccctccaactatggatgcagatggcatcgaggccaccaccgggcctcccgactctctttcctccgcgggctcagctcagcgctcgcccaatccctcgcgcacaccgcgacccacaccggctccagcgcctctcctccttcttcatgtctcctcctcaccttcttagcttttttcccttgttcatgcagggagcacaaaaggagcctcgcctgtgcaagcggatccggctgccctcggccgtccccgacctcgtctactcctcccgtcgccggatttgacgcgcctcccgccggatccgtccggatcggactcgtctactcctccccgtcgccggatttgacgcgccgccgccggatccgcctccatcggaccggatccggctgccctcgaccgtccccggccacgtatgctcctcctgtcgagggatttgatgcgccgcttccggatctgcctccaccggaccggatccgtccggattcgactgcccacgaccgtctccgttccccttctgattattctcacctttgtttcctgatttttgtggttgcttgttgaataatcaatgtgtacctatatgaactggtgagattagtaggtgtaattaagcgatgtggtattattacttagccaaatcgtataatttttttggc

SEQ ID NO: 571 - DNA, 917 bp, Triticum aestivum
  Clone ID: PAT_TA_571
cgtccaccccggcaagacggcaggaggcgggcgcgggcgcggcggcgacgggcagggatggccggcggtggcgccgccgccccggcgctctcgagcccgtggagggcgctgctgcagcgagcgctggacgccaacgcgcacctctagcactccaccttcttccagctcgccacgaggggcgccgacggcaggccggcgaacagcagcttccaagaccacggtgacaaggagcagtgcgacaagattgcgctgaacacggatgcgcggagcaacaagattggggagatcagggaatggcccctcggcgagatatgctggtatttcaccgattcctgggagcaatttcgtatcagcggtatcatagatgtgatcgatggttccagtccggaccctgccaagctccagcaacgagagaaagcttggttcgccagttcagtgaagtcaagatcacaatacttaggacaaagtccaggggttcccgtcgcaaatgatgaccacattaaggatgttcatatcgatccatcggctgccccagttgatgcctactgtcttctgactcttgatccagaaaaggttgattatgtgaacttaaaaagtaatcagagattgatgttcacaagaacccaggaaggagatgagtccagtgactggatggccgaaaaagttagcccataatgactttttttgttaaggaagaactgaaaggtgttattggctgccactatttttatttggtgattttccatggcaagaaactgtcttcattctacaatatattttctagcatgtcaaaatgtattttttggtagagcatccatggattaccgggtctgaacagctgtgctatgtgctttatctgcataacagtcatttgttaacatactttatgactctaattaatatcagtgttcgctttt

SEQ ID NO: 572 - DNA, 1440 bp, Triticum aestivum
  Clone ID: PAT_TA_572
tggctgtcaaacagcttttctgctatccaattttgttcctgcaaaagttgcttctgttctgtataggtgtacagttttcatgttaactggaaagtaccaaagttgtctatcctagctgcaccaaactacaattttcttgttttattaataatttaatatgagatatacaagaaagtgcagcgggcatggcttgtactcatgcttgaggatatttggcttaggctcctggactgtgtcatggccacactgaagacgggacacttgtggttatcttcatgtgtcattggtggtcagagaaaccaaacaaagctggagtgaaaggtctaggagtttcaatacagaacaaagggtctacgagtttcaatacattgttgaaaaattgtgccaaacattaaggttgatttcagttccttcccccttcccccatccccgctcccgccgccctcggccgtcgcggtgctccgggtgccggggcggcggggatggccacggatctgttacggcgacgacggcaccggatccgcacccgcaacatccggatggaggccggcgacgaaccctagcctagccatcagcatcgggatccggcccctgccctcggtcccggggctaggcctatgggggtgctggctcccgcggtggacctcgaccccggcgacgtcggcagcatctccctcctctccggctgcaggtcctggtcgcccaagccaaacccatcgcgctcggcctccccgtccccccccacactgaaccctgctgatgcgactctcactgcgcgctgtcgacctcgcgccaggccacaacggcggcacacacaccggcggcgctcagtgttggggcattggtcagccaatgtacaagcttcaggcggctcaggtagggtggcccacgatattgacagcggccacgaccagcctcggaggatgggtcagtgggacggaaggagggagacaaagaggaggaagaagacgatgatcaccaaattttaccaccgataaaaaacatgtgaccgatgcatagttgctcttatagtatctgctaaagaaattgataaaagatgatatatattcgtaggacttcactcatgtcacttagtcaccagtttgatttattttcctgtattttgcccaggcaacgcacgggcattgtactagcaaccggctccgggcccagcctacattagtgggtgtgttatgtattcgcaaggttgtgtccagtataagacttaattccttgtaaccataaatgtggcttaattctggaaagcattaagtttgcatgcatgctgatactgatcaatccataactctaaaacatgataccctctttcacatgcttcatataagttgtgcacatgccatctcgccaagcactgataacatgttttgtttaacagatcatctgagatttgcataatttgtttgagaatgagcagggcag

SEQ ID NO: 573 - DNA, 1049 bp, Triticum aestivum
  unsure (1)..(1049): unsure at all n locations
  Clone ID: PAT_TA_573
gtctgtggcaacagtccttgatccagnattaagcttcatatgttgcaagctttgtttggctctctcttgggtttgaacatgcaactagagaatggagaaaattagaaagttaatgggtgatttgttgctagaatatcaagcatctgatggtggtgtgggtacctcggagtcacatgtaggtgggagtatttctacccaaggtggtgctgcagtagatgaaatggagaatatatttaaacaatatatgtcctcgaagcctgttatgagtgcttctcgtgtgcgtacagaactggacttatatttggaagaggaaattatccataggccagagggtcttgacatcatcaattggtggcagtatgcaggtatcaagtatcctacattgcgaagaatggctcatgatatactagccattcctgtaacaactgtggcgtcggaatctgccttcagtactagtgggagaatactaagtgcacatagatgttcacttgcaccaaacatgactgaagctcttatgtgtatgcaagcttggtcccgtgcagacatgttaggggattgcaattctactctctttgcggactttgaaactgttcttaaggatgacacagaaatgatggaggttgatgatcaatccatcctaactgaagcctgaaacatgattgtatgatgttgttgctgctgcttggttgcgacgagaaggcggacgacccggcgtgctacactgctacctgttgttatttacatttatccatggctgctacactactacttcctactgctagcttgttggcacacaactactcaacctgaaccttgtatttgtgctgctgctgaactttgtatttctgctgctatttgtgcacctgaaccttgtatctctgctcctgaaccttgtatttgtgcttctgaagacctgcaccatgtatttgtgatgctatttgtgctcttgaaccttgtatttgccttcctgatattgtgttttcatagctgttctactatatattcacattgatggttagtaactgaagctatttgtgcaaaaanaaaaa

SEQ ID NO: 574 - DNA, 751 bp, Triticum aestivum
  Clone ID: PAT_TA_574
cccacgcgtccgcccacgcgtccgagcatactcaaatgtaataacatcatatttctgtgtcggatcactctcggagcatattcttttaggtttggttacacgttttatactgtaatttctgtattaatataatttccttgcaaatatcttaacacattgagtctttgtaccttgtaggcggagatgcaaggtggagatcctaacgcgaccacatctgaagcaaaagaagagatggattctcgttctgtttttgttggaaatgtaagttttcgttctgttgatgtctaaatttagttggcactcctacatttcatagtagttatgatattgcctaggtatatgcgataaaactgatgccatatgtttctatttacatgtgataatgtttgttatgcttgtgaaatcgtttatagaaaagctcatgttcaagttaactacttgatttgcttgaccagcccaaattttgtttaaggtgctcatagattaggtattgatgtttccacaaaatattctatctatactttgatgatttttgttttgattcccaatagattgtgtcatagtgccaatcagcaatgtgtcttagtcccctaaatagtgccataactttgagcatgtatcattgacaatcatattttatcagtgacttgaaatgcactatgtattttctatttttatcaatgaattttttttctggtgcattgattgagaaatgacattggccgcagggagtctgctatcatcaagtctt

SEQ ID NO: 575 - DNA, 851 bp, Triticum aestivum
  unsure (1)..(851): unsure at all n locations
  Clone ID: PAT_TA_575
ctccgcttctcacccacccccctccccccccctccctccctccccgcacacgcgccaagccaagcgctctctctctctcgcatcgacaatggcggacgagaagctcgccaagctgcgcgaggccgtcaccggcctcggccagatcagcgacaaggagaagtccgggttcatcagcctcgtctcccgctacctcagcggcaacgaggagcagatcgagtggggcaagatccacacgccgaccgacgaggtggtggtgccatacgacaccctagcggccccgccggaagacctcgcggcgaccaaggcgctgctcgacaagctcgcggtgctcaagctcaatggcggcctggggaccaccatggggtgcacaggcccaaagtcggtcatcgaggtgcggaacgggttcaccttcctcgacctcatcgtggtccagatcgagtccctgaacaagaagtacggcagcaacgtgccgctgctcctgatgaactccttcaacacccacgacgacaccttgaagattgtcgagaaatacgccaactcaaacatccaaatccatacgttcaaccagagccagtaccctcgtgtcgtcgccgacgagttcttgccgtngccttcnannnnnagnntgacatttttctttactctatttgttcctttataagatccttgtttctattaattttttttttcgtatagttttttcttcttatacttaatctttttttttgtttcctattttttgtgtctatttaataatatttttttatttaagtgttaaattctgttttaattttttatttatttttttatctttaatcttttttctttaactttttttattatttaatttt

SEQ ID NO: 576 - DNA, 812 bp, Triticum aestivum
  unsure (1)..(812): unsure at all n locations
  Clone ID: PAT_TA_576
ggttttgtatgatgtggacttggctactaggagcaggcagattagcttttgtctcgattcgataaagccaatgaacttgagaggacacgttgattccatggttaaggaagtggaggactacttcacaaaatgggagcagcatggtgtagttgacataaagcatgagatggggaacctgatcttgctgatcgcaaatcgatgcttgcttggaaaacagttccgagagaatatgtttgaagaagtatccacactcgcccatgatatttttgataatggcttccacttaatcagcctcttcttcccatatctccctatcccaccacnaccatcgtcgtgacaaagctcgtgctaagctgggagagatgatccatgaggtcgtgagatcacgtaggagttcaggccaagctgagaatgatgtgctacagaaatttgtagactccaaatacatcaatggccgctccatgactgagaatgagatcgcagggctgctcatttgtatgatgtttgcagcacaacacacgagctccgccaccagtacctggacaggagcttgtctgctcagtcatggggaaagctacttggctgctgctatcgaagagcagaaacggatcatggaacgtcatggggaacatatagactacaccatcttgcaagagatgggaaccttgcattgctgcatcaaagaggcgctgaggttgcactctccagcaattctgctgatccgccatgcaagcaagagcttcagtgtgcaaacgagagaaggctataaaattgatatccctcaaggacataccttagcgacctgtactaca

SEQ ID NO: 577 - DNA, 720 bp, Triticum aestivum
  Clone ID: PAT_TA_577
cggacgcgtgggcggacgcgtgggtggagacgagacgagcgtctcttctctgtgtatttacgtgacaccatcgtcctctcctccctacccaccacccatcacgcgcaccacgaatccaaaatctacacgcatggggcacgagatggtggcatccaacggcaaaggcaacggcgccggccggaggacgacgaagccgcacgccgtggtcatcgcgtacccgtaccagggccacgtcatccccgcggcgcacctcgcgctgcggctcgccgcgcgcggcttcgccgtcaccttcgtcaacaccgagtccgtgcacgagcagaccgcgcgcgccctcggcgtcgaccgccgccgctacgacatcttcgccggcgcgcgcgcctcctccgaggggaaggagccgctggacgtgcggtacgagctgctcagcgacggcttcccgctgggcttcgaccgctcgctcaaccacgaccagttcaaggagggcgagctgcacgtgctcgccgcgcacgtcgaggacctgctccgccgcgtcgtcgtcgatccggcctccacatgcctcgtcgccgacaccttcttcgtctggccggcgaccctggccaggaagttcggcgtgccgtacgtgtccttctggaccgagccggccctcatcttcaacctctactaccacatggacctgctcgccgagcacggccacttcaactccgccaagggcccgccgcg

SEQ ID NO: 578 - DNA, 437 bp, Triticum aestivum
  Clone ID: PAT_TA_578
tcagcttagatctttccactgcttccgccatggacgccgaggccgccgccgccaccgccgccacggctacgcctccggcgccctcctcccaacctctgggctccatcccgcagccccctcctccaccccctcctccctcctccgtagtacacacgcctctccctctccagactgcgccgccggtcgccagcttcccttctgcggcctatatccacgcgatgcgcgtcgagagtgcccacatcaacctcggcgtccgcctcgatatgaaaggggccaactactcgacttggcgtggcctcatgcttgaggtcatcgaccagtacgatgtggcggcttggatcgcgccggacttcaccaaccgtgccggcgacgtggcgtggaacatcgtcaacaaagccgtcaagcgctggttctacggctccatggtcacggagctc

SEQ ID NO: 579 - DNA, 523 bp, Triticum aestivum
  Clone ID: PAT_TA_579
ctcgacctcacgatccaagccaacaacaattatactacgacccgacacgccccctccctcagtccctctcttcatcaatctttctcccgtcccccaaacctctcgatctcggagcagcgatgactcgcggcgaccagagggagcgggacaggcagagggcgcaggcgcggaagccggggaccaagggccgcgacgacgggctcacgccggagcagcgacgagagagggacgccaaggcgctgcaggagaagaccgcaaagaaggcggcgcaggccacgcagggggccgacgacgccaagaagaagaacgtcgccggcaagaaatagttcggatccgttctgtctgtctcatgaattgtcatgaagtggagagatgttctgatgtagaatttctgtgcgatgtggttgcgctcggcttgtagcacaattctttcggcgcctccagatcaggcccctgttgttgatgcgtaattcgtggatctttaatgcaatgcgatcaatttggtcgttacatcctcttctca

SEQ ID NO: 580 - DNA, 579 bp, Triticum aestivum
  unsure (1)..(579): unsure at all n locations
  Clone ID: PAT_TA_580
cgtccgcgccaacaacaattatactacgacccgacccgacccgaccagcgccctccctctttccatcaatctttctcccgtcccccaaatctctcgatctcggagcagcgatgactcgcggcgaccagagggagcgggacaggcagagggcgcaggcgcggaagccgggggccaagggccgcgacgacgggctcacgccggagcagcgacgagagagggacgccaaggcgctgcaggagaagacagccaagaaggcggcgcaagccacgcagggggccgacgacgccaagaagaacgccgccggcaagaaatagtagttcggatccggataccggcccagcggcatattggatctgttctgtctgtctcgtgaattgtcatgaagtggagagatgttctgatgtagaatttctgtgcgatgtggttgcgcccggcttgtagcacaattctttcggcgcctccagatcgggcccgtgttgttgatgcgtaattcgtgaatctttgatgcaatgagattaatttcgtcgttacatccaaaaaaaaaaaaaaaaaaaaaaaaagccttttnggaacangggg

SEQ ID NO: 581 - DNA, 699 bp, Triticum aestivum
  unsure (1)..(699): unsure at all n locations
  Clone ID: PAT_TA_581
gtcatcaacaacgtgcagtaccgggggaagctggagagcacggccgtcctcaaggcgatctgcgccggtttcaagggagaaccacggagccgcgtgtctgcatgacacaagatatggagacggacgagtgcctgcacaacaatggcggctgttggcgcgatgaaaaagactaacatcaccgcctgcaaggacacgtacaggggaagggtgtgcgagtgcccggcggtggacggcgtccagtacgagggcaacgggtacaaggagtgcaagcccgtcgggccggggcggtgcgccgccaacaacggcgggtgctggaaggagacgaggcacggcaagaccttctccgcctgcaagggctcggggtcgctcagcgggtgcgagtgcccgccggggttcaagggagacggcatcacctgcgaagacgtggacgagtgcagcgagaagctggcgtgcacctgcccgggctgctcctgccggaacaactggggcgggtaccactgcagctgcggcggcggcggcaaccaagtgtacatccaggccgaggacacctgcgtggggaagaacgcggcggcgatggggtggctggtggcggtgctggtgctgtcntgcctcgcaagcgccgggctcgccgggttcgccttctacaatacaggctcaagcggtacatggactcggaagtggcggggatcatgtcgcaat

SEQ ID NO: 582 - DNA, 529 bp, Triticum aestivum
  Clone ID: PAT_TA_582
ttgcttttgcgtccgcccacgcgtccgcaaaagcgcacactgcaccaccgcacacagatctaaccgaaacccacccccaccggcggcgagccgccgacgagccagccatccaagatgcagtacaacaacctgggacggtcgggcctccgcgtcagccagctctcctacggcgcgtgggtgaccttcggcaaccagctcgacgtcaaggaggcgaaatccctcctccaggcctgccgggacgcgggggtcaacttcttcgacaacgcggaggtgtacgccaacgggcgcgccgaggagatcatggggcaggcgatccgggacctggggtggcgccgcgccgacgtggtcatctccaccaagctcttctggggcggccaggggcccaacgacaagggcctctcccgcaagcacgtcgtcgagggcctgaaagcctcgctcaagcggctcgacatggagtacgtcgacgtggtctactgtcaccggcccgacgccaccacgcccatcgaggagacggtgcgggccacgaact

SEQ ID NO: 583 - DNA, 690 bp, Triticum aestivum
  Clone ID: PAT_TA_583
cgaaccggcttgacctcgtcgggcccatcgtcgagcagcccgagtacaacctcttctcccgccacaaggttgagtctgagtttgtacctctttacaacacttatggcattgggttgactacatggagtcccatcgcttcaggggttctcactgggaagtatagcaaagggaatatacccgctgaaagccggtttgccctagataactacaagaacctggcaaacaggtctctggttgacgacacgcttagaaaagtgaacgggctcaagccaatcgcttcggagcttggcgtctcgatggcgcagctgggtatcgcctggtgcgcgtcgaaccccaacgtgtcgtctgtgatcactggagccaccaaagagagccagatcgtcgagaacatgaaggccctggaggtcgtcccgctgctgaccccagaggtcctggagaagatcgaggcggtcgtccagagcaagccgaagcgcctcgagtcgtacagatgaagcggtcggtcggtcggcttcgtcagctgtgcagcgtgtgcccgcccgccgcccggtgggattttttcagtacccggttctccgaaaaaccatataccgaacgtcctgtgtggtcggcgtgcccagcgtgcgaaacattttgtcgagtggacctgatgatgacggtggtcgtcacagacaatgcttttatgccgcttgt

SEQ ID NO: 584 - DNA, 1566 bp, Triticum aestivum
  unsure (1)..(1566): unsure at all n locations
  Clone ID: PAT_TA_584
gttcgcccaagcgtccgctgcaccaccccaccgaaatcagaacccacccgcatccccacccgcgccgccgccggggccaggcgccgaaccaccgacgacgcagtacaacacccagggccagtccgacctcctcggccgcccgggcccccagggggggcgggtgaccttcggcgaccggctcgccttcgggaaggcactatccctcctcgaggcctaacggctcctccaggtcagctggttcgacagggccaaggtctacgccaacgccggggcggaggagaacgggcgggaggcggtgaggaggcggcggtcgctccggggcctacgctggtcatccgccgccatgctcttcccggccaaggtcttcggcccaacgacaaggcgccacctcccgggaatgccccgcacgcacagcgtggcgggcctcaaggcctcgcccaggcggctcgacatggaggacgtcgacatggtctcctgccaccggcccgaccccacgacgccgatcgaggagagggtgcgggccatgaactgggatgaacagggaggggtgggcggtctactggggcaccagggggtggagcgagcggaccgtgcagcaggtgacggaggcgtggggggcgccggaccggcttgacctcgtcgggcccatcgtcgagcagcccgagtacaacctcttctcccgccacaaggttgagtctgagtttgtacctctctacagtacttatggcattgggttgactacatggagtcccctagcttcaggggttctcactgggaagtatagcaaagggaatatacccgctgaaagtcggtttgccctagataactacaagaacctggccaacaggtctctggttgacgacacgcttagaaaagtgaacgggctcaagcccatcgcttcggagctcggcgtctcgatggcccagctgggcatcgcgtggtgcgcgtcgaaccccaacgtgtcgtccgtgatcactggagccaccaaagagagccagatcgtggagaacatgaaggccctggaggtcatccccctgctgaccccggaggtcctggagaagatcgaggcggtcgtccagagcaagccgaagcgcctcgagtcgtacagatgaagcggtcggtcggcttcatcagctgtgcagcgtgtgcccgcccgtccgcccgccgcctggtggggtttttctccctagccggaggtgcttacctccagtacccgattctgtgaaaaaactatataccgaatgtcctgtgtagtcggtgtgtccagcgtgtgagacattttgtcgagtgggcctgttgctgttgccgtgtatgtgtatcgttcctgtgtctagtgtatgtttactgctgtcgctgtatgtatgtttttatgctacttgtatgtttgctgctgtcctgaagtaagggtcattgcaaaaaaaaaaaaaaaaccaactcgcccccgtgggcgtctccgcgctantggctcgttaaactctgctggaaaactgcgtaccaantaangcttcagaatcccttccagtggtaaacaaaggcccacgtnccttcaantncacctatgaagga

SEQ ID NO: 585 - DNA, 629 bp, Triticum aestivum
  Clone ID: PAT_TA_585
cggacgcgtgggggctccctcacgcccgcaatctctgtgctctctgcggtgagcgggatcagggagaaggcgcccaacttgacccaattgcaggtggtgtggatctcggtggccatcctcttcctgctcttctcggtgcagcgcttcggcacggacaaggtgggctactccttcgcgcccatcatcctggtgtggttcgtcctcatcgccggcatcggggcgtacaacctcgccgcccacgacgccaccgtgctcagggccctcaaccccatgtacattgtggactacttccgaaggaacggcaagcaggcgtggctctctctcgggggcgtcgtcctctgcaccacaggcacggaggccatgtttgctgaccttggccatttcaacatcaaggccattcagctgagcttcagcttcatcatcttcccctccgtggcgctatgctacatgggccaggcatcctacctgcacaaattcccgcaagacgtcgccgacaccttctacaagtctatcccacgggcgatgttctggccgacgttcatcgtggccatcctggcggccatcattgcgagccaagccatgctgtcgggcgcgttcgccatcctgtccaaggcgctctccttcgctgc

SEQ ID NO: 586 - DNA, 541 bp, Triticum aestivum
  Clone ID: PAT_TA_586
gttctagatcgcgagcggccgctcgcgatctagaactagcacgaagaagatgcagtagcatgctgggagcgataagtcgtgtgtgtggcacacaatggattttgccgactatgaatttaaggagatgttcgccatccgctttggatctgggagagtgagcattgcgtaccctataatctgtgcagctggagctattgattttgaatcgttgacgcatgattttcttgagacaaaccaagctaacgagatctgcaaatgggtttgaacgaaagatttagaaggtgaaggagctattgaagagcatgctacattcccactgtcttaatcattttttcatgtacaatgcaatacatgtataagtttggtgctttgtgctggcaagaattttccgattggcatcatttgtagtaactgtggtgattcaggacgctctcaagattacaagtttagtagtggcaacctggacttatgtaagaataaactgaatgatgtttcattctgaagagattcctaactatcgacttgaagtttgcatagttaa

SEQ ID NO: 587 - DNA, 1228 bp, Triticum aestivum
  Clone ID: PAT_TA_587
ccctcctcggcctcgcgcagcgcggcggtgaccgcttgcttgagctgcccccgtccgccgcggaggcggttgacttcctggccgagttcgagcacgagtttggggctggccgtggcccgcgcttcgttgctgagggatttgctgacgcgttgcagcgtgcacagcgtgagtacaagcttctctttgtgtacctccactcccctgaccacccggataccccagcattctgcggtggctgcctctgctccgagccggtggccgccttcatagatgagaacttcgttgcatggggtggtagcatcagaaggactgaagggttcaagatgagcaacagcctgaacgcatcacgcttcccgttttgtgcgctagtcatggcatctacgaaccagagaattgtgctgttgcagcaggttgaggggcccaaatcacctgaagaaatgataacaattcttcagagagttgttgaagaatgcactacgtcccttgttgctgccaggattgaagctgaagaaagactaaacaatcaacgtttgcgtgaggaacaagatgctgcttacagagctgcacttgaagctgatcaggccagggaacgccagatgagagaggaacaagaaagacttgaaagagaggccgcggaggctgagaggaagcgtatagaagatgaggaagcacaagccagggcagtccaagaagcagctgaaaaggaagccgctcttgcaaggagacggcaagagaaggcaatggctcttggcgctgagcctgagaaagggcctgacgttactcgagttcttataagatttccaactggagagcgcaaagaaaggagattccacagttccgccaccattaccttgatatatgactttgttgattctttggattgcttgaaagcggaaaagtacagcctagtttctaattttccacgggtaacatacggtcctgaaaagaactcccaaacgctggtggaagaaggtttccacccacaagctagcctatttatcgagattcaacaatgaatgtccccaattttccaagttatatgttctggaacttccatgtatggcccctccttcccctctccatttggcggacaccggcgtccgccggctgttcgcctggatactccacttcggggccattgctgcttttgtggttctcattcgttaataaattcaccttctgccggatcagttgactgctgcaatgtttcatactgtatttgttagct

SEQ ID NO: 588 - DNA, 350 bp, Triticum aestivum
  Clone ID: PAT_TA_588
aatccgagcaaaattaaccaagttaaattaaaaacatccaggtcagatcagcattcaacacccctccaactcaactgtacaagtttccaaccctcagaacacacacccaaacctttatccttcttccattatacacctaatcttgtctgctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaggggatccaagtttacttccccgtgcttgggaggtattagttttttttttggggcccccaa

SEQ ID NO: 589 - DNA, 2562 bp, Triticum aestivum
  Clone ID: PAT_TA_589
tttatccgagcaaaattaaccgagtttaaattaaaaacattcaagtcaaattagcattcaacacccctccaactcaactgtacaagtttccaaccctcagaacacacacccaaaacacacatcacctcttgcgcatttcgccatccctccttgcacccgtccgaactctagttcgtcggcggggcaaacacgagggcgcccttgcgcaacttacttacggcgaatcgccagcagaccgttcgaactcgctacataccccagccttgccggggagaaaaataaatagcaaaactggggataatttattgcagcttcttcgtcctccagtgagtgagcgaagatcgagtcatcgccctcggccgcgttagccctgcggctagagttctcctggttaggcgaggtcgacaggctcgcgtctcctctggtgtccgcactgtggagcggcctgttcctcccggacctaggccggatgttgttccccacagggaaaggttcctgctcccctgcgttcgggccatccttgtggaagagtatagggcggcaccatttgtcttcattcatcaggctagaattccgaaaatgagaaaccaattcattcctgccctggattctagcatatgcgagtgttgcccttttgcatttttcccatctcttgccattaaacgtcttgtaaaacggaattatgtgctgcggatcggtcatgttgatgaaagcataccccacgttgcatttgttcttgatgtcaattggaaggtagacgaaatcataggttccacggtgattctcatcaatgacgcccagaagcagtttacagttgtacttgttaggaatgtttttgatcatcagcgtggtgcgtgggtcttcaccctttgctatgcgttcgatgtcaagctcaaatagccttttgttttctggctggacagcgtttccatcatgtctgcggttcctcatccgatcatttgtagcatcataggaagcggaaacctggaccatagggttccttcggttcattgcattgcacatttgttgcagcgacgggaatccagcgccaactggggagaacatggtctccctgtaacttcccctggcaggtgcgaagacagggacatctgatggatacatttgagggctaccaggaaaccctacactcccgagagaccctggatgaacagagcgcgcgtttctgaaactgcctccattgtttggagctgaacccatgtggtgttgatccataggataagcaccattattcagtgtgtgaggtggcacaacaccaggataaccatgcatgtgccctgggtgctgcacattcgaccacagcattggagaggagggactttgaggaaaagcatttgagttattccaactgtagtggtgtccattgagggggaaacttccaactccggcaggcccaaatgcttcgttattttgatcgaaggaatgaccatgaaggctaccagaacccactttctggagatgactgtaatccactccatccactctgaagccagcactcctgccacttgatgtcatggacttggagatattacaaataccgttttgactctccggcagcgagtgtgggtggaacatctgcattccatgcccaaagtttccttgaccaagcgatccgccaagttcactaatagcagcttgattattgtactggcgtgtaggttcaattctgataggcgacgacagcttctgagggccacttgaagcgatgccgtggggtgatctatccaactgcgaactaactggagaaaataaattatgcagactgctgttctcatgacttctagggcctccgatggtcccaggtggagagtttctaggctggcgaggggaaccatcaagcttccactctctcggatactgttgcctcaagccgaaaattgtccctccaggattgctaacttcagccttgatttttgggcctgagatagcacccttattaaggtcatatagtgctgcttctgctgctctgacatcgtagaactctacgagtttcttattgcagcttgtagaagccctgcaaatctccttcacatcaccataaacagtaagtgcttggagaagatcatcattggaaaccgaaggatcgatgttagacaccaccaaaattcccttgttgatatccttatctgaagcatttcccttaggaatgcagaattgcacatcaagcttcaccagccccaggggcttgccatggagtgctctcattgcgttttgggcagctcgtatgtcatagtaagacactgttacatacccatgttccttgcaggtgtaaagcttatgtacgtccccatattgctgaaatagaactcttagatcagaatcaagaacgttggtgttgatgtttgtgacgaaaagagttctggaagggcatttgttgatgtggtgctccccaggaaaatggcactttgaggatccttccagatttcttgcgcctttaatggaaatggaatcatcattctcaagctccatccctcctccagtgccaaatatatcttcatcggcgtcatcctggttggtggacaggccagcggacgcgtgggtcga

SEQ ID NO: 590 - DNA, 1524 bp, Triticum aestivum
  unsure (1)..(1524): unsure at all n locations
  Clone ID: PAT_TA_590
cagcgcccccgcccgagcgcccggctgtccccggccccccccgcctgccctccatcgcaccccaacccgaactcccacccccaacccaaaatcagataagcaaagcagcgcgacctcgcgagcgccatgatgtccccgacgaccgccgccccggctacggccacggccgccgccttcctcgccccgccgccgccccccgcgtcctctgccccccccggccgggcccgtcgcgccgccgtccccgccgccctcccgtccgaagaaccgctgctcatacgtgcggcgaggggcgaggatgggctgcctaggccgccggcgtggatgatgcggcaggctgggcggtacatggcgtcgtaccaggcgctgtccaagcgccacccttcgttccgggagcggtcggagaccaccgacctcatcgtcgaaatcacgctacagccgtggcacgccttcgcacccgacggcgtcatcctgttctcggacatactcacgcccctgccggccatcggggtgccgttcgatatctcgggatccaaggggccggtgatctttgctcccgtgcggggcggaggaacaggtcagggagcccgttcccatagatctcgataagctccagttcgttggggagtcgctcaagattcggcgcacccgggtggatggaggacctgctttgctaggattcgtgggggccccgtggactattgcaacttaagttgttgaaggagggatgaccaacactttcgcgtacatgaggcgcgtgggccccgcagatccatttgccccgtggccccttctctctcatgaaattcatagggtttgtgaaagcagctggtcccaagggtcctctgctgctcagggtccacggtgttttgcttcatgcgccgggcgactccctcgcacatttcgttgatgtcacaaggagcttgagatatgaacaaattgtggctaagattaagaacaagaatgccctcacataccacttgtgctgtacataaatggaaatggagtttttcttgggcgcatgaattctcagcgagttgatgttattggtcttgactggacgatggaaatcccttttggaggggctgttcctggtgatggaaccatggcaaaatcaactcaattttgttcataactattttctccattacagtctattgactgcatgaaatacataaggttgtgaaagcagtgggtccgaaaggcatatacttaacttggggccatggtgtcttccaaaaaacaccagaagaagctggtagcacattcctttggatgtcacaaaggagcttgagatatgacacccttttccaagggcatccttactgaagaattgcaacctgttgcttgatgatggcagtagcttgccatattttttttgggcctaccgttctcaactcaacacctcctacattattaaggtcatcccttttgctggggctgtcccttgtagaacacaatggcaatcaactcaattgtcaataatcaccaagtattnagcatcatnaccagnaaggaagatgcncg

SEQ ID NO: 591 - DNA, 1226 bp, Triticum aestivum
  Clone ID: PAT_TA_591
ctttgtaccaacccaacaccacaccttaggcttccttcttccagcaatggcggctctgaccggtgcagcgctcctcctcgccagcctccttgctcttgcagccatcgccagcggcaacaccgaaggtgacatcctctactcgcaaaggctggcgtggaaggaccccaacaacgtgctgcagagctgggatcccacccttgtcaacccctgcacttggttccatgtcacctgcaacaacgtcaacaagtcaactccgtcatccgagtggacttggggaatgcaggcctctcaggcgccctggttcctggactgggacgaatggtgaaccttcagtacctggagctgtttgggaacaatatcagtggaccgattccagcaaccctcggcaacctgacacgcctggtcagccttgatctctacgacaaccgtctcaccggcgcgataccagcctcgctcgggaacatcgggacgctgcgtttcctgaggctgcacgggaacaagtttgcaggtggtataccgtcgtcgttgggccgtctgacgaagcttcaaactttggagcttcaggagaacatgctgaccggcacagtgccgctggaagtcctctctcttgttcttcttggggacttgactgaacttaacgttgccaagaacagtctggccggcactgtcaaatcatctaaaccaagagtagctaccgtcatccaggacacgctcaagactacacgtctacatgctgagcagcactgacaacctgaacttttctaagaataaactgaatgttttttttccttttgaaactgctggaagaggctgtagccttttattccgttaagagcccctagcttacatccatttctagagagaaaaagggaaaaggtgaaaggtagttgaatacattgtaatcagtgcaacttcataataatgaatctttctctgcacctttagtgcatatccagtgttatcagtttggtatatttatatctcaggagagtatagaaacccttgacacagatggctcggaaacaccattccatgcagtttcccttgctgagtgcgaaaacggagcatgtgatggccattagtgttttgatggctcagaagttgtctctgagtatgcttattccagataattgtgacttggagccatctgaaataaccactattatcgatggcttttgtttgaagatgtccacaataattatcattgtattgaaagagtgagacac

SEQ ID NO: 592 - DNA, 674 bp, Triticum aestivum
  Clone ID: PAT_TA_592
gccgccgccgtcgcccacgcaaccttgctcctccgctcgcctcctccccgccggcgacgacgtgatgtcttccgagcccacgaaagcgccgcccacccctgaagcgggcgtccccgcagccaccgtcagcaataaacaacggaagagggacgccaggaaggccgagaaggcggccaagtacgcgcaggcgcagcagaagcccgccgccgaggacccctcaccggagcacgagcagcagaagcagcagcagcccgccgccaccgaggacgacccctcggcggccaactacggcgacgtcgtccccggggagatcctccccgcggcggtccccgacgaaccgtgggccgagatcggccacctcgacaaggccgccgccggccgctccgtgctggtccgcgcgacggcggaggcggtctaccgcgggtccaagaccaagaacgtggccttcctcaagctgcggcaggtgctgagcaccgtgcagtgcgtgctcgccggcagcgcccagatgatgctcttcgccttgtccctccccaaggagtcatcgtcgtcgtgggagggcgccgtcgccctcctcgacgagcccctcagctacaccacagtgcaagaggtggagattaagggtgaggaagctgtactgcatcagcagggccgacccgaagctaccatcagcgtcg

SEQ ID NO: 593 - DNA, 1523 bp, Triticum aestivum
  unsure (1)..(1523): unsure at all n locations
  Clone ID: PAT_TA_593
gacattaacagcggggacaggggtgcagctttgtgcgttttttctcttcaccgtaggacgacttgtgtgttgatttggggaaaagaagcgtgatgggattgttccgtctatacagagatatactccaccgtctcaaattgtcaagtggtgaaaaaaaagtgtaaacaacgaaccggaccggaccaaggacaaaaatcagacaagaaacgacagcgtaggaattaccacaggaaccctttaagaaaaaggaattacccaaagaactgccccatcaccacagccaggctagcttagccgggcttaaattctctacttataagtagtacttactatatactcctatttcacagtacaaaaaagtgcaagcatttatcacaaataacacatccgaaacttacgtttgcaaaaatatttcacacttatggaacaatactacttaccctcccatactcagtactctacctccatcctggtttattggttcttcgtatttagtgtcaaattttaatcataaatttaactaacaaattgtaaatgcatgccaccaaaaattataccattggaaactactccctccgttcctaaatataagtttccactatggactaccattttagagtagattcactcattttgctttgtatgtagtccatagtggaatctttacacaaacttatactccctccgtctcaaaattcttctcttagatttgtctaaatacagatgtattaagtcacattttaatattagatacatccgtatctagataaatctaagacaagaattttaggacggagggagtatttaggaacggagggagtacgttcaaatacaaatccaatgatataattttttgngacatgctttaacattttattagttaacttacgaacaaaatttgacacaaaatacaaagcgggccagtaaaccaggacagaggtgtacaatcttaaaatatacataaccgaaaaggttcactagtgagcttgcagctcaagagcagtatgttgaccaagtagcaacatgctctaaattggggaactgaatccggacggccgaagacagcatccccacattgagcttgtgggtgagcgacaccttctccttcaatgtccacttctgaaccgtttgcttgcaattctgacacactagactcttataaagttttatgccctccagactcaccgctgcttccattacattccggacaaagcgcacaatgttgtcatatgctagaaacctcccaaagattctgacctcagcaaggttgcgatgcttgaaatcagatgcggatggttcccactctactcccttgtccttctcctcgctaaatgcatacagttttctctgctcccccgttaccatttcacataaatgatcccgcaccacgatgcatagttccttaaggctgggtgccccttggagtatgaacattatccaagtcagatcgcatccttcaaaaatgttatacaaaattcacacgccttagtttgtggaacaccggtaacaattgtcttcgacct

SEQ ID NO: 594 - DNA, 776 bp, Triticum aestivum
  Clone ID: PAT_TA_594
caggtcccccccccggcgcccgcctcctgcgaacgcatcgtatcccaaaaaaccagaaacagagcaagagatatcttaggacggagcagagtacagagagagaaagagggataagcgcttgcttgctgggagggagagacatggaccagatcatgaacaagatgggctcctactggctggggcagagggccaacaaagagatgtcgtcggccggtgacgatatcgagtcgctctcgaccagcgtcggggacggagcaaaatggctggtgaacaagctcaagggtaagatgcagaagccgctggcggagctgctccaggagcacgacctgccggtggggctgttcccgcgggaggccaccaactacgagttcgagccggagacgcggcggctgacggtgcacatcccggcagtctgcgaggtcggctacagggacggctccgagctgcgcttcgacaccacggtggccggcacgctggacaagggcagcctgacgggggtggagggcctcaaagccaaggtgctcgtctgggccagggtcaccgccgtcaaggccgacgccgcaaaggtctacttcgccgtaggcatcaagaagtcgcgcagccgcgaggcatacgagatcatcagaggcgccatcaccgtcgacgagttctagattctagtcgcgcgctcgtcgagatgattgttctaccgaaataattgatcaggtgcttactctacctgctgtaagaggaggatgcttgtaaatggggattcataattcaatttcgcagcttac

SEQ ID NO: 595 - DNA, 644 bp, Triticum aestivum
  unsure (1)..(644): unsure at all n locations
  Clone ID: PAT_TA_595
ctcgtgccgaattcggcacgacccacgcgtccgcaatggagtccgcctttccaacagctgcgcgcctcgggctccatgttctcctctactcatcgctgctcctcaacgccctcttcctcgctcaccacttcctctccgccccgccggcgccgtccccgcttctcagcgaggccgacaacggcggtggcggcggcgcgctgagctgggcgctacgtgcggcaagggatgccgagtccgtggccgcggcgggatgctccggccacggccgcgtgttcctggatggcatcgtcggccaggacgggcggcccgggtgcgagtgcaacacctgcttcgaagggccggactgctccgtccggacgcccgactgcaccgtcgacgccgacagcggggacccgatgttcctggaacatactggatgcagcaccggagggcaacgccgtggtggtctcggggtgggaccgcatgactacagaacagcgaccgtctcttcatccgttcaactcaacgttcatcagccgctccgccgcctcggnaancgtcncgacacaagaaatctgttgcacggntcatcaagtataancgtggntagccttacgaaaaatccggtcacgcaggtgtgcacagcgncnacggttaaaacagtt

SEQ ID NO: 596 - DNA, 1286 bp, Triticum aestivum
  Clone ID: PAT_TA_596
cgtccggccctcccctcccctccccctccccagcagccagcctcccccgcgaacgaaccctagccaggcacggcggcggatccctcgggcgggccggagccacaggccgccgcgatgatggacggcggcggcgccgccgcggacccggtcgacgagttcctcatcgggggcgccggcgacgcggcgacggcggggaggacctcgtccccttatggaacacttgggattgaggatgggatgtcagcggacgcgactctcgggcactctaatttggggaaaaggggcagagatgaaccatctccatctggtccaaagtcaaaggcttgccgcgagaaaatgcggagggataaactgaatgacaggtttcttgaattatgctcggttatgaattctggcaagcacactggtcttgaagaatgttcggctagcaatcctgggaagaacgctaagttggataaagcaagtatcttgagcgatgcaactccgtatgttgacacagctcacgaggcgagaccgaaaagctgaaggaatcaaatgtgaatcttcgagagacaatcaaggaccttaaggcggagaagaatgagctccgagatgagaagttgagcctgaaggcagaaaaggaaaggctggaacaacaactcaaagcagcaagtgctgctcctacaggatttgctcctcatatgccttatccagctgcattccaccccgccgtcttccctccatttgcaccaccctatcaagtcccagccaacaaaggagctccggtaccctgctgcattccctggaatggcgatgtggcactggttgcccccaaccgccatggacacaactcaagatccaaagctttggccgccgaatgcttaggcgcgccgaccccgggatgctcgacttgcgctgccattcgcccattggcaagtcagaacgtttgtcaggtccctgagatgaaaggaagctcgcaattgcagttattgtgtttagcctgttgttttggggtcacttgtcccatagagaggtgatacctgtaattaatctggatcttaaccctcttgcttggaaaatatattcagtgctaccatacctcttgtatgagtgttatgtatggaattgcactggtctgtttcttgagtttctacctacaagtacttgtgtgatgcatttggcagtacctgttttgtttatataaagttgaacatgtgagcacttgcatatttgaaaattgcaaaaaatgtaatgtaaaaaaaaaaattttacttttatttttattttttttctatcgtttttatttt

SEQ ID NO: 597 - DNA, 609 bp, Triticum aestivum
  Clone ID: PAT_TA_597
tggcgtggtcgcggccgacgctcattgccggcagtggccgcccgcgcgggtcccacgcgtccgcatacattatgccaaatctgccgacataacagtgtggctcggtgacttgaattacagattagaaggaataagctcgatgccagcaaggaagatgatcgaggagaatcgccaaagtaagctaagagacagagaccagctgctgcaagaagccgagaagggtcaagtgttcaatgggtactgcgaagggaccttgtcttttaagccgacatacaaatataatgtcggaagtagcaactacgactcaagttacaagatcagagtgccatcttggacagataggatattgttcaaggttgaccattcttctggcttggatgcggtcttaagttcatatgaagcacttgattgtgttagcagctctgatcacaagcctgtgaaagctcatctctgtctgaaagtacgtggtggcaatacatagatttatgttacaattgacaatcacaagtatatttaggtgacttatttttttgtaacaacaattgtaaaggcaaatagcacagatcattatctgtcctcttaaaatgatttcgctagatgtaatttggt

SEQ ID NO: 598 - DNA, 794 bp, Triticum aestivum
  unsure (1)..(794): unsure at all n locations
  Clone ID: PAT_TA_598
cggacgcgtggcggacgcgtgggggaaaacgtgagatcaatggcaccatccaaatcccatctcgtcttgctcctcgccgtcgtcctgatcgccgccacgccgcagccttcggcggccgtcagggacaaggcccctgccccctccagcagcaacgttgtagtagcaaaaccatcggcatggtgcattccctgcttttcgtttctaccctagttattctgtataccaccgatattctgtccaccaacgccaagtgcgctgccgccgccgccgccgccagcgaagccggagccgaaagagtgtctaccatcgctgatggggctgatgccatgcaaggattacctcaccaacagaaccgcgccggagcctccaaaccaaggcaagtgctgcgacggcctcaggtcactcttcgtgaacgctcccgtctgcacatgccgcatatcggacgacggcgacctcgacaggctcatgtcggcacccctgcatggaggaaacttccttcgtctggcggttatctgtggcaccactatagctccgagtgattatcgatcttgccaagcaggccccgtgccacccctgagggccgcacccgcccctgaagctgcttcttaactgggcaaaccagaggcatggntcgtagtagaattgcagaaacaaggtcaagctaaaagatgtcaagatccgtcagtaccattcttagaagatatatagtgcgagttttcagttcgattaggcagaatatgtagcttcgtttgtgtcaatctctcaatcgtcttgagactcatttatggttacgg

SEQ ID NO: 599 - DNA, 742 bp, Triticum aestivum
  unsure (1)..(742): unsure at all n locations
  Clone ID: PAT_TA_599
cgccttcatcgtcggcccttctacggccgcctatggcgcctcttctccgtcgtctacagcgcccccacgcgcgccctcgcttcctgatggtccacctcgagcagggcagcacggaggacctcatcccgtaggatccatggacgcggcgcaccctgtagccgcccgtccgggatgagggtgggcaccgtggcttgccctgctcgacgacagctgcggcgagtgcgtgtgctgctcctcatcctcaaactccaaggagaagcgccagtacaacataagcacgccccgcccctgaacaatggccatggcgctagggttctgcgacagccagctaattggtgcgccatacttatctgcctaatcggctgattgggggttctgttgggttgacaaccagcggtgtacaggacgccctcctcgaagcggccatccccgacgagctctcttcgccggaggagatggagcagcaagtccagcacccgcttggcccctgtgtcctatctcgcgtggaaacgctcaccaatgcacgcgccttccttccctcctagcgtgatattggtttatggagcattttcagcaatcttccttccctcctacacgactttggagctgagggcctgatataatgtctcggaacgttcgatgacttgtgggtgacgtncgacgagcgttgggcctcgctttgatgactacgatgctggttgtggagcancatagtggtcttaagaagggcttggaaaataat

SEQ ID NO: 600 - DNA, 856 bp, Triticum aestivum
  Clone ID: PAT_TA_600
gtctacagtgagatgcttgatgcaggctgccagcctgacatagtcacatatggcatcatggttgattccctctgcaagacaggccgtgttgaggaagctgtctttgtggtgcaggacatgagctccaggggctgccaaccaacaaccttcatatacagtgtgctcgtgcatacttacggtgttgaaatgaggatcgaggatgctgttgcaacatttttggatatgcagaaggacggaatcgtgccagatgttgtggtttataatgcacttgtcactgccttctgcaaagtgaaaaaatttgacaatgcatttagagtcatggatgacatggaaggccatggaatcaccccaaactcaaggacctggaacatcatccttaacaagatgattagccttggaaaggatgaagaagcatacagggtcttccgccgtatgataaagcgctgccagccagattctgatacatacaccatgatgataaagatgttctgtgagaatgacaggttagagatggcactgaaggtatggaaatatatgaggttgaagcagtttctgccgagcatgcacatgttctctgtgctgatcaacgggctgtgtgacaagggtgaggttagccaagcttgtgttctgcttgaagatatgatagagaagggcattagaccccctggttcaacatttggcagctgaggcagctccttctgaaggaaggaaggaaggatgtgcttgaatttctcgttgataaaatgaagattctgatacaggaacctttgtttgattgaccattcattatgttccaatggtactactgctcaatcctacagctgccacccaggctcatttaaataataatttcagg

SEQ ID NO: 601 - DNA, 688 bp, Triticum aestivum
  unsure (1)..(688): unsure at all n locations
  Clone ID: PAT_TA_601
cccacgcgtccgcccacgcgtccgcccacgcgtccgcctgtctcctcctccttgccacgctcaccatcgccgctgctgaaatagggcacctgcaggctccggcggcagccacaggcgccgtgggctgccggacggagatcagggacgtgggcaagaacaagctggtgcagtccctgggccggttcgcggtgtccgagcacaaccgccgcctcagccacggcggcggaccagtcaacaacggtgaccccgtccaggtccagctcgtcttcatcgccgtggcggcggcgcagaagcaggtcgcctccggggtgggtatactacctgaaggttatcgcccggggaccgcgccggcggcggcggggacaggccgttcgacgccgtggtggtcgtcaaggcgtggatcaagtccaaggagctcgtgtctctcatgccttctcccaagtaatcgacaggctggctgtcaggtgtacgtatgtgcgctccgtgcaggtgttgtgctgttgttattactcgttgcatttttctcgtcacttgagtatgtaacagaataaaaagcttggtaaccgctgaaacagcatgcatcatccatacttaacgcaaggattatcggttgcgtaccatgttgatttcnctaatggagaaattctggaaacctgggcnatcnattcaattcagtaattgcanggng

SEQ ID NO: 602 - DNA, 591 bp, Triticum aestivum
  unsure (1)..(591): unsure at all n locations
  Clone ID: PAT_TA_602
gggacgcacactgcaagcaccgcggcgggccacttcgtggacggcgtctcggcgttcggcctcggcaagggcaccgctgccgggatcgcgccgggcgcgcacctggccatgtacaaagtatgcgacggcgaaggatgcttcgagtccgacatactggccgggatggacgcggcggtgaaggacggcgtggacgtgctgtcgctctccctcggcggcccctccataccattggataaggacctgatcgcgatcggcgcgttcggggtgatgtccaagggcatcctcgtggtgtgcgccggcggtaacagcggcccgacgccctccacgttgtcaaacganncgccttggatattgaccgtgggggccgggtcggtggaccggagctaccgagccaccgtgcggctcggcgacggggaagcgttcgacggcgagtcgctgacgcaagacaagcgcttcagctccaaagcgtacccgctctactaccctcanngcaccagctactgcgactacttcgacggcgtcaacatcaccggcannntgnnncgtgtgcgacaccgagnnnccgttgcctccgctgaactcgatccnnnc

SEQ ID NO: 603 - DNA, 397 bp, Triticum aestivum
  Clone ID: PAT_TA_603
tctagcgccctttttttttttttttttgcagatgagaactctcttttattaacagaagaggaaatgcgaatatctgtatattttaaaactgaaatgctagtagataaggggaataagaagctgaaaactactgtagttgcagatacccttggctgcaccagctcagatcagtacaaaattcaggtcatcaagagaaaactagaagagctttacataattacataacctcagctcagatttacagtaatgccgatacaccgacagatggtgccgtagagatgcaaaccctcaacatttgcactctttgagatagtagtcaaggaacttcgttttacacaagattttctcctgtaaccagagatgctgaatttcatgcagatttataagagttcccaat

SEQ ID NO: 604 - DNA, 1128 bp, Triticum aestivum
  Clone ID: PAT_TA_604
ggcggaggcccaggagcggggcggcagctcgcggtcgatgggcgcgcgggagtactacgactccgctgctacggcgacatcacgcataaggccatcctcgtcgacctatgcggccgccggcaccctcctcgcccccaccgagcccatggctacagagtgcttgacagtaggcgaaaagtatggggtgaagtactcagaggatgagatcttgatgaggtaccggcaggcatatgcgcagccatggggcagatcgcggcttaggtatgttgatgatgggtttggcaacatatagttagttcttctacaggctgctcagatttagagtacttggagggtgaggaactttatcattactatacaactgagaaggcctggcggctcattgatcctgacgctaaatatgtttttgaagcattgagaagggctggtgtgagaacagctgttgtatccaactttgacacccgtctccggccacttttacaggccctgaattgcgatcactggtctcgatgcagttgctgtatctgctgaggttgcagcagaaaaagccaaacccaactaatattcctgaaggcctgcgagttgttggacgtggaagcctgaagtggctgtgcatattggcgacgaccgtcggaatgatttgtggggagctagggacgcaggctgcgatgcctggctcgtggggcagtgatgttcactccttcaaggaagtcgctgaaaggatcggagtgagtgtgggtatgggcaacaatatgtgattcgccgcggttgcttgtaagcgggctccgctgcgcctggcgggcggtcagtgtcggatcgctgcccttcccttcttcctgtcgagtatatgctcgccgagccccctgagcttcaataaaaaggctgggaggtggtgcttaggttgcctcctctgtacatagtgccgacccttctttgctcaggtgtgtgtgtggctgtccggccgctgtacatattttccagggaagtgagaactgatggcagtgtctctttgtgacaaggccttaatttcctaagtctatattgtagcaacaatgtacgtatgtaattaagcgaactcgatttaccctttgaataaaaaaactcgatttaccctttaaataaaaaaaa

SEQ ID NO: 605 - DNA, 953 bp, Triticum aestivum
  unsure (1)..(953): unsure at all n locations
  Clone ID: PAT_TA_605
cggcacgnggccaccttcttcccctgtcgagcccccacccacctctcccgaccgcaacccacacctatgcgcgaccaccctccatccccatccccacaagcacgtcgctccggcgtggctcgggcgctagatcccgagcgaccgcgccccctggcacccctctcatccttcatctgccccccgcgcccccaaacttgctccaacgctaccggaagccacgaccgcctccggtgcgccgccgacctgccatgacaccggatccggcccccacacaacatgttcttcctccaccacatgcctactgccttgatctggacctgacgacgggctcctccctccagctcctctccgatagagcatcgggctgggtcctcgtcgtggccctgcccagatccggggatggccggcggcctcccatgggcttcccccttctcattctcctctctgacaagcagcgtgccccgagacgactcctcgacttcatctccctagagctcgccctgacccacgcatccgacgtccttgaagtcgttgtttgtcaggtgagcaacagctccaccgtgacccctttccacctgctactctctcctctctatcaccgtgacccctgtccctcgagtagcaacgggactccaggcccgatctgggactcgtctgcgcgtcgccgctatctggctaccagagttcaacaccatcccgccctcctctaccgtgtgcagtgcacacctgcccgcactgcaagtcctccaccttttgctccatcatccacggtgtagtccacacggccggagtatgttgcagcctacatctatagcgggggcagctcgcggcccgtcgacgtgcagttttggcagcagttgtttgcaggactgtttctgctgttttgcagagcttggatttttatttggaccccctttcatttgagtgcagctcgcttcgtnccgcgtccgcgg

SEQ ID NO: 606 - DNA, 877 bp, Triticum aestivum
  Clone ID: PAT_TA_606
aaggaggagtatagtcttggccatggctgggaaggaaggagaacatgtaaattgaggatttttcagagagatcgggactgcttgatttatcagtggactagtgtgctggttgattaggatctttcagagagatcagggttgcttgattaatcagagagaaactgcaacagtacttgggagttgggactggtgtgctacggttgcttgattaatcagagagaaacttatcataatttgtccgttccttttcttgatttggagcaagtgtctttgctggagtcagcgtccttgtggttgatctcatatacatgaggattatctgagtcagctgcttgtggttgacctcatatacatgaggattatccgattattaaagcacatacattggagttgaaatataggcgggtcgtgtacacggggtacatgtacgtgatgtaaacaaaacctatataactcagggaatcggtactacaagagagcttcaagctgacggccaataggaatggaagacatgacttgatggagaaatcagggaacatacattctgctctcttgttcttcggcttggggtgtcggcagctacctattactactagggagtcttattttggacggaaagaaaatacaatattggtttttatccatttgtatgcctgcgttagccttatgaagcacaaaggatgtcccagtgatcaatcacggatgatacttggtgtattcttactaggctaatgggcaaatactcgaataactgaatcacctgtaatctttttttattgtaacggcggtgttatatctgcaacaacagtttgtaagtttttctgtataatttgaatatacatcttggtagctataattcatcaatcatggatgatac

SEQ ID NO: 607 - DNA, 847 bp, Triticum aestivum
  unsure (1)..(847): unsure at all n locations
  Clone ID: PAT_TA_607
cccatggcggccggccaccccccccccccccccccccccccccccgccccccctcgctcccgcctccccctcccccccccctcccccgtcctccctcccccgtgctccagccccgcctcccccgcgcgatcagccggcggcggcggcgggcgccgctgctgccgcagaagggggaggcccagggcgccgtgaaggaggcggacgaggcgcaggccggtggtgctggcgcgcggaaggcgggggaggaggaggatgatgacggcggcctggacataaacgaggcaactggcgagatcggcggcccgcatgggcccgagcccacccggtacggcgactgggagcgcggcggccgctgctcggccttctgagcaaccgctgccaactgggagggtaaaaacttgctctcggattcgttctaagctgtaatcataaggatatggcatgggcatggcatggtggttctgttttactctgctgggggaataaatcttgttgttatactgaacatgattctgaagtttcagagtactgtaccatcttagcatgtatctaagctttctaagttctctctctgtatgaatttttttgagtggtagtaactgattgtttgtttaaaaaaaaaaaaacaacaaaaacacaaacggccccggctgcaagcccgccgccgcctccgcccggtgcaagttccccccccccctttggggcccgccggcgccgccccccggggtcatgcccaccgcctcccacaaggggaactccggcgggtcgagacggcggcggggagacggcggctgcgacgcacaactgcaatngcgnacggctgcgntgctcctgcncaacngaacna

SEQ ID NO: 608 - DNA, 711 bp, Triticum aestivum
  unsure (1)..(711): unsure at all n locations
  Clone ID: PAT_TA_608
cccagagactcctcagagtaatcgagccggccggcttgcttcgttcgtggcgtctctgcttctcaagggcgtgcacaagcgtctgggcctgcccactatctccatctcctgctcctccgccgacgccaccaacatcatcgcctccaccggcaccggcgccgtcgttggcagcagcggccgggccatcgaccgccactcgccgcggctccgcgacccacaccgctcctccacctccaagccgcccagaccaagcaccagcaccaaagactcggtgtcctcagaggaccccaagcagcagcagcagcagcacggcagcaagaagaagaagaagagcaccacggctgatcactgctggtatgggagatgtcagtgggagaagtagatcttcggagcagaggctggtcagcccggccacctcctccactctcctctgcagtccctcccggctgcagtccgaccacctcgacgtcctcgcgttgcccccgcctccgccgccgtccttcatcgagcgcgttccccgggcggcgaagggaagcctccagccgccgtccttcatcgaacgcgttcccgggccgacgcctccctgccggcgtcccttccccaagggacgcgccgccgtncgactgtgtcaccaagcaagagtcttcgttcnncaggggagtcctcctcctggntttcgttcggnatcaanagattaanggggcgttcaaa

SEQ ID NO: 609 - DNA, 1186 bp, Triticum aestivum
  Clone ID: PAT_TA_609
ccccgcgtccgcccacgcgtccgcacatacattgtccgtgagggtgatcccgtggctgagatgcttttcatcatccgtgggaaactggagagctccacaacaaatggtggccgcacaggcttcttcaattcaactacactgaaagctggtgatttctgcggcgaggaacttcttggatgggctcttgtcccgaagcctaccgctagtttgccatcatccactcgcacagtgaaggcactcatagaagtggaggccttttcactccaggccgaggatctcaagtttgtggccagccaatttaggcggttgcacagcaagaagttgcagcacactttccgatactactcacaccattggagaacatggggcgcgtgcttcatccaagctgcgtggcggcggtacaggaggaggaagatggcgaaggacctgagtatgagggagtcattcaattccgtgagatcagaagactcggatggttaagatgaccctccacccaagaagaatatctctctaagaatgatggccgggaaagtcatggctgggaacaggaaagggcttcaggccataaaagagttgccgacactaaagaagccggacgagccagattgctcgctcgaaccctacgagtaaggtataatggtctatccagaacggtcactgatcctctagccctgctaccaagttaatcgtctttgctgcattgaggagactgtaatccggttggaatttggattcgcagaaccggtcattgatgcgagaattctaattaacactgaatcccaaatgcatcgtgggagaccttacgaagagatgctaaacagattatatactacacatagatattctagtcatcgttatgttgtacattcaagatgtgtatctgtgtttgtaaaagtcttggtgcctcagcacagggcgccgctacactgactgtctcagcttcaaagaaatgctgacattgaagccatagtatgaagtactccttaaagaaatacaagagcgtttagaccagtgatctataaacactcgagggagtacctttttggagtctttttagtacgaggtttgctattttgtgtaaagaaatgcagagcatatcccccatcaggccatcacactgtctatttccatttgttaaagcttgagtaaactgtcagcaaattagcaaaaaaaaaaaaaaaaaaaa

SEQ ID NO: 610 - DNA, 1217 bp, Triticum aestivum
  Clone ID: PAT_TA_610
tggaggggccggcacctccgggtggcctccgtctgctgatgctgctcctgggggctcggccgctcgcacgctcacgatacggcgtcggccagcgccagatgctcgcggcgacgctcgtctccgttgccggcggcagcggcttcaccggcacctgccttgttcgccttctcctcgaccgaggatacacagtccacgcccccgtccaggaaccctgggacgaggccgagactaatcacctgcatgctctgcaatgttcggggacactctatgacggcgctgtctgatgcaccgcccgcgcccgggcgcccggtgtgcacggcgcgccccgtacgtctccgcgatctacccgctgaacttgcccctgtgttcccggtaccccggatccagacggacaaagaaggatgtgctgggacaggaggggcaacctccgagaaactcgtcgacttcggtgtttgttgccccccgtttcacacgactcttagggagaccgtggaactccgtaaggagtccaggggaaaccgaagcgtgcacccgcatgtacatagacggggattgctgggcctgacgttgagatcctcaagcaactcgatctttggaacaacgtcgccaaaacgctggaggaaaaagcggcgtgggacttcgccggagaggaaggactgcagctggttgtgctgaatccagggctggtgctgggcccgacgttgaccccggcacctactggcagtctccgtctgctgatgctgcttctgggaggccagaagctcgacatggaacccttcttcgtcggctgcgtggacgtcagagatgtggcacaatctctggtggtgctctatgagaacccgtcggcgcaggggcgccacctgtgcatggagtccgccgtacgcctcgtcgatttccacgatgaacttgctaacctttaccctgaattcccggttcacaggatccaggaggacaaacagggctgggtggtgaggtcgaaggctccgtccaagaaattgatcgatttgggcgttcgtttcaccccattcgacaaaactgtcagggacacggtggattgcctaaggagcaaaggagaaatctagcctgtgaccttgaacaaatatacattttgtgtatgccaggtttgaaaactgttgcaggaaaaaaattctgctgtatgaactgccgccgtgcatgtaaccatgatcaataatgcatgtgttccatttcatgtttcc

SEQ ID NO: 611 - DNA, 402 bp, Triticum aestivum
  unsure (1)..(402): unsure at all n locations
  Clone ID: PAT_TA_611
aatagtccagtgcctcttctcgtcatggccctcgtcaaccggaacaacaagaggaggaccatggctattgctttcctantccttgtaatgatgtctgcttgtaccttaccgtcctgccatgcaaagcgcggacgcgtgggcagcaggatagagcggcgtcaacatgtctgcaccgagcctgattgcatggacatgtgcagcaggatagagcggcgtcaacattcctggtattgcaacaacattggccaatgttgttgttggcttctataatttgaccgaacacaaccgttttggttacttttgcgatgtaatgcagatggataggcttcttgcatgtaatgtgttgatctatttaatggagacgaaatatcatgttcctttaacnnggtgagcctggcggat

SEQ ID NO: 612 - DNA, 977 bp, Triticum aestivum
  Clone ID: PAT_TA_612
aagatatctgcaagagcaggagccgctcgccgccggtagcatagccagtcgatctcttgccggaggtgaaatccgatggaggggagcagcagcggcaagcacttcatcctcgtccacggcctctgccacggcgcgtggtgctggtacaagctggtgccgatgctccgcgccgcggggcaccgcgtcaccgcgctcgacatggccgcgtccggcgcgcacccggcgcgcatggacgaggtgccgtccttcgaggactactcgtggccgctgctcgacgccgtggccgcggcaccggcgggcgagaggctggtcctggtcgggcacagcctcggcgggctcaacatcgcgctcgccatggagaggttcccgcgcaaggtcgccgcggccgtgttcctggccgcgtgcatgccgtgcgtcggcagtcacatgggcgtcaccacggaggagatcatgagacggatcaagcccgatttcttcatggacatgaagaggatggttctgaacacgagccagggccctcgacctgcactcgtgtttggcccgaaattactggcagcaaaactgtacgatcgagagctcagctgaggatcagacgctggctacgatgctggtgagaccgggctgccagttcctggatgaccccacgatgaaggacgaggcgctgctcaccgacgccaactacgggtcggtgaacaaggtgtacgtggtggccatggccgacgcctcaaactccgaggcgatgcagcgctggatggtcgacgacttgagccccggcacggtggccgaggagatcgccggagccctccgctggcccgcgccctccccagccagcgctgcgctgccctgccccggatcgccgacaagtatgaatgaatcgattgtccacacagttgagacttgtacaacgtaatatcttcgctgagagttaagttggtcctataatacattttttttcaaataaaaaaaaaaaaaaaaaa

SEQ ID NO: 613 - DNA, 1902 bp, Triticum aestivum
  unsure (1)..(1902): unsure at all n locations
  Clone ID: PAT_TA_613
gctcccactcggccccagtacctgcgtacgtacgctttccatttcctttcttgctccggccggccggccacgtagaatagatacccggccaggtaggtacctcgttggctgccgcgggaggtcgcttgttctccgggcaaggaaagaggttgcgctcggggaccgatggcggacgacgacgagtaccccccagcgaggacgctgccggagacgccgtcctgggcggtggccctcgtcttcgccgtcatgatcatcgtgtccgtcctcctggagcacgcgctccataagctcggccattggttccacaagcggcacaagaacgcgctggcggaggcgctggagaagatcaaggcggagctcatgctggtgggcttcatctcgctgctgctcgccgtgacgcaggaccccatctccgggatatgcatctccgagaaggccgccagcatcatgcggccctgcaagctgccccctggctccgtcaagagcaagtacaaagactactactgcgccaaacagggcaaggtgtcgctcatgtccacgggcagcttgcaccagctgcacatattcatcttcgtgctcgccgtcttccatgtcacctacagcgtcatcatcatggctctaagccgtctcaaaatgagaacctggaagaaatgggagacagagaccgcctccctggaataccagttcgcaaatgatcctgcgcggttccgcttcacgcaccagacgtcgttcgtgaagcggcacctgggcctctccagcacccccggcgtcagatgggtggtggccttcttcaggcagttcttcaggtcggtcaccaaggtggactacctcaccttgagggcaggcttcatcaacgcgcatttgtcgcataacagcaagttcgacttccacaagtacatcaagaggtccatggaggacgacttcaaagtcgtcgttggcatcagcctcccgctgtggggtgtggcgatcctcaccctcttccttgacatcgacgggatcggcacgctcacctggatttctttcatccctctcgtcatcctcttgtgtgttggaaccaagctggagatgatcatcatggagatggccctggagatccaggaccgggcgagcgtcatcaagggggcgcccgtggttgagcccagcaacaagttcttctggttccaccgccccgactgggtcctcttcttcatacacctgacgctattccagaacgcgtttcagatggcacatttcgtgtggacagtggccacgcccggcttgaagaaatgcttccatatgcacatcgggctgagcatcatgaaggtcgtgctggggctggctcttcagttcctctgcagctatatcaccttccccctctacgcgctcgtcacacagatgggatcaaacatgaagaggtccatcttcgacgagcagacggccaaggcgctgacaaactggcggaacacggccaaggagaagaagaaggtccgagacacggacatgctgatggcgcagatgatcggcgacgcgacgcccagccgaggggcgtcgcccatgcctagccggggctcgtcgccagtgcacctgcttcacaagggcatgggacggtccgacgatccccagagcacgccaacctcgccaagggccatggaggaggctagggacatgtacccggttgtggtggcgcatccagtgcacagactaaatcctgctgacaggagaaggtcggtctcgtcgtcggcactcgatgtcgacattcccagcgcagatttttccttcagccagggatgagacaagtttctgtattgatgttagtccaatgtatagccaacataggatgtgatgattcgtacaataagaaatacaaatttttactgatccaaaaaaaaaaaatacaantttttacnagtcaaaaaaaaaaaa

SEQ ID NO: 614 - DNA, 1268 bp, Triticum aestivum
  Clone ID: PAT_TA_614
tcgagcggccgcttttgtatatattttgagctgtactttcttgacatacgaatctgtacaatttaacagccacataacatacttatactcaaacttttgtaagcgtaatttcagttcaccctgaattcacaattacaaagttgaataaaagcgcacgtgcatgttaaactgcagaacatcacaacggccaaaatgcttgcacatattgtaagaagcctcgtacaaagaatgcaaaacttcctttccagaaattcaaaatgttccaagaaatctgactaaatgggcagctgatccgtttttagcattgcaattttaattacctagcagctgtccatcatgctatcagtcccagccaagttgaccaaccacgaagttactgacatccgggagcgtgctttgcttcgccccaaatgagaaattactcgggatgttattcagggctgacccgctcaaagatggaccctggagcctgctggttaaagataggcacctggacatcaccagacggcttcggaaaaccaaatccaagagaagggaatgaatccgttggagcaacattgcaactgaaaagcttctgctcatactcaatcaactgctgctgtgccgcatcagccagttgcacttgtggcctccgttctttcacccactgaaaacattgtgcaagtcgccagcctctggacttcatcaagaaggctacaacaaatgcagctgacctacttttccctgacatgcaatggactagcactcgtgctttatccctctcgcattgttctaggaattggattgcatcatcaaactgcaaagtcttgtcgtcttgaaggcagtgataagtaaaagagttccggtaaaggttttggcataagggtacagtgttgaggatgtgggagatgccgatggtcttgaggagctcggagcgggaggcgttgtcgtagctgccgaggaagaggaagtccttgagtatctccgaggggaacgccgactcctgccgcggcgccgccgccgccccggcgggccccagcgccggcgggcggtggccgcacaccccgcacggctccccctcctcgtacttgtggtagtgcccgcagatcccgcacgggttctcccgctcccgcttcctcatcccctccctcctctcctcgccggcgatcgaatcggggggattctgctcggggagtgatcgaatcggggtggcgtggaggaggagctggaagagagagaggggggcgcttccgtttcctatttttaatttctggaagatcttcggacgc

SEQ ID NO: 615 - DNA, 636 bp, Triticum aestivum
  Clone ID: PAT_TA_615
tcgccggacgcgtgggcgctcatttacttttctcgcatcgagagctctccccggaacggcggcgagaagggacgggcggaggagagatgccgcaccgcgcgcggccgatgacggggctgctggtgttcatgggcgtcaacctcgtcctcctcagcaccatcacccccgtctacgacttcgtctgcttccacccctactgggaccgcaggagagaacgccgtcaaagggaacgtgaagcactgcaaggcaatggttctctagaaactgcaaaatagactctactaggtatctgcttacattattagcttatcacatcctggattgttcatttacgtgggatgaagaaagtttgatgaagttgcgaccaggcttttcagtgtcggtgggtcattagatcttgtttcgtgatgctcctgcaacgtgtcagtcaattctctgtaatgacaaaccaaggaacaccagacgctgtgaaataagttctttaaactacactgttatgaatcttttgtcaacttcttgtattcatctggtgtaacataagcaaatgaaatcatctatttagttcagacctgttgtaatacaagtaatcccaatcatctggcctcactatatactatatgtagtcttgaaaaaaaa

SEQ ID NO: 616 - DNA, 896 bp, Triticum aestivum
  unsure (1)..(896): unsure at all n locations
  Clone ID: PAT_TA_616
ctgtcccacgcgtccgccacgcgtccggttgtcactgttatgaagaggactaaaactcaaccatctgaaaacttcaaggaaacaatgaagagggtgtcatatgggaacatccttaaagccaccaattggttctctgtagttaaccggataagctcaagtcatacagcatcagtctacattggtcgatttgagttcgagacagatctcgtggccatcaaggtgttccatctcagtgagcagggttcgagaactagctttttcaccaagtgcgaagttctgaaaaacacccgccaccgcaatctggttcaagctatcaccatgtgctcaaccgtagatttcgagggcgatgaattcaaggctatagtatatgagttcatggcaaacggtagcctggacatgtggatacacccaagggttggcagctcaaggaggctgctgagcttgggccagcggataagtattgctgctgatgtggcttctgctctggactatatgcacaaccagctgacacctcctttgattcactgtgatctgaagccgagcaatgttctgctggactacgacatgacctcagcattggcgactttgggtccgccaagtttctctcctcagtatcggcaggccaagaagcttcattgggattcggaagaacaatcggatatatcgctcctgaatatgggatgggatgcaaatctccacagtgggcgactttacggtttgggtgctgcacgggagatccacgcaangcggcgacgaccgctatcggaatccnaacctcanaagtagtcnactaccttccgaaagatnccgagtnaaatncaaatcatccnagaggacaagcgtgctctcgcttgaaacacatancntggcctatggccgangtcangatccnnaaa

SEQ ID NO: 617 - DNA, 643 bp, Triticum aestivum
  unsure (1)..(643): unsure at all n locations
  Clone ID: PAT_TA_617
gagaagagcgacgtgtacagnntcggcgtggtgctgctggagctggcgacggggcgcgcggcggtggccgacggcgaggacgtggtggagtgggcgtcgcggcggctggacggggccgggaacgggcgggagaaggcgatggcgctgctggacgggtcggcggcgcgggaggagtgggagaaggaggaggccgtgcgggtgctgcgcgttgcggtgctgtgcacgagccgcacgccggcggtgcggccgtcgatgcggtccgtggtgcagatgctggaggacgcggccgtcggcggacgcgtgggcggcaacggcaagcccgccctggaggtcaaggtcgtcgtcgcctagccgttcaaagttatttcagtgtctgaactgaacattttggatcagcgctagccgtccgatcggagcaacggacggccgagatctgagcaggcgcgttcaagcgtgtgtagagcatgtagcatgtggtgtgttagtagtaaagataaagattgttcgttggtgaagaattacccaaccaatcttgtgtgtgtactcgtaggaaattaccagtggcatcatccattctgcttggtagatcaatcattggcaggtcaaactacccagtgaaaaaaaatacagtactcttggccgc

SEQ ID NO: 618 - DNA, 539 bp, Triticum aestivum
  unsure (1)..(539): unsure at all n locations
  Clone ID: PAT_TA_618
gttggtggttagaagcctgcacgaacaaagccgccggttctgactgttcggctcggggttccccggccaaatttagcttggagcaagtctcgcaagcgccggcggccacgagagcagcctcagctccgaccgatcgccgcgaccagtaggccgacctccggcggctggcgagccctgagccagcgagctggcgagatggcagagccagaggcgcggatcaccactctgggttcttcagccttcaggttcacagtagactacgagcaaagcaagaaggttcccgtcggcaaggccatccactccgacgtcgtctccgccggtggacaccactggaggatcgagttcttcccgcgcggccagagcgaggccgacaagggcgagtatgtatccatcttcttcaggcacatgagcaaaaccagaaggatcagggccatcatcgaggccttcgtcactggcagcgacggtaatccatctgtgccagacatactgcagaggacatttanacctttgaatcaatggagataaaggccgccgactct

SEQ ID NO: 619 - DNA, 629 bp, Triticum aestivum
  Clone ID: PAT_TA_619
aacacaaagcacaatggaaagcattgaggttttagcactcgtagccgctgtgctcttctgcctagccgtcctccggcgaagcaccagtcctgcggtccagctgatcagggaccctgccgttgcccacagcctccttaacgagcacgccgatgctttcgtgaaccggccgtcagctggccttctcacggctctggcgacctggactcgtggccctgaacggaacgagaccttggcgaccgtgatatacggctcgcactggcgatcactccggtccaacctcaccgcgggcttcctcaaccccacgcacctcgccgccgttgctccgctgcgggcggatgccatccaagaccttgtcaccggcctgtcacaagccggcggagaggaggtggtcatgcgggaacacctcgaccgcgccatgtttacgctgggcgcgcggctgtgcttcggcggcgaccatggcctgcaagagagcggcgtgcgcgccatgcagcgcgcgatggacgacctctcacaggccatggacgacacggtctccttcgacggctcgacactgggcaggatcacgcactggaggaggctgcgccggctcttcggcctgttcgccccgctgtgccaggtggtgcgcccgc

SEQ ID NO: 620 - DNA, 2319 bp, Triticum aestivum
  unsure (1)..(2319): unsure at all n locations
  Clone ID: PAT_TA_620
gcaacttcttggaccgcctgccggagccagcggccggacgttgatgggcgcggcggcctcagccggctccttgtcgcacgccatgattcaggccaaagggtcgggcatggagccggagcgcctcaagggcctccaagcggacgacgccggcttcaagaagggctcccgggcgggccactccgccttccgcgggcgccttccgcggggtcctccttggcgggacgcggtgccaagggccacaagccggcgccatgcaggcccgggcgccgcgtcggagcggggaatgctcgccgaccgggtggtgaaggcggctgaagtgctcatcagggtggccacggtctcggagaaggtccatggcccgtggtacaaagcgatcgcctgaatgtgaatttagttttactttggttggttcggtgaatacacacgttgggtccggtgtaaattctggtcccgctggatgaggtgggaataagtcacttgtacagaaattaattagtagttcaggatgttaagaattcttggtgtcagggcaatatatggatgtcccagctccacgatttagtcaatcaggggcccgggagatcctacaattgggcactgtaatagaactcaataatgtggttttgtatatatatctcatgcgaataaatctaatgatgctcgtaccattgagaaggatttccaagacaaagtgagggaaacaatggagaaagctttctgggatgtggttaccgactcgatgagaggagacaaacctgactacagccaactgatcaacctggtaaaggaagtgagggattcgttgcacgacttggctcccaaggaatggaaggaggaaatctgtgagaacattgacctcgaaattctatcccaggtactcgagtcaggctcccaggacacccaatatctggggcagattttgcagtactctctggatatggtcagaaagctgtctgctgcggcaaaggatgatgagatgaaggcaagtcatgacaaattattgagcgagttggctgcaagttctgaagatactgataatggagtcagctcgttcgtcattgctgtcatcaagggcctgcggttcactctggaagaaataaagcaactgcaagtagaagtgagcaagcgtccggttcagctgatgcaaccgacgataaaaggctctgctggagtggagtacctgcagaaggctttcggcgatcgctatggacctcctgccaatgcgtcagcttctctccctgtaactctgcagtggatttcagcatcaaagagcatcgtggacgcagaatggagcgaacatctgggctctctttcagttcttccagcagcaaatcatgctcagccccttgttacagtgctccgagctggccatggagctccagcagctgctgtagcttcagcaggtagttcaggtttacctgaatgcaagggagaaaagattgacaagcttgtgagggttggcctgttgcagcttattagtggtatggagggattacaattgcagtcaactcctgagagcttccatctcaactttctgagattgagggccgtgcagggccaatttcaagaagtgattgtgatggctacgagcatgctcgtcctgcgtcaagtcctgatgagtgagaattctaagatcactcctctggagctggagactgtcatctcagaactcttcggcgctctggtgaagctgctggacaactccccggaggcaggcactgaagagatcgtggaggcgatgatgagcgcgtcggcctcagccggctctttatcggacgcgaagattcaggccaggaggcagataataacccgggtgctcctgaagagcctccaagcggatgacatcgtcttcaagaaggtctcccgggccgtccactgcgccttccgtggcgtcctcctcggcggcagcggcgccaagggccagaagctggcggatgcggccttgcgccgcgtcggcgcggggaagctcgctgaccgggtgtttaaggcggctgaagtgctcatcagggtggccacggtctcggagaaggtccacggtccgtggtacaaagcgctcgcctgaatgtgaatatagcttactttggttggttctgtgaatacacacgttgggtcgggtgtaaattcttgtcccgctggatgaggtgggaataagtcattgtacagaaattaattagtagttcaggatgttcagaattcttggtgtagggcaatatatggatgtcccagctccagaatttagtcagtcagggcccggagatgctcaatggcacctggttacgccaatgcccaatatgtgcagtcaanaaagaactcaataat

SEQ ID NO: 621 - DNA, 670 bp, Triticum aestivum
  Clone ID: PAT_TA_621
gagccacaaagccctcctcctcccttcgtctccgttgctccgtctcattcccaagctccatactccaccacgagctagctggtactgctgtcctgtcagggaggccgaccggccaagaagatcgaggcatggccgaggcagtccgggacgatcatcgcggcgcggtcggcgtcgccgtggacgacggcaccggcctgcgcccgagcaccaacggcgacagcacgtgggagatagaggagctggagccggacgaccggacggccggaccgcctcctccccctcctcccggggcagcggccacctccgacgccgacgacgtctacgtggcggtgggcaagggcgggtccagcatggcggcgctgtcgtgggcgctgcggcagctcgcgaagccacggagcttcgtctacctcgtgcacgtcttccccgtcgtcgccaccatccccaccccatgaatgatgcctaagagacaagcaaccccagagcaagtagaaacttacatgaaccaagagagatccaagaggcgagagatgctgcaaaaatttctggaccactgtcgaaactttcaggttaacgtcgatgtgtacctcatcgagagtgatcaaatcgccgatgcggtcgctgaacttatccctgttctgaatataaagcagctagtacttggggttgcaaa

SEQ ID NO: 622 - DNA, 841 bp, Triticum aestivum
  unsure (1)..(841): unsure at all n locations
  Clone ID: PAT_TA_622
cctcgcgtccgcccacgcgtccgcatccccgttccggaaggctcgacctcctctggcggcgccgccggaacctccaccgcctctgccccctcccaccccccaccaaagcaccgcccttccttcccctcccctcccctccaccggatccatattatacgcgcttctttcctttcatgggcaagcaaaccctagcctatttttatttgtcttcgctttattagggttaggcacctcctgctccggtgctcccccccccccatcaccgncacaagccgtccgtcgcccgtccacgtccagcggcggagcgcgagcaccatgtccgtggcggcgggggtcagcgatgcggccatcgcggtgcgcgacaagctccggggcaagatcggccagaccaaggtgaagcgctactggcccgggaagaagcccgagtgggccgatgaggccgaggacgacatcgacctccgggcggccaggtctccctcgacgaggccttccccaaggccgaggaaggggaccgggaccgggaccgcccccccaaggacgaccggcggctccggcggctcgcggagacgcgcgcggagaacaaggaggagctccgggccgaccaccgccgcatccggcaggctgagatcgtgtccaccgctgaggaggagcgggacaggcaagaggcccaggtggaggaggaggacgacgaggacgcgcaggaggagcggcggcggaggatcaaggagcggcagcgcctcagggcgcaggaggaggaggagctgctcccgcaggaggacgagccgatcgaggatgacgtgcaggagtcggaggagttcgagtacgagaccgactcggagga

SEQ ID NO: 623 - DNA, 458 bp, Triticum aestivum
  Clone ID: PAT_TA_623
ccactcttcgattctccgcttctcgccagcctcaccccgccatggcctccaccgtggcattcccccccgccatcgccgtcggcgccaatgtgcagcactctcggaggacctcttcgctgcggcccgtcccgagagccaggcccgtggccgcgagggccagcgccgagcgggacggggccgcggcggccgtccaggcgcggtcggggcggaccatcgaggagtgcgaggcggacgccgtcgccgggaagttccccgctgcgccgccgccgaccaggccgcaggcgcccaacggcaccccggagatcaggcccctcgacatggcgaagcgccctcgccggaaccggaggtcgccggcgctccgggcagcgttccaggagaccagaattacccccgagaaccttgtactgcctctgttcatgcacgaaggtgaagaagacactccgattggagctatgcct

SEQ ID NO: 624 - DNA, 757 bp, Triticum aestivum
  unsure (1)..(757): unsure at all n locations
  Clone ID: PAT_TA_624
gccggcacgccggtgagcccccccgcttcccgtagcttctcgaagagaggtcgccgatgaccgtctgatcgtccgtcgccatgggctgcgccggatccacccctaaatctgacgatagcagtaagaagctgaaaaaaccaaagccttggaagcacactcagtcaataacaccagcacaactcaaacagatgcgcgaagaattctgggacactactcctcactatggtggacagaaagagatctgggatgcacttcgggccgctgcagaagctgatttagcacttgcgcaaaccatagtagacagtgctggcatcattgtctcaaattctgacatgacactctgctacgacgaaagaggtgccaaatacgaactaccaaagtacgttctgagcgagccgactaatttgatccgggagaaatgaattcatagaccacgaaggattcgtgtaaatcatgtaaatctcatttgttcggcaactttagtctttacttgctcaaaacttcaatggagatgccacattcggtttacagttctggtctgagttgttatggacttgtagtgctcgcatctctttctaggccgacacctgagtatggtacactgagctgtcgaaacccagaaataggaaaaatatagaatggcaatgttatatgtttttttcaagaacaaattgcaatgttatatgtacatttttttaggcaagtgttgtatgtatacttttctcganactanacctgcccggacctgcccgggcgg

SEQ ID NO: 625 - DNA, 1018 bp, Triticum aestivum
  unsure (1)..(1018): unsure at all n locations
  Clone ID: PAT_TA_625
ctatcgcaggccacacagccatgcagagcgagatttggctgctatgggcgacgctcgccgccgcgctactcttctacctgaccagcgcagcccgccgcgggggcaccggggcacggcagcctcggggcccgacgccgctcccagtcctcggcaacgtgctcgacctaggtggcaacctgcaccacacgttggcgcgcctcgcgcgcgtccacggccccgtcatgaagctcaagctcggcctggtcaccatcgtggtggtctcctcccgtgacgccgcgcgggaggcctacaccaggtacgaccgccacctggccgcgcgcgcggtcccggacgccgccaacgcggtcggcaactccggggcggtccatgatctggctgcccagctccgacccgctctggaagacgctgcgcggcatcgtggcctcgcacatattctcgccgcgtggcctcgccgccgcgcgcggcgtgcgcgagcgcaaggtgcgcgacatggtgggctacttccgctgccacgcgggaaggagttggacgtcggccaggccgtgtacggcggcgtgctgaacctccgtgtccagcgccttcttctccgttgacgtgggtggacgtgggcagcgagtccgctagcgggttgcgggaggtccgtggaggacatcatcgccgcgctaaccaacccaactctccgaatcttccctttcctcccggccgctggacctgcaaggctggcntcnctgggccgggggcgcnttacaaaagtctttngnatatttacggatattcnacgccntntggcaaatcccggactncaaagggcnacaacccaanggnattccttgatccctgctgactcttttcncagnaaaattngtcccaaaagntacgtgaacnttcaactnttncggccggacnaacatggaacacgtgaatggcaatgccactctcggaccnatcatgcaagttccccgaatgggaatctcgaggaaggnngnacctcagaccnaccgaaantctnctnagcttg

SEQ ID NO: 626 - DNA, 658 bp, Triticum aestivum
  Clone ID: PAT_TA_626
cccacgcgtccggtggtgcccgacgccgacgacctccgcaccaagttcccctacctggagcaggtcctcaaggagaccatgcgatacttccccggctccccggtggtctcgagggaggcgaccgccgacgtcgagatcggaggctatttcctgcccaaggggacgtgggtgtggctggcgacggcggtgctggggagggacccggagcagttcccggagcccgaagcgttccggcgggagcggttcgacccggagagcgaggagtgcaagcggaggcatccctacgcgtacatccccttcggcatcggcccgcgggcgtgcccggggcagaagttcgcgttccagcagctcaagctcaccgtcatccacctctaccgccgttacgtcttcaggcactcggccagaatggagtcccctctgcagctgcagttctccatcgtcaccaacttcaagaatggtgtcaagctccaggtcgtccaaaggaagaactaatatgagtgtatgacggtaagtttgtgactgactatttatgtactagcagtacatgcttgctccgttcaacgtgtgcgaaatcacatttctgaaagtgtgtaatcgatttgttcaattcaataaaagttgcggttttgggaaaaaaaaaaaaaaaaaaaaaaaaaaa

SEQ ID NO: 627 - DNA, 722 bp, Triticum aestivum
  unsure (1)..(722): unsure at all n locations
  Clone ID: PAT_TA_627
gccgccggtgcctcagatccgccggtcgcgcctccagtccgccgcccacgccttcaatccgccgcccgcgatggccaagtccgcccgccgtggcaacgaggaccccgagcaggcgcgtcgcgtcagatccgacggggcgcggaagcgcgccaccttgcggtacacacgccatgggcggtcgccgccgccgtcgctcctccgccacgagatggaggagtacgaccgcgcgcgcgggcgcctcttctccggcaccggcagctcctccggggcgtccagctcgcgctcctctatcacctaggtgaagagagagccagaggccgaggcggggccgcagcgacgtgccggtggcgtcgttgggcaggaggacttcctcccctcggcgcaggcggacgccattttgcccccgatgctagcgcgcagtgcgtgggatgagagtgggaaggaggagtggcgccgcgaggccgctaaccaggagcagattttcgtcgacctcacctccgacgacgactccgattgagtgccgccgctggttagctaccacacgagctccggtgagctccattntgtctagtgctacggtagcgtaactccggcgtagctctgaccttttatgtaaatatatctatgnntgngtacgaacgatctgcccctatgtgaagaatgatctatactccggcgagcttttgaattaaagttctcgtgcgaaacatgttttttaaaat

SEQ ID NO: 628 - DNA, 1642 bp, Triticum aestivum
  Clone ID: PAT_TA_628
cgtccgggaattcagatataaaagcacgaccgttgtttagggtgatctctgaagatggattgcagattgatggctctacgcctaatgcatgctggaaggagatatactgcaggataaaacaaaaacagtgcaatgttgcctcggaactggaaggaaatgtttgccagagatctggttcagacatgtttggcttttcaaacccacaaattaggcagcttattcaggagttgccaaatgcaaggtcgtgtttgaagtattttgaaaatggtggggataccctccgtggttacagagctgttcatgttaattggaaagatctagacttttgcagtgtatgtgatatggatgaggagtatgaagacaatttgttcttacaatgtgacaagtgccgtatgatggttcatgctcggtgctatggcgaactagaaccattgaatggagtactttggttatgcaacctgtgccgacctggggcacctcgcgtgtccccacgatgctgcctatgttctgtcacagggggtgcaatgaaacctacaacagatggccgttgggctcatctagcatgtgcaatatggattcctgaaacatgcttaaaagatgtaaagagaatggaacccattgatggattgagcaaaatcaacaaggaccgctggaaacttctatgcagcatctgtacagttgcttatggagcttgcatacagtgctcacatcctacttgtcgagttgcatatcacccgctctgtgcacgtgctgctgatctatgtgttgagcttgaagatgatgataaaatccatctcatgttacttgaggaggatgagggcccatgtattcgtctactctcgtattgcaagaagcacagacaaccatctactgaacgtccatctcttgaaagtaatcttggtaaccctgctcagttagttcagacagacgcggcttcatcatctggttgtgcaaggactgagccctataattttcaccggagaagaggccaacaacaacctcaagttacagctactgcttctgtaaagcgtttgtatgtggagaacatgccttatattgttagtggctactgccaaaataaagtaggctgtgatactagctgtgaaccaattcaatcagtcgccttgttggatgctgcatcacaagaagcttctgtcaatgtgtcttctatggctgaaaaatataaaagcatgaaggccacattcaggaagagactagcttttggaaaatcaagaattcatgggtttggtgtttttgcaaaggttgcacacaaggcaggagacatgatgatcgaatacataggggagcttgttaggccaccgatatcagaccttagagagcggcgtatatacaattctttggtgggtgctgggacatacatgttcaggatagatgatgagcgtgttattgacgctacacgagcaggaagcatagcccatttgatcaatcactcatgcgagcctaattgttattcgcgtgtgataagtgttctcggggatgagcatatcatcatttttgcaaagcgggatatagacccatgggaagagttgacctatgattataggtttgtttcgaatgaacaacggcttccttgttattgtggatttccaaaatgccggggagttgttaatgatgttgaagc

SEQ ID NO: 629 - DNA, 1054 bp, Triticum aestivum
  Clone ID: PAT_TA_629
gaattcggcacgagcagacgcgtccaatcgctccatctgctcctaccagttcatccaacgcgaaaaccaccggcggcgagccaggaccggcggccggcgcggccatgcataaccgggcgggcggcggcgggggcggggcgggggagatcgtggaggcgggcgagaggatcgtgccgcacagcgggcccctgggcgccaagcgctccgccatgcgcaagagcgcgcgcttcgccgagtccgtgtccgcgcccctcacggcgccgcacggggcgccggcgccgcgggccaggaacgacggcggcggcgacgacgacgacgactacgtggagatcaccctggacgtgcgggacgactcggtggcggtgcacagcgtgaagccggcggcgggcggcgaggactcggacgtgaagctgctggcgcagacgctggagaagcgctcctcctcctacggccagggcgtgctccgcaccgcctccacgcggatcaagcaggtctcgcaggagctgcggcgcctcgcctccgtcaaccgccggggggccggccccggccgcgtcgacaagtccaagtccgccgcggcccacgcgctcaagggcctcaagttcatcagccgcaccgacggctccgccggctggcccgccgtcgagaagcgcttcgacgacctcgccgagaacggcctcctccaccgctccaagttcggcaagtgcatcgggatgaaggagctggcgttcgccggcgagctgttcgacgcgctggcgaggcggcggaacatcaccggggacagcatcagcaaggcggagctgctcgagttctgggaccagatctccgacaccagcttcgacagccgcctgcagaccttcttcgacatggtcgacaaggacgctgacggcaggatcaccgaggaggaggtcaaagagatcatcacgctgagcgcggcggccaacaacctgaagaaggtctcggagcagtcgaggagtacgcccggctcatatggaggagctcgaccccaacaacctcggctacatcgagctgtacaatctggagatgctgctgctgc

SEQ ID NO: 630 - DNA, 1053 bp, Triticum aestivum
  Clone ID: PAT_TA_630
ccacgcgtccggcagccttcactgctcgcccgctctgcactcgctcagggattttgggcaaagcaggtgaccttcaggatgaagctcagagcaggcattttgcccgtggccatgctcgccattgccgtgctctcctccccagcattcgcgcagaagacgaagagcccccctgctccgccggcggccgtcctcccgccgtccccagcgccggcgccggcgccgcgccacgtggacctcgcggacctcctgagcgtggccggcccgttccacaccttcctggactacctccagaagaccacgtcctggagacctttcagagcaaggcgaacgacaccaaggaggggatcaccatgttcgtgcccaaggactcggcgttcgcggcgctgaggacgacgacgttcgccaacctcaccagcgaccagctcaagtcgctgatgctgtaccacgcgctgcccaagtactactcgctggctgagttcaacaagctgagcagcctcaacccggtggccaccttcgcggggtcgcagtacacgctcaacctcaccgacaacatgggcagcatccggatcaagtccatgtggtccaaccccaagatcagcagcagcgtctactccacccgcccggtcgccgtctacgaggtcgacaaggtgctgctgccgatgcagatcttcaagagcgacccgccgctggccccggcgcccgcgcccgcccccgccgacgccaagtcctctgatgacgcgcctagcccggcgtcggggaagtcggcgagcgcgaaggccaaggcggggtccaagagcgcgtcgcaccgcgccggcgtcagtgtggccagttacctggcggtggctgtctccggtggcctgatgatgctcttgtgagcgagaggctaatgagagaggtcggtggcggggttcatccgtgctgcttaatttttactacatggattgttgctgagttcattctttggacatagtaggcgttctgctaggatttgcatcatatatgcttctgtggttggtccttgttgatactacttgatatactactattttattt

SEQ ID NO: 631 - DNA, 199 bp, Triticum aestivum
  Clone ID: PAT_TA_631
cgttcgaaaaaattgtcccgagcacgtcatccccaacctctcgaccttatcctcccaccgggccgggacgcctggccgaccttgcacggcgccgcccccatcttgcccgacctttcaccgggctaacccacccggtcttctaacggggcggggcgacccggcccaacagggcttccaacggaacggggcggcccggccg

SEQ ID NO: 632 - DNA, 910 bp, Triticum aestivum
  Clone ID: PAT_TA_632
cctcgcgtccctgagctccagcgtcacccacggacccaaacctccttgtaagcttgttctcagtctcccctacgctgccgccgccaccctgagtctgcccctgccccctttcggccatttccacccgcaggtccccttgcccccccccattcctgctcccagtgtccccgccgccgccgccacctcctccccgtacccgccccttcccggtagtgtcctctcccacccaccgccgacctggccgtcctcctcacccgcaaccgccgacctcgtccctccctcccctctccgcatcttccgagcaactctacgcccgaggagatcgagcgagcgcccgagtgcgcccatcctcgcagcctcctcccacgattccccgcgcccgagccccacgagaggagctcctcctgtgtttttgcacgccgccgccggcgaccactagccacagcttgccggagccagcagacagtgcacttcgccgccatggacgctcgtgtccccgaccttgcagcgcgccaccccgatgcgaagtccctccttgcccgttcttgcgccgctgggccgaagcctcgcccaagtccaagcgccgccgacgtttgcctcctcgccatggcctcccctgcttcgtctgcttcgcggacagagctccgtctccgtcaacgtgtcctcccgccgtctctgttcgctgtcgggctcaatcgactccagcagcacccccacggtgtcgctccgctcggcacccgagattctcaacatgcaagcaaatagccaggagtaaacaagcgcttgcagtagatattatttcgtgagtaaattcaagacgaaagatgttcaaagaagctccaagacattcttatatagcaagttatgtaataatagctgggttatctgggaatttaatgtatcttctctc

SEQ ID NO: 633 - DNA, 637 bp, Triticum aestivum
  Clone ID: PAT_TA_633
cggacgggtggacggagagatcacacacgggaaagaaagagagtccagcatcaagctaagccagcgagctagagcttagcgccagttcaccagtactctcgatcggcgtctccctttccgctccctgccactgaatctcatctccggctgctcgtgccggcggcggcaaatggaggagcagctgagcccggtggccgtgacgcacctgctgcagcacacgctccggagcctctgcaccagcgacgcctcgcagtgggtctacgccgtcttctggcgcatcctcccccgcaactaccctccccccaaatgggatctcccaggtgtggcgtatgacaggaccagaggaaacaggaggaactggatcctggcgtgggaggacgggttctgcaacttccgcggccaccacctctgcagccgcctgcggccaagaagggggcaggagccgccgcagctgcgtacgcggactgcgaggctgccgccgccgcagcagtgcaggaggctaagcagggcctgggcctgggcctgcagcctgagctcttcttcaagatgtcccacgacatctacaactacggcgaagggttgataggggaaagtggcggcggaccacagccacaagtggatcttcaaggagcccccg

SEQ ID NO: 634 - DNA, 973 bp, Triticum aestivum
  unsure (1)..(973): unsure at all n locations
  Clone ID: PAT_TA_634
gcgtgcgcaggtgatgctcgccgtccccatcttccttccccaccccgcctcctcctccgccacgccacgccacctcctcccccctccgactcgcgccctccgccgcccggatccctcgccgccggccgctcccccccgcgaccgccctcccccacgcctcggatcgcaggcgggacattttgtgggtgcctgatgccctgattgacgcacacatgccgcgctaggtaatgacgagcttgcctgagaggggtgcagcaccaccatccaatcctacgccatcatcgtcgtgcgtgggagacgccgccgtagcctcttcttcttcgtctacttcttccgccccagaggagcagaggaaggacggcggcccgaagcagtgcaaggcttcgatcctctcgagcgttctcaccatcttcgagccagacaaggatcagtcaggcaggtcagggggggacgcgtccgggtcctatgcttggtcgagggttctaaggtgtttattgggtggctgattccaatctcgcaagtgatgtcacggggggtttcatggttagaagcagtcagatgctgtttgcacaggcactgatttttcatcatcttggaagttctgggagtccgctcctgagggcgggcatgctgctttcttatacaaggactcgtcacctgtatggtgattctgaagtctgcgctttctcgacatatctgttacttcaatctggaaagatttacggtctggctgctagatcatgggtgggtcatatctatgtgtcnggatngaaanccttatccgacaaacagagagcacctgaagntataaataggatgaaantttcctatggcgcctatgtggctcngngatgaaatgtgaaanaggggagcncantgttncatnatgtgccgcccacttgcatgattcacaaggtcaatcagcatggcccatctttgnggtcccggtcttggcttaaaataancaaggaac

SEQ ID NO: 635 - DNA, 639 bp, Triticum aestivum
  unsure (1)..(639): unsure at all n locations
  Clone ID: PAT_TA_635
gaagatagcaaggcatccaccgcatcgaaagaaacgcttggcgaagaggttaacgaatcgatcttttccgagacttttgtcctcgaggaatttagcaccgctcgggattctcaggcgatgatgatcggtgtcgcaggcttcagccggcacatcggccagctcttgagtaaaagcaacgggtttattgcggcgtccctgtccgcggcgagctgcgcggacgaggcggagaaggccgagggcgcggggtgccgggacgacgcggcggcgctgaggctcaaatggattgccatggcggcgatactggtgtccggggtaatgggcgtgggcctgccgctcgcggggcggaagcggcggacggtgcagaccggcagcgctgtcttcgtggccgccaaggctttcgcggccggcgtgatcctggccacgggggttcgtccacatgctgcacgacgccgagcacgcgctctccaacccctgcctcccagccgcgccctggcggcggntcccgttccccggngttcgtcgccatgctcgctgctctcgccacgctggtgctcgacgtcctggtaaccaggttctacgagaccaagcaccgcgccggaggtagcttcgggtcaaggctgacgccgntggcggactcgc

SEQ ID NO: 636 - DNA, 706 bp, Triticum aestivum
  Clone ID: PAT_TA_636
ggccgataccccgcgagacatgtcaaatgacgaccttggttggctgcacactagttgaggtcgacccggggtacttccagacaagccagctgaccgagaaaagcgacgtctacagcttcggtgtggtgctcatcgagctactgacaagggagaaaccaatatgtggcggacagatggacgaggtgagaagcctagcgatgcattttagcacgatgttccatcagaaccagttgctgaagattgtagactctcaagtggccgaggaagctggaatgcggcatgtcaaaacggtctcgcagctggctttgcgatgcttgaggctgagaggtgaagagaggccgaggatgattgaggttgcggttgaacttgaagcgctgagaagactgatgaaacaacactctgttctgaagagtgaagaagaagagcctctacttcctctgcttcgagactgtgagctgccgcggggagatgaatttcgatgcgcagttgagttcgagccatgatggaattgccaaggatgaaagtattcagatcattctactcccgtccggcgacctctcattttaggtctttcatagtaatagatctgttcaattgtgtttagctgctagtcgtagaaactcatagtagggttataccagggaactgttggctagtttttttctttctccatatctatctagtacctccccgggtggccgctcga

SEQ ID NO: 637 - DNA, 667 bp, Triticum aestivum
  unsure (1)..(667): unsure at all n locations
  Clone ID: PAT_TA_637
aaccacatacgtaccccggctttccctttcgtttcgaagctctcgccttccgctccgttgggcggaacacgaagatcaaatcgtgtaagtcgccttcttcttcctccgtcgatccgatcgaattagggttcgtgcttttcgtctccttttctgcttccttggtctttggtctctgttcttgacagggcaagatcaagatggccgcggttcttcctgcgctgctgccaaccccaccgtcggccccaatctctacgttgctcaagacatcgcggacggacgggaagcctggccgtgcgtcggcgagccggagatggatagataacagatttatgattctggccgccgcgtcggacatgaccggcggtgagcgcgtcggacgcgtgctgttggagatgagcggaggcgagcgagtcaaacgcgtggcatcggacatgggcagcggcgaccgtgccgtacgcgggccatcggacacgggtggtggtcgatcgcgccggacgcgtggcattggccatgggcggcggtgaccgtgccgctcggagccgcccgaacaagtggagcgctgtaagaggctgcganccgggccctcacgatcgngtgcaagagncaggtcggncacaagaagtgtccgaggaaagaanngtcgtggncgacgtanaaggtctgcccg

SEQ ID NO: 638 - DNA, 1005 bp, Triticum aestivum
  Clone ID: PAT_TA_638
tcggcacgggggtccccccccgctcgtctctctctcgcgcgcgacgcacgtcctctccccgtcgatgtgccctctcgccggcatcttgctccgcaccgtcgcctagctcaccgctccccatgcatcgccgcctagctcaccgctcccaatgcgccaccctctcaaactccggcaatgcactgctgggcgaggagtagatgcagaaagctgccatttttatgcgccggcaacgcgctggcgctagatctgagtgcgttggcgctcgatctgcttcgtggagaggcatgaaggaggcgctgaagcggagccggagcggcgccggcgcgggcgtgaagacggcggcagtaggagctggagcccgagcaggtggaggtggagccgcatctggaccttgtactgtatcaagatggatggagtagagagcctagagtaggaaagagccttggaccgtagccatggacagcgcatgacagagccatggacagtgcaacatcacaaacttcattcctgtagagcctgatgcagcgcagcatcacaaccttgatggaaggaggccaggccatgaagagaaaagctcctgcccatatcgattcaagaggagaggagagccatggagggagaagcctgctgctgcaatacctaccttgtcgtcctcatggtattctccaacttctcatgaagtttgtgtagccttctgttactcatgaagcttctgtagcctctgttacacatgaagcttctgtagcttcactagcttatgaatcttctttagcttctgtagattaacaaagaagtttctcatgaattcatcactatgaatcttctcatgaagcttctattactccaacttctgtagcttgttgaacttctgtagcttcagcttcagagtagcttgttaatcttgcagttcccttgctagtcatgaatgttcattgctttggcgagggaaattctgtagcttagtcgtggtgcagcttctgtagttttattaaactttagaaaaat

SEQ ID NO: 639 - DNA, 788 bp, Triticum aestivum
  Clone ID: PAT_TA_639
cccacgcgtccgggaacaattactttgactcgccttcttgcacctttcatgttggatagagggatgggtcattttgttgtgatgagtagtgcagctggaaaggtgcccacacctggccaggctctttactctgcttccaaacatgctctcaatggctactttgcttctctgcgctctgagttatgtacgaaaggcattaaggtcactgttgtctgtcctggacctattgaaacaccagtatcttctggtgcaacttctttatcacaaaggcattcatccgagaaacgtgtttcagtggaaagatgtgctgaactgacaataattgccgcaactcatggactaaaagaagcatggatatcatatcagcctgggctggctgttttgtacgtagtgcaatacatgccaacaattggatgctggattatggacaaggttggtgcaaagcgagtggatgccgctgcaaagaaaggcaacgcctacagttggaatctcctcttcggtggcaaaaagtcggcttgacgatgaagttgttcattacgcctacaggtggaatctcattgagattctgaaagtcatacacatctatctatatagattatgaaccttgttaccctttttcatctttatgtgtgaaatgaccaacgggaagcaagcactccttgtaatgtcacctagtcagcgagttggaagtattttagaactcggatacaagtcagcattccagctttgcatttccacgaaagaataaatcatgcaagatggactatttatctgttgtgtttcctgtg

SEQ ID NO: 640 - DNA, 1454 bp, Triticum aestivum
  Clone ID: PAT_TA_640
cgattcggcacgagcagagaacacgccgccgcggcggagcatcctcggcgcgccagccgacggcgccgccgcccgccccttccccctcctcccgcgccccaccggcgctgccggtttttccctcccctcccgctcacgggggcacaggccctcggtcgcacgccaggacgtagggagaacggggcggagccgtgggtgtcgggaggctcgaccgcagcaaatggccagtttcttcgcgctcctcgtcgtctccgcaggtgccaacgtccacctttacaagttcaacctcgacagcggggattaccacccattgacgtacggtcgggtgcgacggaacaaagtgtaaggcaaggatgtatcgatgacgggagtgatccatgggattggggaggttctttcgatgcaatttgcgagttttggagcaaagctcgtaccatctggacgtaacaaggaggagctggagagagtgaaacgtaacatcatcagcaagcatccagatagcaaagttgaagtgttacttatgttgttatcatctgatgaagaatctctgaaagaagttgtacattcaggggaatcactcttttccagtgcaggcattgactttatgatgcataatgcgctctttgagcgtccaaaaaggggggctctggtagtaactgatgagggtcttaaggctacttttcaaagcaatgtctttggaaccattactttgactagcctccagtcacttttggtgttggttctagagctcggacacattgttgcgatgaacgggtttcagtggaaagatgtgctaaactgacaatagttgccgcaactcatggactaaaagaagcatggatatcatatcagcctgtgctggctgttatgtacgtggtgcaatacatgccaacaattggatgctggattatggacaagattggtgcaaagcgagtggatgccgctgcaacaaaggcattcacctaaagaacgtgtctcattttcggtggcagctggtcggcttgacgatgaagttgttcattacgccaaaggagcatggctctcatatcagccggtggtcattgttatctacgtggtgcaatacatgccaacaataccctggtggcttattatgtgggaaatgaccaagcggaagcatgctgctgcaatgaagggccccgcctagcgagtggaacttcttttagatggcaaaaagacggcttgataatgaagttgctcattacgcctacagttggaatctcattgagattctgaaatagtcatacacatctatctatatagattatgaaccttgtcaccctttttcatctttatgtgcgaaatgaccaacgggaagcaagcactccttgtaatgtcacctagtcagcgagttgaagtattttataaaacagatacaagtcagcattccagcttcgcatttccacaaaagaataaatcatgcaagatggatgact

SEQ ID NO: 641 - DNA, 1795 bp, Triticum aestivum
  Clone ID: PAT_TA_641
tgcccctctcgcgatcccccgccagcgcgcccctccgtccacccaacggaagcaccagacggaggggattctcctctccgacccggcgtccgcctccgcctcctcctcggctccaccggtgcgcggtggagatccgcccggagcccgcccgcccagggattgatcccctttgctggtatagaggaatagcagcttctgtggtgctgtagcttgcgtcttctcctcgtcgtggcggcgcggcaataagatcaagatgggcgacggggtggcttttgaggctgccaggaagatcatcatgcacccgctctacgcgtcgaggtcctcgccctggctcgacctcaaggtgttctacgtgagggtcagcaactgcatggtggacgagtccgcgccggaccatctcacgctcaaccacatcccgctgtcccccgacacggtcatcgaggtcaacgggcggcggagcagcatgcacaccgagttcgtctcgtcgtccctcagaagggacaggatcgacaagaagaccgaggaggccacgtacgtgagcacggatagcataaggatgacggggagcgtaaggttccaggtgtttgataagaacgatctcttgctcaccggggacctggagttatgcaatgccaatggtgtggtcggggaaccgaagagcagcagcaagaaatggaatatcagaagccaatcctcggcatcgtctagtggtttcttgaaggggaagatgtccacgggcccagactctgcgcatcctgttgtcgaggtttacattgctggcactttctctggcacgccaattatattaaccaagacggtccagtatatatcacggaggaagtcccagatgaaactgaagctggactctatccctgagaatgaagcaactgaactacatacagagaactcacacggggactctgtgaaggtatcagaattctatgatcccaagtctgagacagacgtggacatggactataacagcttgtactcgaggcaggactttctagagggcgaggatggtgagctttcatggtttaatgctggcgtgcgggttggagtcgggatcggcctcggcatatgcgtgggcgtcgggttgggtgttggcctgctggtccggacataccaaggcaccagcaggaacttcaggcggcgactgccctgatggccaacgcttcccacaagtatataggaaactgactgcccatcttgctgcccatgctagtgatagatgagcgaggccttgtgttctcccctcctgcagcttgtgtgcactgccaaccatttttgtccctttgaggtatgtaaatgcgagtatgtatatgtatagtaaaaataaaataaagagtcgagtcgggtcgagtcgcttgatgttgctgtgagcattagatggttctttctgaattaaaaatgtattgatgaaggaactttaggtgaccggcaagtgcagtgtttagtcctgagggtgatgttgcacctaagaactgttgcaagccatgacttgttgtgcagagggaacctgattaggtggcctgttatgtgtgtcatatggtttactttgagctttttctcgaacttttgatggcttttaggcttgtgttggtcaccactatccatcttgcttcgaaatgcgatctagagacgggtcttcatttttgtacagtttgtgctggtatgatgcatgatctctcctgctgtttataaaacaaaaatgtaaagccagactgattccagaacaaaaagaaaggtgtggaactcagctcacacttgcagtaaaaaaaaaaaaaaaaaaaaa

SEQ ID NO: 642 - DNA, 885 bp, Triticum aestivum
  unsure (1)..(885): unsure at all n locations
  Clone ID: PAT_TA_642
ttttttttaagaaaacatattntnttgaactcgcgtggttaggcaatttcagtttntacagcacttctcggcaacttataggaggttgtaaataaattncaaaatggaagcatccttacggacgagaccaacccacgcgtccgaagagccagtagcttattcgccgctcgtcggcgccttgggcggcgccggcgccggccagacgctgatccgctccttctcgtacttgacgtacacggtgcccgccgcgacgatcgtgtacacctgcaggaacagcgtgggcgcctggtggtacttgaccagcgacttgccggagccgagctccaccagtagcagcgcggtgaggcccaccgtggccagcaggccgttgagccgctcgctgtaggcggtgaagccgaactccacgggcaggccaagcgccgaccgtggctcccgcagcggcaccggcggcagcgtgacggcgttggactcggcggcggccttcctcttgcgcgccccggcgctgccccgcttcttgggcccgacgcgggacttcagctgcagcacgcgcttctcgaactcctcgtcggcggcgggggcggtggcgaccggggccggcgtctccggcccggcggcgtcatcgccggagcttgcgcggaggggaggcagcggcggtgcgtggaggcggccgtgccagagcggggcccggagggtggtgacggagaaggggctggagagcggcgtcgccattgctcccttgggcgcatgtgtgcaccagcacttcatggtcgcgcggctgcttgcttggctccccccctctcgtgccgaattcggctcgagacctttcggtgatgcgtggctccggtgcatgcacggggcccttgaaagctgccgcacgttgcaaat

SEQ ID NO: 643 - DNA, 709 bp, Triticum aestivum
  Clone ID: PAT_TA_643
agggcgttctgaagcttatgaaagtggaaggcctgaccatctacggacgcgtgggtttgcagaactatcgacatgtgaagtatattccggagaaaaaagaagtgaagagaccatgttcagaagataacaaggcaaaatcaacatctggaattgattctggcaaaaagaagagttttcaaatggctgaagctctacggatgcaaatggaggttcagaaacagctccatgagcaactagaggtgcaaaggaaattacaactgcgcatagaggagcatgcaagatatttgcagcggatactagaacaacagaaggccagaaaatctctggtaccgaaaccagaggagaaaacagaggccagcaccacttcagctccgtcgctgaagtgtaaaatttccgacaccgaaatagaacagaacttgcaaatggatagcagaaggccagagctacaacttgatcttgaaagtgaaccgtaatgaacgatcatggtgcatgctttaatcttcttgccatgtagagttctagtgcttgcaattgcatatatcctgttttccttgaatataccttatgacaaggttctagctaagccagtgtatataagtagttctgctgcttgtttccaggaataaacaagatattctcatctgtaattaaactagcatttgcagttcaaacatagatgtcacaaaaaaaaaaaaaaaaaaaaaaacgg

SEQ ID NO: 644 - DNA, 698 bp, Triticum aestivum
  unsure (1)..(698): unsure at all n locations
  Clone ID: PAT_TA_644
gtcatgtgacatgttccttttgcatgctgcccagctttgtggacttcctaaacggctgcttgggaagcctcattctggtttgactgctagagctgtgctcaaggcctcccaaaacgcagcgttcaatggattaataacctcggccaattccagaattgatgaattcatgctgctgctgaccagcatcgattggacaacagaggaaactccagaacatgcaaatgactacatgaatgaagtcctcatctaccttgacatggtggtatcgactgcacagcagattctgccgagagaggccctcttcaaggtcatttctggttcactcagccacatctcagactccataataacagttcttctcagcgacagggtgaaaaggctgagcatcaatgcggttgtaggtatcgacattgacctgaaacagttagaggagtttgcagaagacagatttcacaccactgggttgtcggcccttaaaaaggaaacaaattttaaagattgccttgtcgagattaggcagctgactaatcttctgctgagcaaccacgctgagagcttcatgaaccgctgtgatcagggangaaagagttatgcgtccttggaccacaagaaggtagccatcatctgcgacaagtttcgggatgctcctgacagcttgtttgggagccttttcagtagaaacatggtgccagagtgct

SEQ ID NO: 645 - DNA, 882 bp, Triticum aestivum
  unsure (1)..(882): unsure at all n locations
  Clone ID: PAT_TA_645
cccacgcgtccgcccacgcgtccgagaacccacaccaaccggctcccctggcccttacccctcccgatctggtcgatgccacaatctcgccaccgaatccggcgttgcccacctcctcttccaatcttgtgagctgcagtccgccaccaccgatgccgctcggttaccgtccggaacttgccacttgcgatggtccgaggccgccgaagccggcgacttcgaagcatccgcccggagctacttcgccctcgacgttgaggagggagtgggcctaagctcctggtctcccagggcccgccgccgctgggctcatacatggcgccgatccggtcaccggccactgctccctctcagttcgtgctccctacctcaccttcccctgtttttgttccgcaggttcttgaggccaggtgcgggcgtgcaccaactagcgactcggagaggagctttggcggtaaggaccatacagcttagtttctcctgggatcacgttctccgaacgtccattgagtttccgagcaaagtctctgcctccaagttcaatcatctacacatccacgccgaggcggggagcttgtacatgtgttcctgtaggctgtactaatgaaggaagacaagcaagtcgtcgattgctgcaattgggcggtagggaagatcggagtcaaccagtgtgacgggttgtcaaggcaacagtaaccttctaaaggaccttctatagtctcctgccaacgccggattanatcgaggtcgcggttgatttggtgaattgcgcgtacctagggctgaaccgagaacgctggngagggatcgcctcatgacgctcggagaactcgtcacactcggcagccccaagcagcggcccaaaacatcttcaagttcaat

SEQ ID NO: 646 - DNA, 1612 bp, Triticum aestivum
  Clone ID: PAT_TA_646
gcagggctggaagtcaacgtgctgcttaatcctaaagatgagcaagttatatgttacccggatcaggatgtgcaaggcatggatcagaaggtgggtgcaggtctggttgcaccccttccgcaatcagcggttaagatggatgaaattcctgttgcaccccttccgcaatcagctgctaagatggaggatgaaattcctgttgctgctgttcccctttccctgtctctcgccatttcccttcccccatcagtcaaagaggtggataaagctcaggttgctgctgttcctcttcccctagcagttgaggaggatgttcccaaacccacacaaaaagttttcaaacgtacagagagtacacagaaagttctctctgataagatgccttcaaagaagttgaaattatctcaagatctcacaacgaagaatatgccttcaaagaagttgaaactatctcaagatcttacaacgcaaagtatggccccagttcctgacgtgaaagttcgctctgttccttcggcgcaactaccaacaaggcaggctgacagaagcaaatggttcaaaccacagccatggcatgaaaaactagcacaagctgataaggaggggaggctggtgtatattcagaatcttgacatacggtttggagcttctgaaatagtggaacttattcgtgaggcactacaactatcttgtactgctaagcctattaaccacccgacctacgatgatcctaacaatggaaaagcatatgttgtattcaattctagaaatattgctgatgacgctgttatgaaaatcaattcaggtttggttgtgggtggaagacccctttactgcagcaaagggttacttaaggtcccaaaaccagcttcaggagctctggttgggcacttaaccatcagtaatcagaaaatgaacccaagacaacgagaagagcagaagaaggcagtgtcaacatcacattgttctcaacccaatacaatagaatatgacctggccttggactggatgcttgtccgagaaaagcaagcaatgaagttcagtatgcttcataagaggcacgcgggtgagaggaagtcgtttgcagcaaagatggagaagtaagtagcttctttggagtcgcttaaccaaaatgtaatgggaaccggccagatggagttgtcaactatcaccccttggagcttggtgtgttgttcacccgaagcaacacttatcttcaagcttttgtcgctgtggcaaccttatatgcgctgatggtttatgtttggcttcgactgattgaatttcgaggtgggactaactgcaacgtaggatgttctttcttcaaggagggaaatgtataggggtggaaattatgaggacattagcttcaggaatcagagtagtgggaaatttctcatgacatgtcttcaggagtcagagtagtgccgtagaagcaagtagccctttgcagcaagccggaggcggttttagcttaacagtaagccagccagcgtagtaacggtgcccatctgctgctgcgtgtttttggacagcaaatcatgaactacagtatgtagtatgttcccaaagttcacggcttggctatcttttctgctaaatgtaccgaaaa

SEQ ID NO: 647 - DNA, 647 bp, Triticum aestivum
  Clone ID: PAT_TA_647
gcagatatgggatactgctggacaggaaaggttcaagagtcttggtgttgcattctaccgtggagcagactgttgcgttctagtttatgatgtcaattcaatgaaatcatttgataatctgaacaactggcgcgaagaatttctgatccaggctagtccgtctgatcctgataacttcccttttgttctgctgggaaacaaagttgatattgatggtggcaacagccgcgtggtctctgagaagaaggcgaaggcttggtgcgcctcaaaaggcaacatcccttactttgagacatctgcgaaagaaggaacaaatgtagaagatgcttttcagtgcattgtaaaggatgctctgaagaatgaaccagaagaagaattgtacattcctgacactgtcgatgtggtgggtggcaaccgcacccaaagatcatcaggctgctgttaagcacgccatggccgtagcaaccattgaatatgcagtctttcgtgcctgtataatatcatgttattctgtattccatttgttacttgaccaatcaccccttcggtacgaaatcagggatcgatgatctgtcctgttctgtctgtcatcttgtatgttgtgtgatttgttgtgaatacggcggaatgaataatattgtctggcc

SEQ ID NO: 648 - DNA, 1097 bp, Triticum aestivum
  Clone ID: PAT_TA_648
gtcaaacgggagcagatgctacgcgtcccatccctgtggtctgtcctgttgccaaacgcacccttgttccccgcctgcgacggcaaggcagcaaacgcgattacgcaagcttaggtttcgtctctccttcctctgtccccgccccacctcgtgccccaccctacctccggcgcgcgacgagcgcgagcaagagcccttggtagatagatcccgatggcctcgcgacgccgcacgctcctcaaggtcatcatcctcggcgacagcggggtcgggaagacgtccttgatgaaccaatatgtgaacaagaagttcagtaaccagtacaaggccaccatcggcgcggatttcctcacgaaggaggtgcagttcgaggacaggctcttcaccctacaaatatgggatactgccggtcaggagaggtttcaaagtcttggtgttgcattctaccgcggagcagattgttgtgttctagtttatgatgttaactcaatgaaatcatttgataatctgaacaactggcgtgaagagtttctaattcaggctagcccatcagatcctgataacttcccttttgttctgctgggtaacaaagttgatgtagatggcgggaatagccgtgtggtctctgagaaaaaggcaaaggcatggtgtgcctctaaagggaacatcccatactttgagacttctgccaaggatggaatcaacgtggaggaagctttccagtgtatagtaaagaatgctctgaagaacgagccagaggaagaactgtatatgccggacaccgtggacgtggtgggtggcaaccggggtcaaggatcatcaggatgctgttagaacctgaggccacaactgtcagctattcctttgactactgtatttccatggtgacttgtggacccgtatttcattcgtgacctttttcaatcacctcgtaagtgcccaaggaatgattgatgcgtctgttccgagctgtcgatttgtggacgtttgtgtagctttatcatgaatagcatcatatcttgtgaatacagtcaggcgaaataagtgaagtgtaaactacagttgcttcattatggttttgtgtgaaagaagcttgt

SEQ ID NO: 649 - DNA, 1277 bp, Triticum aestivum
  Clone ID: PAT_TA_649
tccggcacccggcccaagcgcaccgcgcccacccgcctgtcaccccagtcgacgaaccgcgactgctcaagctcatgcgtcgcctctccccccgcctcccccgccccctctcaggcccctccctcgcgccagcgcgacccctccccccgcaacccgcctcccgaccttcgatccccctcgcccccgcgcgcggagcgctcctccgagccaccgccggcacgcgacgaccccggtggcgacgcaccggccgcaccatcctctaagtcaaccacgtaggaggcagtcaggggttcaggcataccatcctacgaggaactcctcggcaaaagaagaagtccagcaacggataggaggttcccaccggcagatgttggattccgcaggtaggggcagttctactgaagcgctgtttagcattctatgtttggaacgttccggttctttatagattattttaaatcttttggtgatatcaattgataccgcgtaaaacggttcgctaattaaagtctaattctattgatagttcccatgaatctcgatcattttttttttagtttagcacggtaaggccgtttgtagggaatttcccattagttggcgagcccaacgaaatacatggtataggcttagctgatcctcctataggttaagacccttacattggagatatgcggcgaaaagaagggtcaaatgtagaaaacacttttcagtcctgtggaaagaatgcaaggaaaacaatgaatcccgtagaagatgttctacatgcctgacaacatcgatgtggtgggtggcaacctgcatccaaagatcatcacggctgctcctaagccatgccacgccataggcccgtaacaaccatttgaacgtgcggtctttcctgcgtgtataatatcatgttattctgtgttcccgatttgagacttgaccattctccccttcggtacaatatcaaggatcgatgatctttcctcttcagtttcttcttttcttttttgtatagtctggtgagagtgcggcgttaagaataccgttggttccacaatgttaatttggggacgtttgtttagttttatcatgaatagggtcatatacttgtgaaaacagtaaggcgaaataagtgaagtgtaaactacaggtgcttcattaaggttttatttcaaagtagatctttacgaaggatatttagaagccatgctaagggatctcaggatctgtcactatcatttgtacagatcagaaaccccagtgaagtaaaagaaaccaataatttggag

SEQ ID NO: 650 - DNA, 654 bp, Triticum aestivum
  Clone ID: PAT_TA_650
cccacatcgtccgcccacgcgtccggggagggcggggacgatgccagcaaccatggccggcatcatgcgggccatcttggcctgcgtccccgccgcgccatcctccaccggcgacggctccctctccgctgccttctcctcgacctgccccggcggcggcggcgaggatcgcatcagccgcctcccggacgcgctgctcgccgacatcgtctcccgcctccccgtcaaggaagccgcgcgcaccgcagcgatctccccgcgctggcgccgcctacggccatcgacgcctcttgtcctcgacgacaccgacatcttcgatgacttcgccgaagccgacgacgacgacgacggcgacacctttggcctcatcgactggcgcgccctcaccaataccctctcccgcatcctctccggccacccgggacccttccgctgcgtccacctcaccacggcttgcaactacgcgtccgctcgcggcggcagtgcgctcgtccgctggctccacctcttcgccgccaagtccatccaggagctcgtcctcatcaacttccccaactggcccttcaagaacaccctccctgcggagatcctccgcggtcgcctccctccgccgcctgtacctcggcctctgggacaagttcccggacacaaatg

SEQ ID NO: 651 - DNA, 1057 bp, Triticum aestivum
  unsure (1)..(1057): unsure at all n locations
  Clone ID: PAT_TA_651
ccttcctttgcagccgctgacggacgctgggacgctggccgcgcgccatggcccggggttctccctccgcctcggctcgcgccccgccgtcgtcgtcgcctcggcggagctcgccagggagtgcttctcctccgagctcgacgccacgctcgccaaccggccgcgcttcccgtccttgaaggaggtctccttcgactacagggcgctcaccgtcgccagctacggcgctcactggcgcgccgcgcgccgcgtcgccgtcgtgcacctcctctcagcgcgccgcgtcgacctcatgtccgacgcggtcgtcgcccgggagctgcgcgccctggtgcgccgtctcgcgcgcgtcgccgccggtggcgcggcgagggtggagctgaagcggcggctgttcgacctctcccacagcgtgctcatggaggccatcgcgcggagcaggaacacctactccgacgacggagcggacatgtcccgggaggcgcgggagatgaaggacatcgtggacgccatcgtgccgctcgtcggtgtcgccaacctgtgggactaccttccggtgctgcgctggctcgactggcgaggcgtcaggcggcgtctggccgacgcaacgagccggaggaacgccttcatctataagctcatcgacggggagaggcagaagcggttgaacgctgctgcggatgccgctgacaagcagcaggaggagcaggagcagagcatgatcggcgtcatgctctcgctgcagaagtcagagcccgagctgtacacagacactttcatcgccgcccttgtcgcaaatcttcttggcgccgggacggaaacgacgtcgacgacgacggaatgggcgatggcgctcctgctgaaccacccggcggcgctaaagaaggcacagaaagagatcgacacgcacctcagcctcagcggtgagccgagccgcctcctggacaagaaggacctgccccacctcccttacctccactgcatcatcagcgagacctaaccggctgtgccctgccgcgccgctgctgctgccacacgaggccgncgccgactgcag

SEQ ID NO: 652 - DNA, 771 bp, Triticum aestivum
  Clone ID: PAT_TA_652
cccactcttccggtttaggcttactctgatccacaagcgattgctctatgtttcttttttcatgctcttcaaacaagtggtgttcggttgtttactgctattcaagaggaaaataattcaccaccacaagattttctccatggttcagccaaacgaattctcacaagtttgaagtcaaactccattgaagcaacaacttttggacaagattctagttcacaggatgaagcatatactgcaggatactatacatcatctagaggtcccgaggccagctactatggcttacatgccaccatggatgtgtatggccacgaattaaaacatggtcagtggagttcgactacattttgggtttctcattacggagatggtaataaatcaagctataatgagattcaagttggctggcatattcgtccagaacgctatggtgactcacaccctcacttctataccttatggacgagagatgggtttgaaaccggctgctacaacatggactgccctggttttgtacgtgcaaatgacgctgttatagctccaggtgatgctatacatccggtttctcatgtccctggacctattcaaaatatcactctcagagtgtttaaggacaaaacaagtggtgactggtgggtctattacggcttcaacaacatccccacaggggtgggatattttccgaagtccatattcagctacttagcacaaaaggcaaatgtaatgtctttttgtgggatttgttaaatctacaaaagcgcttccaac

SEQ ID NO: 653 - DNA, 863 bp, Triticum aestivum
  unsure (1)..(863): unsure at all n locations
  Clone ID: PAT_TA_653
ggagatnatctatacacgcagggaatcttccaatacatggccagaagtattaacaccatcagcgaatcagaaacttcaggaagagatgaacaaagctctttcactcagtgttgtttgctcaactgaaaatgatggaaacaataatgtgttcgaagtatgtgatggttcggtctatacagtcaacattgatacatgggagtgcacctgcagaaagtggcatgtgtctgggattccttgctgtcatgccatcgctgtgtttgagcaaactgatcagaatccagtcgagtactgtgccaagtatttcagaagagattactaccgcatgacttacgccatgtcaatcaacccgatacctgatgtcattgtacctcctgcatcaactgacctaacgcagagcatgggattgcaaccatgccccattctagcccgccgccaagttggccgaccaaaggaaaagccagctgatcctcgtattgcaattaaaagggcggtgcgctgcagcaggtgcaagggctatgggcacaacaaagcaacttgcaaagtccctctcacagcataagttgtacttgctgttatcagttctcagaatgtacattatgttgatagttgctttccttctccttaatgaactctagtggtaccttttatgtgaagattttcatcgttcatctgacaatgtgcagaacattaccttgtctttgtgtggatcatagcccgaaacgtgttgtactgctgctgtgcgttatcattgaatatttagaaacatttcctagtaggcggcatggggaaagattttgaaggttgtgtgaactgaataacttgatgcacactgttatatctaaaaaaaaaaaaaaaaaaaactc

SEQ ID NO: 654 - DNA, 832 bp, Triticum aestivum
  Clone ID: PAT_TA_654
ccccggcccgacgctatacttaaccgcccgagcacataccgcccggccaagggcccacggggagggagcagacgtcgacgaagactggcggcccgacactgctcatgctcggcctcctgctgctctcgctcttctcagtgggcacagtgtcggcgcagcaaaagttcggcatcaactacgggcagatcgccaacaacctgccggaccccacgcaggtggcgggcctgctccggtccatgaacgtgaaccgggtgaagctctacgacgcggaccccaaggtgctgacggcgttcgccaacacgggcgtggagttcatcatctctggtgggcaacgagaacctgcagaccatggcgaccagccccggcgcggcgcggcagtgggtggcgcagcacgtgcagcccttcctcccggccacccgcatcaccggcatcatcgttggcaacgaggtgctgggcaacaacgacaccgccatggcggccagcctcgtccccgccatgcaggccgtctacgacgcgctcgccgcgctcgggctgagcggccgggtgacggtctcgtcggcgcactcggtgaacgtgctcggcagcagcttcccgccgtcgtccggcgcgttccaggagggcgtggcgcagtacgtgaggccgctgctcgacttccacagcaagacgggctcgccgttcctcatcaacgcctaccccttcttcgcctacaaggggagcccggggagcgtgtcgctgccgtacgtgctggcccagccccgccccgcccggcggcgcccccgcctgcggcaccacgccgtgcgcgccgcgcggatcgacgccgtgtacgcggcca

SEQ ID NO: 655 - DNA, 889 bp, Triticum aestivum
  Clone ID: PAT_TA_655
cgagctcggccatctcagtccagccctgtagccagccagtcggcaagcagggagcgcaatgccgccgccgtcgcccgtgtgcgtggtgtcgtcgcgcacggtgaagccgccggctcggccgcgggagcgcatcccgctcgccacatgggacgtctccatgataaacgccaactacatccagaagggcctcctgttccccgctcccccgccgcccttctccaccggcgccgccgtcaccagccacctcgccgacgccctcgccgaagccctcgggggcgactactaccctgtcgccggacgcttcgtcaccgaccgccaccgcgatgacagcggggccgttgttgggtgctcggtctctattgactgtgacggccagggcgtcgaggtcgtccacgccgtcgcagacggcgtcgcggcggccgacgttgtccctcccgacgccgacgttccgagtgtcgtcgaggaccttttcacgctcaacgacgcaatcaactacgacggccacgagctccccctcttcgccgcccaggtcaccgagctcgcggacggcggcgtcttcgtcggcttcgtctgcaaccatgcgctcgccgacggcacggccttctggaacttcctcaaagcgctggccgagatatcgcgcgccaggctcgcgcctccgggggatccgcagttgccgacgtcgtcgccccggcccatgttcgagcgctggtcgcccgacggcggcacggcagcgccggtcgtgctgccgtgcaaggacctgccggagctcatcgagagaccggcgcgggtgccgctccgcgggcgcgtgctgcacttcacggcggagtcgatggcggcgctcaaggaacaggcccgcgaagagctcctagctgccggggacgcggcgggc

SEQ ID NO: 656 - DNA, 827 bp, Triticum aestivum
  Clone ID: PAT_TA_656
cggattcgtgggcgagctcgaccgtccagctagcatcggcgaccagaggagccagtttgacactcaagcagccgcgtcgatcgatcggagttgcacgggacgcaagcaagctagctagcgcgaggtggttgcgatccatccatgcatctgctccacgggtctgctatgatcggtggcagctggggcggcagagctctccggcgagtcgacagctccccgaagccgtccttgtgccggagcgacgccatgaagaagaagaggagcaagaggtccaggctctcggccgcgctgcgggagctcaggctggcggccaaggcgagggacaaggaggggctccttcagatcctcgtcaccggacaccgcactagccgcggaggatccggcaacggcgagcgcaccggcggaccatcgacggagcgcggtgtagctgatacgggcgacgaccagcgcgcgacactgcggtggcagggacgcggcgttgatgcagccgggcgtgccgatggtcctcttcttgagttggggagaccgacagcaaccaggggagccagctgcggcggccgtcgttgcccgagttgggcgctggcagtggcgcttgtgctcgcgctggtttgcgtggtagcgctcgggacggcgccggccatctgttgctgcacctgcgcggcctggttgtgcggcggctgcggcgcgcaggagcatgcatctgaccggcggcggggcggctcctgccgtggcagcgttagagtaatacagccacaagccggtagtacactgtatcatgcagaggtcaccagtgggtgaactgtatgaatttttgtacagtatgtatg

SEQ ID NO: 657 - DNA, 735 bp, Triticum aestivum
  unsure (1)..(735): unsure at all n locations
  Clone ID: PAT_TA_657
cccctcggccgcccacgcgtccggggggggggggggccgcgtccggcggtgcggtgcggatggcgcaggcggaggcggacgtacccgcaacctcgctcttcggggcggaccgccgcctctgctcagccgacgtgctctcgcccctcgagggtcgggcaaggatcgagggggcggtgctcaatttcctcgccacgctctcgtctccctcttctccggccatccctgtcctccccctgatctcacgcaagtccaccaattgcagcctgcgcagcggcttgctgagtgatgtttcatcggtggatctgtcctacgccttttgcaagaggtcactaatgagagaaaatgatgccaaggcattcgtcagagtatggaaagtcatggagatgtgctacaagatcttgggcgaagggaagcttgtcacccagcgggagttgttctacaaactactatcggactcacccaagtacttcagctgtcagcgccatgtcaatcaaaccatccaagagtggtggtcattgcgtccggtgcgcaaggcgagaggttaggaatcatgggatcaagganaggggctctgattggacgacnttgtgttgcatgaaccggaggaagacacattgagtgtgccattgcttggccttctgggcatgccatactgggggatctgaaccaattgagcagattnaatttgtcttcagaagcccggtatctcattctaggggggaaggatgccatatt

SEQ ID NO: 658 - DNA, 1325 bp, Triticum aestivum
  unsure (1)..(1325): unsure at all n locations
  Clone ID: PAT_TA_658
cggcagcgtgggcccgatcacagttctgccactcgctcccccccgccttgtgcgcaccgcgggtggattgataagttgatgtatctaatggcatacatgccttcctgcggcaccttccatgcacctttagtgtcttcgtgcctgaggaggaaatccacagtggtgcccacggcttccctgccttcccgcggcgcctcccaagcacctctctggtcttcttgcccgaggagcaaaatcacggtgatggccatggcttccacggccaaggatggagttcccgggaaaggccttcagtcctcgcaaggcgcctcacagagaccgagtcgccccactcattgccacctgaaaagagacagattttggattcgcttaacagttaggccaggaggtacaacattcgtggatgcatctttgaagccggttttgaaagattcctggtcaagccacagggactaacctgccacacccttcctcggagagattttttgatgtagtcaaggacctgagggagcgagccgaggagatccccgatgaatacttggtatgtctggttggagacatggtcactgaggaagcactccctacctatcagaaaatgctcaatatccttgatggtggtgtccgcgacgagactggcagcagcccaaccagctgggctgtctggacgagggcatggacggccgaggagaaccgacacggcgatctcatgaacaagtatatttatctcactgggagagctgatatgaggcaggtggagaagaccatacagtatttggttggtgctggaatggatccaaaaaccgaggccaatccctatgagtttttcatttacacgtctttccaagagagggcaaccttcatatctcacggcaacactgcaaggcacgccaggaagtacggggacttgaagctggcccagatatgcggcaccatcgcggctgacgaaaggcgccatgagcttgcctataccaagatagtggagaagctcttcgcggtcgatcccgactacacggtcctggccttcgccagcattatgaagaggaagatcacgatgcctgcccacctgatgtatgatgggcaggaggacaacctctttgagcacttcagcgcggtggcacagaggctgggcgtttacaccgccatggactacgccgacatcctcgagttcctggtcaagaggtggaacgtcgccggcctcactgggttgtccggtgaagggcggcgcgctcaggattacctatgctccctaaggacaaggtttangaagctggtggagcgagctcaggggagcgggaagcagttgcctgttgttcctttcagctgga

SEQ ID NO: 659 - DNA, 999 bp, Triticum aestivum
  Clone ID: PAT_TA_659
cccgagctccaccggcgcggccacaggcgcggtcggcggcgacgtgctgctgcagtgggggcacaacaagcggtcccgctgccggcgcgactcctccgcggcgtcctcgtcggcgtcgccgtcctcgcagcgtcggcaggccctgggcaacggcaagatccagcggcgctgcgttagcgccggcgccggcggagaagctgatgccccctcctccggccgcccccccccgccgcccccgcctccggccccccccgcccctcccccccggcacgcccggagccttcgctcacgacccgccttcccccacgatcaggtccgttgaggagcgctcgggcggcgtgcacaagcggtcgtcgcccgacaaggcgccgcaccacaagccccccgccgcggagcatcacatggattccaagaacgcccaccaccaccaccaccaccacagcaacaaccacgactcgcagctggcggccgccgacaacggcacgggcgccggggagaagctgggcggggagcggctggagcttccccggatctacatctcgctgtcccgcaaggagaaggaggacgacttcctggtgatgaagggcaccaagctgccccagaggcccaagaagcgggccaagaacgtggacaagtcgctccaattcgtgtttccagggatgtggctctcggatttgaccaaaggccggtatgaggtgcgagagaagaaatgtgccaagaagaggcgaagagggctgaaggggatggagagcatggacagcgactcggagtgaagagcgcagaggaggagacgagacgaggacaaagaaagaagatggggatgtcatgtgtgtcagcgagcgaggggtgttacgttaggagaagaaacaaaaccggtagagggggcattgccgaaaggaatggacgcgacatttgtaaatggagatggaggaggcttggccgcaggcaaaagttcgcgtgcgtgctcgccttgcagacgaatgatgatgatgatgatgc

SEQ ID NO: 660 - DNA, 812 bp, Triticum aestivum
  Clone ID: PAT_TA_660
gttcagtcattgggaaattttgggttctgtgcacctaccctatggtgtaaaggatgtttttaaaactgtttacaaggaaggaggtgtacgatctttgtaccgtgggataggcccaaccctgatcggtattcttccgtacgctggcctgaaattttacatatacgaggacctgaaatctcgtacgatctttgtttagtgggataggccctatattgaagctctcttgtggggctttggctggtctttttggacaaacccaggattacccactggatgttgtccgaaggcaaatgcaggtataattcacattgtactcatgataatctatggggttgtaagtttgattgcaactctgattcgcttttgacctggtacgaatgcaggttcagaacaagcagccccagaatgcaaatgatgccttccgcataagaggaacatttcagggtctctttcttatcattcggtgccaggggtggagacaactgttcgctggcttgagccttaactatgtcaaggtcgtcccgtcagttgctattgctttcacgacatatgacatgatgaaaaatttgctgggagtacctccacgcgagaaagctcacccattgaccattgacagcaacaaatgaagcaacatcgacctatttgcgttttgggtctcatttgtaagctatgttgcatatgatgtacttaatagcaacttaactgttacatttgtcattttgacagatgacttgagcatttgagctgctctagacttggatatgattgtatactgattgtgcttcttgaataattgaattgataaatccccc

SEQ ID NO: 661 - DNA, 599 bp, Triticum aestivum
  Clone ID: PAT_TA_661
cgtccgcccacgcgtccgcccacgcgtccgctccttgtaccctccccacctgcgctgcgctgtgtgggttctttccccacctctcctcctcctacctcctaccctcccacctacctctctgcctcctcccctcatccttcttcattccccaattgagtcgacgccaggggagccacctgcgccgcaccgaggatcgtgtctcctggtcttgccccgatccagcaaattcgcccctttcttgctcttgccgcggcagagcagtccgaggagagattttcggagccgagactcagagcttccgtctccttcctcgttctcggattgttcttggttgttgccgagggtagtgcaggctgctagggttggccggttgattctctgcgcgtgcgggcggcgtatatacgtgtcatgagaagatgatgcgcgccaagggcaaagctacattcttggacgccatgaaggagaccacctcccccgtctctcccgcggcggccaaggaggcgctcaaggaggacgagtgggaggtgcggcccggcgggatgctggtgcataatcgcgacccggactcggacgcccccgcgggcgcgcccgtgcccacc

SEQ ID NO: 662 - DNA, 1833 bp, Triticum aestivum
  unsure (1)..(1833): unsure at all n locations
  Clone ID: PAT_TA_662
gctcgcgccttactattagttgtaccctgtccctccctcccacacaaccctgacacccacttgtttcttcttcctcctcctccccctcttgatttctccaattgggctcgcaattttggtttctcgtagcctcttcctgcacagctgctagcacatagagagagagcatcggtagcaagattgactcggctgggtagatagattagccctctgcggctctgaccagagaactatacacgcttgattaggaggagatcgaagccaagatgatgcgcgggaaggctcagaggcccgcggcattctccccgatgagggagtcggtggctggcggcggtgccggaggaggtgtgggaggtccggcctagcggcatgctggtgcagaaccgcaccccggactcggtcccgccccccggcggcgcgcccgtccccaccatccgcgtcaaggtcaagtacgccaggcgtgtaccacgaggtgtacatcaactcccaggcctccttcggggagctcaagaagctcatgtccgagaagacggggctgcacccggacgaccagaaggtggtgtacaaggacagggagcgcgactccaaggccttcctcgacatggtcggcgtcaaggaccgctccaagatgacgctgctcgaggaccccaccgcccaggccaagcgcctcatcgaggagcgccggaatgccgaaggcccggcgcgccgccaaggccgtctcgcgcgtcagcctcgacctcgacaagctcgcgtccaaggtgtcggcgctggagacgatcgttagcaagggcggcaaggtggtggaggccgacctggtcacgctcaccgaggcgctgatgagcgagctgctcaagctggacgccatcgtcgccgagggcgacgtcaaggaccagcggcggatccaggagaagcgggtgcagaagaacgtggagacgctggacgccatccgcgccaagacggccaagagaaacaacacacctgctgcaacggccaataaggcccgggcgccgcacctgccccctcgtccgccgccggcgcagcagcaccagcagcgccggcagttccagcccgctgcacccaccacggcgaccgcccccgcgccgcagaccgcgacggcgagctgggatacgttcgacctgctgtcctccgcgccctcttcttcgtcgtcggcaccggtgtctaccatggcgctggcgaccaccacctcgccgtccccgaggttcgagtgggagctcttctagaggtcgggacgggcccgcccacccgccacatgcgtgtggccacacgttcattggctcgatcagcctcgtctcggtcatggcgcgcgtcaactgtcacattgttcccttcttctctctccattctttccttccatctttgttttttctctttcgagtgtatattgatctcctcaaaaaaggcaacagccccagcgatatgattgtgcccagcgactcccaaatccccacgaagaagatacacacactcatgatctctatgcatgcatcgggtgtgctatgctgcaaataagtggtggccttatgttgatgaaggttcggaatttccacggcgaatttgtgtatagtattgtacggtgtacatcaaatcatcaatttaccattatatgtgcccctccatttgtcttatacatttgctccggggggcccggtccctgtttccccatcgtgcgcctctaccgcctcaggccctgcccggtgaggcggcgtgcgtgcccggccaccacgtcccgcccgtgcagcccctttccgccggtggtggtcttaatgtgaaggntttttaatggcacaaccaanntatatgggnaaataaggt

SEQ ID NO: 663 - DNA, 413 bp, Triticum aestivum
  Clone ID: PAT_TA_663
tgtgtgcaggtcttgctctcgaggctgggcgtcccgtctccccgtgcatgtggtctagtggtgtgcgtcgtgtgtactgggaccggggccgtgggggtggggcattgcgttgggcgctttgatcggctcgtgggcatgggccacgcgcccagtacccacgtactgtatccatcgaacgggctgcttgcctgccactgccactgtgtcactgtgtgtgcgtccgcgatggcgtacaagcccatagcagcgacgcatgcatacctataaatttgattttgcatcgattcaaggtatggcggccgccaccccttgcccactggggtctttccgcagtggcttcgggaacaggagcaaaaggggaggaacgagcaggcgaatctggcccaggcaggcgatgatcatgatcagggcct

SEQ ID NO: 664 - DNA, 1161 bp, Triticum aestivum
  unsure (1)..(1161): unsure at all n locations
  Clone ID: PAT_TA_664
ggtcgacccacgcgtccgcccaccccccaccacacacacacccagcaatggccccggcggcgcaggagcagtggtacatcatgtacgctgttccggatgtgtcggaagatgtgatgaagccccagaaattccccaacgcgacgttctccttcaacaaggttccgctaccttcccgcctattcgtcgagagcagcgtcgccagccccgccggacgcgtcgagtacccctacatcgcggccgccgaccgcagcggccaccttctgctatgcggttacgcctccttcgggctcgccgtctacatctgcgaatccgctcttccgcaggacgacgggcatcttcccccacgacggcggcttcaactgccgccactgcgtcggcctcatccgcgatcactaccgcaggcttctcatggtggccgatctcaacccgtgctttttcgaagaagatgtcttcttcacgctcttctgcacggtcgacttgtactcgtgggtcgagaaggagcccgactgctcgaaaatcttggataagcaacagtggcgcggtgatggcgttctcactcatgaaggtttgctctggtggttcgacttttcctactgtatacttgcctgcgaccccttccacgataaaccggtgcttcaccaaatcaagttcccgcatgtacaacacgagctgccctttgcaccgtccacaatcaacggtgacatactccgctgcttaaaggtgagcgaaggcagcctgcggtacgtgcagatccatggccccagacacgaaccggtggtcagcatgtggacgctgtcctccaacaatccgtcagaggcgcaatggaagccgacgcacgaagtgaggttggctgagatctggaaccatgagacctacaaaaggacgccgctgcacggngatgtgatccccactgtggcgcttgtcaacccgatgaaggcacacgaggtctacttcttcctggacaagcacatcttctctgtcaacctgcagaacagtagtgtggtgcantatgagaagtttgaagattcggggatgccggacctctcctcccgcctggtccatgcttggcagtttccaccggagctcaccgaatatcatcacttgcctggaaccgatgtgttgggtgccacgggaggtttatttcctgaatcaatatgactc

SEQ ID NO: 665 - DNA, 1141 bp, Triticum aestivum
  Clone ID: PAT_TA_665
gcctcgctgctccgccccgaccgcaactacgcgcccctcagcaccgacgacccctccgcctcctccagtagaggtgcggcgacggttgggctgccaccagcctgggtggatgtttccgaagagatatctgcgaacatgcagcgggcaaagacgaagatggccgagctggctaaggcgcacgccaaggccttgatgccgtccttcggcgatggcagagatgatcagcgagcaattgagattctcacgcacgagataactgacctgctgaagaggtcagaaaagaagctgcagaagctgtccatgaaagactcctcagaagattcgaatgtcagaaagaatgtccagcgttcccttgctacagacctgcaaactctttcgatggagttcaggaaaaagcagtcaacttatttgaagcagcttcgccaacagaaagaggggcaagatggtgttgatttagaaatgaatatgaatgggtctaagtcgacgtttgaacttgaagatgatgaatttgaggatgtgggtttcactgaggttcagatgtcaaaacttaagaaaagcgaagcgttcactagagaaagggagagagaaatcgaacaggttgcccaatcagtcaatgagcttgcacagatcatgaaggatctttcagttcttgtgattgatcagggaacaattgttgatcggatagactacaatgtacagaatgttgcggcctcagtcgaagagggctataaacagttcaaaaggctgagaggacgcagaagaaagggggcatggtgatgtgtgccactgtcctggtcattcttatcttcatcctgataatcctcctggttttgaagaagatccttttctgacttagccccctcttcttacggtcgtcgacgaacgccttccaagtgaacgccattcacatatactcttatgtgggtagcgactgtgcagtgccgtcgcgttggaattcaggaaagccgctgcccatttgcaccatatgcaatacgatttagcgatcccaaaagatggttcatccgcctgtgttaatagtggctgggccagcagctcccttgagtcttacacattttttgcagcactgctgagtgtagagatgtcgtattcatacgggtaccaatttttttttaaagtgaag

SEQ ID NO: 666 - DNA, 710 bp, Triticum aestivum
  Clone ID: PAT_TA_666
cccacgtttccgcccacgcgtccgcggggggggggaacttctctacctctctatgtgcatctctatcacaaacaacgctattgctgaattgcaaagcacattagttcgacgatgagaccgaagtttgtttcagcggcgatcttgatggtcgtgacggtgctgatcctcctcgcgtcgagctcggcgcgggtgttgggcggcgaggccttctccggcgagcccatcatcaagctgtgccggcatttgtataggcggcggcttgggggagggccagggccatcgtgtggtacacacagcccacacggtggttgcccacccaccggttgagaagcggcgcacataccaaccgggctgaatgtgtgcctcggccgatgttagctcatccgtccttcatttttgcactttttattggcttcttcgttggtagatcgcctggcaatcttctggtcgtggatgcggtcggtgtgcatcacgtgtgattgttctgttgctgtcatgttctggaggttttagttgctatttcgtattttggctgtaggtttcttcacataggtctgatgcctggtgaggtgcagtttcgtaaggccccctttgtcccatggaccttgtgaatctgatcatgtcgtgtgtgtggtggagagaactaggttgtagcctagtggcaagggagccgcatggcgtgtttagcaactagggttcgagacatgtcg

SEQ ID NO: 667 - DNA, 438 bp, Triticum aestivum
  Clone ID: PAT_TA_667
gttcagaacagtcagtcggaaccgcaggagccatcttcaccttaatctaaaaacagaagtttttccttttgctagatctctgaaaaacccgcagtggagtaagcgctggcattacctacctagattcagcatatgtattggttcggtcggttagcgtcgtggggccgctctctggtttttgaagtttattgcagctggcaaagccccgcactgatgttttgagtcccatcgttctctgtgtggaaaattcagaatcctaatagttctgtggaacacttgttctggtctgctcatcttgtaattttcgttttggaacttgactattgtagggtagacagactcctatacatactgaagaaatgtgcccttccatcaccattccattccatggttcaaaaataccggtcgttcgtttctacatacagaagaaatgtgccc

SEQ ID NO: 668 - DNA, 963 bp, Triticum aestivum
  Clone ID: PAT_TA_668
aagaggaagagggagttgcgacatgaccccggaaacagtgagaagcagcaaaagaaagtgaagcacgctgcacaacgtggccgcgctgctaacaggactgattctattttaccaactcccactgtatttatgcctcatgtgcatcaagtaggttctacccaaccatttaatcagattgtgcatccatctcagcttccgattcctcctcggctttcctatgggttgccacaagcacactttcatccaggtcctcatatgataggacaacctcatggtagtttcatctactcgacggatcctgggattcaactgcagcagcaagcccggcatatgtttgttcctttgccagtccaccagccagcgattaataggtcgtttcacccccatggtttcaacggggcacatgaggtcctgtatgatgacaatagctggttaccttacggaatcaatccgaattacaggagggtatgacaggtgcagcagcttgaggggggcggtgtagccagctaattggtggggaactgtggagttgatgtgttgtagaatgaaatgtgcattagcattcatgtaacaagttgttttgtccaaagtgacggcgaaagggaaaccgaaagcttttctatgttggtctgcggtgagcagattgtaagtttattctagacttggtaattgctcagcgttgaaatatttttggttaggagcctgggtgaagatttgagatggccaggtagatagcactgcagcaaagaacaaaccagagtagctgctgccaactgtttgcccatgtctgttttgtaatgaatgagcgaacctatcagttcgtatgaagcaactgttgtaattcagctgacaaaccagagtagctgctgccaactgtttgcccatgtctgttttgtaatgaatgagcgaacctatcagttcgtatgaagcaactgttgtaattcagctgtagcaaaaaaaaaa

SEQ ID NO: 669 - DNA, 943 bp, Triticum aestivum
  unsure (1)..(943): unsure at all n locations
  Clone ID: PAT_TA_669
tgctcaagtgctcccatctctccccttccgccgttgttggccgccgccgccgactcgccgaacctcttcctactctgcacacaagttcatcttattatacactacattgtatccgtggccttgtttgtcccttgtttggcggcgtcacaatccgccgctgtttgatcttctctactactagcagattgctcttctgtctgattgctgatttactagtccagttggaggattgttaaattcgggattgaggattcgattgtaccgctaatgtttggtaacaaaagcgggtttcaccgtgtcaatgaattagtttagttcgaccagtacggactaatgccttggatactgtatacgttctcgactggactcggagctgacactagtagcatggctgatgcaggaaactgaggcaaagaagaggaggctagagcgcataaaccagcaaaagcttggactgctcgcggaagtcaaattcttgcggaagaagtacagtttgtttgcgaaggatgatccagagcaaacacatcacaggctaaagaagaagaaggctaagcaaatcccatccattctgggaatcaatgaagggccatccaccagcaagaacacaaatgtggacttgaatcatgattctgcaatgaatgctgaggaagccggtttccaggacatccagaacctgggaagcatgatcaggctggtgtagatgaagatataatggcctccaatatcaacttatcagtttatagggatacagaaaattccccagccagtgatgataagagggcagccgcatggcaagatcgggtagccttgcaggtctagtcccgccggggaaatgggtatggcatggcatccttctctgcccgtagactgcacccctgcctggtttcgtcaaatatttgcctagtactctgtanatgaacaattgatataaggatactcatgc

SEQ ID NO: 670 - DNA, 470 bp, Triticum aestivum
  unsure (1)..(470): unsure at all n locations
  Clone ID: PAT_TA_670
aggtacgagttcaggaccggggaggacacgttgtcgaagaagctttacacggctctgacgtcgatccagatgggcctggcggaggacaagaagggatggacggtcgcggttgattgagtaggataacagcgtgggcgcatgcggcgccggaagcattcatcagcatttcttatcatgtcttgccaatgtgaataataatagtgatggtgatgatatctcggggatgtcacggcccgaagggtgatggtttctctgatgctactgatttcttgggaaatatggaaagagagaaatgcacgtgtgttccgtaacaacgcagttcccgtgggtgttcttgttgctcgaactaaaaaggaagcttctctgtggggtgacatttttatgtaatattatgctgagagtgaggcttgtaattcggcccctggcctagaccctaaaaagattctttntattcaacgaaaatggtaagc

SEQ ID NO: 671 - DNA, 1554 bp, Triticum aestivum
  Clone ID: PAT_TA_671
gtgcaggctcatcgttcctttccgtgattggtttcgattcgtttgcagtttgatcgatcgccaatggcttttctactcgggacggacggaggcggcggccgctctcttctcccgtcccggtggaagtcgtcgcagccgcagctggaccccgtcgacaggtccgacgaggagggcggcggcgacatcgactgggacaacctcggcttcgggctcaccccgaccgactacatgtacgtcatgcggtgctcgcaggaggagggcggcttctcccgcggcgagctcgcccgctacggcaacatcgagctcagcccctcctccggcgtgctcaactacgggcaggggctgttcgaggggctcaaggcgtaccggagggcggacgggcccgggtacatgctgttccggccggaggagaacgcgcggcggatgcagcacggcgccgggcgcatgtgcatgccggccccgtccgtcgagcagttcgtgcacgccgtcaagcagaccgtcctcgccaacaggcgctgggtgccgccgcagggaaagggggcgctgtacctcaggccgctgctcatcgggagcggggcgatcctcgggctggcgccggcgcccgagtacaccttcatgatctacgccgcgcccgtgggcacatatttcaaggaaggcatggcggcgataaacctgctggtcgaggaggagatccaccgcgccatgccgggcggcaccggcggggtcaagagcatctccaactacgcgccggtgctcaaggcgcagatggacgcgaggagcaaggggttcgcggacgtgctgtacctggactcggtccacaagaggtacgtggaggaggcctcctcctgcaacctcttcgtcgtgaagggcggcgccgtcgcgacgccggcgacggaggggaccatcctgccgggggtcacgcgccggagcatcatcgagctcgccagagacagcggctaccaggtcgaagagcgcctcgtctccatcgacgatctcgtcagtgccgacgaagtgttctgcacgggaacggccgtcggcgtcaccccggtgtccaccatcacctaccaagggacaaggtacgagttcaggaccggggaggacacgctgtcgaagaagctgtacacgactctgacgtcgatccagatgggcctggcggaggacaagaaaggatggacggttgcggttgattgattaggataacagcgtgggcgcatgcggcgccgggagcattcatcagcatttcttatcatgtcttgccaatgtgaataataatagtcatggtgatgatatctcggggatgtctcggccccccaggggcgatggtctctctgatgctactggtttcttggaaaatgtggaaagagagaaatgcacgggtgttccgtaacaacgcagttcctcgtgggtgttcttgttgctcgaactaaagaggaagcttctctatggtgcctagctagggtggtgccttgccggggtgttatgtctcggcggtgtggcttgccgctccgcccaggcccgtgtcccgcccgacccctgcctctcaaaacttttatt

SEQ ID NO: 672 - DNA, 1895 bp, Triticum aestivum
  unsure (1)..(1895): unsure at all n locations
  Clone ID: PAT_TA_672
gatcctaataggatctttcgattctatctactcggtggtttgattngttcgacaacccaattacaaagagaagagggatggaacgagaagagagccgtctgggagatgtgacaccaattgggtatcctttccggaagtctctccaccgcccccgttgagagtcgccaccaaccacccggatccagggccggtacatacatattcggggccctggggcgagacgataaaatggggcccttgtgtacagaaaaaaaattcagaatatagtatatttccaaagcaatttagtaaggtattatacatactagcatagattgatggtctttgaactaaaaccacaagggaggtgaaaaacacacattcagatcttgttgtttctcctaacacttctggaagaaaagttgtcaataaccacatcagtatttatttcatccaatttttctttctcaatgcataaagtagcaagaatatactgttttttttcactcttttctcaatgataaacattttttagaagacatatcaccaaacaattgcagtaaaacagtcaatacaaggaacaaaaacacctgaatataggcatatggcttgatatcgaattgtcgatgtagcttcccagatctgaaggctgcaacactcattccccgtctccccttctcatcccatctctgatgcggtgatgcctcaagcgtcttcttgatggggaacgttgaggatgcagagagatgattacggaaaggaataccatcattggtctccattaatggatgcacggagcggctcctcgaatttagaagtgcacgggagcggcggcactgttatctgggattggagaatttgggggaggagccgaggaggcgaggaaactagagacaagaccggaggagatcgatggagcgctgcagcagcgtagcgaactagctatcgatcctttaggtccgtgagtgctactacctgggccggggcccctacctcctaggggcccagggcggtcgccccgttgccccgccctatgggccggccctgcccggatccggtccctctcgccgccggcgctcgcgttggtcgatgtagagctggattgggatgccggttccccttgtacagcagtagatgtaggtttagatgtagagctgggcgtggtctcgtgtttgcccatgtggcgtatggcgtgatgccgctctggagcttgtcctcggcgccggcgagcggtgctgaggtgtggatgacctcgcttgcctgtcgacgtccatggagggcggcggcggaggtcgaggctggccggagctccttccccaataagctcgcggtcgttgtccctgatctggaggatcgccagagcctcgttctgttcttcccttgctgtcgtggtggtggtaaggaagaggggatgaggtggacatcaagatcctgccgatttgggttggagcaaatcctcactggtggatggtgcggactgatggcgcctgctaagcttggctgtggcggccgtagacctgttatggagccggcttattgcggtcgatggcctggttctcgtgcatcgccagtgacctttctggctgaagggcaacctactatttcctcctggccaggatgccatatggcaggcagttgcaccttcgtctcggagttcatggagtgctgctgcaaccatgaagtcgtcgccgccccaagtggtccgtccccggtgacggcgaagctcgatctgaggggaagctgtgttggacccaattgcagttctatcttagagtctggggtcctccttgttaaagtcagggacctgtgtgtaatttctctttcttttgagtccttatctgagctttgtactgtaatgaccaggaatcaatgaagctctctaggtccttttggacctagtttctaaaaaaaaaaaa

SEQ ID NO: 673 - DNA, 974 bp, Triticum aestivum
  unsure (1)..(974): unsure at all n locations
  Clone ID: PAT_TA_673
gtcgatgtggttcgtcgcgtgggccgtgggtggggggcggctatggcgagcccgccgggagctggacaaggtcctggacaagatcatctctcagtccgagatacggcaaggtgatcaccttctgagcgttttgcttaggatcagtgacgagggggagcttgacttcccgatcgacatggggggggggaaggcaatcgtaatggatatgttcacggccgggacagagacgacatcgtcaatctccgagtgggtcatgtcggagctcatgaggagtccggaggtgatggccaaggcgcaggctgaggtgcgacgagcgttcgacaataagagcccacaagaccatgaggggcacgtggcggagctgcactacacaaagatggtaatcatggagagcatgaggctgaatccagtggtgccactgctggttccccatgtctgccgagagacctgcgacataggcggatttgaggtcacggaaggtactagggtgatggtaaacacgtgggcgttgggtaggaaccccgagtactggcatgagcctgaggagttcaggcccgagaggtttgaggacggcactgcgacctacaaagggtcgcgcttcgagtacttgccgttcgggagcgggaggaggaactgccccggcgacacctttggactggccgtgctggagctcatggtggcacggcttctctactactttgactggagcctcccggccggagtgaaaccgagtgagctggacatggaaatgatggttgccgcaacctcaaagagaaagaaccaagctgcacctagtggcaacaccgtgcaaggcatgcagtttttaattaaaacttaacttatgcacgttgtagtaatggaatgataatggtcgagtggtgtacatggtgtggagattctgtgcggtctcggcaagaaatccgccggatttgtnncngccgttttcatcctcatgggatggcaatgactaatca

SEQ ID NO: 674 - DNA, 824 bp, Triticum aestivum
  Clone ID: PAT_TA_674
cgccaagtcgctcgtgctgctcgtctacacgcagctctaccccgtctgcatcgtcttcgtccacacggtgcgcatcatgccgcaccgccccgtccggcgccgcggcgaagaggagacggccgccaccaccagcgaccccttctactgcttcctctacatctccatggcgctcgccacctacctgttgttctgcatcgtggtgcagaaccagctggagctctcgcacccggccctcgtcgtgtccgccaccgcgctcatgctcatcctcctcctccccctcgccgtcgtcgtcaagcaggagtacaggatcaagcgggagctcgaggagtccctcctcgtgccccccacggtgacctacgagaagccagccgtgcagctgcaaatggccgccaaaacagagacaaaaacagagacggtgacgtcggcgcccactgaggtcgaaatgtcctcgagcagcaaagcagggccgcagtgcctaaaggagatgtcgccgcccccggcgcgctcttagggcgggtgcgtgatgcacatgttccggagcgtggacatgctggtgctctacacgatcaccatctcgctggtgaggggcacgctgctggcgatcgacgtcgcgaccatctgcggcgtcggcggcacccagacggcgatcgccaacatgggccagatcgggcaatggctggggtacccggccaagagcatcaacaccttcgtgtccctcatcagcatctggaactacgccggccgcgtcacgtcaggcttcgcctcggaggtcttgctggagcggtacaagttcccccgcacgctgatgctcaccggcgtgctcc

SEQ ID NO: 675 - DNA, 598 bp, Triticum aestivum
  Clone ID: PAT_TA_675
gtcggtcggtggggagcagcagtgatggccggagccgaggaagacgaaatggctccttctgctccacatcctgtagatccacaacaacccatggaacaggggccggcggccaagcggagcaggtcggagcaccaccacggcgacggcgacgcgccgtccttcaagatggaggacctgcccgtggatgttcaagctgttataatgtcgcttctgccactgaaaatggctgtgaggacaagcattgtttcaaaaaattggagaatgctctggacattccgctgtaatttatcttttaaaggcccacgttatctgtgtgagaatgataccaaaatacaacaagcaaaatgcattgagacagtaaattgtgttattcagcagcatagtcggatagggatcaataagttcagcatcaggtgtggcctgttcgaggaggactctgttcatctcgacaggtggattcggtttgccgcctcatcgaaggcaaagataatacatcttgatctgaggttcaaggatgtgtttgaagaagtaaaccacttgcatcttgaggccttattagatgctcaaggtagctcatttgtacggtccttgtttcttg

SEQ ID NO: 676 - DNA, 665 bp, Triticum aestivum
  Clone ID: PAT_TA_676
taagaagatggagaattcttacaaagcttggggggatgctgaatgcacggtccaagcttctgaggtcacaatcaaaagcgacatggtttcacaaccgactggaaggctgctgctgccatcagaggatagtgttgagaacccagaacgaaaggcagcctacttaccgcaccttgtgatctctgacccctctccgagcttggatggtgatggcgttgtttacctaattgccagggagaaattatatcaccaaaagtcatgggtccttgctgttgacatgaatagcaagacgctgcgaagtgttgctccctttggcatggtagaagacccatgtgattctgtcgtgtattgcactagcaggtctgcctccaatacttgagttatctggtggaactggagaccatgggctatctaccgcaggaataaattcagcatgaagatgtttttcttattaagaaagcatgcaccggtgctgtgggcagttctctctgggtcttgctttacatattcatttagttactattttagatggaaagacatgatctcctgcgtttgtgatttgtgggcaacttgcttaatatgtttgagcaacatatatttctcgttgtattttattgtgttggacatgatggcctgtgtcttcggtcaagtgtttatagtactcaagt

SEQ ID NO: 677 - DNA, 803 bp, Triticum aestivum
  unsure (1)..(803): unsure at all n locations
  Clone ID: PAT_TA_677
tgttctccgcaacagctatgcagttggagggtccattagcagcagtgccttcaccgccggactgcagtataataaccgcgaccagctccggctgatggtgtcccacaagcttcaggagaaatcgcatgtcaaggagctgatgcaccgctcatccattggcaaggacctctacgccctcttttgtccccccgcgtcctctcagacgacgatcgcggcccagctgatccactgcagcacagcccagagcactgttggtgcagttggaatcgagtttgcggaccctgactctgtcctgaagctccgtctcgcaagctcaggtgtgatatctacctcgtggaagaacagatttggactggccactgtggggttaaaggcccagtttgatgtcactgacctgggtgcccgtccccgggttggcttctcagtgtctgtcagtccccggttctgagtgttgtttggtatggacgaatgaacccctgggtcctgagtgtgagtaggttggttctcgggaagaagttttgtctctgttgcttagattttggtcgcttggcttgtgcatggtgctggatggaacgggattattagatgtaacagaagaattttgtctgggtccttagttggttggcaccctgggaagatgttttggtcattgtggcttgggcgcttgggttaaactgaagaatatcgtgttttggttggactaaaagcaaagccttggtatattttaaattttaccttcgttgtcccgtgagatttgtgtgtttgngatccctgtgtaccaaaatacaagacttctattttgt

SEQ ID NO: 678 - DNA, 1602 bp, Triticum aestivum
  Clone ID: PAT_TA_678
tcggcacgagggtctccgcccgcccctcgggggttccctcttcgcgggccgccggggcggggcccgtgccctcgacccgcgcgcggcgcttcgggcacggccgccggcacccctccgtcgcgctcgacctcgtcgccggcgacggcagcctccaccgctccgccgttcccagcggggcctccacggggatctacgaggccctcgagctccgcgacggggacaagtcggtctacggagggaagggcgtgctcaccgccgttcgcaacatcaacgaggtcatcgcgcccaagctcgtcggccgcgacgtgaggaaccagaaagatgttgatgcgatcatgcttgacatcgatggaactgaaaacaaatcacagttgggtgccaatgctattcttggagtctctttaagcgtatgcagggctggcgcttctgcaaaaggagttcccctgtataaacatattcaggagctgtcaggcaccaaggagcttgtcatgcctgtcccagctttcaatgtaataaatggaggtagccatgctggtaataatctggctatgcaggaattcatgcttttacctgtgggggctacttcatttgccgaggctcttcgtatgggcagtgaagtttaccatgttcttaagggcatcattaaggcgaaatacggtcaagatgcatgcaatgttggagatgaaggtggttttgctcctaatgttcaagacaacagggagggccttgttttgcttatggatgccattgagaaggcaggctacactggaaagattaaaattggaatggatgttgcagcatcagaattccttatgaaggatggaagctatgatgcgaactttaagaaccagcctaataatggagctcatgttctttcggcccagtctctctgtgatctgtacaaagaattcgtcaaggatttccctattgtatcaattgaggatccttttgatcaagatgattggagctcatgggcttcgttgcaatcctcagttgatatccaaattgtcggggatgatttgcttgtcacaaacccaaaacgtatagtagaggctattgacaagaaggcctgcaatgctctgttgcttaaggttaatcagatcggtaccgtcacggaatctattcaagctgctctggattcaaaggctgctggttggggcgtgatggtcagccacaggagtggtgaaacagaagacaatttcatcgcggatctagctgttggtttagcgagcgggcagatcaaaaccggagctccctgcagaagcgagagactggccaaatacaaccagcttgtgcggattgaagaggagctaggcaacgtgcggtacgccggcgaagcgttcaggtctccatgagaaaccagaatcacagacgactttgactggagcagtaaaagtttctacagcggcgacagtggtgtactgtgtacatccttcgattagaaataaaggcactgaccgtataaattcatgacatctccttgtaggagtgccacggtgcaccccaaattttgcagccttgattttatcgcagatgcacggcattattgtctaaaaaaaaaaaaaaaaaaaaaaaaaaaaaaaactcgagactagttctctc

SEQ ID NO: 679 - DNA, 661 bp, Triticum aestivum
  unsure (1)..(661): unsure at all n locations
  Clone ID: PAT_TA_679
agtaccgaccngcancaacgtaaataggccagcatctccagagacactgcgggactggggcaacaatgacggcctacaagcttttcctggctgctgcctttgcagccactgctctcgcagctcctgttgaagagcgtcagtcttgcagcaacggagtctggtctcaatgtggtggtcagaactggagcggtactccttgctgcaccagtggaaacaagtgtgtcaaggtcaacgacttctactcccagtgccagcctggatccgcagacccttctcccacgagcaccattgtcagtgccacaaccaccaaggctactaccactggtagtggagggttctgtcacctcgcctcctcctgttgccaccaacaaccccttctctggcgttgatctgtgggccaacaactactaccgctccgaggtcagcactcttgctatccccaagctgagcggtgccatggccaccgctgctgccaaggtcgccgatgttccttctttccaggggatggacacttatgaccacatctccttcatggaggagtctcttgccgatatccgcaaggccaacaaggctggtggcaactacgctggacagatcgtcggctacgatcttcccgaccgagactgagccgcccgctgcccccacggagagtactcccctg

SEQ ID NO: 680 - DNA, 653 bp, Triticum aestivum
  Clone ID: PAT_TA_680
ttcggcacgagccatcaccaccaacttcctgccccggcccagatccctccccccgcgccgccgcgcgatctccctggctcccccgccgccgcgcgaccttcctggacctcccccccccccgcgcgccgcctcctggctaccaccccgccgggcctcctgccgccggcccccacggcccaacgcgcttcccgccgcgcctccggccgccgaggaatccccctcccatccccgcctgccctcttagttcgccgattgccgcagcctccacactctgcccctaccattcgtcccgcctctcctcttgcgcgtcgccagcaggccggcatccttgcgcgacgtcgccgtcgaagactaatcctggcagtagcagtaagtttgcattggatcccgcctctcctcttgtgcgttgccaccatgaccactcacctcgtgctatcagcgacctgccaaagcctaagcggcgacctgtccgaggcctaagcacgaaattcatgcttgaatcttctccaaattgatgttgcctgcaacgggaggggaaagcctgtagtccaccactatgatgggagaaactgcttctacttttcttctgaaatcaccagtgctctctgtggcacccgcgaaccgtttgcctggcgggttgagcagctcatcaa

SEQ ID NO: 681 - DNA, 1218 bp, Triticum aestivum
  Clone ID: PAT_TA_681
cggccgctagccgccggccggggttcgtttcagtgcctcgcagctcgccgccggccctagttcgtttcagtgcctccgcagtctccaccacacggacttgccaccatgacggcggctcctcttttatcgttgacggatgcggcgacggcgacggcgacggcggcgctggcccccggccgagcgcccgccagagcccgcattcaggccgccccccgccaccccgccaccgtctcgctgagatgccaccgcgctcggcccctaaccgcggccgccgccacgggcgactcgccgtcgtccgccgcgttccacggcgagtgcttcgtcgtcggggacaacatcgacaccgaccagatcatcccggaccgagcacctgaccctggtgccgtccaagcccgacgagtaccgcaagctcggctccttcgccttcgtgggcctccccgccgcggcctacccgattccgttcgtggcccctggcgaggagtcgtcccgctacgccgtcatcatcggcggcgccaacttcgggtgcggctcctcccgcgagcacgcgcccgtcgcgctcggagccgccggcgcgcgcgccgttgtggccgagggctacgcccgcatcttcttccgcaattccgtggcccaccggggaggtgtaccccctggagctcgcggacagcggtgccagcaaggagtgcaagaccggggatgtggtcacagtggacctcgataactcggtcttgattaaccacacatccggcgagcagtacaagctgaagcctattggtgatgcaggcccggttattgaggccggggggatcttcgcttatgctcggaagactggaatgattgcgtccaaatctgcgtgaacaaaaagtaagctttatctgccgtcagattagttgaggccttgcgggtggcatgtaagactggtttatgaataagagttgtcgcacctctctccggaggtgaggtgtgattgtccagcagttttgctgctactttcgcattggcttgtaccagtaatactaggttcgagggtctgaactttgttgtattgaatgttacacccatgtaatagttttctttgcacctgttatctttgatgtcaagttaagtgtacttcctgttcaaaaaaaataaaaagtgtactcaagcactggcttatgtttattgattgcagtggtggattgtattcagtcacttttggtgtaaaagtcgacgcggccgcga

SEQ ID NO: 682 - DNA, 1574 bp, Triticum aestivum
  Clone ID: PAT_TA_682
ggcggctctcagctcagctcgcggccttcgcccgaacccccttccccgctgctccccctaccatgcgcgtctccgaccgcgacgacctcccgagtaccgcgcccagctccagctcccagctcacgttcccagatggtgaaccgcgacaaggccggctgccccacggccgcggccacgctgcccctcgaccgtctcctggcctcgctcgccgccaacgcggagcagctggggaagaggtgggagatcgccgtccgcgaccggagggccagagcggccgagcggaggatggaggcggatgcggcgccgccggtgcagctgcacacgccgctcttctatgccacctgcgccctcggcgggggcctcagcaccggcactcacccacctcgcagtcacgccgctcgacctcgtcaagtgcaatatgcaggttgaccctagcaagtacagggacatctcgtctggcttcggtgtgctgctccaagagcaaggtcttggtgggttcttcaaaggctggatggccacgctggttgggtatagtagccagggagcttgcaagtttggtttctacgagtacttcaagaagtgttactcggacattgctggccccgagaatgctgacaggttgaagaccgtcatctacctcgctgcatcggcgtcggctgaggtaattgcagatttagctctcacgcccacggaagccgtcaaggttcgaatccagacccagccgggattcgctcgatgcctaaccgatgggcttccgaagcttgtccggtccgaaggtgcctttgggctttacaagggaacccttactctctttggcattcaaattgcttacactatgatgaaatttgcatgctttgagaccattgttgagatggtgtacaagcatgctgtgccaaaaccaaaagatcaatgcagtaaaccattgcagctagcagtgagttttgcaggggggtacattgctggagtcttatgtgctgctatctctcatcccgcagacaacctggtgtcttttctcaacaatgcaaagggagccactgtggcagatgctataacaaccattgggctgtggggccttttcactcgtggccttccactccgtattatcatggtcggtactcttaccggagcgcaatgggcaacatacgacgcgtttaaagtatttgttgggctaccaaccaccgggggagtcagctctagttgtcatgctgccactactttgcaccgagtagatcatgagaagcagaactgaccgcaccagggaaggtcttgtgctgagctgtctgtagccggagtagatgtataaaccggcacccccggagctgctctgattcttgcaagagctccagcatcggaggatgaagtgttgaatgtacaccgtgagactttcttttagccggttaggaaatttcacattcaaggggtttttgtttgttgctacccccttggacgttggagaacatacaaggaacgaaacaagcttcagagattgatttgtctggcgcattggcgtaatcatctgaatacatcttgcacatggcccgtgtcggcctggcctgtttatgcagcctaaaaac

SEQ ID NO: 683 - DNA, 782 bp, Triticum aestivum
  unsure (1)..(782): unsure at all n locations
  Clone ID: PAT_TA_683
gccagcgcgaccaccgccaacagcagcgagctgcacatcctgtggcaggtgccgcagtacgcgctgatcggcgtgtcggaggtgatgatgtacgtgggccagctcgagttcttcaacggcgagatgcccgacgggttcaagagcttcggcagcgcgctgtgcatgatgtccatgtccctcggcaactacttcagcgacatcatcgtgagcgcggtgaccaaggccaccgccgtggacgggcggccgggctggataccggcggacctgaacgagggccacctcaacaagttctacttcctgctcgccatactctctgtcgccgacttcgcggtgtacctcgtcttcgccggccgctacaggaagagctgcaaggtggacgggcggagcgacgacgaggaggaaggaagcgtggacgacgaggaggcatgccacgcgtgactcggcggcctctctcgacggccgcctggctgcggtggttcttgagatcggagacttcatgcacgagcattggtacgtacgttcagcgcgcgcgacgggtctctcgttgatgataggacatgcatgggatcggcggtggctggctgctgctgcgactaaagaataagcatgccagtgtcatgtgcaactacgatggcatgtacgcctatgtctagctatgtgttcgtttcttggcatttttggccagtgtgacgctgtaactgaccactacttatgttcacggtaccgcgactagtctgctaccacttcatttatatgcatgcangacagcgcacttcatttga

SEQ ID NO: 684 - DNA, 1202 bp, Triticum aestivum
  Clone ID: PAT_TA_684
cgcgccgctgggcctccgccgccggcccccgccgctgcgcgccgcgtgcctagaggggctgagcctcgcctgccactactacccggcctgcccggagccgcacctgacgctgggcaccaccaagcactccgacccgagcttcatcaccgtgctcctccaggacgccgtcggcggcctccaggtgctcgtcgacgacgacgacaagcagaacccggcgtgggtggacgtgccggcagtggcgggggcgctggtggtgaacgtgggcgactacctgcagctcctgtccaacgacaggttcaagagcgtggagcaccgcgtggtggccaagagcgcggggccgagggtgtcggtggcctgcttcttccggacggacgggtcgacgagggtgctcgcgccgatcgtcgccgacggcggcaacgcccggtacaggaacacgacggtggacgaaatggtcaggcactacagggccaagggccccggtgccgccgccgcccgaggagatccctccggcgtgcaggcgcgtggcgccggagtacgtggggctagtacaacggctgggccgcactctcttcgagctgctatcggaggggatgggactccggcgcgggtacctggaggaggagcaggagtgcctggatgggctgagcttcgccggccactactaccctgcgtgcccggagccgcacctgaccctcggagccgccaggcactccgaccccagcttcctcacggtgctcctccaggacgcggtcggcggactccaggtgctcgttgacgacgacaagaaccagcctgcgtgggtggacgtgccgacagcggcgggggcgctggtggtgaacatcggggactacctgcagctcatgtccaacgacaggttcaagagcgtggagcaccgcgtggtggccaagagtgtggggccgagagtctcggtagcctgcttcttccgggcggacgcgtcgacaagggtgcttgagccgatcgtcacggacgccggcggcgcgcggtacaggagcacgacggtggcggagttggtccggcactacagggccaagggcctggacggcgtccctgcactccaacacgtcaggatctgaatgagcctcactttcatttgctgtgcgaggattgaacaagtgcaacgaataaataaaatgaagaggcaattgcgggctgggtaatacaaacatacaaccctgttaatc

SEQ ID NO: 685 - DNA, 777 bp, Triticum aestivum
  Clone ID: PAT_TA_685
gcggggggtcttttcgcatcgcattgcatcgcccttatccggattggactctatcttgtcactaaataccagaaatcgacaaggccttcacgatgcctttcgctgttggtagtgccgttaccaagcaagacctcgccgtcgctcaggctgaggcgcctcagctcgccaaggtcaaatggtgggctgaccctggaatgcgcgtgctgtacttctacgccgcaattctttgtgtctgttcagctaccactggttacgatggttccatgttgaacacctcccaggccatggacgactggcaggattactttggtcaccccaagggctccaagctcggtatcctcaactcaatctaccagattggcagcatcgccagtttcccattcgctccctacatggctgatcactttggccgaaagcttcccattgctgtgggatgtctcatcatgattcttggcgctttcctttccgctttcaccaacggttacggcatgtaccttggcggtcgattcctcgtcggtttcggaaactctctggctcagctgtcttgccctgtcctcctcaccgagatctgccatcctcagcaccgtgccattgtttcaggcatctacaactgtttgtggaacttgtgagccacactctgcgctttcatcggtctcggtacgatcaacatcagcagcaactggtcatggcgaagcatcaccttgatccaggctgtcccctcccttatccagatcacctttatctggggggatccccgaatctcctcgatggctcatg

SEQ ID NO: 686 - DNA, 1270 bp, Triticum aestivum
  Clone ID: PAT_TA_686
tgccgccccgccgcggcttgtggcgtcaccgacgacgcctcacccccaatccccttagcttctcacacgcgccgccgctacggccgctaccgccgctgccatcgccttccccgcgtgcctgcagtttccaccccgtccgcaacctcggacactgtttctcgaggtaaaccgaaagggaggaaatcatgcccaagttcaagaagaatctgaaccctcaggtcttcttggaaatatccatcgatgggcgacctgccgagagaatcacgtttgagctctttgctgatgtagttccgaagacggcagagaacttccgagcgctttgtactggtgagaaaggcctcggagaatctacgaagaagccactttattttaaaggaacacacatccatcgcattatcccaggatttatggctcaggctggtgatttttccagaggagatggacgtggtggagagagcataatatcggtggaaaattgcctcgggctggactttcttcctgagggcatggtcatccttgatagtccttccatggtggactactgccagatacacacttcaggtcccagcttgttctaactttcaatgcttctgccacaacctgttggcaaaactctagtcgttggcaagtttctatatgataaagctttgcttaagcagcttcagcctcggggtcctgcctcggcaaaccctgcaggtccagtgaaaattgtagactgtggtgaagcctctaacatagatactcagaatcagctacatggagagaaagaaaagaagcttaaaagggcagtagaagataataacttcgatgctggagggagggtcaaaaccaaaaaaacatctagcgtggataaacgaaggaaaaaaagaaagaactactcttctgattcatatagctcagaaacttctgactcacagtcctattcctcagatagtggttcggagtcagaatcatactcttcagcatcattggatactagctcatctagtgaccataggcacaagagaagaaaaggttctaagaaagtgaaacgaaagcctgcaaagaggaagagcagccataagaagagtaagagcaagagtagaggaacaaaaagatccaagcggagctatgggagctcaagtgatgcttcaaaaagctcgagcagcagttctgacaatgaaagtgcaggccgccgtaccaagcatccattgaagaaagaccaagaaaataccaaaataataaatttggagatgggaaaatccttggaatatgcagataaaggcaaaca

SEQ ID NO: 687 - DNA, 1436 bp, Triticum aestivum
  Clone ID: PAT_TA_687
cggcacgaggagagtgaccattaccaagcccgcactggtgcgagaagtactgtccaacaagtccggcgactttgagaagctcaagttgggccgacttcagaggatgttgcacaatggcattggtagccacgagggcgagaaatgggccaagcaccggaggatcatcaaccctgccttccatctcgagaagctcaagcgcatgttgccagctttcgctgcatgttgcaccgacctggtggacagatgggaaggcctagccgcgggtgacgcgccatgcgaggtagatgtctggcccgacatgcagaacctgacaggggatgtcatctctcgcgctgcctttggcagcagctacctggagggccggaggatcttccagctccagggggagcagatcgagctcgccgcgtccgccatgaacaagatacatatccctggttatttgttctttcctacaaaagccaaccgaaggatgagacagatcgcggccgagatcgagaggatcctgaagggcatcatcgcgaaaagagagaacgccttgagggccggcgaagccacgagcgacgatcttctcgggctgctgctggagtccaacatggcacacaccagggcgggcggcaattccaaggccggcatcacaaccgacgacgtgatcggagagtgcaagctattctacttcgccggcatggagaccacgtcggtgctgctcacgtggacgatgatcgtcctctgcatgcacccggagtggcaggaccgcgccagggacgaggtcgtgcatgtcttcggcgaccgcacgccggattacgacgggttaagtcgcctgagaattgtgaccatggtgctgtacgaggtgctgcggctgtacacgccgctgacggcgctccagcgcaagacgtacaggccgacggagctcggcggcgtcaggtacccggcgggcgtggtgcttatgctgccgttgttgagcgtccaccacgacaaggaggtttggggcgcggacgcccatgagttcaggccggagaggttctccgagggggtctccaaggcgtccgtcgacgcgccggccttcttcccgttcggctggggcccgcggatctgtgtcggccagagcttcgcgctgctcgaggctaaaatggggctcgccatgatcctgcagcgcttctccttcgacctctcgccgtcctacacacacgcgcccttcaccgttggcctgctgcagcctgagcacggcgcgcaggtcaggctcaagaggcttcactgagctacagtacatattacaaaatcagttgatctgcatgtacagcatactggtggattctaagactaactaacgcactcaagactcaactacgtgtaaaaggcctgctttgtgtattgactttagatggaagtcggttgtatcagatgactggagtttctcgaccaacggtcaaattttcatt

SEQ ID NO: 688 - DNA, 1718 bp, Triticum aestivum
  Clone ID: PAT_TA_688
cgcgttctaccccttcctccgccgctcccgacgccctcgccgcctccagcttcttccaaaccccgcctttccttcgagggtcttgcttcctccccgagaaaaatcgaggccggagccccccaatccccgagcgcgccgcgcctcgccgaccggtcgccggagatgtcccgcacgctggtgcagccggtggggcagaagcggctgaccaacgtggccgtggtgcggctgcgcctgggcggccaccgggtcgtagatcgcctgcttccccaactaggtgggtcaaggggagcgatccgccgcgacgaggacaccgccaaggagggtcatcggcctcacattctgtgactgtgtaccctggagcgagtacgccctggcccaggacttcatcgcgatgttcaactccgtggcactacatgaatgcttcctcccaatttagtcagaaagggtggatcaagttgcagcggcgagaaatgtatgagcagcggtgtgacggactcgactaacttgccctttcagtagcaagaaatacatccagtactggtacccggcgcccctacaccatgaacatcgatcgagcgcatcatgcacgagatactcgttgccgtcgttccatacgttacctccaaggaacaggcactgaaagttatgaagaatgctagtcaccacctcaaagtgcagtatgcaacgtgcaccaatcacaaggagcttcattgcacctaagtccaatcttgctggccttatggagaagcttgatgggtggaatgcaattgttctttcaaaggatgaatctgccgatcagtcttccgttgtatgtgagattgagccatctgttctgcactcgtgtgaagagaaactgaaggacgtgcaagggagggtggaagtactctcggtgtcggcacacaaagaaggtggctcttctacagatcaatatgacaatgtcgaggacaatgtggagaaggcacagcccgtgcctgcgaaggagtctggtgctgttgctcagctaagtgagaccatgcagaaacagagcctttcgagtgaagtggaaagccagggccaggcaccaggcaagccgcagaaaagatgcaaagaatgtgacatattcatggaggacaagctgtacagagaccactgcaagtccgggtggcacaagcacaactacacacgccacaagaatgggcttcctccgctcagccaggaggagtgcttaatggaaatggagatggcagattcccagaggggtctgaaggactacgatttctgaggtgggttttgtctagaactccctgtcaccatgcctttgaggccgagaaatggcatgcacaggccatgaattttgcagccttgttgtttccgtggacatggtcatcatttggtaaatgctggtatgaagtggggaacgagttttgcgagacgctagcaagtttataaaatgtaatcgggttacatcgtgtgaatgtgaactgtgaaggtagtagaacctggctcatgtgtatttggctgagtaaacctgtggcagctctgatgtttgcggcatgaactgtaacgtgatgctatatggtacggtcttgagtacgaccctgttatggaggtgaaccaacttaatgcaacatatgtatatagattttgcaacttggaaaaatagaaaatgataaaaccataaaaggaaaaaaaaatagcggcaggggtagaagtatacacccataatagaccgatacact

SEQ ID NO: 689 - DNA, 1222 bp, Triticum aestivum
  unsure (1)..(1222): unsure at all n locations
  Clone ID: PAT_TA_689
ccgcgtcccgccatcccgtaacgtaactgaaaactggcgggtgctgaaaagaggcgctcgtgacctcgaggtgctccggcctcctcctcccggacctgcagccgggcctcgcgggactccgcagccgctcgcctccgccttcttcgccccgcgtcagtctgcgcgggggccgtctccggccgagaaccctgtcctgcgtcgcgccgcccgactccgcggcgccgagtgcaagctgagctgggtgaagaaaagcctcaggtgagcagcagcagcagcagcacgccccaggaggctgctgcagagccacctgttccagacaggggtctcaacagaaggatagctgtgctcaccactcttgccgcggtgggcctctttggatctcagaggctccaacttggcgggttttctctcaaggatcttgctgccaatgctgtgccatatgaagaggctctctcaaatggcaagcccactgttgtcgaattttacgcggactggtgtgaagtttgtcgagagttagctccagatatttacaaaattgagcaacagtacaaggaccgtatcaactttgtcatgttgaatgtcgacaatacaaagtgggaacaagagcttgatgagtttggggtagaaggtattcctcattttgcctttctggataaggaaggaaatgaggaaggcaatgttgttgggaagcttccaagacaatattttctcgacaatgtggttgctctgtcttctggtgatccaacgatacctcatgcacgagccgttggtcaatactcgagcgcagaattcagaaaagtccatcaagttgctgatcccagaagtcatggctagtaatagctcttccgtcgctaccagtttcagcattaatgccaagactcatggacaagatgccggtataggttaagcatgttgagtcttgaagccaagaatttgggcgttgggcagagctgaccgagtgcagaaatcacattaaaaagagcaacgggatcagtgtttcatgtatatgattgtggcactgtgcaagtggattttctgattcaggtgtttggctagaacactgagctgctagtgactacgagaatcagtgtattgtgtacaggtgaaacagatgtatactacggccgcgagaacgtactggtgttaaaacacgtgcctgtttcgggtgttagtaacatttttttaatacagtacagttgtaacttatgggattacnttgnag

SEQ ID NO: 690 - DNA, 641 bp, Triticum aestivum
  unsure (1)..(641): unsure at all n locations
  Clone ID: PAT_TA_690
ccacgcggccgcgccaccaacccaacaatcacagcgaatcccgctcgctgcacaacactgctagaaagaagagccagcaagccatggccggcgtcctgctctcggccgccgttgcctgcgtccttctcgccggcgccgcgtccgcgtcgtcgtcgtcgccgcgggtgttcaccgtcggcggcgtagagaggggctggaggcagccggcgcccggcgaggagacctacaaccactgggccaccaagaaccgcttccacgtcggcgatttcctccatttcaggtacgacaagaacgactccgtgcttgtgggtgacgcgcgacgactacaagcgctgcggcgcggacacgccggtgactccgcctccgacgggcggcgacggcgaggttccggctcgagcggcgaggcgtgcttcccgtcagcgccggcccgccgcccctccgccacccccgccgcgccggccccctgcgccgcctggcgcagattcaccgcgcccccgcctccccggcggagccccccgccatgtctccccggcgggtccttcaactccacgccggggtccggatcncacntccacgcgcatgccgccgcgcgggaacgccggcgacgnggagnnnngcggcgccgcnnnnnncggtgccta

SEQ ID NO: 691 - DNA, 825 bp, Triticum aestivum
  Clone ID: PAT_TA_691
cggacgcgtgggttgttggctggctcctgaaactgagcacatgttggtatttcattgttgtactggtgtatgcaagggttattttcgtgcagaggttttgaactgtgatttccttctctttcaagcctaaagcattcaactgataatttcaggcaggcatttcaattttctatcatgcttctagatatcaaacgtggttgagaaagttccatttttaaggggctggagctccatggcttacagatctaacgacccctgatgctctttgcatatttccaatgataacatcactgttcgccatgcttccctttgaggagcggcaggtgcagatgcgtgtgcgaggagcgccgtcggtcgaccagcgttctttcttcgtcaggaagggtgcagcctgctactcaagcccctcttcttcgctccttgcagaggagaggcatgggcaccaccacacttgagagatggacgaggacatgaagctttcgtggagaggacgaggtggccgccgcagcacccccacgccgcggacgcggagattcccatcctgtctgcccccgataaccacttcggcggcgccatgaacggaaacaatcgcctcttcatggcaggcgcagaccgcatggtcgtcttcctctccggcttcttctacaccatcagactcagaccctctcccgctccctctccctctgcatctctataaaaatatgctcaggtcaactaggagatgatgcaagccaaggcgctcacaccgatttaagatggtgtgggtgatcaatagaagacaaatgaatacactgatggaaggccatgtcaaaatgacagctgtta

SEQ ID NO: 692 - DNA, 743 bp, Triticum aestivum
  unsure (1)..(743): unsure at all n locations
  Clone ID: PAT_TA_692
attntcaaagncaccanggtaaagggaatnccatntgagcacaggtaaagaatcatttcggttgtatattccttctgcaggtcgatctatcttacaggtcttgaggaactttttcactctaacagatgttacagcattcccctgaccaagttttgcccccattgaaaaaactaggaacagaatcggaactatcctctttgtggcctccatggataaatgggtaaacgaaagaacatgtcgtcgggttcacatcacgatgcggagaacggcgagtccaacggctgatatcgaaacgatggtacctatgcagtatttgatgacatcatactttgctgcctccagctgggccttcagtgaatgaatttccttgtcaagctttgtggtgagatctgtggtttcttcattctgcttggcgagctcatcacgtatgcgccctctttcaaggttcagatccaaccgctgccctgcagtgaccttgtcaatctcatacttcagttcactcctcatcttatcaatgtctccacggagtttttcagtctcccgctgtaacaaagagaaatggttttcctgcgagctctgcacttgtgacttgaacttggagatattggcctcctgcagcatctcactcttctgcatctcggtcttggagacgaaggactcagagatgctctcgaggctgtcgttgaggacctncgtgatggcggatgtgatggcctccgcctgcttggtcgggacgccctgcg

SEQ ID NO: 693 - DNA, 649 bp, Triticum aestivum
  Clone ID: PAT_TA_693
aaaaaagacgtcgccgcggcggtgggcagaaatcggtatccgaagcgggcgagccaaaccagcgcaaaccccaaatccccaatccgagctgccctctcccccctgagatggcggcggtctggatggcgttggcggtgatgctggtcgctgctgctcaggtggcggtggctgccccggtgacggcgccggccttcctctgggcgcccaagaactacggactcagtcccaatgaggttaaagaagtagtccactatcagacaatctccccaaagagcttagctgattctgttcttgaggaaggtggctggtcaaacctggtgtgttcaaaggatggtcctcaaaagaatgtcgatgttgcagtcctttttcttggatcaaagctacaatcatcagacatctctaaagataaacaagtcgatccagctttagcggacatactaaagctatccttctcaagctccgagttttccatggcattcccttatgtggccatgtcagacgacgaagcattggagaactcattgctatctggatttactgagaattgtgaggatggttctggaggaaatcatatcacgtacacagacacgtgtactgcaagcagtgaaagtgtgaagaaacctctgaacatggattctgttcaagactt

SEQ ID NO: 694 - DNA, 727 bp, Triticum aestivum
  unsure (1)..(727): unsure at all n locations
  Clone ID: PAT_TA_694
tcaagacttggtgaagtcacggatgggaaacaaccaaccaactgagctaatcgtcttctgtagcggtggtttcaaggacagtacanaatcagaagggcagttgcttttggatctggtttctgttcttgacaagtctggggctaaatacacagttctttacgcttctcaaccctatggtttgctggagaatccttcggacctgccattagccaggtatcttgcagagaagaccaacacaactaaacctgtcctagagaaatgtgatggagagtgccaattaaaatcaactctcctggaaggagtttttgtgggtgtagtgctgcttatcatcttgatatcaggactttgctgcatgatggggatcgatactccatcaagatttgaggctccccaggattaatcttggtctgattttgaagcaaacccgatgtggatggccagtgtttgttaccctgcgcagtggatatagttagcttcctcttcaaaggtgccttgcttgtgtatttttctaagccaaacttctgtttagtgaccaaacttttggtgtataattgcattccaaacccacggagatctgagcttttgcaaactacactacatgcgcaaggcttatgttgtactatcaaaccagaattgtttccagttttctctgtgaatagcctgggattcaggaagccaataagatgatggcactactgtccatctaataaaatcttgttattttttt

SEQ ID NO: 695 - DNA, 1656 bp, Triticum aestivum
  Clone ID: PAT_TA_695
gcattcaccactgccttgctcccacctctctcgcaatacagatcacggccgcggtgaccagcagagatcggtatcggaagcgggcgagccaaaccaacgcaaaccccaaatccccaatccgagctgccctctccccccgagaatgccggcggtctggatggcgttggcggtgatgctggtcgctgctgctcaggtggcggtggctgccccggtgatggcgccggccttcctctgggcgcccaagaactacggacttagtcccaatgagcctagagcgtagacgactaacagacaatctccaatgaggctaaagaagtagtccactatcagacaatctccccaaagagattagctgattctgttctggaggaaggtggctggtcgaacatggtgtgttcaaaggatggtcctcaaaagaatgttgatgttgcagttctttttcttggatcaaagctacaatcatcagacatctctaaagataaacaagtcgatccagctttagcggacatactaaagctatccttctcaagctccgagttttccatggcattcccttatgtggccatgtcagacgacgaagcattagagaactcattgctatctggatttactgagaattgtgaggatggttctggaggaaatcatatcacgtacacagacacgtgtactgcaagcagtgaaagtgtgaagaaacatctgaacatggattctgttcaagacttggtgaagtcacggatgggaaacaaccaaagtagaccaactgagctaattgtcttctgtagcggtggtttcaaggacaatgcaaaaacagaaggacagttgcttttggatctggtttctgttcttgacaagtctggggctaattccacagttctattcgctaggcatcttgcagagaagaccaatacaactaaacctgtcctagagaaatgcgatggagaatgtcaattaaaatcaactctcctggaaggagtttttgtgggtgtggtgctgcttatcatcttgatatcaggactttgctgcatgatggggatcgataccccgtcaaggtttgaggctccccaggattaaacttggtctgatcttgaagcaaacccgatgtggatggccagtgtttgttaccctgcgcagtggatatagttagcttcctcttcaaaggtgccttgcttgtgtattttactaagccaaacttctgtttagtgatcaattttttggtgtactattgcattcccaaacccacggagatctgagcttttgcaaactactacatgcgcaaggtttatgttgtactatcaaaccagaattgtttccagttttcccctgtgaatagcctggaattcaggaagccaataagatgtatggcactaatgagccagctaataaaaaagctattaataagatagcactactgtccatctaataaaataaagttatttttttaaaaaaaaaaaaaaaaaaaaaaaaaaaaaaaaaaaaaaaaaaaaaaaaaaaaaaaaaaaaaaaaaaaaacccaaaaaaacacaaaccaactaaaaaaaagaaaaacaaaaaaaaatggggccccccagggccccgcccctccaaaaattagggatccccccgggttgggggaatccaatatcaattttttcattcccgccaacccccggggggggg

SEQ ID NO: 696 - DNA, 1729 bp, Triticum aestivum
  Clone ID: PAT_TA_696
ggggggaaaaaaaattttatttattaaaaaatttcttgcccttacaaggaatttaaccaaatccgaaattctggaaacaaaacaaggcgcacgtttccccaattccttcgcgcttaaatctcctttcataacagggcaacctgaagccgatgcagcaacaaaagctggcccactcaaaaaacttgcgaggaaattgcccccctcgaaaaaaaacccccccttctccaccttggggccctcataaacggggaaaacacaaaccccgaaaaactcaacccgggggccgtgcggaggggggcccttgaaggggccctccatgtagccccagggccggaacttgaaggcgatcctgggattgggcgggccgctgtacacgtccagcacctcgatggcgaagccccggggaaaccccgtgaggaacgtggacgtggccgactcgaccgactccgcgtccgggtcgtaaatgcggtgctccggcggaagcgtggtccccaggaacgcgttgtaaccgcccatggccatcacctcctcccgcgtcagaggcttcagcccgttggtggtggcggagtagttcttggggtggacgctcttctggtcctcgggccgcaccttgtggaccaactccatctcccaggtcttgagcagccgctgcaccttctcttccagagatccctcggcccattccttggtccgctcttcctcgaagagcttgttcacgaggtcgtagttgggaggggctccatgcctccacacggtgttcttctcgccgtcgccgtgcaggaacgaccggtatttgtctcctccttcagcagaggccatcggacgcgtgggcgcccacgcgtccgcggacgcgtgggcgaacatagactgatcgatgatatggtggcttatgccctaaagagtgaaggtggctatgtttgggcttgcaagaattatgatggagatgtgcagagcgatctagttgctcaaggtttcggatcgttaggtctcatgacatcggttctggtgtgccctgacggtagaacagttgaagctgaagctgcacacggtacagtcacacgacattacagagtccaccaaaaaggaggcgaaactagcacaaacagcattgcgttaatctttgcgtggtctactggattagcacatagggcaaagctcgatgacaacaaaagactgttggatttcacacaaaaacttgaagctggttgtgtgggaacagtggaagcagggaagatgacaaagcatcgacctcttctcatacacggaccaactgttagccgtgataagtatctgaacaccatggagttcattgatgcggttgctgaggagttgaggacaagattgtctgcaaaatcaaagttataaaggagggacttgttaggatcctataatacaaggtttgcgtttgtgctacgaatagggcaacgtgtcttccctacagtgctcaaatagagcctctggtgacagtctgaatgcacctccgaacaatgaaggaagatgctgtctagctcgaaaataagtaggctcttttttatcggattcttggtgatgatcgagtcatttcatgcagctcttcagatagcgatgtccaaatccaagttgggcttcttacacctacacacccgaagtggtgtttgtaccagacataataagccactttattcaaacattgtaatgccaccacatgaaatcaaaagccaatttgaaatctgaagctggtcatccaaaa

SEQ ID NO: 697 - DNA, 879 bp, Triticum aestivum
  Clone ID: PAT_TA_697
agtcgatggattgactttttttatttaaacatttcttggcattacatggaatatagccaaatccgaactctggagacaatactagctagtgacatgcatgtttcgtcgattccgtcgcgcatcagtctcctctcatcacagggcagcctgaagccgacgcagcagcagcagaagcagcagaagcaggcgcactcaagaagctcgcgaggaagttgccacgctcgtagaagaactccgccttctccaccttggtgtcctcatcaacgtggaagacacagacgccgaagaactcgacgcggcggccgtgcggagggtggcccttgaacgggccctccatgtagccccagtgccggaacttgaaggcgatcctgggcgggccgctgtacacgtccagcacctcgatggcgaagccccgggggaacgccgtgaggaacgtggacgtggccgactccaccgactccgcgtccgggtcgtagatccggtgctccggcggcagcgtggtcgccaggaacgcgttgtagccgcccatggccatcacctcctcccgcgtcagcggcttcagcccgttggtgatggcggagtagttcttagggttgacgctcttctggtcctcgggccgcaccttgtggaccaactccatctcccaggtcttgagcagccgctgcaccttctcttccagagacccctcggcccattccttggtccgctcatcctcgaagagcttgttcaccaggtcgtagttgggaggggctccatgcctccacaccgtgttcttctcgccgtcgccgtgcaggaacgaccggtacttgtctcctccttcaccagaggccatggctaactgcagccttccactcgactctattccccgacccggccggc

SEQ ID NO: 698 - DNA, 1483 bp, Triticum aestivum
  Clone ID: PAT_TA_698
gcatgtagctcttccgatagttatgtcctccaaaccaagtgggggttcttagttcttacacttgcacacctgaagtggtgtttgtaccgaacaaataaactgctttattttaacattgtatattgtaaatttgtaatgtcacgaaatggaatataagcccaaattgaaatatgaaggtgatcatccagggcattgattagcaacatatatgcttcaatttctgtcgacgccaacgtcgaagacacagacgccgcagaacacgacgcggcgccccggcgaagggtcggacctggacgggccccccaggtagccccagtgcggggtctagaaggcgaacctcggcgggccgctgtacacgtccagcacttggatggcgacgccccggcggaaccccgtgagggaggtgaacggggccgactccgccgactccgggtccgggtcttcgaatcgatgcaccaacgggcgagcggttaccagaaccttgtcatggccgaccacatccgatccgtccccaagtggcagttggaggatggtcgtccgtggttgggagctaggtgtgtctttggtgcttcagttcccttcctctccaggccaacctgaagccgatgcagcagtctcaggttcaggcgcgctcaagaagcttgcgaggtagttgccgcgctcgtagaagtactctgccttctccactttcatctcctcatcaacatggaagatgcacatgccaaagaactccacgcgctggccgtgaggagggctgccccttgaacggcccctccatgtagccccagtgccggaacttgaaggcgaccctgggcgggccgctgtacacgtccagcacctcgatggcgaagccccgggggaacgccgtgaggaacgtcgacatgccggagtcgaacgtctccgtgtccgggtcgtagatgcggtgctccggcggcagcttggtcgccaggaacgcgttgtagccgccgatggccgtccactccttccgcgtcagaggcttcatcccgttggtgctgccggtgaatccctgggagtgcacgctcttctggtcctcgggccgcaccttgtggaacatctccatctcccatgtcttgagcaaccgctgcaccttctcttccacagacccctccgcccattccttagtcctctcttcctcgaagagcttgttcacgacgtcgtagttgggaggggctccatgcctccacacggtgttcttctcgccctcgccgtgcatgaacgaccggtacttgtcgcctcctgtttcagcagacgccatagctggctaaattaccttcgtctcagttcaaggtacaactttttcttttttgcaggggagttcaaggtacaaggtactaggttagtagtattcggaagctggcgaccgggattgagccttacagtccactcgattcaaccaagagtggtgtgtggttgattccctacttgtaggaaaaatcagatgtagaacaagatcaaccggacg

SEQ ID NO: 699 - DNA, 926 bp, Triticum aestivum
  unsure (1)..(926): unsure at all n locations
  Clone ID: PAT_TA_699
ggaaggatgatgatcttgctgatctcactgcaaaagtagatgatacagtctttcgttgccatcaggtgattctggcctcaaggacatagtattttaaaaccagactatctccaacagtggattttcttgaaggtaacaatcgagtgcatgcatctctgggtctcccatttcttgaggagcatgacctgagtacggaagcatttgaaaagatgcgttgaatacatgtaagatccctttgcactttttcttgcttaaccattattgttattggtactgctcttgtctggtttattccctgcttgtgttaattttaggtatactgacaatctggagcatatgcatccaacccaggctgaagaactatttgatgtcgcatcgagatacctgctgtttccccttaggcgtgctgtagctgatttactgttaccaaatctggaacatgtttcacctgcagagctgtgccattggttgatcttgtcagacatttatggcgttatgaaaataagggagtactgcctggatatcattgcctacaatttcgagatgtttgcggacataagagagttcagggctttgctcttgacactcccaccgccatctgcaaatgacgcactacgaacgactcgtcccagccagcccggggctgcagggcacactgaccaaggcaatattctcgatgacttgcgtgagaaatggttggaagcggaggctgctgagctagacgagagagatcagagcgcagcgctgtttgaccagcgactggagatgctcatgcttgttgcggagcgggaagcctgtgatgatgacaatgctgccctccactgagggctggaactctatacctttcttgtgtagctcttccttttgtagtcnttgctggaagggactgatgtagtgtttctgaattacatgtctcccctttgtnn

SEQ ID NO: 700 - DNA, 965 bp, Triticum aestivum
  Clone ID: PAT_TA_700
tgttcgtttcagctgggtcacactgaatcggacatctccgaagtgtgctcatccttggaagaggatttcctcgtcggttctctctgccctcgtttgcccctggagtctcattcgttatgagcgcggccccggcctaggtggggccttgccgaacattatggtgtaccgattgacaaaattgatatcatcactgctggaatgggaaatgcattagctactgatggtgggttctgtacaggaagtgctagagttgttgatcatcagcgtctaagcagcgctggctatgttttctctgcctctctgccaccctatcttgccaagtgccgcagtttctgctgtaaactacctggaggagaatccttcagttctcgctaacctaaggagcaatgttgcgcttctgcatgcaggactgtcagatgcaccaggacttgagatttctagccatgccctgtcaccgatcgtcttccttaagctgaagaaatcgactggttctctggccactgacctagatcttcttgaaaccattgccgagcaggttttgaaggaagattccgttttcattgtggcgtcgaagaggtcaactctggacagatgcaagctccccgtcggaatccggctgttcgtttcagctggtcacactgaatcggacatctccaaagcgtgttcatccttgaagaggatttccgcgtcggttctttcagatcacgtttgagcctggtttcccttccaatatgacgagggcttggaggtttttgacgccgtgtgtacactaaaggctgattgcgtgtttggtaaatgtacataacagttatgtacatttctggatttcatgagttccatatgttgttgtcgcccatacctgctagtgaaaattttgtaaacgctgtggttagtgatgatcagttgtgctgtacatttgactaatttccatgttgtaaactaggcaaaaaaaaaaaaaaaaaaaa

SEQ ID NO: 701 - DNA, 671 bp, Triticum aestivum
  unsure (1)..(671): unsure at all n locations
  Clone ID: PAT_TA_701
agcgaccgttcagtggcgcgagcgagcaacgcgtccttgttgtccaatggcaaaggaggcagcgggctcactgatcaggttcaccatccaagtccaagcaggggcgccactgggaagaacacggcgttgatacggcggctctggaggtcggcgatcagcgagagcaggaagaaaacagctggatctgcaggggcgacgccgacatcggaacagaggtcaacactgatcaccccgacattgccggttggggagcggtgcagctcatcctacttggtgaaaccgcagcagcagcggcagagaagccacgaatccaaaggattggagcgagggccgcacaagcacaagcagaagcaaagcctgcaggagaagcttctggaggctaggatggatgatcgcaagccctcgcccagctctgctgccaagcacaagacgcagctagcggcatgcaactgagatcgatccgatacagatcattgaagagatactcctatgtatacattgctgtggctcgcacggtcgcacccggcaccatatatttataggataggatatgcgcatttgcacatgttaatacatcaaatacctgtatatacgtacgcaaaatccatcttcttcgcttgtgcattccagtctccgcctgtcatatgtacactaattaacggctntcattc

SEQ ID NO: 702 - DNA, 980 bp, Triticum aestivum
  unsure (1)..(980): unsure at all n locations
  Clone ID: PAT_TA_702
taccgctcatgcttcgcacaggggcggcgccaagcgcgggttcgccgactcgctcgacggctccgctgccagggctgccggggaggaagacaagaagaagggtgaggccgccgccgccgccggagccggggctccgccagccgccaaggcacaggttgttggatggccgcctgttcggagctaccggaagaacacgctagccgccaatgccacaaagaccaaggccgagaacgaaggcagaagcgaggcagggtgctgctatgtcaaggtcagcatggatggagccccgtacctaaggaaggtcgatcttaagacttactccagctatgacaacctttccctggagctggagaagatgttcagctgcttcatcactggcaaaagcagttcctgcaaaacatcgacgagagacaggctcactgatggttctagggctgatgctcttcaggaccaagagtatgtacttacctatgaagacaaggatgctgactggatgcttgttggtgatcttccttgggacttgtttaccactacttgtcggaaactgagaatcatgagaggctctgatgctgctggaatggccccaagatagctggaaccgacgaccggccagaacaaacaagcgcccgtccgtcctggcctctcctccgcatcctgaagtctgtctgaatcacgcaagtgtggaattttgagttaacgctgcaaggcgccgctgaagggtgcgatggttgtctcgactctctgaaagtgtctgcgctgctgctgctagttttatctgtctgtctacgtgtgtagtggaatatgtgcgtcctactgtaaaacaatccgtttttggcctcgccgtttgtagatggtcccttttggttcatgaaagatcaccgctggctgtatgatgatgctttcgcctatgctcttacatatatatttgaagtcaagtcgttttttaacaaaaaaaaaaaaaaaaaaactcgagactagnn

SEQ ID NO: 703 - DNA, 1324 bp, Triticum aestivum
  unsure (1)..(1324): unsure at all n locations
  Clone ID: PAT_TA_703
gcgtgctcagcgccgacgtcttcgcgcgctactgccgcctccgcggccacaacgtgctctacgtctgcggcaccgacgagtacggcaccgccaccgagaacaaggccatcgaggagggctgctcccctctggagatctgcgacaagtaccatgcaatccacaaggaagtgtacgagtggttcaacatcagcttcgaccacttcggccggacatccaccccgcagcagacagagatctgccaatcgattttccacaagctgctggacaacaactggctctcagagaacacaatgcagcagctctactgcgaatcatgccaaagattcttggcggacagattcgtcgtgggctcatgccccatggagggatgcggcaacgacaccgcgaggggcgatcagtgcgacagatgcgggaggctgctgaattcgaccgagctgattgatcccagatgcaaggtttgtgagggcataccggtcgtccgccatacggaccacttgttcttggagcttcccttgttggaggagaaactggagaagtacatcgacgaggcctcggcgaccggatcatggagccagaacgcagttcgcatcacggatgcctggttgaaggaagggctgaggcctcgctgcatcaccagggatttgaaatggggcgtccctgtcccacatgagaagtacaaggataaggtgttctatgtctggttcgatgcgccgatcggatatatttccatcacggcctgctacacgcccgagtgggaaaagtggtggaagaacccagagaatgtcgaattgtatcagtttatgggcaaagacaacgtcccattccacacggtcatgtttccctctgctctacttggtactggtgaaaactggactctgatgaagaatattagtgtgactgaatatctcaactatgaatcaggaaagttctcgaaaactaagggcatcggagtctttggcaatgacgccaaagccacaaatattcctgctgatgtgtggcgatactacttgcttagtaatcgtcctgaggcatcagatgcagttttcacatgngggaggtttgcagataaagcataacaacgagctgctaaagaatttgggcaacttcatctatcgagtgctaagctttatcgcaaaaccagagggagctggctacggctccatcatacctgaagcacctaatgctgatatacatccattgagtcagtcgttagcagaaactgttggtaatttgattcagcagtatactgatgcaatggacaaggtcaaactaaaacaagggctgaaaattgcaatggccatctctagtgagggaaatgcttacc

SEQ ID NO: 704 - DNA, 1600 bp, Triticum aestivum
  unsure (1)..(1600): unsure at all n locations
  Clone ID: PAT_TA_704
cgcaacggcaaggctgctgcgtgggagggaagcccatcccgatcgaatacccgtcgcgctcatcatcatcgccccgccgccaggcccaacaaaacgggggagctcgacccgacccgcctcgcacccagcgacccaccgagccgaaccacccgactacccgagcgaccgaagcgaaacagactcgccgatacatccatcacgcgcagcaagcgaagcgtagcgccgagccgggacgcgaatgagcgagggggccgcggcggcggcggcggcggaggatggggcgacgagggcggggcgggcgtgggcgttcaggcgggatctggcggcgggggcgctgatgggngggcgcggtgcacaccgtggtggcccccatcgagcgggtcaagctgctgctgcagacgcaggacggcaacgccgcgctgctcgggaggtcgcgccgcttccggggcttcgccgactgcgtcgcccgcaccgtgcgggacgagggcgtgctctcgctctggcgcggcaacggcaccgccgtcatccgctactacccctccgtcgccctcaacttctccctcaaggatctgtacaggagcatactgaaagacgcgggaacctcagcagacaataagttcgcatcaattgctctcaccaacttcatcgctggtgccgccgccggatgcacgactctggtcatcattcccccacgtccgcccacgcgtccccgccttgcagccgacattggccaaacagacgcccgccagttcaagggcatccggcacttcatccaaaccatctacaagaagaacggcatccgcggcatctacagagggctaccagcgtcgctccacgggatggtcgtccaccggggcctatacttcggaggcttcgacaccgcaaaggacacgctggtgccgctggactccccactgtggcagcgctgggtggcggcgcaggcggtcacctccacggcagggctcatctcgtacccgctggacacggtgcggcggaggatgatgatgcagtcagggatggaggcgcagatgtacagcggcaccctcgactgttggcgcaagatctacagggcggagggggtcaggtccttctaccggggcgcgctgtctaacatgttccggagcaccggcgcggccgccatactcgtgctgtacgacgaggtgaagaagttcatgaatgggggtaggttgtgataggtatagagagagtgtgtggttctccacagattttggggttccggcatggagattagacacgaccaaacggtacacggagcagcagcggcggcggcggctcggatcaagcgctttgtttgtagtaggcgagtactggtttcctgctgttcgccactaaccaaccaactacaactagtagcaagggcatcatggtcccagagattgtggctggctgttgtttgttttgattttcgttccgtctctctcgtgtgtgactcgaagttccaatggattgactgcctctctgcctgtgtgctttctggtggtgaggttggaactacaaagaaagagtgacaaggtcgcgccactggcctgcctctcaatatcttgtactacaaaaaaaaaaaaaaaaaaaaaaactcgag

SEQ ID NO: 705 - DNA, 774 bp, Triticum aestivum
  Clone ID: PAT_TA_705
cccacgtttccgcccacgcgtccgcccacgcgtccgcgccggcaagtcgacgtgccccaagaccggccaggtgctgactaatctggagctggtgcccaacaaggcgctcaagaacttgatctcgcggtggtgccgggagaatggcgtcgccatggaaggcagcgagcctggcaagcccgagccggcgccgccggtggccgcaaacaaggccgcggtggaggcggcgcgcatgaccgcgtcgtttctggtgaagaagctctcggcgtcgttctcccctggctcggacaaccgtgtcgtgcacgagatccgtctgctcgccaagtccggctccgagagccgcgcgttcatcggagaggccggcgccgtcccgctcctcgtgccgctgctcaactccgaggacgccgcgctgcagctcaactccgtcacggcgctgctcaacctctccattctcgatgccaacaagaagcgcatcatgcacgccgacggcgcggtggcggccctctgcgaagtgatgggctccggcgcgacctggcgggcgaaggagaacgccgctgccaccgtgctcagcctgtcggccgtccatacataccgccgccggctcggccggaacccacttgtgatcgaaaaggtggtgctcctggtgcgcacgggccccccgagcaccaagaaggacgcgctggccgcgctgctgtgcctgtccgcggagagggagaacgtgggcaagctcgtgggagcgggcgccgctgaggcggcactgtcagcgatcagcgagga

SEQ ID NO: 706 - DNA, 881 bp, Triticum aestivum
  Clone ID: PAT_TA_706
agggagcgaccttatcgatccccttcgtctccaacctgcgcctccttctctcacaatcttcgcgttgatctcgtcggagcaaccagggacggcattgcagcccccaaaaaaccaacgacatgcagtagcccagcagacggcgacctgtagcattcgcgcgcggccctgctgcggacggtgttgccgagcgccgcgagcgggagcgcctggtgcgccgccgttgttgcagagcacgccagagaatcgcgtgcgcccgccggtgctgcgttggagcatcaccgacactgcaacgacgaccgcgacggccatggcgtttgcaactccggcgctgcaatggagcttcgccggtgctgcgagcctgcgacgacgaccatggcgggccggccatggcgttacaacggagcttcgccggtgctacaatgacgaccgtgacgggccggccatggcgttgcaacggagcttcgccggtgctacgacgacggccgcgacgggacggccatggcgttgcaatggagtttcgccggctgccttggagctttaccacaggcgctgcaatggagcttcgccggggctgcaatggagcaccaccgaagcttccggctgcaatggagaaccaccagggctgtggaagctgtgacggtgatgcaatggagatcggcggggctgcaatggagcatcaccagtcgccaacggtgctgcgtggacgcgtttgatgttgctgtgatcgaatggctactagcgcacggatcagacggctaactagccggatgattttctagagaaatcatccgattgatttgtagcagcccccaaaaaattacacctacaaaagtcacgaaaaatagcgaaaacatactattgatactattcgatttgcttgg

SEQ ID NO: 707 - DNA, 849 bp, Triticum aestivum
  Clone ID: PAT_TA_707
tctcggcggctatggaggacgacgacgactgccctcccctcgccgtcgagctccctccgcagacgacctctcctctggttcccgcttcctcctccgcctccgcctccgcgccggtcggcgtcaccgtcatcaccggctacctcggcgccggcaagtccacgttagtcaactacattttgagtggacaacatgggaaaagaatagcggtaatactgaatgagttcggagaggaaattggagtagaaagagcaatgatcaatgaggggcaaggtggtgccgttgttgaggaatgggtggagctagcaaatggatgcgtttgttgcactgtaaaacacagcctggttcaagcacttgagcaacttgtgcagactaaggagagaatggatcatatattattggagacaactggtttggctgatcctgcaccacttgtatccattctctggctggacgatcaattggagtcatcaatcagactagactctatcattacggttattgatgcaaaaaacttcaggcggcaaattgatgaacacacgaactcttcctcatttcctgaagcatttcaccaaatcgcatttgcggatgttgtgatattaaacaaaattgacttagtaaaagacgatcttgaggatttggaaaggcaaattcatgatgtcaatgcgcttgttacagtggtgcggtctgtgcggtgccaggttgatttaaatacaatatttgatcgacaggcatatggtgtgaagaattcatcacaactacaagagcttctggagtacagtaaatcagcaccacctaatagtcgccatgataacagtatttccaccttgtgcatttatgaacaggatccag

SEQ ID NO: 708 - DNA, 1133 bp, Triticum aestivum
  Clone ID: PAT_TA_708
gcagagtcctcaagtcgaagggagaaatatcgtctccaacaatcccgattccgatcccgatccccactccaactccagccccaaccccaactccgattcttctatatactccaaagtgatgtcgccgagccgcgcgctggccgtgcctcgccttccaccacggcgcgggtcgacccacggtgaccttcgatgtgtcggagaaaaagccaatcgccggctacatcgacgagctggagaacaaggagatctgtccagccacgcacggctttatgctagccaggtgccctgcctccatgtccaccttcctgtggactccccagagccgcggcaagatcgagctgccgccgttgccgatcgagcaggacctgttcatagactgcatctgcctgctctccaacaagcccaccgcttcaaactgtgtcgtgcttctggtcgagccttacgccaccttcatatggtactgtcacatcggagacgatcagtggcgaaaacacgactatgacatcggaacccagccggccctcgacctgcagtccgaggacaaagaggtcataactccgattgcggcatgtgggggcaagttttatttcaacagcacacaaatcgagcttggtgttcttgatttctgccctgctcccgtattcagttccatcaagatcaacgacgtggtcgatgatatctacggtgttgaactggctccagctcaagtttttctggtggaatcggacggggagctctatatggtttccctgttatgggcggaaacaatttatggtgcaagagttcataggatggattttctcaaagcagagatggagaaaagtgtatgatcttggtgatcgaacgttcctattgtccctgttcaactttggtgctctctgctctgtcggcaagtctggactgcgagagaactgcatctacatggcgtatccttgggagcagaccgtgcacattttcagtgtaaaagatggtagtatggagacgcacaagctggatgatgctccctcctcagataaagcattctggatgctccctgccaatcatatagattagtttagattcacaagatattttttccatgtcgtttttagttatcaccagacttggattgtgcaacctgtttacgtgttatt

SEQ ID NO: 709 - DNA, 1393 bp, Triticum aestivum
  unsure (1)..(1393): unsure at all n locations
  Clone ID: PAT_TA_709
ggaaccgcgtcagcaccaacgcccgcggcgcgcacaataaggagagcccctgctgccggcatggggccgagccacagccaggccaagcccaaaccggacaggcacgcgacgcgacagccgcccgccgacgaccagcacccgacccgacacggggccacccgtgccggcccgccgggcccgccccacatggacacgttcttcctggcacacgactctccctctctatctttcgacgcggcccccccgcgcccggcactttttccagccgtggcccgcggcggccggcgcgggcccggagggcccgcggtccatctgagttcgctgggtccgggccggggcgggcggaccccggccgcgggccggcacccgccgcgtccatgccgctcatgcccagacttctagccggcttccccacgtccatgtcccacctcacgtccctctgcgcccggacggcacctaccagctccaggtgcgcagcgcgctcgcgccgctgcgggaggacgggaccctcaggctggaccccggccccgggctgcacctgatcgccagggtcccgcacgccgacatccccccgggccacctctccgtgcagtcccaccgctccgcccccaacgactgcgacgccgcctgcgccctcgacccccgcaaggaggaggcgcccctcggcgacggctccggccgcgtcccccgctcccgccgcgccatcgggcccccccgctcgccgccgccgcacagcgcgccccacctgcagtcggcctccgacttcaacacctggctcaaggactctcttctcggaggcaggtacgacgacgtgaacgggtacgaggagaaggcgcccaacgccaagacggctcacccgcggccggagcacctctacccgctgcacgtcgcgctcggcgccgccggcgacgagtccaaggcggagctaatccacaatagctggaccaacgcatcgctctcgtacgcctcgtatcgtttcaccacgaagaactgacggcctccatcgagctgtgttggctggctcgcgcgatcctcggtggcttggttggcactagtaataagcatgtcacgctaggtgtggtgggctcgtgggtcttgaaatgtgttgtgaaagatcatttgctttcgtgttggggcgtgatccttgacagtgtattactcttgctgtcttacatggcatgttttacgtaattctgttcgtctctgtaaaagattaaaagttttaacacaacaaaaaaagtgccttgaaacaacacacagaacggtaatcacnacncttagggcaantctttccctcgnantcccaaaatatnttangggatatgccaaaaatntcggcccaaaatngcggcaantctttcggaatttacanggattgtcataaaaaaanggg

SEQ ID NO: 710 - DNA, 362 bp, Triticum aestivum
  unsure (1)..(362): unsure at all n locations
  Clone ID: PAT_TA_710
gatagacctccaagaataaatgacactntggtagtttatctcactgaagggggctgtcgcacaagaggtgagattcttcttgggtacaattcagggccaccttctactgtgtcgagatttagtacttacgaggtacaaacatcataacaattgaaccattatcttttcctgtttgcaaatcagcctttctatttctgtaatctaagtatatttggatatttctgtgatgattcagaactggacctatgtatcttattgtactgtgggtgccataatgcaactgtcatgcccaaaaaaaaaaaaaaaaaaaaaaaaaaaaaaaaaaaaaaaaaaaaaaacaaatataaaaaaaaaaaaattag

SEQ ID NO: 711 - DNA, 1033 bp, Triticum aestivum
  Clone ID: PAT_TA_711
ctcctgccccctgccgcccgcgccatcgtcacccttggcccgggcccacacctaacctcccaccgggtcgtaacggaggcgtactcagagcaatagtcacgtcccgccagaacttgctaggcatgaggcgtcaaagtttaagccaggatcggctcccgatagacctccacggaagacctgacaccgtcacaatgcatctcactgaagcgatctgcggcctgataagccagaaggtcatcatggggaaggaatcagagaccacgtcccgactccagacgatgctcacagatcttggggacaagacggccattgtattctgcaacacaaagaagtcagcagacaaccgtgctaaggatctggacaaggcaggtttccgcgtcacagcactgcatggagggaagtcacaagatcagagggagatcagccttgatggatttaggaaccgcaggttcaatgttcttgtggcgactgatgttgcagggcgtggtattgatattcctgatgtcgctcatgttattaactatgagatgcctagttcagttgatacatacacacatcgcatcggaagaacagggcgtgcaggaaagaagggacttgcaacttcattcttgaccctggataacactgatattttcttcgatctgaaacagatgcttactcagagcaatagtcccgtccctccagaacttgctaggcatgaggcgtcaaagtttaagccaggatcagttcccgatagacctccaagaagaaatgacaccgtctatgcatctcactgaagcaatctgccgcagaagaggtggagatccttcctgggtataattcagggccaccaactgtgtcgagatttagtacttatgaggtacaaacatcataacaattgaacaattatcttttcctgtttgcaaaccagcctttctatttctgtaacctaagtatattcggatatttctgcgatgattcaaaactggacctatgttgcccctgcttccatgccaaaaaacattttgattgaaaaaaaaaaaaaaaaaaaaaa

SEQ ID NO: 712 - DNA, 842 bp, Triticum aestivum
  unsure (1)..(842): unsure at all n locations
  Clone ID: PAT_TA_712
gcttgctggtcttgactatattgtangctctccaaagtgatgtcttcatgtacacatacgatggaaatatggctaaagctgtgcaaggccataggcgtttcgaggacttcaggaagacgattaacccagataggatggattttgtgaacctggtagatgaatttgatgaaggaaggatcccttgggaggaattcagttcagaagtgaaaaggttgcacaaagatagaacaggagctccatatttcagggagcctggagagtttccgaagctggaggagtctttctttgcaaaccccttgcctggctgtatatgtgagaaacatagtgaacaatgaacaagtaacccagcccaatcgatgattctttgacaagctgtgccagcagaggatataggccctctgctttcctgccagctgcagcatgcatagtttgttcgtccctgatcattcatagtcgagacacgggcgtttgcgcctacattttcaagggcatcccctgaagttcagtgcaagaaaattttgacaggcgatcaacatattcaagcgattggcggtggtaaactaattctcatgcgaccaaagcacgtgggggtgaggcataccgcagcgatatgaagcggtatataagaagtaactatgagttggcggagtaagtgtaggtatccctggtatatgttctgttctttcttgcacttatattgtgccgattactgctgctgctgctaagtacgagtagtattttgtgtagacaacattgggataaattggttcnaatatggtacttttgccccaactgtcaacgggattttccactgnnttgtcaaaattntnanataacanggn

SEQ ID NO: 713 - DNA, 603 bp, Triticum aestivum
  Clone ID: PAT_TA_713
cgtgagggagaaccaggtgctgaaggtgggcatggacaacatgaggatgcggctggcggagctggagaaggagtgctcgggcatgcggcaggagatcgagaagctggggcgcggcggcggcggcaagggcggcggcggaggaggagggtgggcgtcccatgtcccgaggcggttcagcctgaagatgaagccgcagatgtgcagcacctaggaggggtcggtgagcgagcagcagaagagcatgagcgccaagctcgacaagctgcaggccaagctgtccaagcagaagcgccagctctccgccgacgcctgaatgaaacgccaaactccctggttactcctgtgattttaattaacttggtgtgagctgtgttatagtttccgtagccgtttcgtttaggtttacatgtgccaagtgcagtgttttgagtcccttggtgtgaacatttctggtgttttctttgggtgtgttggttagtgggaatggaaatgtgtagcaaagttatcatgttgctctgtgtttactgaagtagtgcaagtggtcgtcagttcgtagttgaggggactgaaatagtactactatctatgcacatatctttgatc

SEQ ID NO: 714 - DNA, 792 bp, Triticum aestivum
  unsure (1)..(792): unsure at all n locations
  Clone ID: PAT_TA_714
ggcaagagcacttgcgatgatgctactcatggccatcgcgctgaccaccactatgtcggcggcgagcaccatggacatcacggataaggacctggcgtcggaggagtccttgtgggcgatgtatgagcgctggtgcgagaaccacagcgtggaacgcgaaattggcgacaagactcggcgcttcaacgtgttcaaggagaatgcacgcatgatccacgagttcaaccaacaagacgtgccctacaagctaagcctcaacctcttcggcgacatgaccgatgaagaggtagaacgcacttacggtcgctgctccaacatcaggtccaacggccggaagcgccggcatcagggtcggctcacgcaaggatccatcattgcccgcgaagacctcccagctgccgtggactggcgcatgatgggatacgaccaacgtccgtcagcagtgacgaacgtgaagcgtcaggggacctgcgggggctgttgggccttcgcggcgatagcggcggtggagggcatcaactccatcaggacccgaaacctaacgtcattatctgtgcaacaacttctagactgcgataaggggaatgagggatgtcgtggcggcaacgcggaaggggccttcgagtacattatccaccatgggggcatcgaaatagaggccgagtatccgtacgttggccatgagcatggccgctgttcggtgcccaagcagagccgaaacaccgtcgtcaccattgacagctacaaacaagtgccgcccaatgaggtggcactgatgcangcagtggcggc

SEQ ID NO: 715 - DNA, 616 bp, Triticum aestivum
  Clone ID: PAT_TA_715
cgccgacgacgtgccccgcctcagctacctccagtgcatcatcaacgagacgctacgcctgtacccggcggcgccgctgctgctgccgcacgagtcctccgccgactgcaaggtcggcggctacgacgtgccaagcggcacgatgctgatcgtgaacgcgtacgccatccacagggacccggccgtgtgggaggacccggcggcgttccggccggagcggttcgaggacggcaaggccgacgggctgctgctgatgccgttcgggatggggcggcggaggtgccccggcgagacgctggcgctgcagacggtcggggtggttctcgggacgctggtgcagtgcttcgactgggatcgggtggacggcgcggaggtggacatgacggagggggtggggatcaccatgcccaaggccgtggctttggaggccgtgtgtaggcctcgcgcggccatgggcagatgtccttcagaagctctgaggatcgaacttgttggcatcctatatgtacagtatgtttaccagtagcatcgctcccgtatgcatggtccgataccgttttgatgtagtactgaagaaccgaataaacttttttttaactacttggcgcactttatt

SEQ ID NO: 716 - DNA, 583 bp, Triticum aestivum
  unsure (1)..(583): unsure at all n locations
  Clone ID: PAT_TA_716
ataacgcatcatggacacccgganacatgggntgctgatgtgggctncagctctttccnttgtgtcggcnnangtcaaacggcngacatgagaagaaaaatagcaaaaatgccattgtttggaatcgaagtngtcactgcttctcttgggttccttacaaactttgacgatgtcnacaggttatgggcatttgttgcaaaatttctggactcatcgtttcttgaacaggagaggctgtcccacgcgtccgcccacgcgtccggatagtttttagaggatttccgttgtggctttttgcagcatttagagaattcagttgtggctattgcagctactttgttataaatacagaaggaaggtggtggcaacagtgtaattgtgatgagggttggaagaggagatgtcaaggcacttttgcctatagcttttgtatcccaaaatgtgtctccccttggcatgaatggtttatactttggtggcgcggctggtatatttcttcattcttcttttcccccctttacagggatgcgacttttttgctcgtagattttggtcgagattcgtatgtatcattcacctgatt

SEQ ID NO: 717 - DNA, 854 bp, Triticum aestivum
  Clone ID: PAT_TA_717
cccacgcgtccgaggacttaggaggctaacttttctggtaactggtagccactatctactacgcatttcctgaatgccaatcagcgaaagtttcacaacgttctatcactcagaaatgaccggattacaatcttcacttgagaaataaaaaatacaatggctctaggctcaatatgggcgcgcctcagaggtaatggtcaggccggcctggccaggtcaacggcattgagagtctttggtttcgcaacatggatccccgtcatcgccatgttcaacctacatgttgcagaattgacctttgtggacggcgcatctatgtaccctctgataaacgacgagaaagactcaactcttcaacgggacgtgatcctcaactggaagtggtcaccccaagagaacttagagaggggcatggtggtaacattacggagtccactacatcccgagacaatcgcagtcaagcgcgtagtggcgctggagaacgatgtgatcaagacaaaggcgcctcatccgctgccaacggtgcgagtacctcaaggccatgtatgggtggaaggagatggacctccaggatcgagtcttgatagcaacacgtacggaccagtttctaaacagttgattacgggtcgagtcacacatgttgtgtttccttttcgcaagtgtggagcacttccatggcgtgagcataagcggccattggtagaagtgatggttgttgaagatgtactctatgtatcaaatttacgaagacacaaacagcaaggggtttcatagcatgacaaatgtggaatcatgacactagatcatgtataataaactcatacgtcagaaaaaaaaaaaaaaaaaggccccta

SEQ ID NO: 718 - DNA, 1163 bp, Triticum aestivum
  Clone ID: PAT_TA_718
tggtgtgtatataaatgtgatgcttccttccatgactaaacatgttgatgttaggtatgaatgtacagtcgagtcatgtttaacagaattgctttctgcattatcagatcacctacaattattattctttattacagtctcatactaaagtagtctgattagtcatagtaattcataaatatttccagtatatatagttcttattcggttagtaggacttttttccaattgtgatgtttgaaacattttcttatactgataatgatctagaataaaacagaccaatgataactggtatgtagcttttgaagccactgatatatacaaaatattatttgagtacaacaggagagatgcaatcttatggatatttccacgtgggtaagaaacattcagcttggcaagcggacttgactagccatgtgtaggactcagccctgctgacttcaaaatgattagtcattggtgttttcttaagtacctgttagcccaagtgcatcagttaagtagagtgttatgttgaaaaaaggaaagagactactcttttgttacttgcagtacaggtacatgctataacatattacctttatgctctctttggatttcagtatatgcatgtgaacaaataagtcactaatatcaatgcccaagaattatttgtttgctattctaatcgttccagcagagagcaatggatatagaagaaatatgtgaacggttgttacagagattgaactctatagatagcagctctcattgggtgactgaattagactctgacatgaattatcatattttctggttctctgctctaatctaagctctaagactacatgaactaccatatattctaatttgtgtggctacactacaccgttctaacttgctggctatgagcatcagatgtgttagacaaaaaatcattgttaaatgaataatagtgccaaatgagattcactaatcaaacaccatcgatgaagtcacatttatgcgtagcgagccatgcttcctatctgtcctatgttatgtttctgaatatgtatccacgtcaactggtctaaagttgcgtatctagatgagttgcattttgtttatttactaaaatatagctattatgggattatttgggtatcagctttatgaacaagcattcaagttttgct

SEQ ID NO: 719 - DNA, 655 bp, Triticum aestivum
  Clone ID: PAT_TA_719
cgaagctcctgtttatttcacatacccggctcgatctcgccacgaccgtgtgcgcgctccagcctccaggggtagcaaagcacgcaagaatcgtcgccagggaggaggaagacaaggaggagagccatggcgagcgtggtcgagacccacgactccgcggtgcccggcggcggggacgtggtgttctgcgtcatcatcttgttcatgtccgtgctgtccctggtcatcttggcgacctcctctgccgtcggcagcggcgacggggaagaggaagggaggcagcggcagcgctccggctcccgcgggaacgggccggtgttcgtgggcggcaggggctgcgcctgcggcggctgccgcgccggcgccggcgtcttgcggcacctacctctcgtgatcaccgccgaccgtgcacgcgccccgcgcgcgctccgcatgtacatgcgtggacgcacttaccgcataactaaggaggagcatcgatcggagctctcgccaggcttgcgcaaggctactcagttcttctttttcctctgcttgtgtatattactactaatagctgcacatcatgtgatgtgaataaactgcaagaacatggagtgttttatctgttccctgaataatcatcgatccatgtgcgattgttgcttcttcttct

SEQ ID NO: 720 - DNA, 837 bp, Triticum aestivum
  unsure (1)..(837): unsure at all n locations
  Clone ID: PAT_TA_720
aaacatcttcttttcattccaacagcctagttcatgagcgaccatcaatcagtaccccagactcaggacgggtctacggaacagagtttcgtagactcggactattcattcaatgtcttcggagctgacttcggcggtttttccttacctctggtgacctctcatgagagtgtggatcaatggcttaatgtgagctcttggtctcaagacgccgcttctcttggctcaatggatcaagagaacgggtttggtgcgactgcgagttctgcgcctcagtcccacgatagcttctcagaggccatcttctcgtctccgatgaccgggatggattcccatctcagcaacatcgactcgactccattcgtgttctcaagttctcccgtgccgtttcttgaccttccaaccgccccaggtgatgcttataagatggcatcgctcactggttcaccaaacaccgcagccgctctatagagcgtaggttcagcgtgcgaccatacgagcgataccattcttgactcatcagctgcgttagaaattgacggaataccagcacattcatttgatgtcgtttcgtcagagttcggttcatctcctcccgacaacaactcaggctccgggataagcagcaatcagactttcagagaagattcggctattcgtttgaaaaacaacgagtttgcagagcatggaaaatggctctgcatttggcctggctgcgataggttctttggagaaatcgcatgcgaaataatcatcttcgaactcatctgaagcctgtttactgttcgtggnnctggttgtaactttcgggattcttgtcagaaggatatgcgacga

SEQ ID NO: 721 - DNA, 655 bp, Triticum aestivum
  unsure (1)..(655): unsure at all n locations
  Clone ID: PAT_TA_721
gcgtgctcccccgaaccccggctcatcgcaagcgcgtgattcattccgcgcaacctccattccacggcgtcggtgcggtgttccctctccagtccgcctctccccctctgtctctctcgtgttgtttattcttgcaccccgagacggacggcaggaggaggaggagagcaccgtccaactcccagccagcgccggccagttccttcctcgccgccgttccgcgggtgattcccggagcctgagttgccgagctgcaggtccggttcgtcttcttctcctggttgagcctcagtaagttgaagacaacatgtttcgtaggaagcacgcttctcatttcaattcagatgatgctgagcagcgacaagcaaagatcaacgaactgagagctgcacttgggcctatgtctgcccgtggcgaaaagtactgcagtgaagcatgcttggcaaggtatctcgaagcccgcaactggaatgtcgacaagtctaggaaaatgttggaagaaagtctcaagtggagggcacttagcaggcctgaggatattcgctggcctgatgtttctgtggaagcagaaacaggtaanatgtacagggcaactttcaccgatagagaagggagaactgtcgttattatgagacctgcaaagcaaaatacatcg

SEQ ID NO: 722 - DNA, 1264 bp, Triticum aestivum
  Clone ID: PAT_TA_722
cacgcgtccgccacgcgtccgcgggcgcgtgggtctcggaaccccggttcttggacatcctcgcaggtctggttcgtctgccgggggctcctctcctctcgtggtcgatcctggttgagcgtcattgagttaaagggaacatgtttcggaaaaagcaagcttctcatttcgattcagatgatgctgagcagagacaagcaaagatcaaggaactaaaagctgcacttgggcctttttctgcccgtggaaagaaatattgtgatgaagcatgcttggtaagatatctcgaggcccgcaactggaatgttgacaagtctagaaaaatgctggaagaaagtatcaagtggagggccgctaagagacctgaggatattcgctgaccggatgtttccgttgaagcagaaacgggtaaaatgtacagggccactttcacagatagagaggggagaactgtggttattatgagacctgcaaagcagaatacatcgtctcatgaaggccagttgcagtatcttatatataccttggagaatgcagtcctcagctgcctgaaggtcatgacaaaatggtgtggctgatagacttcacaggatggacactggcccatgctacccccttcaagactgccagagactgtatgaatgtcctgcaaaaccattacccggagaggctttcaattgcgtttctgttcaatccgcccaaagtatttgaggcttcttttaaggttctcaaagtactggttgacccgaaatcagcccagaagctgaacttcgtgtacaaggagaatgaagagagcatgaagacaatgtacagccacattgatccagaagtccttcctgtggagtttggagggaagaacaatgtcgtgtacaaccatgaggattactctaagttgatgataaaggatgacatcaaaagagcaagcttttgggcagcagatgttagccatgtcgtcaacgtggactcggttcctgaggttaaaccgcagtcgtcactaattgttgctaaagcgagttgaggaacatcggcaagccatcttatctgttattgcagaagttggttgaggagcttcagtgagccattgtgacagttcttggtacagctctgaaagaggaatgcatcgatataagttgcggatgtttggataaataaatgtaactgcggaatatctcgcttgtgatgttacaaaaatagttattacaacaattccatattcccttgaccaacaatttgacacactaaagaattcaaagccctttggcgc

SEQ ID NO: 723 - DNA, 1584 bp, Triticum aestivum
  Clone ID: PAT_TA_723
tcccaaccgcgtccgcacccccgcctccgccgtctcacccccccccccccacgcccagtttcggtgttgcttctcctacgccccccccgcgctggcgcttccggcgctcccccaccgtcagttccttgcccccgttccgccgctgatattccgcgccccagtggccgaggtgcgggtccggtccggcttcaccccgctgcctctccctcggtctctctcgttgtaagtcgaagtcgtcagcgtgaggagaaggggaggagcaccagacccccctccagctcccggccagcgccggccagctgcctcctcgccggcgtttcctggaggatgcctggcgcctctgttggtgaggttcaggttcggctcatgtttgccccggggtatcttctcctggatgtacttcagtgagtggacgactataattttagtagaaagcatgctgctcattgacaatcagatgtcgacgagcagagacctgcacttggcaatatgttggcagctggagaagggccactgtagtggagtagcgtcaactactgaagtggaagatccttggttaggtatcgacaagcccagaacaataatgttgacaagtctagggaaatgttggaagaaagtctctagtggagggcggctagcaagcctgacgatagtcgcagacacgagtaaaatgtacaggcaaaaacacacagaatgtgaagggagactttcacagatagagagggctgcaaagcagaatacatcatctcaggaaagcaggttacatcgtcttatgtagaccatgtacggtatcttatatataccgtggagaatgctagtcctcagcctgcctcagggtctagacaaaatggtgtggttgatagacttcacaggatggacactggccaatgcaacccccataaagaccgcccgaaaccattacccggagctgctctccgcttcctctatgtgcaattcgcccgcgttttgtgcgaccccctttaaggttctcaggctcccgtttggcccgtaatcggcccccttgacccgaaatctatccagaaagtcaactttgtgtacaaggacaacgaggaaagtatgaagaccatgtacaagcacattgatccagaagtccttccggtggagtttggagggaagaacattgtggtgtacaaccatgaggattactctaagttgatgacaaaggatgacaccaaaacaacaagcttttgggcagcagatggtagccatgccgtaaacgggggctcggtgcctcaggtcataccgcagtcgtcaccaattgttgctaaagcaagttgaggaacatcggcgagccatctcacctgttattgcaaaagtaagttgaggagcttcagcgagccaatgtgacggttcacagctctaaaagaggaatatatatatcgaatacgttgaggatgcttggataaataaatgtaactgcaatatcttgcatgtgatgttacaaaaatagttattactagtatatccccaaacaagtgatctcacaacagttccatattccgttggccaataatttaaacactaaagaccacttctctgatttaaaaaaaaaaaaaaaaaaaa

SEQ ID NO: 724 - DNA, 633 bp, Triticum aestivum
  Clone ID: PAT_TA_724
gagagaccaagaagcagcagggcgagaatcgagaaggacaaagagagtggcgagcgcaacagccttcgttttgccatatagatcatggcttggaggtgccacatggacatggttcttctgctcgttatactggagatcattctgctcattgcgacggcgccccgagggctggcggattcgtgtgcccgtgggtttggatgtcaccaaggtgatcctgactggcccggatgtgtttgccgcacaagactttgtacttgcggccgttaatcaagactgtacttccctcaaaaaatatatcaagattgtactttatatgtttagggcgctagcgccgatcagatacaaagtctatcattcctccctgtcgaaagaagatctactgttcccgcaaagaaagaaagaaagaagatcttgtgtggctggttaaagttcatcatgtttgttgtacaaagatcagcccgctggcatatatttgagtcctagatagagttttgtttcagttttgaattctgtttagggaggagtactcctgtaaaatggctttttaacaggtctaggttgcatcgtctttttttatcacccgggctgcatgttgtaaggaccaaacctgttaggttttgactctccgtgctg

SEQ ID NO: 725 - DNA, 859 bp, Triticum aestivum
  Clone ID: PAT_TA_725
cctgctctgttctgattttggggacagaaggaatgggcctaaattgtgccattagtagctattttcatgtagtttatgcttttcttcccttttacttatcatacataaacacattactcacttattttcattccttgatttttttgagatattacatagcatgttgtctgaaaacattagcaagttcctttaattcaccgcttcatatgtctcagattgttgaagttttccttttgttctgctatgtgctttcaagccccgatttagtaactttcttataagattgtttagtttatcctattagattcgaaatccaactttgggaagctgcttgaggaggtttctcatggtctttttatgtgtaattcttcctataatggttgaattggtaatgttgcgtgcatacaatcaaagcaccgaatgagacgatagtaatgatagtcagacagtttttttccccacgcgtccgttagtttttccttcctctttcactaaaatgtgtactaacattttcttaagtacaaaattatggcagtgcacatatatgattaatttgttcttctttcatgttggagagagtggcagtgcgctgattaagctacattctttcctattagagagttgtgtatattctcttgctacttaatgttttctttgcttttcctgcacacaatggttagtattatcctgtcagtcggttagtttatatatagcttcagttctagttgtaggacatgtgctgctcaaagtcctaatgcattgagtgcatgttgttttgctttagccttagtcttgtgttcgggaattgctggttggcttggaataaactgacgctttgggtgattggtgactggttgct

SEQ ID NO: 726 - DNA, 823 bp, Triticum aestivum
  Clone ID: PAT_TA_726
acaaggagtcgttatcctattatgatcatctagctgccagtgcaaaattagcacactctccgctctcactgtctcctctcagccctagacgtattcataaagtcaaaactacagaatctccaaggcatgtaatgaaagatattgaaaatgatttcgtagatttgaaggaacagggaggatttgatggaattgggatgctagatgtgttagaggaaactaacagattacatgatgaatatgatactatgacccctaaaggaagttcatgtagaagatatcaaaactggggttctgaatcttcacctacgtttccgcgagttggttatggacggagtttgagtctccctgcaaggaggtcactagttgtctcctttgaggaatcccttttgtctggtcgactttcttatggaaaagataatcagacaattgatggtttcttagctgtcctgaatattgttggcggtagcttctctcccccaactcagaaacttccatttgcagtcgcaagcatcgacgaggatagctccttgttgtattattcttctattgatcttgctggtagattgtccacaagtgcaaccaacagcaatagcccaaaactccaaagaagccttagtaacaataattcaagatcagcaaagagtcgcttacgcatccctgctaaggggcgcatacaactggttgtgagcaaccctgagaagaccccactccatacattcttctgcaactacgacttgactgacatgccgtctggaaccaagacgttcatgcggcaaaaggtcactctgtctcccactgtttctccctctaatacagtgaaaga

SEQ ID NO: 727 - DNA, 1047 bp, Triticum aestivum
  unsure (1)..(1047): unsure at all n locations
  Clone ID: PAT_TA_727
cggtttgtgaatgtgccatttgtaattgctgatgcnnnnnnnnnnaananagccggggttgtaggagtagcgggggcgccgccgtggtacatagcagctcataacatgatactggcacatgcatctgctactagactttacagagaacaatatcgagccgtgcaaatgggagttgttggcataaacgtttactccctttggacttatcctttgacgaactctactgtggatttagcagcaactaaaagatatcaggacttcctgttcggctggacactaggacccttggtgttcggagattacccccgagtgatgaagacgaatgttggttctcgcctcccatccttcacaaaatcccaatctgaatttgttaagggtgctattgatttcataggaataaatcattactattctgtctatgtgaacgatcgccctttaaaggaaggtgttcgtgactatgcagcagacatgtcagtttaccagagaggttctagaacagacccagcaacaagcgagtacgtcccaacggcttatccagacgacccacaaggattacaatgtgtgttgcagtacctgacagaagcctatgggggcctccccatttatgtccaagagaatggcaaggcatccgcgaatgacattctcgatgacaccgacagggtggaatacttgaaggcctacatagggagcacattggatgcattaagaaatggagccaatgtgaaaggttacttcgcgtggaacttcctggacatattcgagttcctagcaggatacaagatagggttcggcatgtatcgtgtcgacttcgacgatgaagcgcggccacgagaagccaggctctctgctcgctggtactccaggtttctgaaaaataatggcattagtgctcagagtgaggtcgacgatacaggacaccatgctcaacagtgagttgtatagtcagatgcactgagtttgtgcgtgaccttatcttaggtatatatgggaaatgataaatttatcctgggtgaaaaaaaaaaaaaaaaaaaaaaaatactcgagtct

SEQ ID NO: 728 - DNA, 679 bp, Triticum aestivum
  unsure (1)..(679): unsure at all n locations
  Clone ID: PAT_TA_728
ctgagcttggcatacttagcaaatctgaaccacgaattatcacaacattcaagagggtgcggaaggggaccaatggcggggtaaccatagatggacttcttgcagcagcagcagctggatgctcgattgggcttgcatttgtgctgataggattcttaacaactcagtgtgcttctgatgtattttggaggcaactgctagttatacccttagctacagctgctggactatgtggaagcctgatcgattcattactgggcgcaacggttcagtacagcgggtactgcagcgttcgcaagaaggtggttggagtagatggtccaacagtaaggaggatttctggaatgaacatactggacaacaacggcgtcaatgtagtgtctatcttcttgacaagtctgcttactgccttggtgtgcacatgcattttctgaggtctagttgggttgtagtggtagcaccacattacagaggataactaggaaggaacacgattggtaaattagagcacggaatcttgaatagtggtgttgttcatttatttacgatcggtgatattggcggttgttgatttagcattagtgtgttacacaccatatagacttctaatgtaaaaatcggntgtagttatcccattcagatgtaacactgaatattcggatagaggaatgggtctgcc

SEQ ID NO: 729 - DNA, 1113 bp, Triticum aestivum
  unsure (1)..(1113): unsure at all n locations
  Clone ID: PAT_TA_729
atcgccgcctctcccgcgctcccacgctggcggtccgcagagccatgctcctgtcgccgccaaccccgtggccgcgcgtcaagcccgtgcgcttgaatcgtctcccgcagtgcaaagaccggctcctctcgcttccccgcggccggcggccgagggcgccgcggcggctcggcgtgtgcatggccgagatggcctgggtcgggagcgagtcgccccgagagcttggggtttctgacggggagggggacgcgatgctgggaggcgacaagttgcccggtccgagggcggaggcggcggccatccggtggacgcccgtcgaggcggcgctgaatcgcatgagtaaatggctggtggctgtttcttttgctcttgcagctctttggaagcgtgatgctgaaattatgtgggctttgatgggtgcggttgcgaacactgtgctttcgtccattcttaaaaagctgctcaaccacgaaaggccggcaccggctttgcggtctgatcctgggatgccatcatcccatgcccaatccattttctatgctgcaacatttctagttctttcagtgttctcctggcttgggacaaattatctggcaatgattcttggggctacaactgtagcattggcctcctatctatcatggctacgggtgtcgcagcgtctccacacactgaaccagattctcgtgggcgctgctgtaggatcagccttcagcgctctgtggttcgcgctctggcatttgctcgtgcgggaagcttttgcttcctcgttgtggggtccaaattccaatccgtccttgggtcagtaagtgttctctgtttccttcgccgtcccaatcattcagcactggctcaaaggatgaataatgatatagatagcacgcaacaagttaatggacagtgaaacaatccggcagagaaggtttatccgcacctccgggattncaccagaaaggactccacaatggtcactaancagacaaacacaatttgattacacgnanacatgtctgtacatatacaaacatgggctgctgctggntgtnatcagctaatttccgagcgtagcnagaattcgngtanagnaaatcactancnagaatcgggtanaac

SEQ ID NO: 730 - DNA, 553 bp, Triticum aestivum
  unsure (1)..(553): unsure at all n locations
  Clone ID: PAT_TA_730
aaaagggaaaantcccnggtntccgtccttgtccttttggaaaaaaccttnngggggttncttcccccgncagcttngccaaaatgtccggcacgctcaaggagatcttgttcatcaacaacggcctcgagtcatgcctgccgccggagctcggccgcntgcgggagctcacggtgctcgatgtcagccacaaccagctcgccggcccgctcacgcaggaggtggcggggctgaggaagctggagcagctcaacgtcgcgcacaacctgctctccggcccgataccgcaggccgtgtgcgcgctgccgcggctcaagaatttcaccttctcatacaacttcttcaccggggagccgccggcgtgcgcgcgcgtcgtgccccggggcagcgaccgggacaactgcctgccgaatcgcccctctcagcgggcgcggcagcagtgcgccgccttttacgcccacccgcccgtcaactgtgcggcgttccagtgcaagccgttcgtcctgcnttcgccgcctccgtccccgcccccgccgttgccatcaccgccacc

SEQ ID NO: 731 - DNA, 1426 bp, Triticum aestivum
  unsure (1)..(1426): unsure at all n locations
  Clone ID: PAT_TA_731
gacggttcctgtggaagtgatatagttttatctcctgggggtagtactgatgtatttgatgtttctcggactcctatcactgatttccactatcaagaaagacaccaacaagggaagtttgctaaggtgccacgtagtctacttgattttattctgatctcaaaggcagtagctgttaactcttccaagacagaacaactgctctctcatcatacctgccactgcagtgctctcaaccagaatcctgtgtggtggcttatggaaggacctcgaacaattactcatgatttctcgaagtcatgctgtgaggctaacatccaactggtgattcacaattcttcagaccataacactagcgtgagagtggttacatctgactgtatgcctgagaaaagccaaactgccccttcacatgaatctgccagtggtcagggtggatggtatgacgtatctctggaaaatgacgtaaaggccatctcaagtaccaagggggcacattctcagaaacaatcatcagaaagcatttcaccgtttgtttggtgctcattgagttccgctcaagttgatctgaaacctgacagttctgctaaaattcccctcaaagtgtgcatatttgcacctggaacgtatgatttttcaacgtatgagctgcactggaaagtgcattcatctgagagtggacatgtggatgaaaatgtgacatcaggtggtggccaagggtatcccttctatgttaatgttcttccaagcgcctgatgaattacaatgatgataaagatacttctcatgaagctcagcacagaaaaacttgcatgtagtttagtgcagaagcctgtcctgtgggggcagactgaagatctccgatatcaccagcccaagctagcggacaggcaaagtgcagatgtaccctgtaagttcccaggttggatataggacacccatatacatggattcttttgttgtcagcttcagtgctgactgcatttatacgagccctttttgaggatgaatcatgaggatagttcaggtgattagacgatgtataccattgttgtcgatgaaactggggtgcgatgcacgctgacagacatttatcgagttggtggtgtatcctatagctatgttattcttgtacatccttctctgtaccatttttcgcgaggaggttaggtaatcttcctgaaactgttggcctgggcgcggccgtggtacctcggctttttgttgaattgttgatgccggcgtgatttttcctgctcttttgtatgaataggttgagctcctgtctgcctgggtattcttgtatgtataggattattttggccagtcgtgatacttgggcagtaacgttttgacttggtgtactacataatcacagttttgctatgcacatttacgagatgattcnnngtatgtgaattctttt

SEQ ID NO: 732 - DNA, 1321 bp, Triticum aestivum
  Clone ID: PAT_TA_732
tctcacgcgtccgccagtattcggggaaccagtagcatctcaattatcaagagcggcaagagatgggatctctccccgtcccgagtgtgcaggccttggtggaggccaccggcggagacgatgtgccgccgaggtatctccggccagatgcggcagaggaagcggtcaccggtgacggcgacggcgaggctcagatccccatcatcgaccaccgaaggctgctgctggagctggaccatggcggcgaggagtctgcacgcctccacagagcctgccaggactggggcttcttccagttagttaaccacagtgtcccagacgatgtggtcgagagcatgaaggccaacatccagcaattcttccagctacccgcagagacgaagaagcgattcgctcaggagcgagggcagctcgaaggctacggtcaactattcgtcgtctccgaggatcagaagctcgactgggctgacatgctcttcctctacgcacagccacctgagaggaggaagaccaagttctggcctgaccagcctgctaccttcagatcgacgctggatagatattctggtgcgctgaaggatgtatcagactcccttttggctacgatggcgaagaacttgggactgaaacgagaaacgatcgctgacaaatgcatccgtggaatgcagtctttcagaatgaactactaccccccatgcgcccaagcagagaaagtcgttggcttgtccccgcactctgatgctaatctcctaacccttgtcctccaagtgaatcatgtccagggcctgcagatcaagaggaacggcagctggcttcctgtcaagcctgtcccgggcgctttcatcgtcaacatcggagatatgtttgaggtcttcacgaacgggaggtacaggagcatcgagcaccgggcagtcgtcgaccccaaggaagagcggctgtcggtcgcggcgttccacttcccagacatggacgccatgataggtcctctgaaggagctgaccgcacatgaggacgatgcctacaagacgttggacctcgagagcttcatgaagatcttcttcgcgacgaagctcgaggggaagagcttcttagaccggatgaagctaaactagcagctgctgagtgacggttgaactctgttgttgtcggttacgaatgccgggtgcatctgtggtgtctgttatcgtttcagttcctatatatccagtgtgaaaaataaaggaataatggaggttgatccccagaagaagaaaccaagcaagtgggcagcattctatgattgtagctggccggattttctgaatattataaattattactg

SEQ ID NO: 733 - DNA, 884 bp, Triticum aestivum
  Clone ID: PAT_TA_733
accgggtgatatggttgggggatctgaactaccgtatttccctgagctatgaagataccaagaaacttctgactgaaaataactgggatgccctttttcaaaaggatcaacttaacactgagcgcaattctggaagggtattcaggggttggagcgaagagaagatatattttgctcccacatacaagtacacttttaactcagattcttattctggagaaactgcaacctcaaagaaaaagaggagaaccccagcctggtgtgatagaatactatggcatggagatgggattgcgcagtcatcctacttccgtggggagtctaaattttctgaccatcgtcctgtctgtggatcattcactgtggaagtgtatttgctggacggcaaatcaaagaggcgcacatctaacactaatattagaattggtgctgaagagctcttaccgacgagtaagaataaggttaccaaaggtgctgggaccaaaaccacaaaataaatcggctcatgtcatgccactcatggaggaaggtgccgaggaaactttctgcggctgcggcttggtatctgtttccagcaaattgttttctcacaaagagaaaggtgattattatgttgtacagtaaatgtaatcacatgtagttttcaaatggcaagtgattaggttatatacttcagaaattcccacgatattcttttttgttggttcgggtagagcaagaaagcctctgcacagttttgcaagttgtgtcttacaaaccactgtagttgtagatgtgtcaagcttgagttttttctggagcaaaattgtactgaaagaaggcatccaatcaaactgtacaatatattctttctcatcttgatacacaaaaaaaaaaaaaaaaaa

SEQ ID NO: 734 - DNA, 1035 bp, Triticum aestivum
  Clone ID: PAT_TA_734
ggcacgaggctccatctattcatgtagatgaatttatggctaggcagagggagcgtcaaaatcctgtgccagccccatctggggatgcaccccaagtaaagagtcagacaagtttggatgacaatgtccgtgttaagacggagaaaccgcgacaacccaaggcggatcttgatgacgatcaagaaattgatattgtctttgatgaggaattggagtcagatgacaaactaccttttcctcaaccggatgataatctacaaccacctgtcattgttggggaaaattctccaggtccagttgttgaggagacagagaatcagcagaatgaaaaaagtcccttttctcggagggacatacctgtctcaagaacaatgagagtcttggtgctcacatatcttctcggacagctatgcttccagaagctaatgttcctttggagcgaaaaggttcagtttctagcccagcctcagagaagagtgcattcagtgatcatgctgatgaacctgcatacttttcctctcataacaagcgtccggcagaagcacctctgcaacaattgcgtcctaatacttatcagaagagaagtgcacataagttgtctgagagttctctgtcatctggatctcatggacacgatcataggttttccagaaaccaaccacctctgccaccaatgccactgccaacttcttccatgcctacacgaagtcctgagtcaagtcaaaggaggtcatcatcttacaatgcaagggacagcgctagggatggaccaccagcttacccatctaattatcctgtacaaccttttgaggctagtatgcctaccgcttttgtagggcttcaggctcaaactgaacatgccctagcaagcaacggtactttatcatcgaatgctcctaatgcagacgccaatttcttgtggaacaattttccaagtgaatagggccctatggagcacttcaactctggttcatcttggccgaccaatggaacccttgctcacctttatcaaacccaaattctgcaatgagctct

SEQ ID NO: 735 - DNA, 484 bp, Triticum aestivum
  Clone ID: PAT_TA_735
cttcccacccctccactcagcggcatctacgcgtccgagggctggttcatgaagctcctcaaggagagcaggcggttcgtcgtcgccgacgccgccaaggcacacctcttctacctgccctacagctcgcagaatctcaggctctcgctctacgtgccggactcgcataacctgcgccccctctccgtctacctcagagatttcgtcaagggcctcgccgccaagtaccccttctggaaccgcaccagaggcgccgaccatttcctcgtcgcctgccacgattggggaccatacacgaccacggcgcaccgcgacctctccaggaacagcatcaaggcgctgtgcaacgccgacagctcggaggggatcttcacgcccgggaaagacgtgtgtgtcccggagacgaccatcaggacgcccaagcgggccctgcgggacctgggcgggctccccatctgccggcggggcatgctcggcttgtttg

SEQ ID NO: 736 - DNA, 884 bp, Triticum aestivum
  unsure (1)..(884): unsure at all n locations
  Clone ID: PAT_TA_736
ttgnccgcccgcgccagatttgcccgcgctcccgggtcccttgccggccgctcgcgcgcctccagggcgacacttccggaccccgtgccccgccacgggcccgccactcccagccaagaaagaaagacgacggcgacacgcataggtacgcggaaccagtcgcatggggctcctcgaccagctctgggacgacacggtcgccggcccgcggccggaccacggcttcagcaagctccggaaatactcctccttctcgccctcgagcccggcggccgaagacgtcgcgccggcggtgacccgcagcatcaccatcgcccggacgccgtctctttccctcccgtccgggcgagtcgagctccgtgccgtcctccccgggcagtgcgccggactccccgttcgcagcagctaccattaggagagacggctggagggcgtttcgccgggaatccaagatcgccaacgtcgacgtcgtccgggcagaggcggccgtcgggcccaggagcccaaccgtgtacgactgggtggtgatcagttcattggactgataataaagaagcacaaccggagtgtgaaataatcgatcgaagaagaagaggaggtagctgacgtgtttgaggcaacgtgttcgtcacgcgatatggatacctgctattgtgtaatcgttgtgttaactaagtgcactatctttgctcttcttttacgtagttgtgtgccctttcggggggccaaagtatgtgatgtggttaggagtgctgcggtagtaggttccgatcaagatgtgttgccttgacggcgccttttagtgcgtgtggaggagatgagcgctgaaatgaggatgcaatgcaagtgttcgaccacgcctcgagaaaaaaaaaaaaaaaaaa

SEQ ID NO: 737 - DNA, 1059 bp, Triticum aestivum
  unsure (1)..(1059): unsure at all n locations
  Clone ID: PAT_TA_737
cacgcgtccgaagccatccacgaaggagctaattagtcagaggctggtcgacaggccgagtggcatgaaaacctccccatcagacccaccgggacacctagattacgagcgtgtgagcgcgcgacatcgctagaagctttacgtcgcgtcgcccgaattttaatgggaaaagaggggggcaaatatgccagtcggactgagctacaagtgattcctcccggaggaggagcccaaaagcatccctatagtatatatacctatcgtgtttcttggaagacttgagcgatacaagttgcctggcccaagatcgccaaagaaagatttgcctttccctctctctgagactctgcaccgccgccggtgaatcgtcttcaacctcggtcttcttcctcttcttccatggcgcagcttttgtggctggcgctcggggttcttcttctggccagctcggtggccgacgcggcgactgccaactacaccttcacagtacagagcatgaaaatcaaccagctgtgcaacagcactgacatcatcgcggtgaacggccagctgccaggcccgacgatagacgtgttcgagggcgacgaggtggtcgtcgatgtcatcaacgcgtcgccgtacaacttaaccatccactggcacggcatcctgcanaagctgacgccatggcggacggccgacatggtgacncaatgccgatccagccaacggttctacactaccgggtnaacgtgacggggcacgaggcacactgggggggcacgccactctcttctgggcgcaacgggtacggggccttataatccgccccggaacggaccgctaccctttccgggccggacaaaaggncccgtgtattgnaggggggacngatgcgnactnaaaagacccnnntgcgcagtgccaacctcganctttacataaaggctacggcanttacngggnaaagaaantacggggggggnnccaaacangggtnntcggnnaaaaannncttntnnnggnncngnngggnnnntnntgggggggnnnnnnnntnnnncnggnnnnnnnncnncn

SEQ ID NO: 738 - DNA, 760 bp, Triticum aestivum
  Clone ID: PAT_TA_738
ccggtccggaatttccgggtcgacccacgcgtccggtctctggttcggaggatggtaatgttcgggtttgggataccagaagtcagcaagtaacccggaaattcaaacactcccaaggtccagtaactaatgttctcatagtaacacccaaaagattaaacctgccacctttacaaccattgcggaaagtgtgcgcagcaagtggcgaagttgtaccacgagctgtaattctgcccaaccctgaaaatgatgttcatattgctggaaatctcagctctaaccttctagagcagctcttggatgcacagcagcacggcagctctaggttatttgattctggggtgagcactctcaatggcgtaccaaaccaacagggggcagaatggagaagtaaatacctagagttgcaggatctttttgtgcatgaggttcttggtgatatgtcatcttaatggacatatgataccacaagactggatattatgggctactgtcagttaggaggtttgtggtgaagaactgttcaacacatgagtttggtgttcaactagcaaacctgggaaatccatggatgccaaagatgacttccttataacaaggaaactccttacctttcattgcgtccacatgtcaattgacatgtggcagagccatatcagaaatagtaggaaaaactataaacggagcaaagatgggacatcttaaactgtaattcgactgtgtaaacagaaatgaagaaattttcgctaaaaaaaaaaaa

SEQ ID NO: 739 - DNA, 1671 bp, Triticum aestivum
  Clone ID: PAT_TA_739
gcctgggcccccgcccgtggcgcgcccgggggcctgcgcccccccctcgtcctcgtcgtagccgtccccgccggcgcctccccctccgcccccccccgccgcgccccttaaccgccgccttgtacgccaccgcctcctctcgccttgcctcgtcctcacccactgctcggcgccgtcgtcgttgtttatcaccggggagggagccaggctcgatcgatcaatcctcctcggcgccgctatctaccttatctgcaagaaattccttctagtttgttgtcaacatggattgctgctttatgttcggacggagatctcaacatgctgttgaaggcgatgagggtgaacatagtgtgagggtcttttcttacaacgagttgagaaaggcaactcaagacttcagtgggggcaaacaagctcggcgagggtggttttggttccgtattcaggggaatgctcaaagacggcacactaatcgcagtgaaggttctgtcagccacttcaaggcaaggcgtccgagagttcttgactgaacttacagcaatttcagacatcaagcatgaaaacctcgtcacgcttgtcggctgctgtgctgaagggtcccataggatcctcgtttacaattatcttgagaaaaacagcctttcacagacattgctagggtctggctacagcagcatccagttcaactggagggctcgtgtcaaaattgccgtgggagttgcccgtggacttgcatttcttcatgaggaaatccgtcctcacattatccaccgcgacataaaagcgagcaacattcttctcgacaaggacctgaccccgaaaatttctgattttgggttggcggggctccctcctgccaatgcaactctggttagcacccgcgcggcaggaagatgtgggcactttgttccagaaaatgccttgcggggacaagtgactcagaaatctgacatctatagttatggggttcttctctccgaaattttcagtggcacatgttatgcacacagcacgcaatggcgcgccgcccccactcccccttcggcagacgtgggctttctacgagcaagagcgtctcgaagagatcgtagatccggacatagacgaagaccaggagatcgaggaggcatgccggttcctgaagatcggcctgctgtgcacacaggacgcaatggcacgccgtccccacatgcccaccgtcgtgaggatgctcacgggaagcaagagcatctccatggagaagatcaccaggccagccatgatcaccgactttgcggagctcaaggtcagcaccaagccgcacggagcgaaccaggcacggtccaacacatcgagatccttctccaccacggagatatcggagcccttctcgtcgtcggagaatcacacacagacatctgtatgaggagctggacaggaaattagcgccgttcgatttgtacattgtcgtggtgatagatatgcctgcaatttttggaggatatattgctttgttttttgttttttttccttttttgattccacgaggaagggttgggttaatggggcaacctgtcgtttgcttgttgtgtagtacgatgtgaatatctggagatggagatgatcaagataggctcttgcaagatagtacggttcacatactcttgctttgaaaaaaaaaaaaaaaaaaaa

SEQ ID NO: 740 - DNA, 612 bp, Triticum aestivum
  unsure (1)..(612): unsure at all n locations
  Clone ID: PAT_TA_740
tctacattngtgcagtncctaatctntaagatccgatgtnttaacccccacgcgtccgagggagagaggagacaagttggtggcaagttctcttatacaccatttagtgctgggaggcacttctgcttgggagaggattttgcttatacgcaaattaaggtgatatggagccatttgctgaggaactttgagctcgaattgatctcccctttcccgaaggaggaatgggacaaattcattccagggcctaaaggtaaagtgatggttagttacaagagacgaagactcacgtgattagcatctattgaagaacttgtaagggtgtgtactatgtggtggatcaagtaaattgttaagtgtgtaatttgaagagagaataaatgtatctgtgcttgggactatttggtaaaatatgtatttcaaaagattaagtgtgtaatttgaagagagaataatgagtatgtacgtctgggactataggtaaaatatgtatttcaaaagattgtgtgtgatttgaagggagaataaagagtgtgtacatttgggactaaaaaaaaaaaaaatatgacactggaacagcccgggcggaccaccgaaatcactagtgaattc

SEQ ID NO: 741 - DNA, 709 bp, Triticum aestivum
  Clone ID: PAT_TA_741
tgcaacccaacccaactcaactgcctctcaaactgctgctgtagaagtagaagggaggcggcgccgtgtgcatcgcctcctcaactcatcatcatcaatcgaaaaagaaaaaagatctcttcttgaccgccttgctggggtgggttgacgcccacacagatctcaagctctcatctcatctcaccggggcaggggatggactccaatccgccgtcgccgccgccgccgcaagcaggagacggcggcggcggcgagaagcagcagctggctttcgaggcgccgccgcagccggtgagggaggagtacgtgcagaacgccgtcaagttcctctcccaccccaaggtcaggggctccgccgtcgtctaccgccgctccttcctccagaacaagggcctcaccgccgacgagatcgacgaggccttccgacgagtccccgatccgccgcccaccaccgcgtcccctcccacccagacccagacccaggcccccgccgcagccgcgcctccgcaagcgtacgcgcagccagcggcggggcctatcgtcgtcgccgcgccgcagcccaggctcacctggtaccgcgccttcgtcgccgccgggctgctgctcggcttcggagccagcgccgccgtctttgtcaagaagctgctccttcctaggctcaagtcatggatccgcagggtcgtcgctgagggcgatgaggccaccgagc

SEQ ID NO: 742 - DNA, 920 bp, Triticum aestivum
  Clone ID: PAT_TA_742
aaatgccgcccccttcgcacgaaatcaccacacgcgcagcaggcacaaccacacgcccccgccccacccacacccgctccgccgccgccgatccccctccgatcccccaaggaagccgtcgcgtcgcagcagatccgtccatggcggcgctggggtccaagctggcgcagctgcaggccaaggcctgcgaggcgacgcggttcgtggccaggaaagggtgcgcctaccacaagaccctcatggagaagaacaagcagttcgtcgtgcagccccccaccgtcgagaagtgccaggagctctccaagcagctcttctacacccgcatcgccagcctcccgggccgctgcgaggcattctggaaggaggctgaccaagtgaagcagctgtggagaaacaggaaagatctgaacgtggagcacgcgggcatcatggcgctgttcggcctcgagctctacgggtggttctgcgtgggcgagatcgccggccggggtttcaccttcacgggctacagcgtctgagcgccttccttccatgagtaccttcacgcggtcgtcgtcgattaagagctgaagactctgttagccaatcagtttctcgtgatgcgcggtgcgaagttttggttttctgaaaaaaaaatactattcttgatgctggtgaaaaaagtactcgtcgatgaggtctaataatttgtcgcacgcttagtttactgatgaagcctggacagatgaaatgtctgatgtttgccttgcttgcttgctaagttcagggcaagaaatgatgaaatgaatttcacttggtgatgagttagtattatattcatgctgaaattagagcatattacgctcttccagacgaaatgatgaaatgaatttgacttggtgatgaggtagtataataatgatctccccacaaaaaaaaaa

SEQ ID NO: 743 - DNA, 863 bp, Triticum aestivum
  Clone ID: PAT_TA_743
cgtgaatcatggccaaatgctactccgactggcctcccctcccccctctccatccatcgagaagatcgtcgcccaacacctccctctgcacgatcaagcggcagctcgcgtccttcgtcctgcactgctcccgctcctgcgcttcccccgttcttgagcccaagaatttgcccggggagctccatgttctttccgctccggcgtcgccggccaaggcggcgccggtgcctacgcttcggatgctgcgaagctcggcatctcaacaagttcatccggggcctctgcagcgaccggcagaccgagccgctcgccttcgagtgctaccggagggctctgcagcagcccgagttccggccggacaagaagacgatgaatgcgctcaccgtgcagctgctccggtccaagcagtggagctcgctggagcatctggtccaagatttcatggcctatggtgtgctcccggagagacggacgtgcgcgcggctcgtcgcgacctgcgtcaaggcgaggaagttcggcctcgccgacgtggtgctcggggtcctcgaagggaagaagggcccggccgccgccgtgtgcttcagctcggcgctgcaggcgtacaacaagctgcacatgtaccggagcacggtgctgctgtacgagcggatgaaggcggcctgcttgtcggtgaacgccgacgcctaccgcgccgtgatggcggcgttcggggcgctgggcgagccggacacggtgacttcgctgttcaagcagtacaggtctcggaaatggtacccctccgagacctgcctcgagacgtacaccatcgcctgcgacgcgctggggcggccaggcagagccctggacgcgctcaagtgcctgcg

SEQ ID NO: 744 - DNA, 1564 bp, Triticum aestivum
  unsure (1)..(1564): unsure at all n locations
  Clone ID: PAT_TA_744
cgtccgntcccttctctaaccatctccccaaaaacatgtttctccggaaaaccaaatcgtacttgttgaaaccctagcgccatctcgccgccggcgatgtccgcttgacggacgcgccaccgagaaagcaccaaactcctccgagccctcccctctctctgatccgtcgcccgcccgcgggatccggatcgtcttcagccatgtcaaaggccagggtctacgccgacgttaacgtggtgcgccccaaggagtactgggattacgaggccctcgccgtccagtggggtgagcaggatgactatgaagttgtgcggaaagttggaaggggcaaatacagtgaagtctttgaaggtatcaacgtcaacaataatgagaaatgtgttattaagatcctgaagcctgtgaagaagaagaagatcaaaagagagatcaaaatactacagaatctctgtggaggtccaaatattgtgaagctgcttgatattgtcagggatcagcattcaaaaacaccaagcttgatctttgaatacatcaataacacagatttcaaagtgctatatccgacattgacagattatgacattcgctactatatctatgagttactgaaggctttggattactgccattcacaaggcattatgcaccgagatgtgaagcctcacaatgttatgatagatcatgagcttcgaaaactccggttaatagactggggccttgctgaattctaccatcctggaaaggagtataacgttcgtgttgcatcaaggtacttcaagggacctgagcttcttgttgacttacaagattacgactactctttggacatgtggagtcttggctgcatgtttgctggaatgatattccgcaaggaaccatttttttatggccatgacaaccatgatcaacttgttaaaattgcaaaggtacttggaacagatgggctaaatgcttatttgaacaagtacagaattgagcttgaccctcagcttgaagcccttgttggaaggcacagcagaaaaccctggtcgaagtttatcaatgcagacaaccagcatctagtatcccctgaggccatagatttccttgataagcttctgcgctatgatcaccaggataggctcaccgcacgtgaagctatggcacatccatacttcctccaggtgagggctgccgaaaacagcaggactcgtgcgcaatagcaatagcaagactgttgctgacattgaacgagcagcgcttgacgaagctgcatccttgtagcgactttgtcatgtattatgactcgataatggttgggtcagctgggaaaggtaagagcctgtgtggtgtgtgcctctcatcgacgaggcggaaaagaactgtgatttgctcctgttgtttgtgtatggaaacctgattgattgaaacttcgcaaacacttttcatgtaacgtgtttggtaacattgtacgactctgcttgtaaagaatatctttggtaaattgctttggattcaaaattctgaatagtcactggattattagcttgttaaaaaaaaaaaaaaaatgcntgggaatcancag

SEQ ID NO: 745 - DNA, 655 bp, Triticum aestivum
  unsure (1)..(655): unsure at all n locations
  Clone ID: PAT_TA_745
ctcaactgctactaccaccagcttgccagcagccactcggcaacttctctcttagctagctcgtgtcgcgcgcgatgggccctcagcttctgctcgtccttctgctcgtcgtatctggaggcgttgccgctgccggcgccgacgaggccgggctgccccgactcgagttccaaggcgtcgtcgactggggccgcgggaacgcgtccgttgcgccggaggagctggcgttcatggacgtcatctccgcggacggcgcctgcgggcgcttcgcccgcctcgtcgccgagacggggaacgcgggcgaggtcttccgggggcgcgtcgcgggcggcggcggtctcacggtgttatgccccgaggacaaggccttcgccaagttcgagccgacgttccggagcctcggcgccgacgaccggctcgccgtgctgctgtaccacgccacggcggcatgctacggcagggagcatttccaggcattcgactgggtggcggtgagcacgctggccgtcgacggggccaccaacaagggcatcgccatcaccctccgcgacgacggggacacggtggagatgtggccgtcgccgccgtcatgggagagcgctgncagggtgaccaagacggcgtccgaggagcccccacttgccgtgtacgtcgt

SEQ ID NO: 746 - DNA, 1565 bp, Triticum aestivum
  Clone ID: PAT_TA_746
gctctcctctgtgtgtgtgtgtgtgtgtgtgatcttcttcctctctcaaggcagtttaatcttcttcctctctctctctctctctctctctctctctctctctctctctctctctctctctaagccctcctcgaggcactaatcttcttgctctctctctctctctctctctctctctcacgcgcgcgcgcacacacacacacacacacacacacacatggtttagcccctaattttaagaagctgcacaggcaggcgcggacgggtgtcttctcttcccagcttggttacggtcattcttcctagatctcaagatcatcagaaatggcaactggagagataaccgaagggagcagctccagccccgaactaccaaagatattttcatttcagtctctggaaggaattacgaataacttctcccgaatattctgtaaagatccatttggaccagtttataagggaactctgccagatactgacaaagagattgcggtgaaaaaacttgagcaaagcgcggaaatcccacctgaggattttgagaataaggttcagagtgtttatgagattaaacatgaaaatatcgtagagttgattgggttctgcaatcaaacactacagatcactacagaaaggttactctgctatgactttgatcctaatgagagccttcaacagcatctttttgggcccaaagcaacagatggctccaattcggctgatcccagtacagactgggacacatgtttcaaaatagtcaagggggtttgccagggtttactttatctacacaagttagaggatcccattacccatatggatcttaacctgaataatatatggttggatagagcaatggtacccaaaattgcaaatcttggactctcaagaatctttagtaaacaacggatcaaatactacaaagaggaatcaactagatacatggctccagaatatctaaacagcactggcatgtcggtctcaatagacatatatagtttgggggtaatgatgatccaaatcaccacaagagaggagaacaacgacaatctggacaaggcctcaaggatatacattaaagatatacggaaaaggtggacagcagagcacatagcatccgtgtactcatcgcttgattcagaatgcctccatcaagtacatacatgcataaaaacagggctagagtgcatgcagattgatcagaaaaataggccttccatagatgtaattgttgacaggctcaacacaatctgaaaaaacaagaggtattgaagcaaagagaggcctgttttgggttgattttgtttcaggaaaatgcggagaaggcacttggcacattatttgaaggccacatttcagaaatcctttatcgaatagactcttgtgtatattaaatctgtactggtatatgccctaaaaaaaacatgccatgttcagttatgtttgtatcattttatagttataaaaaacaaactggcacatacttacatttgaactaaaaaaaaagtgtgtttcagtatttccccattgaacgtgagtttggaataaaaaaaaaaaaaaaaaaa

SEQ ID NO: 747 - DNA, 853 bp, Triticum aestivum
  unsure (1)..(853): unsure at all n locations
  Clone ID: PAT_TA_747
gccgcgaccatctggttttcctgatgagattctccgtacgaaggtaccccacaaacacgacgaactgtgtgacgctatcggtgagcactcggagggaggctctatgaacccaacagaaaatgtggtgtgacattctaattttttgcatgctgttgatgatgtgtctcaggacaaagagcgagagggctcaccttgttgaccaccctccaaaggtgaatccgaataaacgacgtaaggtggaaagcgacccttcgtcggctgatgcaatggaaaccgagaagacaagaaaccaggctgaaagatatccgggagaagagggtagttccgagtcgcaacaaggtcttccaaggggcaaacggaagggtcggaagcgcaccagtcatgtaatgaaatcctcgggttccaagaagaggaggaagataacgaacatggattcatcctcagagaatgctgctccccccttgtctaattccagcagcaaccccatggttgatgagagccaagagcatgattcttctggcggtgataggcaacctaacgtctgcaggttcataggatatcggctgagacagtgctgtttgcaatgacatattactggaaggggaccaggtgatttcctttctggccctcgaatgcagtataagtttgtttgggctgagatcgagaagagctgtggcctgggaaagcgtatcctttaaccggagttccaagtttgtagcaggctacgaactgtgagatttcatgcccagcaaactgcgctcatgtgacaatagtgtatgtaatctagagtaaccatttcttncccagcatagtagagtgttttttggttggcatgcttgagcctagtatgttg

SEQ ID NO: 748 - DNA, 2235 bp, Triticum aestivum
  Clone ID: PAT_TA_748
aaccacatgtcggggtcgctacatgatgtgtcgcgtgatctggcacttctcttgagcggtcgtgattctctgtacaaacggaggcggttagtgatgcccagaaagagtagaatcgcttccgagagattgccagtggaagaaggaccttccctttgaaactcaggtgacctccaagacgtagaggtgggagcaaagaagctgcctgattccgcatgggctatcccaacgcagacctgaatggcatctcatgtgccgcccgtgggtccgaccacccgtccttcttagcccccatgctgcgcctcaactctcgcaccccgaggagctacccttcaagttctctcgcccttcaccacttttcgtcccccgccgcatcttcgccacgtgaggattccgcgcccgcgaaaggagaacactcccgccaccggcggagaacccccgccccgctagtgctcctccccatgagcgctctcctcctcggctagctgagcatcaactggggatgccggctgctggctagcgcagtgagcttcccccacctctcaaggttatcggcgcatcattgcgtgatcagccagctatggtatggttgagtgtgtggaaccgcttgtctcgagaagattccatatccgaaccgcattggcctaaaagcctggcgagatgggctgcaagtgccgcgtgcttgtcgggaccggccagggaatgtttccttgacctgggttgcttcccagaggataagaagatccctcttgaggcgttgatcaatatttggatggagatacatgatcttgacaagccagatgctttcgccatcctcatggagctatcgaacaagaacctgcttaccctagttaatgatgcacagaataaagctggagatttatacagtaactatcatgactactcagtgacgcaacatgatgtgttgcgtgatctggcacttcacatgagcggtcgtgattctctgaacaaacggaggcgggtagtgatgccaagaagagacgagtcgcttccgagagattggcagtggaataagcaccctccctttgcagctcagattgtttctattcatacaggtgagatgaaagaatctgactggttccagatgagcttccccaaggcagaagttcttatcctcaacttcgcctcaagtgtatactacctcccgtcgttcattgcaacaatgcagaacctgaaggccctggtgctgatcaactatggtactaccagtgcagcccttgacaatttatctgccttcaccacactaagtgacctgaggagtctttggctggaaaagattacgctcccgccactgccgaaaagcacaatcccactgaagaacctgcgcaagatctccctcgtcctttgtgagctgaacaacagtctaagaggatcgacgatggatctctccatgacgtttccgcgcttatccaacctcaccattgaccattgcgtagatctgaaggagctgccacctagtgtatgtgaaatcagctctctggaaagcatctccttgtcaaactgccatgacctcacagagctgccatatgagctgggcaagctgcactgcctgagcatcctgcgggtgtacgcctgcccggcactgtggaagcttccaccgtcggtatgcagcctgaagaggctgaaatacctggacatatcgcagtgcattaaccttacagaccttccagaagagcttggccacctgacaaacctagagaagatcgacatgcgggaatgctcgcggttgaggagcctcccgaggtcctcctcgtcgttgaagtccctcgggcacgtcgtgtgcgacgaggaaacggcgatgctgtggagggaagccgagcaggtcatcccggacctccgtgtgcaggtagcagaagagtgttacaacctggactggcttgtagactgatgttctggatgctctctgcactccgggctcaccatgtacaaatgatgtgtatatgtttccctgtttgaatgcaggatgggtagtcaatacactgttcagttttgacatgttcagtgttcatgtagttgactccagtagctgacatatcttgaagtcatggtctttcgagtagaaatgcacacaagagtttatattggccaggctaacagagaatttatattggcacagaccatttttctctccgagcaaccggcaggagagctgcctttttattaaggagcagaatatgtacaaaatgaacaactccgacacatcatgctaattactca

SEQ ID NO: 749 - DNA, 702 bp, Triticum aestivum
  unsure (1)..(702): unsure at all n locations
  Clone ID: PAT_TA_749
ccggctgcgcgatagtcgatctgattgtgcctccatgatggcatcgtgatgcccaccgccgacggcgctgcgtcgcgaccaaaggggcacccggccacggccggggactcactgcagttgaagcacgccatctcgccaccatgtacggacgcgtgggttgtgctgcaggtccttggggttgggtgttcttgtcgccaccatgttcatgcaggcacaaattggactgagaaatgctaacagaggaggagaagaccatgcaagtccttggggttgggtgcggcaactcgcggctcgaagacaatcttttgtggtggggcgtcgctgccgccggcggcacctgcatagaccgtctcgctgggaacgaagagatgctcccctgatttggagctgtagaaaggaggtggttgcagacacaaagtggggacacacaactcccagtcataatattctttatcttggctcgttgtttggggatggacgcatcaatctgatcgcgctctcctccatgccaaacggatccttggttcggaggtgcgcggtgccgacgatgacaacctttctatcgacgcaagggcagcaggagctcatgacgctgttgatgccaccaccatgcacangggttgatgcaagtgcgatcactaatgggggagaacataanacttcaattgagggcactgtgattctctagctacatgtatcatg

SEQ ID NO: 750 - DNA, 795 bp, Triticum aestivum
  unsure (1)..(795): unsure at all n locations
  Clone ID: PAT_TA_750
cccacgcgtccggcctgctgcctactacagtaggagtatctgtctcctctgctctgaaacaaataagcgcaccaatcccggtgcgccgtctgcctctgcctgccgacctctccagacggatgggcatgggctgcctccaccagcggctcggccgcacgcgtgctctgccgttcgtgaggaggttcaagccgagcgagatcgaggcggccaccagaggcttcagcacggccctcgagaccggcgggcctcgcggcacggcgtaccgcgcccgcttcgctgatggcctcgtcgccacggtgcgccgtgcgggcagcggcgacccggaccaggaagggcaggagggcgccttctaccgggagctgcagctgctcggccgcctcaaccaccgacacgtcgtcaggctccgcggcttctcagaaggacacaacaggtttctggtgtttgatcagatggagaacaggagcctgaaagaatgcctccacgatcctcttaggacgccactcaactggaggacccggttgcaggttgccatagatgtcgcagcagccctggagtatctctactacttctgcgaccctccggtgttccacgtgacggtgaactcgagcaacgtgatgatggatgctgatttcgtcgccaagctatcgaacgtcagtgtcgtcggtcacgactcttncgaaggatcccacgccgaagagcgaattcagcagatgcggacggagcctggtgttccagtacgggcgtgttgctcctggagctcgtcaccggacagtcgncccgggggcggcgacggcg

SEQ ID NO: 751 - DNA, 617 bp, Triticum aestivum
  Clone ID: PAT_TA_751
ccccacgcgtccgacgaatcggagaagtcagcgtgggcgggggtggacaaggtcgtgggctgcggcttcgagccgacgaagcggaaggtgtacttcacggtggacgggcagctggtccacgcggtgagctgcaacgccgacgccttctccagcccgctgtacccggtgctggcctccagcttcgacgtgatggcgctggtgaacctcgggcagagcaagttccggtacgcgccggccaacgcgcggcgcacggccaacccgtgcttcgtgcggtccgcgtcgctgggcgagggccggagcggctccatggggctcgacttcgacgacagcggggacctcttctccatgggccgcgtcgactccggctggacggaggcctcgcgggttagcaagagcaggaaggagagcggcggcggcacgacggcggccggcgacctcgaagccgagtctgacctcttcgagatctcattgtgagagatagcgacaggtgggctcattggtcaagcaggagttaatggcgaaaggtggtggtgccgatactgacgcgggggttaggacttactagaacactgcagctgcaggttttcccacggccgtcgttgaatcttctcgctgat

SEQ ID NO: 752 - DNA, 561 bp, Triticum aestivum
  Clone ID: PAT_TA_752
tggtggttcccctgtgccacccggagctgccgctgcggctcggggttcggcctgtggcggggattctgctgcacgggccgccgggctgcgggaaaaccacgctcgcccacgcaatcgccaatgagaccggcgtgccattctacaagatatctgcgccggaagtcgtatctggggtctctggggcttctgaggaaaatatcagagtcttgtttaagaaggcgtacagaactgctccctcaattgtatttatagatgagatagatgcaattgcatccaagagggagaatttgcaacgtgaaatggagcggcggatagttacacagttaatgacatgcatggatgaattccaccagaatgctggatcggatggtggtgacttggactcgcaatcatctgaaaagaagcctggctatgtcattgtaattggagctaccaataggccggatgctgttgaccaagcgcttcggagaccagggaggtttgatcgagaaatatctctcggtgttccagatgagattggacggaaacagattttgaagatgcttactcagaacctaacac

SEQ ID NO: 753 - DNA, 852 bp, Triticum aestivum
  Clone ID: PAT_TA_753
gagagagtttctgcgttttgcaaggaccaaacttcgaaaataatgcattgctcggaactttgatcctaatgcttgtggttggggatgcaggatgagtgagtttgattgatatgaatggaagaacaaagatcacacagggatctcagaagagtggcaattctccaatgaagacagggttctttggaagctcgggacacttccacctgggctcatgacgttctacaagctgacgcacccccttgacaaatcatggcatgtccttggattaggagacaacccatccgtccacgcgtccgagatagacaatgctgctgtcgctcattacaatgggaacatgaagccatggctggagctggcaatgaccaagtatcgaccatactggacaaggtatataaagtatgaccacccttacatccgcggatgcaacctgagtgagtagatgtgatatgaagcggctggagaagatcacacatctgaagcagaagtgtcccctttctccttgaagcatgtagtgaactatgtagattaagggaagtagtatcggctggagctattgattgcttgcaccctggaaatttctcatggacgctctcatgattgatgtgttatagtcttagcagttcctttgttcaattgatgtgcagcttaatatccaatttgtttggccaacaaaatcacgctaaacctgttgaacgcgtgcctgttgttggtgttaccgtgttgcttagggctactatagtagaatttctggagtaatggtgattgtaagaattgcagcattttcttgctgttgctcagatgatttaagtggtattcaggatcattgtaagaattgcattaaccttggggttg

SEQ ID NO: 754 - DNA, 931 bp, Triticum aestivum
  unsure (1)..(931): unsure at all n locations
  Clone ID: PAT_TA_754
atttatcnaagggccagcccagatacttgccataaaaggatgatgctccggaaaagatcagaggaaggtggtgttagtcttgactacttgcaaggtttgcatgagaaacatgagagctggctgtttccttcgaaaggaggaggccgtggtgtattatcagttagtcagctgcccacacagatggagggcaacttgcctccagggataagggatcgtgtcttttacctggaaggagatcacatgcattctagtatccagaaggttcctgctctggtcttggattgtgaacctgacattgatttcaacagagacatacaagcgaaacgacagtacgcgcagcaagttgcagagttctttgaattcgtgaacaacaaaaaggaagctccatccgagcaagcaagcactgagaaggaccgcatgaatccaaagatcatgttccctaacaaaggaggtttgtgggtccctgaaggtgtgccgcctttcgcgggctctgcaatgaatctggatttcagaagagccatgtcttcatatctcccaacttaaggcctcagcttcgagagtacccgggcctgtttggttgaaggctaagaatgccataatcatgctaactttttgtcgaaatcgtcttatggccaaggaaaaggagccataagcacgacaagcttagctacaaagagcagtgcctgtgacagacgggtcatgaggctaagcaggttatggcaagccatagttgtggtaggcaaccaaacacaggaccctcagctcactgaccttgtaaaaatcgctgatgcttttcactagacctattagctttgcctgatgctagccgatgatgtagaatagtngtgtccgtatccccatcttgtaaattggcgatctcgctggtagttccacgttctgtggtagcagtagcctatgtttatctgaacca

SEQ ID NO: 755 - DNA, 1017 bp, Triticum aestivum
  unsure (1)..(1017): unsure at all n locations
  Clone ID: PAT_TA_755
gtcgacccacgcgtcgtgatacatcttctcatctctcatctgaaccggtctgctgctctgcaagactgcaaccaagtctgtgcccacaagagtgtcccgatctcgacggccctcgctgacatcagcccatgaccaggtgaccagacctaagctctcacggccatggcgagggcgaaggcaccgaggcggaagccgccgcaggcggtctcccgacggctcctcggattttgcgggctgagcttcgcggcggcgttgtacgtggggattgactacctgcggtacctctcgccgacatggcacgaccggctgcagccggtgctctgggcggcgctggcgctcgccgccgccgcgcgcgcaccgttctaccgccactgggatgtcgagctccgggcgggtgcttcccttcctcggttccatcgtcttcatgctcagcgccttcctcatcgagatgatctccgtccgcttcgtctccgtcctgatggggctccagtggcacggatctgctgctccacttcctgacactggccaatggctgcttctagctttgaatgagaagcttcctggaagtgttgttgatctattgagagctcatgttatcactcttcaccattattggatgttatttatgatgttggggttcccagtgctgtttgattgcatcaaggctcctggtctgggaatanccacaagatatatgttcaccatggcagtcggacggttgcttcggacggcaacttttgttgntaaattcttccatctgcgaaaccttggtgcnctgcaggccgttatcaaatacctgggcacctcatcctgggcgcaaaaatattacgttcaatancttctgatcaatgctatcgtgcggcatanaaatgatatggctatgctgtgtcaagctancctgatgagtanntccgacngggncgatnattctagnaacattgagggcaacccggagagggcngatggacatctgttgaaaaancatggngttcaagattangtaagngggaaagctng

SEQ ID NO: 756 - DNA, 679 bp, Triticum aestivum
  unsure (1)..(679): unsure at all n locations
  Clone ID: PAT_TA_756
atgccataggtgcttgtcgtgttcatgatatggtgcttgatataatttgtttgttatcaaaggaacaaaattttatcaccatactagatagtaatgggaactactcatcttcaaaaggcaatgctcgtaggttagcaatccaaacaagaggtgaagagcagtacaaccatttcggcaacacgagcatgccaaaattgaggtcatgttatgccaacaagtgtcctagaagtatgatgccaccactttcatgctttgaagtgttacgtgttctagatttgaaaaactgcatatctatagaaaattgtgatcttgagcatattggaaggttacatcagttgagatacttgagtctggagagcacaaatattagtgagctcccaaaagatataggagatctaaagtttctgcagacactagacttgaggaagtgcaagataaaagaattgccacagagtactagtttgctaaggaaacttaagcgcctgagcgttgacgagaccactaagtggacatgtgttcgtataacagtgccgaattggatagggaacctgacatccctggaggagttatcattgaaaatntagtggtgaaattctctaccctggttgaagaaactcgtaagctgacagagctgagggtgctggactgtcatttaagggggacctctgaatgattggtc

SEQ ID NO: 757 - DNA, 788 bp, Triticum aestivum
  unsure (1)..(788): unsure at all n locations
  Clone ID: PAT_TA_757
gctgtggagttgtccccgtactgtcacataaggcaaggtcnccntgctgttgcacacncgtcatgatgcttccaanccgcagacagggagcttagactgagatggttgccccagggctccaaccggacataatcacttactcgacaatatcttctggtctttgtcgggaagacagaatcgaagaagcgatcaaagcattttgtaaagtgcaagacatgggcataaggcccaacactgtgctgtacaacgcgatacttcttgggctctgcaaaaggcgtgaaacacacagtgctatcgatctgtttacttacatgatatcgaatggctgcatgccaaatgaatcgacctacactatattgattgaaggcttggcttacgaaggcttggtcaaggaggcacgggaaatgctggctgagttgtgctccagaggagtggtgagtaagactttggtaaataagggagccattcggttacttgatgcttgatggaactatgcatacttaaaaaggttgaccagaccagtaggagtgtgtggatccaggaatatgttcttgtgcatcttaggcagcagagatacttcattgttcttaatgatgtcttattcgacgctgtgttcttatgaacatgtgagtgtcctttcttaatgtgaagcgcacagcctcctccagctcaacttgctacaaacttgtacaggattcttctctcttctttaatatactcaatagggagctatcctatcttgtttcccgttagaactgttccgactgggaaantattttggggggggg

SEQ ID NO: 758 - DNA, 589 bp, Triticum aestivum
  Clone ID: PAT_TA_758
aaaaacgaactggttaagtacacgtgggacgatttcctggcaataacacgcaacaccataaccagcaaaaaacaaagaaagggtgggtcgcgtaggcataataaggcagacttgttcataggagatactgagatggtcaatggtggcgggtcttcgaactcagatgatggagatgttgacacatcggtatcctagatcgccgccaggacatggacacccaaatggagtccgtcccacagattcattccgatataatttacctctagtccccctccccctcagtatctaaattcatgtgcataaggccctggtggtctgataaaaggttagataaccatgacatctcagattaaattggagatggtcaattataggaacaaattaaattgaagatggtcaattataggaatgaatttagctgagcaatcatttgaaatgatttcagaactgtgcacatctgtttataaggtttacatcaaatttactcgacatgtaactagttcccgacaccttttatttcatcgagccgttgatgcatcggtttgacttgggcaaaaaaaaaaaaaaaaaaaaaaaaaaaaaactcgag

SEQ ID NO: 759 - DNA, 1615 bp, Triticum aestivum
  Clone ID: PAT_TA_759
gccccctgcaccctgctccaaacccagccaaaccctcgcctccccttcccccggggcgtcctcttcccgccgcccgaatcccaccccaaccggacccgagctagaaggaggagcagagcaagatgcccccgaagaaggcggcggcgtcgaaggccgacgtggcgaagaagcagaaggtcgtggaggacaagaccttcgggctcaagaacaagaacaagagcaagaacgtccaagaagtacgtccagtcgctgcaccaggccgtccagccgcagcccgacccgagcatgaccgccgcctggtagaagaaggtggaggagaaggcgcgcgagaaggaagctcaacgatctattcaaggtcgccgtcagccagcccaaggtccccgttggtgtcgaccccaagtcgatactttgcgagttcttcaaggctggacaatgtcagaagggtcttaaaggaaagtcttcacgcgacatgaatgtccgaaggaagggagagaagatggatctttactgcgacacgcgcgatggagaggaagaagatacaatggatgactgggatcaggagacccttgagaaagttattgcatcaaaaaacgcagagtaccagcagaataaacctactgatattgtttgcaagcactttcttgatgctgtggagaagaagcagtatgggtggttttgggtttgtccaaatggcggcaaggagtgccgcttcaggcatgcccttccgcctggttttgtactaaagtctcagatgaaagccttactgagaggaagagagtaaaaaggttgcaattgaagatgagattgaagaccagcgcagaaaggttcaaaccacaacccctatgactacagaattgttcatggaatggaaaaggaggaaggcagaagaaaaggaagctggtctggcggccttgagggcagatagggctaagaatgaccgtatgagtggtcgtgagttgttcatggccgatgcaagtgtgtttattgatgatgctgaagcatatgaagtttatgaaagacgtgaagagccacaagccaaccaggaacagggcaagaaaagtcaggatgaaggtccaagctcatcaacctctaatggcaaggaggccgacgaggagctggatgatgaagatctagatgatgacgatgacctagaccttgacgaattaaatgaactcgaagcaagcctgtcgagaacttccattcaaattcaagaaccaggtgaggggacatcatcttgaacagggaggtcattgagaagtcgtactccatttttgcgctccaaatcggcctacttgctttattagatacaaaagggtggagcatagatgcaagtggacattagtttcaagtgactatgatcatcatctgttttgagggagcgatgattaactgatgatgcccagtgttaagaacatgacatttgatgtttcctgtgttgccttgttgtctttgtgggagttattttgctgcttgtgaataacagcaccaaagtttttctagccttgtgcaaaacctatatggaaaaccttggtgcggacctatttataagtggtgtcccaggattgtagtctttttatcccctttgtttaacagaatttgggatcttagatcacct

SEQ ID NO: 760 - DNA, 1294 bp, Triticum aestivum
  unsure (1)..(1294): unsure at all n locations
  Clone ID: PAT_TA_760
gatttcggctcgtcaattctctgccccctcaccgcgacgagtgagtcccccgttcaggagttctgttgcgatcacttcgttgagcattacgtaattttccccctcgctcccctttggcggcggcagcggagggtttgattgagttctcttctcctctcttctcttccacctctcggcgacgggtaagtcacaggtacggtattcgtaatcggttcctttcgctgttcttcgtccgattgtattccaggcgagcgttctgtctcggtcgtcgtggtgctctttccgtcgatctcgaggtcttagtcccggtggtttcaccccgtctgtttcgttgatatcggtaccgtattctgaacctttgctgctttgatttagggtcgcggctaatctattctgctttgacttctgatctgatctagggctccatcatgctctgatggcgatttgatttagaagccgtgcctttatcatttatcattatcgtggtcagtgattggcttggtttgatttaaacggttgtgactgggttaatgggagagtgtgatttttggcgggatttatttgtgcggttacttttggtgtgtttcatttcaagattgcttggaaaatcggtggttttctttgtgtttgcattctagacgtaattttcttgggtagtacctggttccttggcgggaggttttcttcatgaatcatctggttagattttattttatgtagactgattaaactgttgggttgtatctgcgatattactttactgctgctcgttttatctggattggtttgtcaaggtctattcagatgctggttactgtgtgggattctaccaatccttctgatcactagcttgtgcgtttgattttctacatggatattcggttgggcttcagccggtttcatgctctgtccggtgttggattagtcttagcctgataattagtactcttattgtaatctgtagccatgtttttatgattagtatgttctaatgcaatttatgttgtacacaattgtcaattatgcatctgttctgatgttgcgtactgtaaccgatgtaattgttgaatgatatatggatgccataatttagcccttcgtcttttttggtttggtgtataaaagctgtaaccaaatagcaactgaatttcatagcttgatgttcttttttcctgcataagttacatttctattcattgttcatccatgcaaattcagctgagattattgtgaacatcctgtttttgtagttctcatcatctcaagttaataananactttnacctaacatttt

SEQ ID NO: 761 - DNA, 1050 bp, Triticum aestivum
  Clone ID: PAT_TA_761
gcctgccctccgccccctgggcttccccgcgtccgccgccgcgccgccctcgcctcccccgccgcctcggtcgctccgctcccacccccctccatggctcgaagcagcaaaccaggatctggatgaggaagaggagatccgggcgccccattggtggatcgactatcacgagctcctcccgccatggaggagcagcgaggccggagatccaggcggcgcatgcctcacggggggggggagaggccgcccaccgcggcgagcggcatccccgtccgcgcgccggcgccccccgccgtcggcggcctctgcgccgccgccggcttcccctcggctgaccttgccacgctctgctccagctccgaccggcatgcaagcctagctgactgcagtttgattaccgattcatctatggcagcacaggcaggcgtattatcttggaggttgcttcttatttttaccgtggatcaagtttcttcatttcctttgtagctacctctgctccatttgttttatatatcatgtatgctttatatatcctatgtgctgccatgatccttgcttcactgatcatgttgattttctagatttggctgggtgccgtgttcttttttggcccttgtccgctttgatcaatgtgctctgggatctggctctgtgactgtgatgatgcacccgcagggaggaggcaacatcgacgcgatggcacagcagaggagactgggcttgttgtggaacttctggaggcagtaggacatgatgccgcacatcacagagatcaagatggccatgcgcatgccgatgccgcccgccgacatcggcgagagcgtcaccgccggcaacggctctagtgacctttccaggatcttctccatgagctactggaaggacaccaactccagcatcatgttcttcacgcctggccgcaagaaggccaagttgttcggcgacagcgatgacggcatggtcaccagcttcagcaacattgactcccaggaaagaacaagcatcaacaagagggtaaggaggctgcataacctcatgaccaacatg

SEQ ID NO: 762 - DNA, 1134 bp, Triticum aestivum
  Clone ID: PAT_TA_762
caccggtctccctccgaaacatctattcgcctccttccctatccccctgctctactattcgagttgagatctttctcccctccggctactcctccgccctccaaccttgctcactcaccttgccagtaggctgcaccccagcctgcctctcgttgaagagggagatcgatggcgagcagcgtggaaggaggaggggacgcaggggaaggggagtggctcaaggtggccgagctgaaggccatggcggaggcccaggacccgcatgtcaaggaggtggacaacatgacgctgcggaggttcctgcgcgcgcgcgaccacgacgtgggcaaggcctcggcgatgctgctcaagttcgtggcgtggaggcgggaggccgtgccgggcggcgtcggcggcgtgatgccggccgatctggtgcggacgggagctgtcgcaggacaaggcccgcatgggcggcgtcgaccgcgccggccgccccgtcctgctcgtcttccccgccaggcacttgtccgccgaccgcgacatggcggagcacaagcgactagttgtgtacctgctggacaggatcagtgccaggatcccgcgggggcaggacaagttcatgtgcatcgtggacctgaaagggtgggggtacgccaactcggacgtgcgcgcctacatcgcggccatcgagatcatgcagggctactacccggagcggctgggcaaggcgctcatggtccacgtgccctacatcttcatgaaggcctggaagatggtgtaccccttcatcgacaccaacaccagggacaagttcgtgttcgtggatgacaagaacttggaggagactctgcggcgggagatggatgagagccaggtgccggagatgtacggcgggaagctgcccactgtccccctcaccgacgactagctagctacaacgtacgatcgatcaatcgatgtacctagtaccgagacaaacaagggctcttgtggatgtaattgggggagagatgcgctgctagctcgcaccgtcactgtctgttttgtaggataatttatgatcaaatccggtattttagaatgaaggctcgagacgaagcgctttcgaattaacgaagtcatggaccgttcgaaaaaaaaaaaaaaaaaaaa

SEQ ID NO: 763 - DNA, 800 bp, Triticum aestivum
  Clone ID: PAT_TA_763
cttggcttcacacaaagcgatttcattttgaggtcgtagtttccttccgtttttgtttctggaagcttaatttctagcatgtgcagctcatggggagaaggaaagcagtggagaagaagagattgaatgatatgtgcctcttgtatgggctactgttagggcactcttttggggtaatcataaaaaagaacttattcagagaggagagactgagagagatttgtttgatgtgttgagaaagatgcacaacttcactatttgttgggtcaattgatcaatgttttacatcacaactattcattgctgtattgtgatttttactatgtctctgaaccatctggatgatgagttatgcactgtaatttttagtttgtcacaagaacatgaacctaatttttagtctgtctaaatcacgggcagatcgggcactgtggagcacagggaaggaggacaaggatgaaggaggtgtgtagaatttggcgccaagggagatgatcgagatggtggagcagatccaatggactctaggagactaggtagaggagacaccactcagagcccatcgatcctgtgagtaatggaggagacaccatggtgactgattgctccagtgagtaatgctggccctacttcctgacttcttccgtgatgcaggtgttctggcccaacttcctcttttccttctttgtggtctttctgttatggtgaccggaggattgctaactttgtgattgccgcacataaacctgctgagccgacatcgacgccaagtgtggcgatgccacttccgatgatcggga

SEQ ID NO: 764 - DNA, 656 bp, Triticum aestivum
  Clone ID: PAT_TA_764
ccgcagcctctgctctctcgcgtctcaccccctctccctctccgacgattcgaagtcgattccgatgccggcgatcgcctgcggcgcctgcgcggctgccttcctctcctccgcccacgcccgtagccctccgccgccttccgggagcttccggaagctcgtctcgcccacccccaggcggctagggcaccggctggccgctcctatggcctccaccgtcgactcgcccggcagttcctccgacttcgccaagcgcatggaccgcgcctggctcatctccaagcaaccaagtccgacttcttgttcatcttgtcaatccactggcgatgtggagtgcaggtggtgtgcaggcacaggcttctttatccttggcaacaatatgttgtgtgaagtaccctcgaagaatacaagatgtgtgatttgctctggaaagggcttttcacgttgcgctgattgcaagggaaccgggtttcgcgccaagtggcttgaagagccccctgttgacaaatgaacatcagaagtaaaccataaactttactattttacaatacctctgtccaaattcctctgtttgtaaacgatggcacagtaatcatttgtcacttgcgtcgattcaatggaaagtgggtaattttcatagtcctcccgtcaaagta

SEQ ID NO: 765 - DNA, 735 bp, Triticum aestivum
  Clone ID: PAT_TA_765
aggcacgaacgtcgtggtcacggccatggattcctccttctccaacgctccctatgcctcctcctcctggccgtctgcctccatggctcccccgccacgtcccgcccggccaccaaggacactgacccgatgacgctgcggatgatggagcagcgattccggcgatggaaggcggagcacaaccggacctattccaccccggaggaagagcgccaccggctccgcgtctacgcccacaacgtgcgctacatcgaggccaccaacgaggacgccggcgccgggctcacctacgagctcggcgagaccgcctacaccgacctcaccagcgacgagttcatggccatgtacacgtcgcgggcgccgcccctctcggacgacgacgacgcgccgatgatgatgatcaccacccgcgccgggccggtcgacgccggtggacggcggcagcagtgtacgtgaacgagtcggccggcgcgccggcgagcgttgactggcgcgagagaggcgccgtcacggcggtgaagaaccaaggccagtgcggatcgtgttgggcattctccaccgtagcggtggtcgaaggaatctaccaaatccaactgggaaacttgcctcgctctcagagcaagagctggtggactgcgacaagttggaccatggttgcaatggtggagtgagctatcgtgcgctgcagtggatcacctccaacggcggcatcacctcccaggaagactatccata

SEQ ID NO: 766 - DNA, 730 bp, Triticum aestivum
  Clone ID: PAT_TA_766
ctcggccgttctaccaaggccaagctagggcacggcggccgtcaggtctggagcgagcaacaccggccctctggacaagagaggacctgctccgtgcagcggcaccgggtccgcgtcaagacaaggggaaaagctcctgcaatcaactgaaggcatggcaaaggcgggagagaacagctttgaggatgaaatcatggagtcggacattcgaattggaaggggaagttgttgagccagacaatgatcctctgcagaagatgggagatccatcggttgaagtctctgaagaaatgcgcgacaaggcacagctctacaaaaagaaggtgttgatgcgctttcagaaggtaaactggacgaagcagtcgagcacctgacggaggccatcttgctgaaccccacttcagctatcctctatgcagccagggctggtgtttttgtgaagatgaagaaaccaaatgcagcgattcttgatgcggaggcagcattacagataaatccagattctgctaaaggatataaatcacgagggatggcaaaagctatgcttgggaagtgggaagatgctgctcatgacctacacttggcagcaaaattggattttgatgaagagatcagctcagagcttaagaaggtaagatattaaccattaacatccaaaatgccctttggaccccgggcttagtgatcctggactttcgagaaattcgaaaataaatattgagggagtata

SEQ ID NO: 767 - DNA, 936 bp, Triticum aestivum
  unsure (1)..(936): unsure at all n locations
  Clone ID: PAT_TA_767
cggaaggccgtgaccgcgagaacatacccggcagccccgataaaaacggccggcggcgcttagtgcggctagggcgagtctactctcggtggttctaccaagctagggcacggcggccgtcagggctccaacgagcaacaccggccctctcgacaagcgaggacctgctccgtgcagcggcacaagaaggcatggcaaaggcgggagagaacagctttgaggatgaaatcatggagtcggacatcgaattggaaggggaagttgttgagccggacaatgatcctctgcagaagatgggagatccatcagttgaagtctctgaagaaatgcgcgacaaggcacagctctacaaaaagaagggtgttgatgcgctttcagaaggtaaactggacgaagcagtcgagcacctgacggaggccatcttgctgaaccccacttcagctatcctctatgcagccagggctggtgtttttgtgaagatgaagaaaccaaatgcagcaattcttgatgcggaggcagcattacagataaatccagattctgctaaaggatataaatcacgagggatggcgaaagctatgcttgggaagtgggaagatgctgctcatgacctacacttggcagcaaaattggattttgatgaagagatcagctcagagcttaagaaggtgatgtgatcactatccactcatctaatcaactggaagaaatatttacagccgcgtcaaaactgtcgaagcttgtgattctgtattttactgcaacatggtgtggaccatgtcgttttatgggccctgtttacaaaagcttatctgaacagcaccgaaatgtcgtattccttaagctggacattgatcaacaaggcaatattgcccatcgctggaatgtctcaagtgttccaacattctnctgtgtgataaatggcaaagagattga

SEQ ID NO: 768 - DNA, 1327 bp, Triticum aestivum
  Clone ID: PAT_TA_768
cccgtggcgcccgagccagacccagcagcgccagccccgactaagaacggccggcggcgcttcgtgcgcctacggcgagccttctcccagtgcctagacagggctcggccgcggtcggggctccaacgcccaacacccgccccctggccacgcgaggagcggggccgtgcagcgtccccgggtacacgacaagacatcagaaggggtggcgaacgtgggagagaagcacgtcaaggacgggagcatagagttggaaggagaaattgatggggtcggacatgaaccttggaaggagaagttgtagagccgggcagagatctccggcgaaatgacggaagatccacccgtcgaggcacagcgctgcaatgagggacggtgctcaggtcctttcaaaagatgagcgggacatacgagtccagcacctgacctggaccgtattgctgaaccccccttcaccgatcctctctgcgcctggggccggctttagtgagcagatgaagaaaccaaaggtggcgattctggatgagaaggcaacactacatataattacggattctgctaaaggatataagtcacgagggatggcaaaagctatgaagatgctgctcatggacttcgctcaggagctacattggattttgaaagaggattctgatgacctcttcaggacagcgaaattgaagtttgaagaagagatcagcacagagcttgagaagattgaacccaatgaacgcaagatatgaaaaaagctgactaggaaagacagcgtagggaagctggggacatgaaaaaagctgacttggaaagacagcgtaggcatgctgaggaggtttctgctgcttctgctgttctaaagcctggtgatgtgatcactatccactcatctaatcaactggaagaaatatttacagccgcgtcaaaactgtcaaagcttgtgattctgtattttactgcaacatggtgtggaccatgtcgttttatgggccctgtttacaaaagcttatctgaacagcaccggaatgtcgtattccttaagctggacattgatcaacaaggcaatattgcccatcgctggaatgtctcaagtgttccaacattctcctgtgtgataaacggcaaagagattgataaggttgtcggggctgacaagaccggccttgagagaaaaattgcggagcatggctctcgtaaacactgagctatcatgttactcctatgttgtactcctatggactcaactcttaaatgagcgcttatgaataaaacatgacctacatgtgtggacaaaaaaaaaaaaaaaaacaaaaaaaaaaaaaaaaggccccta

SEQ ID NO: 769 - DNA, 748 bp, Triticum aestivum
  Clone ID: PAT_TA_769
aatccagccacctccacccctctctctctctctctctctctctcgacatgggcacgcttctccgccgcgtcctcctctccctcgcgctcctcgccgccgccgcgacccccggcgcggcggcggcggcggccaggctgtcgacgtcgtactacagccgcagctgcccccgcgtggagcagatcgtctcggacgtggtcgccgccaagcagcaggccaacccgtccacggcggcgggcacgctgcgcctcttcttccacgactgcttcgtctccggctgcgacgcctccgtcctcgtctccccgctctcctccgaccggaccccggagcgcgccgcggagatcaacctctccctcccgggggacgccttcgacgccgtggcccgcgccaaggccgcgctgggaggccgcctgcccgggcaccgtctcctgcgccgacatcctcggcctggcggcgcgcgacttggtgggggattctgggcgggcgcggtccccgtctcctcggccgccgcgacgcgcgccgctcgacgcgcgcagttgggagggcaactccccgcgcaccaacatgtcggcgcgcgcatacggctgttccgcgcacgcgcgcaagggcatcacgccgctggcgggcgccaacgtgggtttccagtgtccaatcgcgcacgggctttctcccactgcttccgagttcgcgcacccggggtgtacaactacaagggcaagggcggggggcgccagcgggcacgacccgtcgc

SEQ ID NO: 770 - DNA, 655 bp, Triticum aestivum
  Clone ID: PAT_TA_770
ggacgcggttggtcttaagcgccattcagcacgggaccctgatgagattgaggaagagcagcgtgatagggcacgaaggaagaaaataaatggacagtttgagctgtttgtgaaaagggttgtttccgtttggtcgcagccaagatttcagcagctcggcttacattttgaaaggccatcacagaagcttggcttcaatggagtccatggcagaacaacttgttttatagttcctactcctagttgcctggtacagcttgttgagtcaccgtttcttgtgacttcgttgagggaggtcgagatagtatgcttggaaagggtggccctggggcagaaatccttcgacatggtgtttgtatttcaagatttaaagcgagatgttgtccgcatagaggtcattccaatggcatctcttgacaagatcaaagattggcttaatgacagcaacttgaagtactatgaatcaaagctgaacctcaactggcgaatggtcctcaagaagctcgacgagcaagttgtgacacaaatgacaagtgggattcttgaatccaaatgctactgacccaaattccggggattctgagacagacgatgataagtacgaaccttctgaagcgagtcagcctctgattccgatgataaaaaaacggcgaca

SEQ ID NO: 771 - DNA, 1184 bp, Triticum aestivum
  unsure (1)..(1184): unsure at all n locations
  Clone ID: PAT_TA_771
cccacgcgtccgagggcatttcctccttctagtaccaccgtgtgtgcttcaagcctcaagtgctgtgtactagtactactactactacgtgtgtgtgtgatacactagtgagtgtgtgagtagtacgtgtgtgtgctcatccaccggtcatctatcagtgtactcgagtgcgagcgagtagttctgggctgataggggaggccattctagctagctatatgttggtttagacagcagatgtcttggatctgatgctgcctgtgggtgtggccatatatttatacaggtagaggtcgcatgggtgctagacattgacttcaaaaggatgatgtagttaacgtgctcctcactcgtttgaagtcagagcttctgatccagagaagcgcaaatacacgttagcaatgacgttactgatggttcacgtatactggctatgcgtcattctcttgccgccaatgcttaccagatcagtgagagaaatggctagtttttccttgcagaccatccaaagtgatcacaagtcaactccactacagtaagtcatctaagtattcatcacgcatatcactgccagctatacctaggtacgtacaaaggacaacccggtgctggttgtggcctagtgtattcaacaatttcgctcaatcatttgttggacttctttctaatgcaacaattgtcaattggcatcagagcctctggttgtggtagccatggccggtggtaaaggagtgcagcaacgcaccacctcgggtggttcccagtcgccggctccggaggagcggcgagggcgcagccgctccaggcgcggcatcgcggtgagggtcgtggttagggaagatcgtgcgcgagaccgcggtcagtggtagcgtacccatcaccttcccgatgctcacgcgctcgaactacagcagtgggncgttgatcattggagtgcaacctccatgcggcgagcctctgggctccattgnaggacgactttggtcgagagaaaggaggacagngaaagccggtggcggcactcatgcgcgccacgccgccgggagatgcacggcatgctcgcgggcgaaggcaagcgccagggaagcgttgggaagcccatccgtacacagcgcctcggcagcaaccgtgtgcgcgaagcgaacgcacagaagctgcgagcggactttcgagacatcgccttc

SEQ ID NO: 772 - DNA, 800 bp, Triticum aestivum
  unsure (1)..(800): unsure at all n locations
  Clone ID: PAT_TA_772
attagtttaaaatgtttacgtatgaagtttctatgctatataagaaagtaggtctgaactatttgaggtcatgnttctatttacaggttactcgtatagttgcatagctgattcagttacattagttcaaaacaagtgtttgtatctatcttaactntcaggttacttgtattgcatattgattgatttcgtgcaggctcctccgctagattttttttgaagtgtatgtgttttttttttgaacaagggggttcatattctggacatatcctcgtgacagcaagtttataataaattccgaaactcctaggttgaagtcagcaaagatagcatattcaactatattcaaataattgtacataactgcccttaagaattataagcaagataaatgctcaccggaccgcctcaagagacgcgcncagggcgcgtcccagccactagtttgagatgtaaactgcgatgagggtgaatttgcatgccagtggggcgggagagttgccaagttggctacgtaagccgtgttgtttctcgtcatgtttagcatagtgaggttagcagatagaacttgcatcattttgatttactttgctttataattattttacttttatttttgtgtgttttgtcacagttatttcttctgcaagttgttgtttcctggtccgtgaagtgtgtgatgcactgttaaatgttagacgatatgtatttcctccgatatatttattataattttttctatgcacaaatgatagttgtaaaaataattttgttaaaaagctgtgtgaaaattaatattc

SEQ ID NO: 773 - DNA, 717 bp, Triticum aestivum
  Clone ID: PAT_TA_773
tggaagggaaggtggtggagaagttggttgcttgcttggatacaacaatgagaaagttgttgaagcctctctaacagcactgtccacattattagacgatggactggacattgatcaaggtgtgatggtcctgtgcgacgcagagggcgtcaaaccaattcttgatgtattgtgtgagaatcggactgaggcgctgaggcagagagcggtgtgggcagtagaaaggatccttaggacggatgaaatagcttatgagatctcgggaagagcggccgcccgggcaggtttggttgaagctttcaggcatggtgactttaggacaaggcaaattgcagagcgagcactaaagcatgttgataagctgcccaatttctcagggatattttcgaagatcggggcacagtgaccatgttatgcagaagtaggctagttctcttataccggtcgcctgcagatcctcttgggttgcataaagatacgtaactcaaatattggcgcatgccaaatctcacaccaatcagttgctttcccagcttaatcgtgttagtacctcggccgcgaccacgctacccaaactaatcgaattgatagaatgggaactgaaggtattgttggtgtgtatagtatagtgtatatttccaccctgtaagcttgttgtatctgtattattcagatgctcagatgcatagcattataattttttgggaacaaaaaacc

SEQ ID NO: 774 - DNA, 454 bp, Triticum aestivum
  unsure (1)..(454): unsure at all n locations
  Clone ID: PAT_TA_774
cccacgcgtccggcttgcgaaagaaactgcgatgatgacgattctcatagccctgttcgtccttgggttcgttgcaggagcgcaacaaactgatgccgcgtacgatgtcacgtggtcaccgcgcggcccttcgtcgacaatcccacctcttcatccgtcggacggcgtgttcccgacacagtggtgcaacccccgcccacagcacctcaaggccgacaaagggatcctctttctcaggcgcaacctgttcgacggcgcggtgctgcccgcaggcaccaagctcgggcacgccaggagggcaggcaccgccagcacggtcaccggcaccaacctcgcgccgccgccgttcgactacggcagcctccgaaacatactgacctactacaatattgcgccgggctcggagcaagcccggcaggtggncnncacgctccggttctgcgggcgcaacgag

SEQ ID NO: 775 - DNA, 1007 bp, Triticum aestivum
  Clone ID: PAT_TA_775
gctcctcgtcgtcacaggtgtcgcccccctgtggtgtgccctttcaggattgtatcctaacgttccattcatatcccacacagcgttcatccattctgatctgaacctgttcaggtaattggctagtgcaaatgtgcatctgaaaatgtaagaggggttaaggaactgtgtgtgagatagagaactagctgaggcaaaaatggtttggaagtgtatttcgggacataagaaggggatgcaagtatatgcaatcatcacgggtaattgtagtagcttctcaggactctgcagtgttatactgcatcatttcatgaagttccaggggacacctgacttcaaattttgtgtgtggcctggtttgtaaacatggctcttcctgatgatcttcatgactgtctacttcttttgtggtgagacggaagtggtcgccgcactttttgcgctatcacatcatattggccattcttcttgacacgggctcccaggctctggcgaccatgtgcaactggaatccaagcatcgtctttcagggtaaaccaatggcgtatttctggatgacactggccttcattcagatcttcacagttgtcgagtgtatgaggtgtgcgctttcaggaatgtatcctaacgttccattcatatcccacacagcgttcatccattctgatctgaacctgttcaggtaattggctagtgcaaatgtgcatctggaaatgtaagaggggttaaggaactttgtgtgagatagagaactagctgaggaaaaaatggtttggaagtgtattttgggacataagaaggggatgcaagtatatgcaatcatcacgggtaattgtagtagcttctcaggactctgcagtgttggcagtgttatactgcatgttttcatgaagttccaggggacacctgacttcaaattttgtgtgtggcttggtttgtaaacgacaagcaattcgaaatgatgtttaatttgaccagtatgcttatgttggaaaaaaaaaactcga

SEQ ID NO: 776 - DNA, 1405 bp, Triticum aestivum
  unsure (1)..(1405): unsure at all n locations
  Clone ID: PAT_TA_776
gtaaaccctgccagttcatgttgtcttctctgtcattacttttcagctcataccaatctaacgttgttaataagtaacctgatttgctttttcacttcatctgcaatcacgttgttgatattactcggttcattatctgaatatgctacactttgatggttctcttgtaatttattggctctagacttctgtttatagcacaactaaattcatatatggctagagatttttcttttttgaagaatagggttacaattttagaaccatttcatctcaattctgttaacctcttcagaatctgnacaatgtggtatttttgcattatttcaccccgactccccccgtcccccccctccaccgcccggcccgccctctcctcgccttgccagccccggcactgcccgcacggcccgcctcaacccccccgtcccccgaacctacgcccgccgcgggctggaagacgcagcactcggggcgcggcgggaggaccgcaccgccaccgtgctcgcccgcctcttcgtccacgacgcctaccacatcctccaccgcatcgacggccgggtggaggagccggacctgcacttcgacgagggcggtagccctgccgcagcagctcatggactccgcctccagtgttcggtgcacagcaagtgagactcgcctgcatgcatgtcggcgatgtctatgcagtagaatttcacacgatggggtgcccgaggcatcagctcgtgctgcgcacctattgtgtcggtaccgagcaagcgaacctcgcctgcatgaccttgggcaatttttagcccatagaatacaaacatgggtgtctcgtgtcattggctcttgttaggaatgagttctatattgtgcgacatgagttggagatcatgatgcagctcgaagagcagatcgcggcatgtggtcctgactcctaagtagcggcaagtgaagggggaagagcgtggccccatgcaatcccttgcattatgcggtccatgtgtctcggaagatgtagccgttttcaaagggtgtctagtactatagggtgcgcgtaaaacttagatgaatattctcgcgtcggaactttgggctcgtaaccctgtgaaagaaaactgttgtcgtgtgttgatgtcagtgtgaagtccatattctagagtgtcgtggatgtgttggcccccgccttatgtgcctaatgctggattgtcataccaaattcccactagtttcataactcatagattggtcatattaagatagagaaaagggaacaatctttaatccttaatctaattcttttgaaatttagatttggatcacttagttttgaggtaccggaaagtctcatttaagctgttaaagaattatgtggtaaattttgtcatcatgccttgttagaagcacatggtagcta

SEQ ID NO: 777 - DNA, 550 bp, Triticum aestivum
  unsure (1)..(550): unsure at all n locations
  Clone ID: PAT_TA_777
cccacgcgtccgtggtaccccacgtacggtaacggagcggtaaccgaccccgcatcacccggctcctcgctggcgcgcggtgccgcccgcctgcgcgcgctcccgggcgtcagaccgcctcgcacggacaaggcaaggcaagggttgcggcgcggcggtggcatggggaacgctctggccggcaggcggcgcgcggcgaaggtgatgacggtggacggcgccacgttccggtacaagacgcccgcggcggccggcgcggcgctgcgcggctacccgggccaccagcggctcgagtcccgcgccgtgcggctcgaccgcgtccgcgcccgcccgctgggcaagctctacgcgctcaagccgggcaagctcggcggagccgtgcatctgcggcggcgcgggcggcggcgaggaggacctgcgcgggccgcacaagacgtggtccggcgcgctgcacgtgggcgccagggagcggctggagagcctgatgctgtcgcgccgcaccgtgtcggacgtggcgtccctgatgccctccgccggcagggaggcggnn

SEQ ID NO: 778 - DNA, 814 bp, Triticum aestivum
  unsure (1)..(814): unsure at all n locations
  Clone ID: PAT_TA_778
cctccacatacctcaacgacccggcgtacacggagctggcacccagcttcgactcccaggtgcgcgagaagacggccacgctcagcgcctccaccccgttcgagtactgctaccagctggcccgcgggcagacgtagctgttcgtgccggaggtgagcctgacccgactggcgcggggtgcgatcccggtcaccccccccttcgtgctcaccgccggcgagatcaccggcggccagatggtggccgtcggggagtgccccgccgtgcgcaagcacgacatcaccagcgacatcatcggcgagaacttcatgaccggcctcaaggcgggtgttcgaccgggagaggtccgtcctcggctggcacgagttcgactgttacaaggacgtggaggtagctggcccctgcgggagccccggcgcggctccggggccgtcgccgacgccccgtatcaagccgcggcagagcgcaaccacgccgtaccccaaaccggtgccggtgacgccgaggcaatcctgctcacgcggcagccgcctctccttctccatcgccctgctgtttttcatgctggctttcgtacgcgcccgtggtctgacatgatcgcgcatcgtcagatatgcacgaacccccacaccggtgtacttgcctacttccatagtttcgtgcagttcttgttccactatgtcgatactgtgtcggtcgctttgccgattggtttantangganccatgtgtanagcgggtgtcaaatcagatgcaataaaaacntacagtgacncttcgtgtnaatgcacccttcctttcctttnaaaaaaaa

SEQ ID NO: 779 - DNA, 579 bp, Triticum aestivum
  unsure (1)..(579): unsure at all n locations
  Clone ID: PAT_TA_779
gttgcacagcattgaaggattgactgaggttgctcctcggtgcgcctgcttcagagtttcggaatcttcgactaacatattgtcagggctcagctacttcgattcggtatgacattcatttactctaaattgtacatgaaagtgaagccctagagtgacggctgtcagctggttggagtgatatcatgctcctctcatccagcagcttcgaccttgtagcaattgtctgttcgcccttcccatttttctcatctttatattatatattttttgtaagaaagaaaaatctcagtgctacagaaatgagaaaattaaaagagttacacatagggtgacagaactcgttctgctggctttcctttcctctgaatgtaggtagaagtggaaaagtatcttactgtagcttttagaccattccatggaaggcattttcttttggtgctttatctgaagttatatgagtctttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 780 - DNA, 450 bp, Triticum aestivum
  Clone ID: PAT_TA_780
gtgtaccaacacacgcggaggctcccatggccgctcggccgcatcaacgcggaaaggggctcccgccgtgctcttcctcgtcggaggagccgccggggaggcgggtgctaagcacagcgccattggggaggccaagggaggcgggctcccatgtgcctgcgcggaaaccgtgctagtgggaggccattgccgccgcggcgcaggatgcggcgagcttcgggtggcggcgtcagttgccgcgctggtgacgggaggtctccgtcggctgccgcccgggttcttcccgacggcgcgcgtcgcccaaccgctggtcgtgaagaccaagcgcgccagggagcaccaccgtgccaggaggccgcggccgcgtacacggcggaccgcaaggatgcaagccgtgctataccgcgggcatggctacagccgaggcaagcgcggatgcgagcgttgcgg

SEQ ID NO: 781 - DNA, 699 bp, Triticum aestivum
  Clone ID: PAT_TA_781
cccacgcgtccgcgtccttctcccctgacaacgccctgcccgttcgcgtcctagtcctccgagctcgactggctcttggccaagctgaagatgtcctcgacgaagtgaagggtgaatccgagcccgagttccaggctcttggtgctcttgctgagctgaacttgggcaagaccgattccgcagtccagacgatcgagaagcttgtgtcttcggccgccgacaacacaacggttcaggttattggaggaacagttcttcaagctgctggaaaatctgaggaggctcttgctctccttacccaacatcagggaagcctcgacgccgtctcccttatcgttcagattcacttgcaacaaaaccgaaccgacctcgctctgaaggaagtctccgctgctcgacgatgggcccaggatagtctcttggttaacttggccgagtcttgggttggactgagagtgggtggtggagaagtaccagcaggctttctacgtctatgaggagcttgcccaagctccctcgacttcatcagtacgcagtcttgtctcgcaagctgtctgcgaattgcaccttggacgaacagaagaggcacaggctgccctggaccaggctttggaaaaggatgccaacaacgccgatgccattgccaacttgctcgtcctcaatgtcatctctggcaacaagtccgatgagtttacacag

SEQ ID NO: 782 - DNA, 628 bp, Triticum aestivum
  Clone ID: PAT_TA_782
gccggcccggctgccgtgggaacgttcggcctcactgattgcccggacatgttgcgttcaccatgttcgtcgccatcaccttccctttcggtggcctgctcggttcggcgggttcgcctttgcgccgaccacatacttcctcccctgtatcatgtggctcgccatctacaagcccaaaagattcagcctctcatggttcaccaactgggtctgcatcgtccttggggtgtgcctgatgatcctgtcgccaatcggagggctcagacagatcatcttggattccaagacatacaagttctactcatagacttcatccacgacgcattttgtgtagtgaaaactgcaagagatcttttacgatgtctactacaaactctcttgtcttgcaaaggaaaaaagaaaggaacatcatagtaccacggttacagatgggatggtacttggtagatgcatatggtcagagaaaacttggtttagtcaaagcaaaagggttgtgtttgtggttaatcatgtacgtaatatatatggtgtgtggatttgactctgggtactgtaggatcgacaatctctttttctgctcaaacttgcatgggtaaaaaaaaaaaaaaaaaaggcccctatcgtgtgc

SEQ ID NO: 783 - DNA, 627 bp, Triticum aestivum
  Clone ID: PAT_TA_783
acttccgagctccatctccatctccttgtttctctccaccttctccttggtgtgactccggccgcccattggcgaagggaagctccgtgccgccggaagagaagccaggcgccatggggacgcaggcctcgccggacaactacacgccgcccaaggatgagaggactgcacggggagaaggcgatcgatgactggcttcctatcacgtcgtcgaggaaagcaaagtggtggtactcggccttccacaatgtcaccgccatggttggcgctggggtgctcagcctcccctacgccatgtctgaactcggatggggacctggcatcgcggtgatgaccttgtcgaggatcatcacggcgtacacgctggggcagatggtggagatgcatgagatagtccctgagaagggtttcgatcggtaccatgagctcggggagcacgccttcggtgataagtgcggcctctggatcgtggcgccacagcagcttgtcgtcgagatcagcttgaacattgtgtacatgaataccgaagacgactctctcgagaagctcctccaagagatctgtgacgtgaaatgcaaggagataatatgtcacttaccttatcatgatcttcgcgcggtacacttc

SEQ ID NO: 784 - DNA, 1909 bp, Triticum aestivum
  Clone ID: PAT_TA_784
cccccccgcccgtccgcccctccgcctccccctccgcccatgcgtccgtcacacatccccctctgttctttttcttctccatcgcccaagacaagccccggccggcagcaacatggggatgcaggcagccgagaacttcgacccgccggacaaggatgtcgggacggacgagcacaagaagatcgacgactggctcccgaacacgtccgtcgaggaaacgccacgcgtgtgttactcggccgtccacaatgtcaccgccgtggttgggcgcggccgttgcccatcctcccctactccttggcgctagctcgggctgggcgccctggcaccgcgggtgcacttcctctccgtcgtcgtatcgcgctctatacgctgtcgcaaaagatctcgcatatgctcgatcactgatggggtcagaagcgtgctgagagtctacctcaagctcgtgccgccactccctgggcgccaaagcgggggccttggattcgatgagctcggaattctagtcataggatgactccgaaagtcgccttctgtccctgcccaaaacgtggagagaaaatttacggatggctactaacgacgtctactgctaccacaggataaataaaggcaaatcaaagaacatccagccgtcttaccacgtcatgatctcggcttgtgctcacttgatccttatcttcggcgaaaacttggtctcgtccttgcggatggtcttcgtttctgactatatatggaggtagtatttaacgtttgttggggtggaatcgataaactcgtttaatgctcagaacgtcaacgacgacctgagagcatcgacgactccagggcaggtgttcggattcttgggggggctcggcgatgtggccttctcctactccggccacaatgtcgtgctagaaatccaggctaccatcccatcgacgccgggcaacccgtccaagaagccaatgtggaagggcgtggtggttgcctacatcatcatcgccgcctgctacatgccggtggcatttatcggctactgggcgtttggtaacagcgtcgacgacaacatcctcatcaccctcaacaagcccaagtggctcatcgccatggccaacatgatggtcgtcgttcacctcatcggtagctaccagatttacgcgatgccagtgttcgacatgatggagacgttcctggtgaggaagctggagttcgcaccaggcattacgctccgtctgatcacccggaccatctatgttgccttcacgatgttcgtcggcatgaccttcccgttcttcggtggcctcatcgggttcttcggcgggctggccttcgcgccgacgacctatttcctgccctgcatcatgtggctcatcatctgcaagcccaggagattcagcctctcatggttcaccaactggatttgcatcgtccttggtgtcattctgatgatcatcgcgcccatcggagggctcaggcagatcatcatttctgccaagacatacaagttctactcatagatcactacaagtgccgttcatcatcatcgcctcgcgattggcgattctactgccagatttttatttttatttttattttctgtccctgcaaagaagaaagatcatggtatcacggcttgtcgcagatgtcggacggtctgcttagtttagaccggaggagggctgtgttgggggtaaatcgtgaaggggtccagcccgcttgcagcgccgggagttttcatgcatgtactcgtattattttgcagagcactagctatgaaaataggcgcaaggattcatatataccatgagacatgtcaaattaagtgcaagatccatacatttgattggattattcctgcgatatgtttaagcttttaaaaaaaaaaaaaacctcggccgcgaccacgctaatcactagtgaattc

SEQ ID NO: 785 - DNA, 344 bp, Triticum aestivum
  Clone ID: PAT_TA_785
atcacaccaaagatggccatggcggcgaaaacccagcttgtcttgtgcatgctcgtggccttcttcttcctcctcctcgccatggaggttgctgccgctagggaactagaggaaacaggtgatccctacaagggctcgtatccttcaatgggttatccaactggaccgccaccataattcatgggtcccggggaatacttatagtactctacaacatatttatacatacacgcatgttcttagtttcatgagaaataaacgatatgtatctatatatgtatacgtatgcaggtgtcagagaaaatgtttgtacctacgagtggattaatacatgtttcttccac

SEQ ID NO: 786 - DNA, 365 bp, Triticum aestivum
  unsure (1)..(365): unsure at all n locations
  Clone ID: PAT_TA_786
cccacgcgtccgcgaacgcgtgggtggaagcagtcatatattcctcgcagtctctgacgccgtgcgattctgtacgacgaagtcgatgcaggaaccgtgagcgaagtagttcggcggaatggctggtggtgccatatggtgctagtgttgagaatggttttggtgctccctgtgatctaagctgggtagcgcaagatgatgtggctttgtggccaatgtagatacatataataagttaaggcaatcatcggagcctctccggtttaccaaatactactccctccgttcaccgttataagatgttctaactttttttctgaaacagatgtatataaccgtattttagtgtgtttgttctctcnnaa

SEQ ID NO: 787 - DNA, 1180 bp, Triticum aestivum
  unsure (1)..(1180): unsure at all n locations
  Clone ID: PAT_TA_787
atcatcagtacacaagatttatttcaccggcccatttgttgcaaaaggtttcaagatcggtgttgtttgcggcatagttggtttgacagaagctgtagctattggaaggacatttgctgctatgaaggactaccagttagatggaaacaaggagatggtagcacttggaaccatgaacatagtaggctcaatgacatcttgctatgtcacaacaggttctttctcacgttcggcagttaacttcatggctggctgcaagactcctgtatccaatgtggttatgtcagtagtggttcttcttaccttgttggtcatcacaccgctattcaaatatacaccgaatgcaatcctagggtcgatcattatttctgcggtgatcggccttgtggactacgaagcagcaattctcatctggaaagttgacaaattggacttcattgcttgcatgggagcttttttcggtgttgtttttgtatccgttgagattggcctcttgattgctgtagcaatctcatttgccaaaatacttcttcaagtaacaaggccaaggacagccctacttggaaaccttcccggcaccactatataccggaacatcagccagtatccagaagcaaaacttactcccggggtggtgattgtgagggttgattctgctatttatttttccaactctaattacgtccgagaaagaattcttaggtggctgacagacgaagaagatagagctaaagcactgggattgcctaaaatcagttccttgatcgtggaaatgtcgcccgttatcgacatcgatacaagtggcatacacgctcttgaagatctatacaagaatcttcagaaaagagatatgcagctcattctgtcgaatcctggttccgtcgtcatagaaaaactgcaagcatccaagctcaccgagcacattggaagcagtcatatattcctcgcagtctctgacgctgtgcgattctgtacctcgaaggcgatgcaggaaccgtgagcgaagtagttcggaggaatggctggtgttgagaatagttntggtgctccctgtgatctaagctgggcagcgcaatatgatgtggctttgtggccaatgtagaaacatataataagttaaggcaatcaccggagcttctccggtttactaaatactaaaaaaaaaaaaaaaaaaaaaaaa

SEQ ID NO: 788 - DNA, 839 bp, Triticum aestivum
  unsure (1)..(839): unsure at all n locations
  Clone ID: PAT_TA_788
cagaaactgcctccgcaggagggaagggaggagagggtgttgtgccgtggtcgatactctgaagattgattccggtccgcagcagcgacgccggcaacatgaggttcaggatccggaagaagcctgcgtccgcgccgccggacgcttcttccacggccgccgtgccggacactgcggccggcggcggcggccgggcgacgatcgtcgctagcccagatcgctacggcacagagaatggagcaaggagcgatgagtcggtcttcgattccaggcccgcgttacactcggacagtgaagatgatgtccaaagcatgagcggagacgtcactacctcaagtcgtagcacaccagatcaccagatgcaaacatcattcgcatcgcgcgtagcagcgcactttccttcgtcggccggggaggatcatagccaactcgtgaggctccacttcacgccgtcaagcgatggcgcgcatgatgaccagacccaaatcgcttgcgcggcacggatctccgtccacgctccagaacagctgaattcttcttggaaagtagagaaagcaaagcagccagccaagccaggttgcttcgcgtgctctgcttcgactggtaccggcaacgcccccgggaacaacacccaggggcccaaggttcggcgaggctggtcgcagctgtcgcattttgcctgcctgccttgcctcagcccagcagggcggggtcttgtataccccttttttgccccggtttcccttgccgcaccttgcagaagtctgaggagtgtggagggcttgttcaatagtggcatgaatagnaaacaattatgcagggtaaaatatagngcatac

SEQ ID NO: 789 - DNA, 602 bp, Triticum aestivum
  Clone ID: PAT_TA_789
cccacgcgtccgctcacgcgtccgcccacgcgtccgagtcgtagtagtgcactgatacgtccttctgcgtgtgtactcgagttgtgtgctcaatgtttgatgtatgcataattatttgtgtagtacgacgggaaataagaaatgagctggtttggaaaataattctgttcttttttttgctaataaagatgacatgcactactgtatctatttgcatagattgttgttaaactcgttttaatgtattatgtataaaaaaagttcaactcttatttttcaggttttctggtggcagtaaagatatatgcagatttcaacaacaaaaaagactgttgtttggagtcgtagtagtgcactgatacgtccttctgcgtgtgtactcgagttgtgtgctcaatgtttgatgtataagtgtgagatttactatggctgttcagttagtgatgtgtctatcttgtaacaaaattccctagcataatgcggttggaacatttgccttaactaatgtatgtgttgttgaagcgatgcatgcattactgcaagtgaattctgatactagtagactaaaaaaattaaaaaaaaaaaaaaaaaccccccccccc

SEQ ID NO: 790 - DNA, 412 bp, Triticum aestivum
  Clone ID: PAT_TA_790
cggacgcgtgggcggacgcgtgggcggacgcgtgggcggacgcgtggggttctagcggctataacaagagatgaggactacacaaattctactcttaggccttgccctcgtccttctatcctcgggcatcatggaaaccatcgaggcacgtggagcctgctgccctcagatcgaaaaggggaagtgtaataacaatgattgtgcgacttattgcaagatggtgaatggttgggaatggggttgtgtccctgagggatgcacgtgtgtatcgtgctggaaagatccacaatgctcagggccagaagtaccaccaccttcaagacacttgatgtaacattttctttcatgcttgtggtattaccatacaaaaaaatatgagtcccgagtagacaaataatgtgtgtcaagtttc

SEQ ID NO: 791 - DNA, 1237 bp, Triticum aestivum
  Clone ID: PAT_TA_791
cgcggccgcgtcgaccttgagaggccattgaagttggccaaagaagcaataggcatcgtgtatgtatctccctatgaggttgccacctgcccgctatgctgcgaggaaagacgaggttctcatatgatcaaggtcggctgttcccacaaattttgctacagttgcttgattgtgtatgttgaaggcaggctgcatgcctcgaagctgcctattagatgcccacagttaaggtgtaaatatcatatttcggctggtgagtgtaaatcattccttccggtgagcagctatgagtccctggagagggctttcgcggtgggcggctgcacctttgacatggaggggctctatcgcccctatccaaactgttcggtttcgttagacctcagtcagcacttctccagggcgagctcgtcgtccgagccggcgtccgattgcatcgagtgcccggaatgccacagagatatctgtatcaactgtggagtgccatggcacatcatgatggggtgtgatgagtaccagagcctgcctgtcgaggaaggaggtgcaggggacctatctttgcatcggctagcacaaaacaatagttggaggcgatgtcagagatgtcgacggatgattgaactaacgcagggctgcttccacatgacttgctggtgtggccatgagttctgctactcctgtggcgccgagtacaacaacggcgtacaggcatgccagtgcgtattctgggatgaagacaacgctgagccctcggcggcgcagtcctgccaggcatctgagatctgggcgtgggacaccttcgactgcatgcccacggccgccgacggctactcggagcaggagcgggcgcagctggcgctcatccagcggttcctggcggggggtttcagcctgagcggcgaccaccaccacctgagccagcagtcgtcgccgccccgctgcgcgggcggactcgtacatcgtcgacaccatgaaggacctccaccagctgccgtggctcgagcggtttgtgtcggtgatgagcgacacctacaacgacgactacatccagtgaatgaagagtttaaaacttgaatcatagatatagcattagaaagaagatatgagaatgccgcatataccgatgacttcctgttcggaataatgtgttcccctgacaaaaaaatccaccctgtcgaaaattggttgacactggaaaaacaaaatgatacttccacctttgtttgtttgtttgttg

SEQ ID NO: 792 - DNA, 1007 bp, Triticum aestivum
  Clone ID: PAT_TA_792
gggcgacggacgcagaacccagcaagaacaccactagtgctgcattcgcagcgagcgaggaagaggaagagggtgagagagagggatggcgtgcctgcacgatcacgagtgtggggatcacaactgcgccgccgattggtcgctctacaatcacatcgacatccccaaggtggtggctctgaacgaatctgtggccgggagcgtcaaatcggtcttcaagtcgtgggaccagcgcctcgagacttccgggggttttctggagagcaatgagggtgaccctgagttacttgttttcatcccatttacctcagatgtgaagatcaagagcatcgctgttgttggtggtgctgatgggacaagcccttcaagaatgagagcatttatcaatagagaaggtattgacttttctgatgctcaaaacatgcagcctgtgcaggaatgggaactggcagagaatttgcagggagttcttgagtatcaaaccaggtattcaaggttccaaggtgtggccaacttaactctgcattttcctgataactttggtggtgatacgactaagatatattacattggtttgcgtggtgaagctactcagaacaaaagggatgttgtggccacaattgtgtatgaagtaatgcccaatccgtctgatcacaaaacaaaatccgagactggaggtggtttctcacatgttgagtaggcatgtcaggtgtgggtgacatgcttcctcggttggagagaaacttgacctctgatgagttctgtatgaataaaaccagtccagctcttagattcgtagttttgagagtaaaccagtgtatttgtcggttgtcgatggctcgatgatgtaacttaactatggtgccttgtggttgcctgtggctcgatgaggttacttaacgatgtcgcccatgtcttcagtgttgcgaacaagttactatgattctagctaacaagaaatagatgcgaccgtcctgtctttctttcaaaaaaaaaaaaaaaaaaaa

SEQ ID NO: 793 - DNA, 689 bp, Triticum aestivum
  Clone ID: PAT_TA_793
aaataacatcaaaagttcaaaatgaagattcaggatcgtacattcatcatctctggcggtgcgtcaggccttggtcaggcttgtgtagaggatatatgcgccaacggcggtaatgtagccatcttggacatgaacgaagaatccggtcaggaactggttaagaagctctccacatacaccaagttctttgagtgtaatgtcttggagacggagagtgttgccaaggcagtgcaagatgctgccaagtgggcaaaggagacaggaaagcctttgggaggcgtgatagcagcagctggtgtttcgacacccgcaacgatccttgaccggaatggcaccgcctttgacttggaaaactttgactttgttcttaacgtcaacctccgcggcaccattgacctcgtccgccagactctggagcatctggccaaggtagaacctcaaggacccgacggcgagagaagcgttgtcattatggtggcatcatctgcagcattcgatggtcaaaagggccaagtttcttactccgccagcaagggcgctgtaacggccatgactttacccatggcaagagacctcgcgcgatttggattcgagtcgtgactattgcgccaagtctctttgagagccgaagacgagcggtgatgtcgaaaggttagaaagagtcttggaggtgcgatggaattccagga

SEQ ID NO: 794 - DNA, 723 bp, Triticum aestivum
  Clone ID: PAT_TA_794
gatgaatatcataccggcatacttagtagttaaaacaaacaatagaacaatctgctaataaatatgcaatggcaaaaccttttcatctatgaatatcatgccgaggttccagagccaattaactgtaggattgattgaatttcatattctcattacttgcacttgaatacatagtttcgtcctcctgttgtgaacttgctatgcttgttgtatgccattgctgcaaaaggatcacaaaatcgctagtgaattattaataatgcacctatgaagattgtatgcagaataacaattacaaaccttgatgattcaggcgagaggctactcagaaggtagattggatccagaataacaattacgaaccttgatgattcaggtgagaagccactcagaaggttgcttgggcgtcactacatctggcttggtgacattacgtagttgaattggaagactgattttgttggtagtgtgctagctaggtagcagatttggctgacttcaatttttgggcatgtgctgggtgcggttgcttacgtagttgaattggaagactgattttgttggtagtgtgctagctaggtagcagatttggctgacttcaatttttgggcatgtgctgggtgcggttgcatgtatgtgttttcatgtgccgtgtttgccttggcaagtcatgtttgtacgtagtccgtatacacgtcttatttgcatgcgtgtccgaatttg

SEQ ID NO: 795 - DNA, 714 bp, Triticum aestivum
  unsure (1)..(714): unsure at all n locations
  Clone ID: PAT_TA_795
acggcgcgccgcgcgtgggagctcaccgtcggcccccacgcgtccgacggcctcgccttcgggatcaagcgccacatgaagcgccagggtaatttgcagcatgagtatagtggaagtgactgccttcaactaaaaggtcacgatgcgcatactgaagtagcttatcttcttgagcacttgaagctttgcatgttctactcaaagaataggttttctgaatttctcaagtttggtgggtacagtcaagaggacgttctcatccacaagtctagggcgaggcttatgcagccttccttcgtacttgtgcgtgaccaaaaagccaagtgttttctgcttttcatccgcggtgctatcagtcctagggagcgactgacagcagcaagttctgttgaagttccgttccaccatatagttctgaatgaaggacagattgagaacgtaatcttagggtatgcacattgtggaatgcttgctgcagctcgctggatatctaaccttgtcatgccccctctgcgcaatgcagtacgagaatttcctgactaccaaataaaggtcatcgggcactcaatgggagcaggtattggggcaattctgacatatattcttcgtgagcattatgattttacatcatgcacatgtctagcctttggtcctgctgcctgtatgacattgggagctggcagaatcagggaaagattntatcacttcctcttg

SEQ ID NO: 796 - DNA, 369 bp, Triticum aestivum
  Clone ID: PAT_TA_796
cgtgctgtacctcgctcctctgacctacctgttcgtcagtttcttcatcgcaagctacgttaagcgtagtaatgctgccagcaagaagtcgcatgatgttaacgccaacatcgctcttgcagagaaggctggctgggatgctgccaagggcattgagaaggaaatctacgatggtgccaacactgccaacggttcttcagccgatgaggcttcgcgggcttctacgccaaagaaggctaatggcaagtcgcgacgcaaggcctgagcaaatgggggtttgaaagaaacacaaaaagcgtttgggtctcggttttgttcgatcgagttctgtgtaagagatttagacgatatagcgataccatgatttac

SEQ ID NO: 797 - DNA, 594 bp, Triticum aestivum
  Clone ID: PAT_TA_797
agaggaaggtattggacactaccgccagagactacgcaaagccactagtgaggccaatgtgaacgctcgagcgagatcgatgctccaaaatcctgcaccgccgatggttcccccgcctatgcctcctagcacgagcaacaacgcgcttcccggtggcatgatctagcggtcccaagataccgctaccaaaacctttgattcttttaattcatattttgcccacaacgatgggttcacgacgaagataccttacggccactttccttttctacttttcttttcaccttaaacttaatcctatcgcctctggagacacagcaaagcgctgaaccatggggctttcgacatttgcttgtattttaagggtaaagaccttttgtcacccggacgtttcggtttgggagggacttttaattagatgttggacggatagtgcgaatctagtctagtattcaggcgcaattgggagcatggctggtcagggaatcaagcaggcctttgattcatgaaactggcggcagggagggtgcgaagggaaaccatgtctggaagcagaatgaaaaggaataagctgacatgcattcaacaggttgg

SEQ ID NO: 798 - DNA, 933 bp, Triticum aestivum
  Clone ID: PAT_TA_798
cgacgagccacccaaaatccgccccttttcccgccgcacgggccctaaaccctaacccagtcgccggcgcggcgccggagatgatgcagcaacagcagcagcagcagcctctgccgccccctccgccgcagcacccgccgccgcagcccggcggcggcggcggggacttctaccgcggcccgctgcagccgccgatgcggcagctctctgcggcgtcatccccccacctcgcccccgcctcttccaccaatctcccgcctgactacgccgcacacccgggccccccgccacagcagcagcatcagcctccttacgacgcttatggtgacagttttggtgctaaaaggatgcggaagcctgtccagcgacgaacagtggactacacaagcactattgtccgtcatgttcaggctcgcatgtggcagcgggacgctagggatagattcacattgcagccaactccagctgctgtcctggatatgttaccgtctgttgcatatccagacaatccctccacaagttttgctgccaaatttgtacattcatcaatcaataagaaccggtgctctattaatcgtgttttgtggaccactacaggccgtcgacttatcactggatcacaaagtggtgaatttacgctatggaatgggcaatcttttaactttgaaatgatccttcaggctcatgatctacctgtgagatcaatggtttggagtcacaatgaaaactggatggtgacaggcgatgatggtggtgcaatcaagtattggcaaagtaacatgaacaatgtcaaagtgaataaaacagctcatggagaatcggttcgtggtttaagtttctccagaaccgacttgaagttctgctcctgctccgatgacagaaccgtgaaggtttgggacttcgcaagatgccaagaggaaaaatcattaactg

SEQ ID NO: 799 - DNA, 1322 bp, Triticum aestivum
  Clone ID: PAT_TA_799
ccggcctccgccaaagcccccgcgcgcccccataccccccacctccccccccgcgcctccgctccagcccgctggcccctgctccggctccgcctgggcgctcctccggctccgcctgggggggcacagaggaccggctggggatggccgcagccccggcggggggtggcggcacccgccgcgtggggtccgaacacgtccccctgggctgcccatcagctccgcgtggcctgcccctcttctgcgcgcgcccgccctctcttgatggggggcctcgagaggttgccccaggggctccaatcgcttcccccagtgtccggcatctcttccccccaggacagcggcgactctacaggccaccgctatgcacttccgaagtgattggcaggttatacccgaagaaactagaggggctgccttccagggatgcccaagaaccctattcgatgtttcgacaaacccaactgaggctcaagttttccttgaggccgtcgagcatgggcttgatggagttgtactgaatgtagaggtcatggatgatgttattagactcaaggattattttgacagaaggaacgaggcaaagagccagttacagttgacaaagggctactgtatcaaaggttgaagttgttggtgtgggcgatcgtgtttgtgtggatctctgtagtatcatgcgacccggtgaaggccttctggtcggttcctatgcaagaggaatgttccttgttcactctgaatgcttggagacaaactacattgctagcagacctttcagggtcaatgcagggcctgtgcatgcatatgttacagtccccggcgacaagactagctacctctcagagctgcaatcaggcagggaagtaattgttgttgatcaaaatggattgtggcgaacttcaattgtccgccgcgtgaagattgaatcaaggcctctcatccttgttgaagcaaaggagaactctggaaatggcacatatagcattttccttcaaaatgcagagacagttgcacttattggtcctgacagaggatctggtggaaggactgctattcctgtgacttcactgaaagttggcgacgaagttctggtgaggaagcagggcggcgcccgtcacactggaatagagattcaggagtttattgtcgagaaatgagacacactgtgacatttacccgccttagcaggctggcatgctcatcgctgctgtttttgttctccacaacaaatttgtgcaagttcatcaaatcatcactaaacccaagagacatacgtctagtatctgtacattcctgaaattcaaggctcatttttccatttt

SEQ ID NO: 800 - DNA, 720 bp, Triticum aestivum
  Clone ID: PAT_TA_800
ccgggatgacccgcccgctcgtcgagatcctcagggacctcaacaagcgcgtccccgacaagatcatcgaccccgacaccaacaccgtcccctggtaccatgccaacagaatgctgagcttctatgcaccaggttggtgtggtgaagttcgtgatgttatttattccaacagtggaactgtgaccgtggtctatcgagtgattctgaaaggaacagatggagaggctttcagagacgccacaggcacggcaaaggtgcacgagggacgcaacgatgacgctgtcgcggctgcggaggaggcagcattcagcaaggcctgcgcacggtttggtttcggcctgtacctgtaccaccaggatgagatcctgtaggggggacgtcacagctttgagattcattctgcaatggaagctggtcgtaacgtgggtaggcacgcccgtggagagttggaaatgcttcgctggtgcttaatgcttgtgcaagaagcttgtaaattgttccttctgttacgtttttgttgttgttgttgtcggtgtaggctcgcaagattcatccagctagagaaaggaaaaagaacatatgaataatgtgttgttacttctctggtgcattttctgccttatgtaatttttagagattttttgtttggctggtctcctcatcccctacggcccttcagccctttgcaataggcaacaccacattgacaaaaaaaaaaaa

SEQ ID NO: 801 - DNA, 601 bp, Triticum aestivum
  Clone ID: PAT_TA_801
ccagacgcaaaaagggatgaaaaaaccaaacttctcccgcaagactggctcgcaccaaatcgcatcgcccttcgagtcgcccctcactgatcccttcgcgtcctgcttcccaagccacagcccccaggcccccacgcccagctcctcccgctccgatttcacagccggcgagctagccatgtcgattcggccgctgttgctgccggagccgccgggcgaggtggatcgggcgccggagatcttcgcgggtggcgtggccgcggtgcgccgcgcagtcgtcatcgggaacggctgcgccggcgccgagaaccagtgcctcggcctcgtccgcgccctcggcctggccgaccgcctcacgctctacgtaagcagagcgccgcccctctcgtttcctctcgtcctgtgatgactctttctccctaactccttgtagaacccttgggaatcatgtcatcagcttaacgtggtctcgcgtattgcgatttaattatttgcttagtaattttactagaatatagggccgttgcttgcaaccaatttacttgcaacggagaagattaggcaggatgtgtataatttagttactggaattatgtttttg

SEQ ID NO: 802 - DNA, 1797 bp, Triticum aestivum
  Clone ID: PAT_TA_802
ggtatcacaaggtgaactttgagggtcttggcctcctttgattgatgcccataatatgtttgatgtgctatgatcacggcagagtccactgaatgattagcaggctttgcaatgaaccgagttgcatatcttttgatcatggcacaaaactagtttcattgggaagtattcttatcgctggcaatccaccccgccccacccctccccacccggacgcgtgggcccgacccaggtgctccgcctacctagggcatccgcatcctcccctctagcccccgcgatcgggacaccccccgccggcgagcgatgttgccccctccgcgccgcggcccggcgtacaagaccaagatgtgcgcgttgtggcagaacggcaactgcgaccgcgagctctgcagcttcgcccacggcacggccgagctccgccggcccccctcctcccggcccaccttcccgccccaccacgccgggagaagagattatagaggtggtgatttcagaggcaggattgaaaggaggttctcacctcgcaggaggcattcccctggaagagatttcaggggtcatcgttccctacatgatcgaaggccaacttctcgagaaagggagtctagcttttcacggtctcccagcaggaagagtgagaggaggcatgaaaagaagatggatgatggagaaaccaactcatctaaagagttctcctatctctgataataatgataggaaaaaggaaaaagtcactagtggtgacgagaaagaggattatgaaaaggagctgaaacaagttagatcagatatggaggctttgcgtgacgataaatctcatctcgagattgttttggatgagaaaatggacgaagtgcgcaggatttctagccaagtaagtgaccttgatcagcagctgaggagggagaaagaagaatgtcatagaatgacgtcaaaaatgaagaagttcctaaaagctcatgtccgttttatgaaagctcgggaggagttgaaaaggtcacaagctcgttttgagagacttggtgatatgcttgcttcagaaattttaaagcgtggtgctaatgaagaagcttccagcgtccatgttgatgaagatctaaatggaccttatgaaaggagtccaaatgctactccagctaaaaagagatcaatcccatactcaactagtgatgaggcaaaagctgctaagaaaagaagagagcgagagactgatacattcactagatcagataaatataggtcagaaggcgacattacagactatgataaaacaattaagggtagtgatggaacaaaatctatatatttgaagaagagactgtgggaagatgaaaagaataagcttggaaatgctgcctcctctgcagaccaggtgaaagattctccagtgaagcacgctttgccctccactggtatggctgctcgtgccttatatgaccttaacgaggcagttgaactggatgatagaaacgaacagatagatgcattgctagaaaatgatgctgacgggactagatcgcctgtacctccagtgggccaaaatgccttcgagcagtatgaggacctcgacgaggaagtggatgtggacgtataagccgagcacagagttgatatgataaacgacgcgatggcggtggcgcataatacaccagttggcttctgggagtccgaagactgttattagcatttccgtgtacaaagtggcatcttttgtgtttttttagcataatatacctatctatttgatatatatatatatatatattgggtgtttttagctttttactcagaatc

SEQ ID NO: 803 - DNA, 743 bp, Triticum aestivum
  Clone ID: PAT_TA_803
cctctctcttgatcatgaatctggcgtcaggatggtggctctatttgatcatgaggaggttggttctgattcggctcagggagctggttcccctgcaatgctggatgctttaacaagaatcacatgctgctttaaccattcaaattccaagttgctagaaaaggctattcaaaggagtttccttgtatctgcagatatggctcatgccttgcaccccaattatatggaaaagcacgaggagaaccaccagccaaagttgcatggtggacttgtgattaagcacaatgctaaccaacgatatgctacaaatgccgtgacagcttttattttccgagaaattgctgagaggcaccagttacctatccaggattttgttgttcgcaacgacatggcttgtgggtcaacaatcgggccaatactctctagcggtgttggtattcgtactgtggatatcggagcgccacaattgtccatgcacagcatcagggagatgtgcgccgttgacgacgtcaactactcgtatgaacacctcaaggcatattttgaagaattcactgaattggataacaaagtcaaagtagactgctgaggtgtactagtaggcaaccatattgggtcggcagaacctgtacttctacaatcataactacaatgcataataattacagcagtagtgtcggattatgtatgttagtgaagacatgattaaataatggaaaaatatgattttcttttcaaaaaac

SEQ ID NO: 804 - DNA, 246 bp, Triticum aestivum
  Clone ID: PAT_TA_804
ccgtgccatgccatcttgtttgtgtataaaagaaggaaaagagaagagaagctcaggagttgttgtaggccgtgttgtgcctgtaatctttgttacacaccaataaccgttatatgtctgtctgagagatgtaattcttggttcttgagttaggcaaaaccggattattattcgctgattattgaatgttggatgtaagttggaactatttatcatcgaatgtttcttggctgtaaaaaaaaaaaa

SEQ ID NO: 805 - DNA, 625 bp, Triticum aestivum
  Clone ID: PAT_TA_805
gttgcgtacaacaataagtttaactgaacacaaaggcaagtcgacaacatgcacactttattgcagatgtatgcggactatcctgcgaagatccatttctttgcaactgccaacatatatggtaatcattgggtaagtaaaatacaatatcaccacttcacattttaataaaatttattcttttttaatgcatgtaatatatagaccaatagttgggaggcttggtctacaacaatatggttcacttttactgaaataagcaggcaaacacagcaatcaatagaagttgattatcattctaaaagagatggccgtctcgaaattaatggtcctgcatggagtaattttgtaagtcaacatgagatatatgttgatgtgtgggtagtaatacttgttattcctggaaacaataggccagaagtgacattgagattcaaagcaataacaatagtttaaaggcaagtattaagttctgatgaagattctgattcggaagatgaagactagaaccatttttttatatattgtttagaataagttcttttttaactatgtattacaatgatttatatgttttttttagaaatagggtcttttttaactaactactacaattatttatata

SEQ ID NO: 806 - DNA, 897 bp, Triticum aestivum
  Clone ID: PAT_TA_806
cttcttaaagacccatttattctcaatggcttgccgatcatcgggcaagtcaaccaaagcccatactttgttctcatacatggaacaaccaggcaatctcatacataactagggaagacagcgaactcatttccaccgtgtctaccactctaatgttaacaagaacacctttttaaaaaaaaaaacaagaacaccggactccacgaactacatatgcatgatccgccctgaaagtgaaacggactgaacctttccataaacctccagaaccaagctccttaattataagggcccatgccgatgctggagccgccgtatggagcgccgccggcggcatcccgggatttggagtagctgatgtaatagaactcgctgaggatggccgtgaagaaggtgaaggctgcaccagcagcgaagacgcccttgcgcagcgtctcgcaagagagcgggtcaccgttgaagatccccctgtacctggtgtggtatgcattgcggactgatcctgccagcaaacacgccgctgcgacgaggaaggtcagccatgagaagaggaagagcatgagggcgcaggcgcgcgagccccccggcttgagcccgcgcccgcagcagaagcaccggctggcgagcatgacgacgacctgcgcagcggtgaggaggaggagcgcgccgacgccgtagccggtggcgacgtccgagtcgtagacgcagtagtcgtactccttggccagatccggcgtcaccgtggccttgctgcggcgctgctcggcggcgacggcgaggccgaaggcgatgaggttgaggagcagggcggacacctgcacgacgatggacgccattgccattgccctctctctctctctctctctctctccgtctctgtgtgtctctctctccgag

SEQ ID NO: 807 - DNA, 1131 bp, Triticum aestivum
  Clone ID: PAT_TA_807
aaaacttagtcaaacatgcacatgtttgacttttgaaaaaacttatatggtactttatatttcaaacgaagggagtatattatataaaggatccaatgcaataatccgaattgtgtaaggcccaaccaggcaatctcatacataacctagtgaagacagcaaactcatttacaccgtatctagcactgtaatgttaacaagaacaccgcactccacgaactacatttgcatgatccgccctgaaacggactgaacctgtccataaacctccagaaccaagctccttaattgtaagggcccatgccgatgctggagccgccgtatggagcgccgccggcggcatcccgggatttggagtagctgatgtaatagaactcgctgaggatggccgtgaagaaggtgaaggctgcaccagcagcgaagacgcccttgcgcagcgtctcgcaagagagcgggtcaccgttgaagatccccctgtacctggtgtggtatgcattgcggactgatcctgccagcaaacacgccgctgcgacgaggaaggtcagccatgagaagaggaagagcatgagggcgcaggcgcgcgagccccccggattgagcccgcgcccgcagcagaagcaccggcttgagaagaggaagagcatgagggcgcaggcgcgcgagccccccggcttgagcccgcgcccgcagcagaagcagcggctggcgagcatgacgacggcctgcgcggcgacgaggaggagcagcgcgccgacgccgtagccggtggcgacgtcggagtcgtagaagcagtagtcgtactccttggccagatccggcgtcaccgtggccttgctgcggcgctgctcggcggcgacggcgaggccgaaggcgatgaggttgaggagcagggcggacacctgcacgacgatggacgccattgccattgccctctgtctctccgaggtggttgcttgctctgctggggaaagtgaggtgtggagcgggttccgtgtccacgtaaaaggtcgcggcttcgtgtcggtgacgccggcgtcggcgtggagctggtgagtgcgagctggctaacacagactcagatctggggttggtgcttcccgagaagaaaaacaattgatccggttagttggc

SEQ ID NO: 808 - DNA, 602 bp, Triticum aestivum
  Clone ID: PAT_TA_808
gcccaactaacctgacgttccatcccacctcagcctcgttgccaattttctcccgaatatttcgaatcgaaatactcaaaatgctttttccaagatgccggctcctccaccattcattgtaaacacggaccccaagcgcgtggcagaatcacagacaacattgatcgtaggagttattactgccatcaactttgtcgccctcgctgtcgtcgctgcaaggacatacacccgcttggttatctccaagtccccaggtgcccaagatgtgcttatgattctaagtgcttgtactggtctggcgggcactattatcttgtatcttcagatcccccacggtctagggaaacacgccgacacgatcgaacgagccgacttcaccaagtttagcagatacagctttatactcacagtagtccctcttctcggaggaatcggcctactgaaaatcgcaatcgccctcgaactcatcaaatacaatgggaactcatggaaagtggtacaagattactttacggtgcatgattgcttttggtggttgcgtatacagttgaggcgtgcctttcgttcattcttttctgtaatccagtcgcaggcaaatggga

SEQ ID NO: 809 - DNA, 807 bp, Triticum aestivum
  unsure (1)..(807): unsure at all n locations
  Clone ID: PAT_TA_809
tcccagtaccaagagagagatccaagacttggccggccggccggaggagatcgagaaggaggaggagacatggtgcgcgggaagctggaggtgctgctcgtctccgccaagggcctcgacgactccgatttcttcaatagcatggacccgtacgtgatcctcacctgccgcagccacgagcagaaaagcaccgtcgcatcaggagcagggagcgagcctgagtggaacgagaccttcttcttcgccgtctccggcgacgctccggagctcagggtcaagatcatggacagtgacgccctctcggccgacgacctcgtcggagaagcatgtatcccgctggaggctgtgctccaggagggcagcctgccgccggccgtgcaccgggtcgtcaaggacgaggagtaccgcggggagatcaagatcgcgctcaccttcaccccggcagaggaaaacgaggaggaggagagctacggcggctggaatcagtccacctgaaaaatgctagcgagccagcaagacggtaaggttgtatgtctgtcataatgagataacagctttggatctccttgcatgggtgtgacagacagggcaggcaatacagaaaaaacgagtaaaaatagggggaatatggatcgatgcatgaagtactaatcaagcaattcaccgcatcattttgtaatgcatatcaacaatacttacgcaattcataatggatagaaagcattcaggacatggtgtgggtncattaagaaaatgctcaaatggggaatattacgataaaaaaaaaaaaaaaggccctaaggcccc

SEQ ID NO: 810 - DNA, 601 bp, Triticum aestivum
  unsure (1)..(601): unsure at all n locations
  Clone ID: PAT_TA_810
gtccactggcacggcgtgaagcagcggctgacatgctgggcggacggcgccgggatgataacgcagtgcccgatccagcccaacacgaccttcacctaccggttcgacgtcaccgggcaggagggcaccctgtggtggcactcccatgtctccgcgctccgggccaccctgcacggcatcatcgtcatccgccccaggtccggcacctacccgtttcccaagcccgacgtggaggtcccggtcatcatcggtgagtggtggcagagggacctcgtcaaggtggacaagaacttctccatcgggggctcgttcgacgataaccctgccgccgccaccatcaacgggaagctcggagacgtccacaactgcaccggggtggcggaagacaacttcgtgctcgacgtggaacccggcaagacgtacatgctgcggctggtgaacgcggcgctcttctccgagtactacttcaaggtggccgggcacaagctcacggtggttggcgccgacgccaactatctgaagccattcacgacagacgtgntcgcagtcgcggcgggcgagacattcgacgtgctcatggtcgccgacgccccgccctgca

SEQ ID NO: 811 - DNA, 440 bp, Triticum aestivum
  Clone ID: PAT_TA_811
ggagattggttctagcagtggttggtttgttcggggaattcctgatgctcgtgatttgtaaagggtttcagccagggcaagtaattatcagctgagcaaaggctacaacatgctaggaggagaagtttgaatggaggcagagagtacacttggaaatacaatggaaaaaggaagaggagacaatgctagcggaagttaaagcaataaactataagcattttgaatgattagggcctcatattgttgggaacattacaaccatggggaacgctaattttggttgcgaatttagcatagaagccactatatgctcattttggtcgtctgtcgcatccaaaaacatatgtaattttccttttgttgcacaacacccttatatatgggcgtttctagaaacatatgtatttggtcgttaattttattgaattatgttaagtttt

SEQ ID NO: 812 - DNA, 814 bp, Triticum aestivum
  Clone ID: PAT_TA_812
cggcgccacctcgcccaaatcgaaccctccctagacctcctcctcgaccgccgccgccgccccctctgccgttgaccaccccctccaccaccacccctctggctgacctgtgcacccccatacgcccccaccgcggccttcctccccgcccacggcaagcgcggtgtcccctctctactggggtggtacaatacttgcctcagatccgtcttggtggcaacccgatgcaggtgctattagtgaaaggattggagactggttctagcactgtttcgtttgttcgaggagttcctggtgctcgtgtttagtccagggtttcagccagggcaagtaattatcagctgagcaaaggctacaagatgctaggaggagaagtttgaatggaggcagagagtacactaggaaacagaatggaaaaaggaagagaaggcaatgctgaagcacaagagcgagaggctagcggaagttaaagcaataaactataagcattttgaatgattagggcctcgtgttgttgggaacattacaaccatggggaaagctaattttggttgctagtttagcatagaagccactatatgctcattttggtcgtgtgtcgcatccaaaaacatatgtaattttccttttgttgcacaacacccttatatatgggcgtttctagaaacatatgtatttggtcgttaattttattgaatgaagttaagttttacgaaaaaaaaaaaaaacaccgggcggccgcgcgatatcctttgtgcattctgaatgattagggcctcgtgtcgttgggaacatacaaccatggggaaagcta

SEQ ID NO: 813 - DNA, 636 bp, Triticum aestivum
  Clone ID: PAT_TA_813
gtgtcgcaccatggcccggcgacacggcaccgcacgtcgtggaggatctcctccgcctcgtgcagatcctgagtgacggttccgtcgtccgcggcgacgagtccgtcctcggcccaaaggagcccttcccggacgtcccgggcgtgcagtggaaggacgtcgtgtaccacgcggcgcacggcctccgcgtccgcgtctacaggccgacttcggtggtggccggcggcgacaagctcccggtgctggtgtactttcacggcggcggctactgcctcggctccttcgcgcagccgaccttccactcgttctgcctccgcgccgccgccgagctcccggccgtcgtgctgtccgtgcagtaccgccgcgcccccgagcaccgcctccccgccgcgatcgacgacggcgcggctttcctctcctggctgcgcggccaggccgagctcggcgccggcgccgacccgtggctcgcggagtcggcctgcttcgcccggacgttcctctccggcgtctccgcgggcgccaacttgtcccaccacctcatcgtccaggtcgggctcggcgcgcctcgaggtcagcccggtgcgcatagtcgggtacgtactcctctctggctttttcaccggcgccgagcgcacg

SEQ ID NO: 814 - DNA, 1103 bp, Triticum aestivum
  Clone ID: PAT_TA_814
ccgcgcggccgcccgggcaggttcagatgaagctgaagcaaggagggaaagggctaaacactcactcaagagatatatgcactactatgaacgctgggcatctaatcagacatcgaggcagaaggcaatagcagatctgcaaaaggcggaaaaggaacaacttgcaaagttaactgatatttatggaataccggagacacaactgaagttcattattgaagcttggtcacagattatagaatgcaggcgagtgcttcaatggacgtatgcgtatggctattatctcgaggataaggtcaagagtggattttttgagtatctgcaaggtgaagctgagtctggtttggaacgtctccatcagtgtgctgagaaagacctgctagcgtttttgccattctcaaaacatgatactactgaagatcatccttcaccagctgaatttggtgaattccgtgtgaagcttgctggtctgacaagtataactcggaattactttgagaaccttgttcgagcattggaagatgggttggaggatgtccagtgtgccggagaggctgcaacctcaagcaaggccaccaactcgaagaaagcaggagctaaaggcaaagtggcgaagaagcagccgtccagatcatcttcggaccattctgatgatacttggccatgcgagcgctgcacatttctgaatccctcttctgcggatgcgtgtactgcctgtgataagcagcggtactagtagattaataaactgctcaaaaggcagtgacccaagaagctcaaagcgcatgaaaacatgtgtgtgcttatgctttagaaggtgaagcagagctctcaacggatgcaaaggtgtacataagaaaggtcgaaggtccgtcctatgttttatgtagatcccaacggatagcattggttacaatgtcaatgtgcttttgcccctgtgttgtaaatattggttacgaataggtgtagtgtggtgggcttcttctgcggttccatccaccttgctcccttcgtttctcctaacctaaaacatattaggttaagacttaccaagaattgttttattaatatatgatttctttttgtggggaatgtgtgatccc

SEQ ID NO: 815 - DNA, 1202 bp, Triticum aestivum
  Clone ID: PAT_TA_815
cccacgcgtccgcccacgaatccgcgcttagctcgagtcgaaggcgtcggcgtcgcacgcacgcacgcactcaagaggaacacacaaaattcaccagccaactgtggcagtgcggtcgcgatcggtcgaccagcaagctagctagttagcaggtagccatggcggctcggcgtagtggcgcggtggtggcggcgttgatggccctgctggtcgggctcgcgggcgcggacttcgcggcggaccgggcggagtgcgcggacaagctcatggggctggcgacgtgcctgacgtacgtgcagctggcggcgacggcgcgctcgcccacgccggactgctgctccgggttccggcaggtgctgggcgtcagcaagaagtgcctgtgcgtgctggtcaaggaccgcgacgagcccaccctcgggatcaagttcaacgtcacccgcgccatgaacctcccctccgcctgcaacatcccggccaccttctccgactgccccaagatcctcaacatgtcgccggactccaaggaggccgagatcttcaagcagtacgggatcgagcacgagggcaagaacgccaccgccggcggcagcgccgccgtcaccggtacctccggcgcgaagagcgccgacgcagcggccggcgcagggaggcacacggcggtggtcttcgccgtcgtcgtctcggcgctgctcgcctccgtccttgttctcgcatgatgacaggctgcagtgaggcgagacagtcagcagggagggagatcagaagtcgggacacccagaggtgtctgtatgattgggcctggctgcgcaattttcagcctgggccttaagtttggtcaagcagagggcccattgattgccgtgtagcgagtgagtgagtgagtgaattctaagacaagtagaagtgtattgcagtgagtgagttgcctgcctccccggttcctgtttaatccctttcttggtctcttttatttttccgaatagtgagttgaccgccggatcagttggtgttggaagcttacatttgtcctaccgaaatttctctcccttgtccttccattttctggagcaagagtgtgtaattaatatgagtacttcatatatttttaaatgatatgtgtattttacagtgatgtgctgttacatgctcgaatctggaagaatgtcaatcttttatttctcattaaaaaaaaaaaaaaaaaa

SEQ ID NO: 816 - DNA, 696 bp, Triticum aestivum
  Clone ID: PAT_TA_816
tcgcccacgcgtccgcccacgcgtccgcccacgcgtccgtacggccggaggagggctacggctccggatacgggtccaagccgcaggtggagcagacctacggcggatccgagtatggctctgggtacggaaggaagccgcaggtggaggagagctatgggtcggggtacggaagcaggccccagggagggggagaggagtacggtagcgctgggtatggcgggaggaagactgaggaggagggctatggtggttctgggtatggatctggcaggaaggtgcaaggcgaggatgaaggtgcctatgggtctggtgggtaccagaagcccaagccgtatggagaggagacccagggttcatatggtggtgggtatggccaggggaactatggccgcaagaagcaggatgacgactctgatgatgagaagaagaaccgttacgcgaagcgcgatgactctgatgatgagaagaaggaacgttacgagaagcaccaccaccatcgccgccacaactacgatgactaagcatccagcatggtcttgacctgctgccatcggccccacatctcgctactacacgaataaagattggtcttgtttcccttgttggtgctggatcattcccctcttttatgaacttgtatgactgcaacctaaagtgtgttatgtgggtggtttatatgtttgaactatctcc

SEQ ID NO: 817 - DNA, 633 bp, Triticum aestivum
  Clone ID: PAT_TA_817
cgtccgcccacgcgtccgcggacgcgtgggcggacgcgtgggcgtcccaggtcacacaccactccttcccctcccctgatctccccgccgcgccgatccccccaccagcgcagcagcagccatggcgaccgcctacaacctccggtcccgcgacgagccggacgacttcgacgagttcgactccacgccctacggcggcggctacgacctcttcgtcaccttcggccgcccgctcccgccctccgacgagacctgctacccctgctccgccccctccacctcctacgacgcgccccactacgccgccgaggagccctccccctacgcccaccaccagaagccgcagcccgcctacggcttccgcccccagaacgagcagcagcagcagccttcctacggccgcgaggacgacgactccggctacgtatccaagcccaagcccaagccccagcccgcgtacgggttccgcccccaggcggaggaggagcagcgcccgtcctacggcggcggggaggaggatgaccagcaggaggagcccgcctacgggtccgggtacggctccggctacgggaggaagccgcaggccgaggagagctacggatctgggtacgggaacacgacgcagccggagga

SEQ ID NO: 818 - DNA, 1574 bp, Triticum aestivum
  unsure (1)..(1574): unsure at all n locations
  Clone ID: PAT_TA_818
gctggtctccccccccataccgcacccccgcccccccacccccgcggctccgcccccatcccgccccacccctgatgtcccccccgcgccgatcgccccaccagcgcagccgcggccatcccgaccgcttccaccagccggtctcgcgacccgccggaggcctctgccgcgtcttcctccacgccctccggccgcgcccgccccccctccatccctgctcgcccccctcccccgcccccccctcatgccccgccacccccgctccgccccctccacctcctccccctcgcccccctccgccgccgacgacgcgcccccccaaggcccaccaccccagagccgcgccccccccccacggccgcgccggaggaccaacgcccagctcccagcctccatcccgaacccgcaggcaggccaaggaccggcctatggttctggccgccgacggagaaccgaagccgcccggcgacgaggcccagggttcccagggcggggggggtggcgagcgcaaccaggggcggaggaagcaggatgacgactctgaggatgagaagaagacccgttacgcgaaccgcgatgactctcatgatgagaagaaggaacgttacgagaagcaccaccaccatcgccgccacaactacgatgactaagcatccagcatggtcttgacctgctgcgatcggccccacatctcgctactacacgaataaagattggtcttgtttcccttgttgatgctggatcattcccctcttttatgaacttgtatgtactgcaacctaaagtgtgttatgtgggtgggttatatctgtgaaacggccccggcgcagggggagcagacctacggcgggtcggagtacggctctgggtccggaaggaagccgcaggtggaggagagctatgggtcggggtacggaagcaggccgcaggggggagaggagtatggtagtgctgggtatggtgggaggaagactgaggaggagggctatggtggttctgggtatggatctgggaggaaggtgcaagaggaggatgaaggtgcctatggctctggtgggtaccagaagcccaagccgtatggagaggagactcaggcttcgtatggtggtgggtatgagaagcccagctacggcggggggaactatggccgcaagaagcaggatgacgactctgatgatgagaagaagaaccgttacgcgaagcgcgatgactcggatgatgagaaggagcgttacgagaagcaccaccaccaccgccgccacaactacgacgactaagcatccagcatggtcttgacctgctgccatcgcccccacatctcgctactacacgaataaagattggtcttgtttcccttgttggtgccggatcattcccctcttttatgaacttgtatgactgcaacctaaagtgtgctatgtgggtggtttatatgtttgaactatctcctatctgtgtgcttgaggtgatgtgcttatgtacatggtgcgctgtacacttatcagattgctgtgtctgaaactccgaaacttggttctgcttcgtcaaaaaaaaaaggagccactgcgngtagc

SEQ ID NO: 819 - DNA, 1127 bp, Triticum aestivum
  unsure (1)..(1127): unsure at all n locations
  Clone ID: PAT_TA_819
attcagcaggttgcttcgtgtatataccataatctgccggatgaggtcactctatttgaggatcacaagtgccatgaagagcagatcccttctgactgtacacagatattatgtgctcataaaaacgaagtttgggtttgtaaggttctcaaatgatgggaactacctgggcatcatcttcaagtgattgtactgccatcatatgtgaaggtggaagaaagatgatacattaaccaagaagtactgcctccgagggcacaaaagtcctatttcttttggttgcttgggagcccaaatgatagaatgcttctcacttgtgggtaatggggaatcctttaaagactgtggaatgttgatactnggtgaaatgcatccttaaattttggtgctgcaagtaaaacacatcatcgcgtcatgtgcatggtttccaaattcnacagaaaatagtatgtgccacctctgaacctgaaagttctccaaatatgattttcacttgtgaccttgagcaccaacggctggtggcccgcgcgtgtgcgaaaatacctaagttagtgatcttgctgtgacacctgatggccaacatctaatctgtgtatgtcctaacgaaatctggatccgagaacttcggaaggggcgggaatggaaaattcctgaacggcagacaatatcatctctttctctttcaggtgatggacagtcaatgattgtcaaccttaatagccaggaaattcatttgtggaaaaccaatggaagttctagagtgcccgataaatacaaggggcacaagcaaggaaagtttgtgattagatcatgctttggaggatcagactatctgttcattgctagtggcagtgaggattcacaggtggtatttttaaacaaggaatgacatctgtttagaaacagcagtaccatgcgtttggaggttttatgctcttgcactataccttttctgtgaggagtgatgctgaacatcgcagactcgcatatccaaaagtgtacatttggcaaagaggcatggagatgccgataaaggtcctatatgggcactcaatgactgtaaattgtgtaagctggaaccccgcgaggccccagatgttggcttccgcaagtgatgaccagtacag

SEQ ID NO: 820 - DNA, 548 bp, Triticum aestivum
  Clone ID: PAT_TA_820
ggatacgctcgtgctcacacgcacaccgctgccaagaagcagcagaagatcagcagcagtagctccgctgataatgccgcgagctcgtcctccagcaacagtttccacgtcgagcagatcaatcctatctgcggcgaccagctgcccgtcagttgcaagatgccggatagcacggccaccgccggagatggtggtggcctgttgtttgaaggcatccagcctgacgaggtctttgcagagctggaggagttggagactgataataatcccatgacgacaagtgcaaacgtctacggatccaggggggtaagtagtaactacgagtggcacaaattctaatcacgatgcttctagctaatcaatcgatcagggcggccgtgatacatatatgcatgctcgactaagaagatcatacatatcttaaaacgcacggtttctccccctttatttgtacaacaggataactaatatatttgtttccgccaatatatgatgataaaactaagagtgtacatatacgtatattttacgaggtaattaatcaagag

SEQ ID NO: 821 - DNA, 844 bp, Triticum aestivum
  Clone ID: PAT_TA_821
ctcggctctgttcgtttcctccgccgcccacgccacgccacgcgggcgccgcacgaggagcgcgcgagctgccgcgagcccgcgatcgacctgttctgttgatccagctcgaaaggggtaaagaatggcgccgccgcccgagggggagcggggcggcggtggctgccgcgcgaggtggcttcggcgggaggtgctgctggccctcgcgctcgggcagctcgtctcgctgctcatcacctccaccggcttctcctcctccgagctcgcgcgccgaggtatcaatgcaccaacgtcgcagtccctcttgaactacatccttcttgctcttgtctacggtggaatactcctctaccggagacagccactcacgacaaaatggtactactacttgatcctcggcattattgatgtggaggctaactatatcgttgtcaaatcttatcagtacacatctttgacgagtgtgatgctgctggattgttggtcaattccatgtgtaattgttcttacttggatctttttgaagaccaaatatggattcaggaagttctttggtgttggagtttgtgtggctggccttatattagtagtattttcggacgtccatgcctctgatcgagctaaagggcccaaacctttgaagggtgatttacttgtaattgttggctccatgctttatgcttgcagtaatgttaccgaggaatatctggtcaagaagaacaaccgaattgagttgatggccatgttgggaatttttggagcagttatcagtggcatacaaataagtattcttgagcgagaagaacttcattcgatcaaatggaatgccgggcgcggtgttccc

SEQ ID NO: 822 - DNA, 967 bp, Triticum aestivum
  unsure (1)..(967): unsure at all n locations
  Clone ID: PAT_TA_822
actcgctccacacctganacagagcagaggatagataaacccaaacccctgcgcctccattcgaaccaaacccgagccgccgcccgcggnaatccaaacttttttccctcccttccccgcgcgatcaagcgatcggccgatcggggagcagcggcccgcatagatggagtccgacaagatggtccaggtggaggcggcggcggatcctgaggagcgcaccgcctccggcgaccccaaggcctgcgacgactgcaacaccaccaagacgccgctctggcgcggcggacccaacggaccaaagtcgctgtgcaacgcttgcgggatccggtaccggaagaggcggcgggtggccatggggctggacccggaggccaagcggaagcccaagagggacgacgccatcaaggccgcagccgaggccgcccaggcttctagcaaggaggaggaggaggaggaggaggacaaggccaaggccggcgacgagaaggccggcgaggagaaggcgagcaagaagactaaggcgaggacgacgcacaccgttgagctccacatggtgggctttgccaaggacgcggtgctgaagcagcagcggcggcggcggcggaggaagccgtcgtgcctgggcgaggaggagcgggctgccattctcctcatgtcgctctcatcaggcgtaatatacgcctgatccatccttgatggatcgatccctgatgaatatgaagaggtgttgttggcatcaaatcaaatcaaatcaaataatcatctatgctatgctatatgatgatgatgatgtagtggtagatgagcaacctacctacctacctgtgttggttgctgctgcttaccgttggttctttggttcctagctagctagtgagtaccctgtgctgtgactgtttgtttgttctaattatgtaccgtctgacttaatctgcaatgcaaagtgacaaggacaagtcaagtcaag

SEQ ID NO: 823 - DNA, 1060 bp, Triticum aestivum
  Clone ID: PAT_TA_823
attcggacgaggaacccctccctctctccctccgataaacccaaacccctgcgcctccattcgaacggaacccgagccgccgcccgcggaatccaaacttttttccctcccttccccgcgcgatcaagcgatcggccgatctgggagctgtcgccggcggagatggagtccgacaagatggtcgaggtggaggcggcggcggatcctgaggagcgcaccgcctccggcgaccccaaggcgtgcgacgactgcaacaccaccaagacgccgctctggcgcggcggacccaacggaccaaagtcgctgtgcaacgcttgcgggatccggtaccggaagagacggccggtggccatcgggcgggacccggaggccaagaagaagccgaggggggacgacgccctccacggaggcgccgaggaagcccaagagggacgacgccaccagatcgataaggaggaggacagccgaagcaccggcgaagagtaggacgacgacgacaaggcaagcagaaacaaaggcaggagaacgacgcacactgtacgactagacatcgtccgggtagaccaagacgagggcgtggagccgcagcgtggagctcggcgtgggaggctgcggcgacggcgcgaggcggagggagcagcagcggtggtcgcggcacactcgtcgggtgaagtcgccgtccccgggcgaggaggagcgcggatccatcctcctcatgtcgttctcctcgggccaagaagaccccggacccgtcctgtggccttcctcccctgcacctctgatgggcttcttccctgtgctatatgatgagcttcgctgagttaataatcatctatgttatgatgatgtgctcctagattagcaacctacctatgttggttggttgctgcttaccgttctttcgttgctagctagttgttggtagtgagtgagtacttgatcgtcgtcatgttactgttaatgcctgtttgtgtttgtcctaagtatgtaccgtctgacttgatctgcaatgcaatgcaatgcaatgctcttctcttgtgtgatgaaaaaaaaaaaaaaa

SEQ ID NO: 824 - DNA, 1216 bp, Triticum aestivum
  Clone ID: PAT_TA_824
tgcggcaggccggttccccacgcgtccgctgccatattccttcattctcttctagcagctagcttgccaatccatccatcggtggcaaattcagcagcttaattctagccttctccttctgaacgtgcagtagtgcacatggccgcttccccttgcttttcgttggctgctcgctgcagcctcttgctcacggcagcgctggtcctagcgctgagccacggagcccacggttatggcgatgccggtgccgggttgagctcgtccttctacgacgactcgtgccccggtgcgcgcgacattgtccggcgcgtcatccagaacgcccgcgtcgccgacgcgcgcatcccagccagcctcatccgccttcacttccatgattgctttgttcagggctgtgacggctcgcttttgctggacaacgacctcccggcgatcctgaccgagaaggaggtccctgccaacgacaggtcagcacgcgggttcaaggtggtcgacagcatcaagcgtgcgctggagaatgcatgccctggcatcgtgtcctgcgccgacatcctcgccctcgcctccgagatctccgtcgagctggctggagggcctcgctggagtgtgccgctgggccgccgtgatggcacgaccaccaacatcgagagcgccaacaatctcccgagccccttcgactctctggagacgctccaggagaagttcaaaaacttgggcctcgacgacactgaccttgtcgccctccaaggagcacacacctttgggcgggcgcaatgccagttcacgcagcggaactgcagcgccgggcaggacgaggagacgctcgtgaatctcgacacagtcacccctgacgtcttcgacaacaagtattacggcaacctcttgcgtggccgcgcccctctcccctcggaccaggtgatgttgtctgatcccgttgccgccgcgaccaccgcacggatcgttcgcaggttctccggaagccagaaggacttcttcaagaatttcgcggcctcgatggtcaaaatggggaacataagcccgctgaccggaagggccggggagattaggaacaactgtcggagggtgaacagaaaaccctattgatgaatgagattgatgttatgagttgtgaactcgttgtctttgtgtaaatcattcttttcattcattccaactgtaaagtgttcccttattattaaaaaaaaaaaaaaaaaaa

SEQ ID NO: 825 - DNA, 793 bp, Triticum aestivum
  Clone ID: PAT_TA_825
acccgtccgcgcaccccggcgtcccccccttccggagatcccctcttccgcttccgcctcagcccccagaaaataaacccccaagcagcaccgcgagtctgcctccgtacgaccgcaccgcttgcccccgaaccctagctagagcctgccagcagcgccgtcgccgtcggcgaatcgaatccgcgggcgcccgtccagccatgtcgccgcccgagaaccccaacggcggggccgccgccgccgcgccctcggagcccgcgccgcccgccaagccttcgtcttccaaggggaagaagaaggacgacaagaaggacgacgatctgtcggaggaggacctggcgctcaaggagcagctcgagctctacgtggtgcgggcgcaggacgtggatcccggcgtgcagaggctcgccctcgagagcatgaggcaggagattcgctcagctacaagctcgatgacgtctgtcccaaagccactgaaattcctccgcccacactatggaaccctcaagtcctactatgaaactatgccagaatctgagctaaagaagtacatggctgacatactatcagtgttggccttgacaatgtctgctgaaggagagagggagagcctgaggtaccgtttgttgggctctgaaggcgacattggttcctggggtcatgaatatgtgaggaatctggctggtgaaattgctcaagaattccaaaagcgccagggtgatgacatgccaattgatgagttaatggaactagtgcagcaaattgtctcattccacatgaagcataatgctga

SEQ ID NO: 826 - DNA, 450 bp, Triticum aestivum
  Clone ID: PAT_TA_826
cccacgcgtccggcgcccaccgtcgcgttcaagcagtcgccggtgctgggctgagctacgctggcggccgtgcactgccgtgccgtggagcaagggtcgacgacatgttgtaggcctctcctcgcttctccgtagctttggacggaattctgctgcactttttacgtggcagtgtcagtgtggcatggcttggctccctgaagcatttgccattggggaactcgaagggtaaaatattggaaggaacatccgcgatatactccagattcttagctttcatttcgacttaagatatatatgtagctgcctcccgaatgcagaattatgccccggctgatgtgggcgtttgagttgcgatataatccgctgaaaagcagtggatacagcagctgcggtactgcaagcatgggcctcctccgaacataaataaattctccagagttcgtctaa

SEQ ID NO: 827 - DNA, 613 bp, Triticum aestivum
  Clone ID: PAT_TA_827
cttgttacccacccctaccccgcaccgttccctggagatggagaacctcgccggagccatcagggacctggccgccctctccacgcggctactccttcaactcagcggcgacggcgagaaacgcaacctggccatctccccgctgtctatccactccgtggtcgttcttctcgccgccggtgccacgggcgacaccctcgaccagatcgtctccttcctgggcctgtccggcggtgcagcgcatgcggccctcgcctccgaggtggccacccttgtattcggcagggacgctggcgtggagccccagatccggtgcaccgtaggtgtttgggtggagtcctcgctccgtctgaggtccgccttcgcagacaaggtcacctccgagttcaaggccggggtgcgagccatgccattcagagagaatgtggaagaggcgagggttgagatcaaccgctggtttgaggacaagacaggcggcttcatcaaggacctcatgccagaaggccacctcgacgccatctcgacggtccttgtcatcggcaacgcgctctatatgaggggcacatggctagatccgttcattccttacaacacactggacgacgacttcttc

SEQ ID NO: 828 - DNA, 852 bp, Triticum aestivum
  unsure (1)..(852): unsure at all n locations
  Clone ID: PAT_TA_828
gatttcaacttgacggagctgcctcctctttcctcctgcgagctttgcttcctccccccgtaatcctcatcgctgcagtcttctcccacggcactcaacgcatcttatggcatggcgccccggccttacatagccgctcgcccgcgggctctcgccaaatcccatgccagaaacgcggaacgacctgccgatggagccgtcgttcgggtccaactccgcgagcaccgaggaggcgtcgacccggcgcgtggccaaccgcatcatccgcgcgctgcagcaccacctccagctgctgcaccgcgccggcgcggacttcttcgtgctgggcgccacgggcaacgtgtacacggtgacgctggcgaccacgccggcgtgcacgtgccccgaccccggcgcgccctgcaagcacatcctcttcgtgctgctccgcgtcctcggcctgtccctcgacgaggcctgcgtgtggaggcagtcgctgcggccgtgccaggtcgcgcggctcgtcgccgcgcccacgtacccggaggtgctcgccggccctcgcgcccgggagaggttccaccagcagtgggcggcccacgcggcggctgcagccgcaaaggccgctgaccagcgccggcaggagtccgccggtccgtcgttgggccgcctcgacggcgccgcctgcccggtgtgcctcgaggagatggcgccgtcggcagaggcgcaaggcggcgcggcggcaacggggccggcgccgctgctgacgtgcggcacctgccggaactcggtgcacgccgagtgcttcgcgcggtggaagcgccaccgcgcgaggcgggcggcgacgtgcgtcgtgtgccgcgcgnggtggcg

SEQ ID NO: 829 - DNA, 1090 bp, Triticum aestivum
  unsure (1)..(1090): unsure at all n locations
  Clone ID: PAT_TA_829
acttggcacaaatagctgcttctcacttgcaagaaaaggaccttgtctatgtgtctgggcaattaactggagatgttccgccattcaaacatactgatggccaagcaaatattcaggttgtagcacatttgctgtcattccgtgataagaaagctgtggaaacggatctcatggtgcaggaaccgggagggtttgtggagtattgctgaggctgaaaagaaagttgaacaaaccaaacctttctctaaatatccagcacgcacatttgcagattataaagccaaacaggacaagtacagaacgctctggaatgatgttcttgccaatccacttaattggactgataaccgggctgagaaggcgaatggatctaaaaatccaaattacccggtgttcatggccttgccaccagatgaggcactctggcttgactcagcaccacattatgttctagagaagttggatggtttgacctttaatagtggctacaatgcggctaaaacatataagccttttaattctagcatggggaaaggtacaaatacaggttggagtaaattcaagacaagccaagctgcctctcctgagaaacagaaaaaggaagcggaattgtggcagaatcttgtggacagtcctcaaagctggtgggacaaccgagcagacaagaggtcacctaaagcccctgacttcaagcacaaggacaccggcgaggctctgtggttgagccccaagacaccaagttcggttacagatgcgctgccaccggtgaaaggaggcagcagaggatttagaaggccggagaccctgctctcttgacctatctnaggtggccttggttgtgcnatgtgcgttgcctcagctctattcttttgctaaatactcagtctgtctcggtctgctaacttatgcgagtctcggtctgctaacttatgcgagtctggtagagaccacttcaagataaaaaaaaagaatctctgccttaacctccagcgctgtcactgatggccatgtgggttgggttgggttgggccttcgtaatgctatgccaggatgtaaatagcatttccacaaagttnannatatttatgcc

SEQ ID NO: 830 - DNA, 1103 bp, Triticum aestivum
  unsure (1)..(1103): unsure at all n locations
  Clone ID: PAT_TA_830
agcggaatgttcaggaagcggtgcgcaaagcgcgctgcatcaagagttgagatctgtgaancagatgagtgggatcgaactggcaaagattccagcatttcaaagttcaaagtcctaggatggcagtttgcatttttctacagagcatctctagaagagcaacttctctccaaatgggcataattaattgaaaaagaactactgccatttttgtacagctgatgatcattacaagagttgggtgataccgatagcattatttttaagcgaggcagatgccttgtgagcttaatgagcatatgctgccatttgtattgaatgtgtactaagggggcatggtgaagcttaggggctggaggtctaagaaatacaagccaaggtttgtagcggatttttgacggttcatggtcctcatattttgtcttcgtgatgatatttgaagtacaagaagatttgcaaggaaggatgtacagtacaaataccacagattgctgtagtaaattatctgaacataaagaacatagttctgaacaaacattgaggagagacaatggcaaatttctcatgataaagcaatgtagtccagtatcccaccatgaaaaccaacggtggatgattatgcaagcatgacaactgaacaaactccaaataattgggcctgcctcagtcacataattttctgtaatattaacatgaaaatgcagaaactgaaccatgatgctgctgggaatcagaacgatagctgcaattggtattgcagttcaatcttcctgaaaaattaggagaaatgcaatgaccagatcagactacatctcctatgacatataccccattgccccgtatcttgaaaacgaaaggtggttgtagatctgatcctgctaacaaaaggtggttagttcatgagtcgactcggccattcccttttaagttgttggaggagttgttgaggttggtgcttgcataggaaggagttggtgactccctacctggctgcagcgagttgccgctacctgggtgggtggcactacattgcttgatccattgcaacgtggcatgaattttttttaaatgactccaaaagatagatcacnaaattcaggaaa

SEQ ID NO: 831 - DNA, 516 bp, Triticum aestivum
  unsure (1)..(516): unsure at all n locations
  Clone ID: PAT_TA_831
gttgccggggacaccgtgcncccntggccaggggancgagnggttccgacggaaggccccagacttgtggcagacgnttnggacgnttccagatccgaggtgtccgccgtggcgtcgccggcagagggtaccggtcgctacactacatgcggcccctctgcatctgggcgatgcagtgggcgctgtcgccgccggagcttcacatggacgtcagggtgttgccgggttcggtgtccgccgtggcgtcgccggcagaggtggtcctggctcgggagaagttcgaggaggtggcgagcatgctgaggctgccggaggaagaacagcacaagggatatctcagagctctgtaccaaattctccggcagacgctgctcccggcatcctgattctcttacggatctgctaatttacatgcggatgaaaacaattcgccttcatccgttttctatgccctaaaaaaaaaaaaaaaaaaaaaaaaaaaaaaaaaaaaaaaaaaaaaaaaaaaaaaannnnnna

SEQ ID NO: 832 - DNA, 604 bp, Triticum aestivum
  unsure (1)..(604): unsure at all n locations
  Clone ID: PAT_TA_832
gtgcccactttagatggtaaaacagaaattaagatacccaaaggagttcaaccagggcaagttgtcgttttaagggggaaaggattggaattaccaaaccaggcaggatatttcggagaccaacatgtccgtttcaaaatacattttccattgaaggttaacgaacgtcagcgtgcactgttggaagactttgcagcagaggaagccacgaaagaacagagtttttttgcaacaggaaactggtcggagctcattgctgaaaatatgaagagccaaaatttcatgatcgggcttggctttgtcatgctgatttatctgatgctgagcaagactctgagttaaggcttcgaaactatgcggtgatatcaagcagcggtgacatcagaaactgaatggggcattagtatctggtcaagcttcttatttggccacgagaattcacaattttggagctgcggagaggagaattactagttcctgtggaacagataagtcataggaatgatttatgagttatccttctgnggggaggtgatcacaaaagttgcgtggagtttgtttttgactcttcaataagctaaattattgttaaggcgctccttaa

SEQ ID NO: 833 - DNA, 175 bp, Triticum aestivum
  Clone ID: PAT_TA_833
agagagtagacgctccctccgatcaatcttgcagcctacacacattggttgctcatacgcactagcatagagctgttccatttcttctaatttattcctattaatttacatatttttttgtggatgaactgatcaaaaggtttatacagcaagtatatatgtgttccactgatcc

SEQ ID NO: 834 - DNA, 1337 bp, Triticum aestivum
  Clone ID: PAT_TA_834
ggataagcaagctgcatatgggtggatgtttaagcttagtgaatgggctaatttttcctcgtatgatgttggtttgcgctctggctctactgcctcacatattctggtttttgatcggcgaacaaagaggctagttgaagaagcaatagatggaaagatagtgttgtccatgagggctttatatcagtcaaaagtagggctcacccttattgattcaggtgtcaaagatatcttgaagaacctatctgagaagcaaggaaagaagatgaattcgccagaatctgccaaagatattccaaagttcctcgagttatttgcgggtcaaattaatatggatgagactaaggaccctattgaaagttttaagacgtttaatgaatttttcatcagacaattgaaacccagtgccaggcccattgcacaaattgatgatggtagtattgctacctgtgctgctgattgccgtttgatggcctatagttctgtcgatgagagcacaagattttggattaagggtcgcaaattttcaattgagggtctcctaggggcggatgcacaccataatgcttttaaaaatggatcattggtaatttttcggcttgcacctcaggattaccataggtttcatgtacccgtctcaggaactgtagagaaatttgtggaaattcctggatgcttgtacacggttaatcccattgccgtaaacagcaagtattgtaatgtgttcaccgaaaataaaagagttatctcagtaatctcaactccggagtttgggaaggtggcatttgttgccatcggagcaactatggtaggaagcatcacattggtgaaaaaggagggcgactacgtccacaagggagatgagtttggatatttctcctttggagggagtacggtaatctgcgtgtttgagaaggatgcgatacaattcgatgctgatcttctagccaacagcgaaagatcactggaaactcttgtcgaggttggcacaacattgggcgtctccaaacggaacagagggctaaaagtttcggagctacagaagtgttcaattgaatgatagaagttagtgagtgcagtgcagcacggtacagaactgtaaagttataggacatagcttgcctggacagggatcagtagagtatattctcatagtgtcctttttttttcatgtcagacctatttcatgagttctttcggtagttagctttatacttggatctgctttgtgcatcatatgtaagaagatccattttgttaccattgtaaaaaaaatcacatttgatctattttctagtcaaatctgagctgcaaaaaaaaaaaaaaaaaggccccta

SEQ ID NO: 835 - DNA, 928 bp, Triticum aestivum
  Clone ID: PAT_TA_835
gcacgagggtcacttctgcttcatgcacaagattgcgttgatataccttccaagaccaaagaaaccccattattccttgcagtgaaaaatggttctttgagctgtgtacgacttcttttgcgttatggagctaaccccaaagcccagaacctacgaaagcaaagaccaatagacgtggcgacatcccaggacatgcggtttcttctcaactccgcaaatgttgtaccaatgaaccatggctcaatggaaaagaaccatgcgatgaaaaaagaaaggcacaaagagcttccgggtgatgatttccatgattatgacaacggcgattattatgaaagctgtgttgtgccaaaggcgtcagtaggtcaccgggattttccggttaaaagtaagggcaatactgccccaaaagaagggcccaaattatctcggcctaatgatcattgggagaagcatgactacactcgcaaaatctttgttgggggtctcccgctttcggtagaccatgcgtaccttaccacattcttcactagtgaattccgacctgtggaggaagcaatagtcattaccttaaaaatagatgagaggatacagtcccgaggctttggctttgtaaaattcgaaagagagaaggatatgattagtgcaaaggaagctcatcatgtctatgtgcttgggaagagagtggagataaaggatgctgttgctagaccgtccctgcctgaactcgaaagagcaacttccttcaggcaccatgtacgtgagtccccaagagtgactcatagtgagctggaggatgaacaacctgagcaatataactttgggaaacggcggccaatgccagagaagcacctcccatcttggttctttatattcaggaggtggttgccaagatttctcatgaaagcaaccgaacgatatggtgagaagt

SEQ ID NO: 836 - DNA, 655 bp, Triticum aestivum
  unsure (1)..(655): unsure at all n locations
  Clone ID: PAT_TA_836
gcgacgcgagggtgggcggtagcgtgggttccacgggnagcgcggcgtctcctgctcctcgtcccgcggnaaggcggcgtctcctccggcgacgaccgccttcccctcctccagcgacgaccgccttcccctcctccggtgaagcgcggtgtcttctcctcccgtgacggctccctgaatccaccgcgccgcgcgtttctcggctcgcgtgtggagcgcaggagcgattccggcggcaggggaagggtggccgcggctgctgtctggggtcgattctcaccgtacgcttcggtcttcctttgctgtcgcgtggacttcgggtgtgccggtggtggccactgccgtgggatcgagtcacccagctccttgtagccgtggactttgggtgtgccggtgatgactactgccgtgggctagaggtgttgtccctgatacgaattcgttatcaagcaattagggatcaaatatggcttcatgccaagaaagaaagcgggctgagagagaggccaggaagaaagttgcacaggctttcaagggaaggagctatttggaaggttgaagttgcaatatccttacttgggttaatgtggattttgcctatgccctgaggggatatcaacaaaaccgggtanaatgangggcctgccaatggcaa

SEQ ID NO: 837 - DNA, 1253 bp, Triticum aestivum
  Clone ID: PAT_TA_837
aatgctcagcaagggcagcttcatgcctcacaatccttggggcctggttcttttggccagaatataccaactatgcaattacctggccagctccctgtgtcacaaccgttgacgcagcaaaatgcttctgcaggcgctctacaggcgccttcagctgtacattccaatcccatgcaagctgttcctggacaacagcaacttccttccaatgtgacagcgctaatgctgctgcagcccgtcctaccgatgctgttacaagcaccacagttccaacttgaagagccgcagccagtgatacattgcagttatcaatcttcacagcagacgatttttctgattcaaatacctttggggctactacatcagcagcagcagcagcaccagcagcaacatcagctgcagctgctgccactttccgcccgttcctaagcaacagggacagccggtgcaatctaataccccttggtgctccggctgccatgatgacgacaaaaattaaatgcaattccacagcaggtcaattcgcctgcagtttctttaacttgcaattggaccgaaccatacctcacctgaacggttttaaatattactacaaatagcataactcgagagagtaagtgggagaagcctgaagaatatatactgtatgagcaagcagcagcagcaccacgaaacttattttacttcaaacagcaccaacaaaagcttgttgcgcagcaacttcagtcacctcctcaggctcaaactattccgcctatgcaatctatgcaacaccatccccagtcacagcaaggacataaccaaatgcagatgaaacagcaggatttgaattataatcagttacaggcaactggcacgattgatcccagtaggattcagcagggaattcaagctgctcaagagcgttcttggaaaagttgactgcaggtggatgaatgatgtgtcagccaagactccagtctcaggaatgtgctccagcaaaacctgccgcttccgtctgtgacagtgttttttgccttcgcgcggatggccatgttgactcttgcggtcattgtaactctgaatttagcttagattagtgcctagattgtagatcctatgtgtgtaaaatgtttgcagtctaggccttgtatcactgtaacattgccgattagaatggcagctgtgtatcgctgtaacattccgtgtttttatttaccttttttggccccagaactgacctcctcatatgcatcaaaaaaaaaaaaaaaaag

SEQ ID NO: 838 - DNA, 449 bp, Triticum aestivum
  Clone ID: PAT_TA_838
ggcacgagaaaacactcaaccgccgaggagcccacccgacctatctctcttctagccctacctctctcctaatctgggcatcgacgatcgacgatcgacatagcactcagcatcgcccgccccctctcttcccatctggcgggcagcagaggagaccggcctcctccagatcggcctcgaggtcaacgacgcggacaaccgacggactcgacgctgccacccggagctacatcgcccacgatgtcgagtagggcatgtgcaagagctcttggccttccggggctgccgccgcaggacttgtatcgtcaggccgtcgtggtgtcgatccagccgccggccacatatgggtcttcaggtcgggtgcggcaacttgggacatggatagtagctttggtagtacagcatacccaggacccgtgacctgctggtagccttttatactcttctat

SEQ ID NO: 839 - DNA, 1170 bp, Triticum aestivum
  Clone ID: PAT_TA_839
acctcaaacacaacccaacccgcacacacacgcctagctctagcttgagagagagggagaggatggcgggagcggtgaacggcgtggaggcagcgcaagctcagggcggcggcgcggcggcgggggaggcggcgatcaggcaccggacggtggaggcgaacggcatcgcgatgcacgtggcggagtccgggccggaggacgggcgggcggtgctgttcctgcacggcttcccggagctgtggtactcgtggcggcaccagatggcgcacctcgccgcgcggggctaccggtgcgtggcgcccgacctgcgcggctacggcggcacggaggcgccggccgacgtcgcgtcctacaccgccttccacgtcgtcggcgacgccgtcgcgctgctcgacgccctcggcatcggcaaggtgttcgtggtggggcacgactggggcgccatcatcgcctggtacctctgcctcttccgcccggaccgggtgacggcgctcgtcaacaccagcgtcgccttcatgcgccacgtcttcatccgcgccggcgccgccgccgtcaagaccaccgactacttcaaccaagcctacggcccgacctactacatctgccgcttccaggagccgggggtggcggagaaggagttcgcgccggcgcacgcgaggcacctgatgacgcggatcctgagcgaccgcttcagcgagcgcgcggcgggcaaggagcccaaggacggcggcggcgacgacgccgacgcggcgctcccgccgtggctcacggaggcggacatcgactacttcgccgccgcgttcgagaagacgggcttcacgggcgccatcaactactaccgcaacatggaccggaactgggagctggcggcgccgtgggcggacgccaaggtgacggtgcccaccaagttcatcgtgggggacggggacctgacgtaccactacgcgggaatccaggactacctgcacaagggcgggctcaaggcggacgtgccgctgctggaggagctggtcgtcgtccccggcgccggccacttcatccagcaggagcgggcgcaggaggtcagcgaccacatctacagcttcatcgcaaagttctgaagaacagctgaaaatcgatcgttcgtcgtgtgttgtcagtttgatcatcgttcgtttcgtactttcattg

SEQ ID NO: 840 - DNA, 1018 bp, Triticum aestivum
  Clone ID: PAT_TA_840
ggtgcaccccaactcgtacgcgctggtgatcagcatggagaacatcaccctcaactggtacttcgggaacgaccggtccatgctggtgtccaactgcctgttccggatgggcggcgcggcgatcccacgcgtccgcccacgcgtccgccggcggcgctccaagtacgagctggtgcacaccgtccgcacccacaagggcgcggacgacaagtgcttcggctgcgtgacgcagcaggaggacgaggccggcaaggtgggcgtgtcgctctccaaggacctgatggcggtggccggcgacgcgctcaagaccaacatcaccaccctgggcccgctggtgctcccgctgtcggagcagctgctgttcatggcgacgctggtggcgaagaaggccttcaaggtgaagatcaagccctacatcccggacttcaagctggcgttcgagcacttctgcatccacgcgggcgggcgcgccgtgctggacgagctggagaagaacctggggctgacggagtggcacatggagccgtcgcggatgacgctgtaccggttcggcaacacgtcgagcagctcgctgtggtacgagctggcctacagcgaggccaagggccgcatcgggcggcgcgacagggtctggcagatcgccttcggctccggattcaagtgcaacagcgccgtctggagggctctgcgcacggtggcgccggaggccgaggagagcaacccgtgggcggacgagatcgaccgcttccccgtcgaggttcccagggtctccagggttggcaacgcatgatcttgtccgggctggcaaccttaattgattgggtgatcgccattgccatctcctggttcaatacccttgggcggccttggcaacgtgcatgattgggctgttgttttgagttgtagtggcaagcatctgtggtggggggcgcctaggataaactttaggtgattcgatgatcaggcgggagtggtgattggatggggaaagaaatccgcgtttccaggtgagtccgtt

SEQ ID NO: 841 - DNA, 1032 bp, Triticum aestivum
  Clone ID: PAT_TA_841
gcacggcaaagcttcctcaaggtcgtgtgggttactgggtttaactagcttggctcggccccttcctccgcgcaactccgacgatggcgcgcctcctcgttctcgccgtcacggccacggttctcatggctcaatccgggcagccggcgtctgctgcgcggacgtcgccggcggaggccttctggcgcgccgccctgcccgacgccaccatgccggacgccatcctcgagctcctgccccagggtgatcaccacgcatcaacggaacagggcgcgtacatgaatgcagagaccgacacaccggaaggcgcggtcgaggccgtggaggacaaggacccgccgccgcccatgaacttcaactacgactacgacgacgccttgccccggagcgaagccaccagcgccccctcccccgacgtcctactaaaccgcgctgccgtcgtcacgccgtcgtcgacggtgttcttcctcgaggacgcggtgcgcgtcggggagagcctgcccttccacaggatccatcgggccaccgccgccgccgaggcgtcggcagagcagccgctggagctgtacaccgtccgctccgtgagggcggtcgaggggtccagtttcgtcctgtgccggggagaagccggcgaaggggccgtgtacgggtgccgcgccaccggcccggcgagggcctacgtcctggccctggccggcgagcgcggggacgcggcgatgaccgcggttgccgtgtcccggtgggacccggagcacgccgccttccggctcctcggcgtgaagcccggcggcgcggcggtctgccacgccgtgccggacgcgcaggtcctgccggccatgaacgggaagagtcccgccgccaactaagtggcccctcgtgtctgtcgtgtccgaatctgtatgatggtgaactcgtgtctatgggtatagctgttgtattatctgttccttccacttccactgtatgttgctaagcactctatagagtgatgtatgactgttaaaaataaaggatgaatgtttgaatttgttt

SEQ ID NO: 842 - DNA, 1525 bp, Triticum aestivum
  unsure (1)..(1525): unsure at all n locations
  Clone ID: PAT_TA_842
tggcgtggtcgcggccgaggtgcaactgcctctggttctacgccaggctgccccttcccgggcaccaaaacacccggtcgggcccttggagctgaccgacccggctcccgggcaccccccgcccgtcggggaccatcaccggctttcaccagccacaaggatgccagaaaacgccactgtcgcagcgtattatggcgagcccggccatggggtgttgtaccggacgccctgacaacggctttgggcagatgcaggtccgaagttccgtgattgggcattcccaccaagcgtagccatcatttccttgtattgcggacataggcttttaaagatcgcatcgtatgctgttaatgcactaccgtggtctctccaaccgacagtgccttcatgggattgagattgtgaactcaccaaacttgtcggcagttcctgaggctgacatgaagaggtgggctgagcttacaggaagggaccttaatttctcagtaccggctgaagcgagtgactttgagtcatggagaaatcttccaagcactgattttgaacttgataggccacagccagcagcgtcaaagagcgtcgcacatacctctcataataataatcacaagaaggcactgaatggttcaggtctgaacctatctacaccaccgtcatcagacgatgggatggacctttcaccaaagtgccacaaacgccgcaaggacttctttggtcatggcgtagaagaggattgtgcgatggccaataattcctgttccgagagagagcaagaggtagaagtccacaccggtgagccgtcatggatgcacgacttcactggcgtggcaaagcacgcaagtgggcctgttactgctgccaagacgatatacgaggatgatgaaggctacctgatcatggtgagcatgctcttatccgatccacacagcgtgaaggtcacctggaggaacacgctgacgcacggcgtcgtgaagataacatgtgtgagcaccgcccgcatgcccttcatcaagaggcacgacaggaccttcaagctgaccgacccttcccctgagcactgccctcctggcgagttcgtgagggagatacctctggccacaaggatcccagagaacgccaagatcgaagcgtattacgacgagaccggtactggactggagatcatggtaccaaagcaccgggtcggaccggaggagcatgaagtccaggtttgcatgaggcccccgcatcttggcgacaatgatctcgttttatcataatagaacaggaaaaaaaagattttagcctcttactaggtcctccggtgtcatgccatgagacaccggaacatagcagcaacgctatcgtcatgtccaacttatttgtctcccttaggcggaaaattaccttctcccctgttaatcccctctgtactttctttctacacaggtgctacatcactacattggtggtgatccccttgactattcctttctgtgaaacatggcaaagctaatagtagtatatattncctgtnccctgtata

SEQ ID NO: 843 - DNA, 632 bp, Triticum aestivum
  Clone ID: PAT_TA_843
atggtttgcccttaattctgtatcacctgcaatagttgaagtgaaaggtgttcatcagtttgactggttgaccagagagaatgtcccagtactagaggctatagaaaaccaccgtggagtcagaaatcactatcatggagatcatggaacagtttccagtgcaagtgacaacccaagggtgcttgcttccaagctgcaggcccgaagccccaaatacatatccctgcttaaccatctgcgcatctatttgcctgagctctttccaagcctcaacaaggtggtcttccttgatgatgacattgttgttcagcgtgatttatctcctctttgggagattgatcttgaagggaaggttaatggcgctgtggagacatgcagaggtgaagataattgggtgatgtctaagcgcttcaggacatatttcaacttctctcaccctgttatagatcgaagtcttgacccagatgaatgtgcatgggcatatgggatgaatatctttgatctggaagcttggaggaagacaaatattagggatacataccatttctggttgaaggagaatctaaaagccggtcttactctctggaaattcggtactttaccacctgcgcttatagcatttcaggggtcat

SEQ ID NO: 844 - DNA, 819 bp, Triticum aestivum
  unsure (1)..(819): unsure at all n locations
  Clone ID: PAT_TA_844
acatatttggcacgttcattggtggctcggacacgacctcagtgacaattctatgggcgatggcggagctgacccggaatccccgacttctgaagagggcgcaagacgagatcagggctgtggtgggagttaacgagagggtgcgaccagatgatctggccaagctggtctacctcaagatggtggtgaaggagacccttagactgcacccaccagcgacgatgctactgccaagggaggccatgcgggacatccgaattgggggctatgacgtgttggccaagacgcggatctatgtgaacgtgtgggccattggtagggacccagcaagctggccagacgagccggaagagttcaaaccagagaggtttgagacgagcgagatagacttcaagggagggcatttcgagctaactccatttggcgccgggcggcggatatgccccgcactgtctatgagcacggccaccgtggagttcacgctggccaacctgctatatagcttcgagtgggcactccccgaggggatcgtggtgagcatgcaggaggaaggcaagcttatccccctcctaaagacaccgctcttgctggtgcccaccccataccagcacatctgagcacaacgaggcatggcatgacacacccgagagagatccggtcaaaattaatttgctcccatgtatggagtaaacatgcatgtaatcttgtaactcttatctactctgtacgtactaccagtctattaccttgcaatactgggtttttcttcacaagctcctcagatgtcattgacttcgaaattttgcatnatcctagtgc

SEQ ID NO: 845 - DNA, 998 bp, Triticum aestivum
  Clone ID: PAT_TA_845
gggcgatcatgcgccggctcaccgccggtccaaacgaggcctcccttccggcagccacacctcttgcctttggcagcaacagcgctggcaacaaggcatggcccggggtgttccagatatcgtccgccgagccgtcatagccgacgtacgcctcggacgagctcgagctcaccctcgggagctcaaggacctgttgagaaccacccttctgatgatgatgatgatgatgccaccagtgtctgtctcttcttcgcctggcgggtttatccttcctgcttacttgggtttcggtgtcatcttatacatgcgcgttgtttatttgtcgcaatggcaacaagggatcgcggggccttttgaaggtctgctgaagaggacgtccatcctctttcagggccctgggtctggtacttatattttacgctacattatgcaacttgttagcttatttcttctttttttttccttacttattaaaaaaatgtgtctcttcaaaacctgggcaaggaatgctggccaagacaccttgggacatgttgaagaaatggaatggcggcagatgattccgtcatcatgtaagcaaagcactacatgcatctgctgtggacattcatcctctttcaggggcctggtctggacttatattttagctacattatgaaacttgttagcttttttctttcttttcttcttacttcaaaaaaaaatatggaaagatggaaaaacggcaaggaacgctggcaggacacaccttggacatgtcgaaggaatggaatggcggaggccatttgtcatcagtaaggaaaggcagtagatgcaagtcctgtggccatctatcatgtgctcttgcaatgcaaacatgcttcagttgtccttgatatgacttgtcgctgcactctgtcataaagggtgtgcgttgtatgtggtggaccgttcattcattgattctttggtctttgctggttaaaaaaaaaaaaaaaaaaaaaaaaaaaaaaaaaaaa

SEQ ID NO: 846 - DNA, 403 bp, Triticum aestivum
  Clone ID: PAT_TA_846
cccaaccaagggcggctgcagggaggaggagaaaaaaccagcagacccccacgggattcgcctggatcaaacccagacccaaaccagagggatttctccagaggtcgatccgatccgcggcgcgtccggcggcggggtctctccttcgggatcgatcgtcgcggcccgcggcgggcgggttggtgagggcggagttggggttcgaattgggctgctgcggcgcggatttgggggcggaggcggctgcggcgggattcgcgtcgcggaggtcgttgcgctgcaccgcgccgcgcggcggtgcgggtttgtggagggcctcgcgccattgcatcgagggctcgcgtgcggcgtggacgagcccctggacgccgtcgccggagccaggtcggtccgaattgggcgg

SEQ ID NO: 847 - DNA, 642 bp, Triticum aestivum
  unsure (1)..(642): unsure at all n locations
  Clone ID: PAT_TA_847
gcctcctcgcctttgcgacccgcccgcggcgccccacggtggacatcatcagcagcgggggcctgcgcttcgccttagcgccctatggcggaatccggcggcagatgcgcaagatctgcatcatggagctgctcagcgcgcggcaggtgcgccggatcgactccatcaagcaagccgaggtcacacacctcatggagtcggtgctcaccgcgtcttccgcctcttcgtccgccatcatcgacatcggcaaggagctgtccaggctgacgaacaacatcatcgcgagggcggcgtttggcggtaagtgtcggcagcaggaggtgtacctccgagagctcgccgtgttggcttcgcacgtgggagggttcagcctggtggagctctaactgtcgtcgccgctcgggcggtggctgaccggcgactgccggcaaactagggggagccacgcccggatacaacgaatcctggcagatatcatccaagagcgcaaggagaagaaacaacataatgcctcggctgcggctgctgctactgctactcctactgaatatgaagctcctttggacgtgctcctggggcagcacgcaaaaaggcccctcagtttccctttaacaaacaggcaantggtacattgcggctcgg

SEQ ID NO: 848 - DNA, 413 bp, Triticum aestivum
  Clone ID: PAT_TA_848
gagttgcctggccctcgggtccaacggcggcgcggtgaatgggacgccgaaccggaggccgtcggtgcagcagcagaacggcgtgcgatcggcgagccgggacggccgcagggagagtgtcaggccatcggcgccggtgaactacgtggccatcgccaaggacgacgcggcttcgcaagcgtcttcgacctgacacgtatggctggtgccagtgtcggagaagtataactgtgcagtagtccggagattatagtgcttagcttagcttagctcagctaggtggagcaagttggatgtgatatagtcatggcgggagtcgcctttgtaactggatggatcatggatgttcgtctcgtgttgtagatcgaatgcagctggtgctatgaataaccgacacttttacaaaaaaaaaa

SEQ ID NO: 849 - DNA, 794 bp, Triticum aestivum
  Clone ID: PAT_TA_849
gccggccgggccgggctcctgccaggaaaaaaaaacacaagcctgttcctacgatacgatctccccagatcccctccccgtccccgtccccgattcgattcgattcgattccccgcatcggccgctcagccgccggtaggatcggagccgggggagcgcgatggccgcgccgccggctagggcccgcgccgactacgactacctcatcaagctcctcctcatcggcgacagcggtgttggcaagagttgcctcctcctacggttctctgatggctccttcactactagttttattactacaataggtattgacttcaagataagaacaattgaactggatggcaagcgcattaagttgcaaatttgggatacagccggtcaagagcgattcaggactatcacgacagcatactaccggggagccatgggaatcttgcttgtttatgatgtcacggatgagtcatctttcaacaacatacggaactggatacgcaacattgagcaacatgcctctgataatgtgaacaaaattttgataggcaacaaggctgatatggatgagagtaaaagggctgtttctactgcaaagggacaagcattagcggatgaatatggcatccagttctttgaaactagtgccaagacaaacctcaatgtggagcaagttttcttttccattgcccgagatattaagcagaggcttgctgagactgattccaagcccgaggaccggacgatcaagattaacaagacagaaggttctgagaatccagaatctcagaaatctgcctgct

SEQ ID NO: 850 - DNA, 1121 bp, Triticum aestivum
  unsure (1)..(1121): unsure at all n locations
  Clone ID: PAT_TA_850
ccctctctctctctccgtccctcattcgatcccattccccgcatcggccgataagcccattccggcgctaccaccaccccacatccctccccgtccctgttcctgactcgacccgatccgcctccccgcctcgccagctcagccgccggtcgccggttaggatcgggaccgcgggagcccgatcgccgcgccgcgcccgcgccgactacgactacctcatcaagctcctcctcatcggcgacagcggtgttggcaagagttgcctcctcctacggttctctgatggctccttcactactagttttattactacaataggtattgacttcaagataagaacaattgaactggattggcaagcgcattaagttgcaaatttgggaatacagccggtaaagagtcaagagcggtctagcacgacaacgaaagcataggaccggggaggcatcgggatcttgcttgtttatgacgtcacggacgagtcatctttcaacaacatacggaactggatacgcaacattgagcaacatgcctcgtgataatgtgaacaaaattttgataggcaacaaggactgatatggatgagagtaaaagggctgtttctactgcaaagggacaagcactagcggatgaatatggcatccagttctttgaaactagtgccaagacaaacctcaatgtggagcaagttttcttttccattgcccgagatattaagcagaggcttgctgagactgattccaagcccgaggaccagacgatcaagattaacaagacagaaggttctgagaatccagaatctcagaaatctgcttgctgtggctcatgaggaatacgtggacttctaccatgggctgttttaactttatctgtttattactgtcagcttgttattataggaactgtaagacttaaggagatgactatgttgtggttgttgtgttaccttctatattctttgcagcagcaactattacttttaatgtagtttttgtgatttctaggggtgattgcatgttgtattgccatcgtgagaaccatccacttgctgctgatgtaactgcatttcagtttttcaatcggttgattgctacatctgctgcnatgtaactgcatttcag

SEQ ID NO: 851 - DNA, 848 bp, Triticum aestivum
  Clone ID: PAT_TA_851
cctcctcctcccggtaggggccgcccctcctcctcctcctttcgatcggcgctgccccggctccccatgatgagccatcaccagatctggtcagccacaagctcgtggatccagccatccacaggcttcgccgagccactatcttcggatccatggctggccacgcagccaatgaggacgcggcctcgatctggagtgcctccaccgccccctaccgcagccccggtaggacaccaccacctgcccccacaacgccgctcaactcccggcaccgccccgcgatgcaccaccatccagcaaccaccccccgaccgccggcggagatccgggcgcgccgccccaaggcgccccgtgcggctgctggcgtggatccgggcgtgccgcccccatccaccccgcgcgcatgccggtgcagatccgcccccgtcgccccgccgtggcctacccaaccgcacggtcctccccctcgctccccgtttcctcaccgccgccaagatctagctgctctgctagcctacagagcgcggcgaggtccattaacatgcctggcatgcagctcgggcaagcatgatgtgcagctcccccagcgttcgcttgcagttcgccggctaattgtgcacgtcctggggttcatagatggcgcatgtgcacctcggaaacagcctccgtgttgttcacttgtggatgcatcatgaatgcatttttttttgttcttcatatttttggcagggaggttagcttgggtccccaattctccagtggttctgaactccagcgaccacaacgtgggtgtggtacgtgccgctcgcaccagcttatcatctatgcatgcgaggttcatgcaccag

SEQ ID NO: 852 - DNA, 1373 bp, Triticum aestivum
  Clone ID: PAT_TA_852
gttcttgattgttagtggcctactatattttttttcttttattattttattttgcattatcacaatgataagggaaacactttcacacaacccgtgatcgcacctaatgatgcgtataacctatgcaaacaaaaacgtaagcaagtatactgcgcgcacgcaaattcaaaagctccacccgcaagccggcatgcatgggtcaagctgtggggtaaaagggcgaggtggcgaggccgcaggtgcccgtgggccagaaaacgtccttggcgaggcagatgtatccctggtcgccccagtcgttgctccacgagttcttggcgatccagaacttctcaccgaactcctcgcagtagccgacaatggtgacggcgtggttgaccgtcgcggcgtcggcggagcaggggccccggaagatgccgcctgagtagaactggaactcccacgtgactggcggcgatgtacaccgtcacgggactggcgcgccacggccagcgccagctgccgctagtcgtttggcggaagcctggtgattgacttgaagcttgtccacgtctcgaccgccaggtattgcccgtcgcacgtgcccttgaagccgctgtacgggtaccccttcgtctgaccgtgatgccaccgcgggaggcgacgaggcccagggcagtgtcagtgcggccgccgctgcagccgctgctgccggtgtcgcagtccacaagctgctgctccgacagcgacaccagctcgccggtcctgatcttgttcatgccctcgatggccgccaccgccgcgaatgcccagcatgacaagcaagagccctgaaacttgacgccggtgacggcgccgctcgagcgccagtcaacgcagcacggcttccaggagtcgtaggggagcggggagggaggctctggggtgaagacggagttgttgaacccggtgaactgctccgcgacctcgctggggttgaggtcgccgaatctgttcatgccgaccctgaccgtggtgacggtctggggcccgaacccgccgacgacggcgttgacggtagtctggctggcgaaagcgccgatggagttggtgttcgtcttgaatacctggaaccgcttctccttctcctcgggggtcgggtagcgcttcgagtacttggtttgccacctcgtccacctggacctcacctcggattccggcagctcccacgatggcggcggcggcggggccgccgcggtcagcgatgtctgcaggaggcaggcgatgcccaagagtaggacaaggcaagccatggaagaagtcattttggttgattaacttggactgtgtggaaatccatgcaccggagctaatgtttatataggcgctttggtgatgcgtgtgggcctcgtgcc

SEQ ID NO: 853 - DNA, 891 bp, Triticum aestivum
  unsure (1)..(891): unsure at all n locations
  Clone ID: PAT_TA_853
gnaacgaaacagcgtgcgataacgaaactcgcagagaggacggacatggcggcgaggagcgagaacgagtcggacggcgacgtgggcaccaaccccgccgaggggggctcgtccctgtccctgccgcctctagctgccggtccagccgtatgcgtcctccggtccgccggggacttcgccggcggcgccttcgtcggatctatctttggatatggacaaggtttgctatctaagaagggcttgaagggctcactcgggaatgcagggtcttctgccaaaagttttgcagttctttctggcgtccagagtttggttttgtgcttgttgaggaagctgcgtgggaaagatgatatcatcaattccggcattgctggttgttgcacaggtcttgctttgagttttccaggtacaccacaagcgctgcttcagaactgcgccaccttcgcagcattctcatgcatcatggaggggctcaacaagcagcagaccgcgatggcacacaccctcactgggaacgccttgaccttcgcgcacaacaatggcgcgggcgtcctcccccccttcactctccccccaatcctcgacgcttccgatgcttttgcctcatgctgccaggccttggtcgccaagcctaagaagcactagacagcatcattaggagggagagtgggatatgctcaggaaacctagctagctcctaacgttatgtaaattttgcttttggataatgtcgaaaatttagatcgtttgcttttgtcagccgggcgttttgttgtcgccgcgtttcgtggcgtacgggcttgctttgttgatgatatgaaggatagattttgttgacccggaagataagatgtggaaaattttgcttgatggctgtatctgctttgttna

SEQ ID NO: 854 - DNA, 1007 bp, Triticum aestivum
  unsure (1)..(1007): unsure at all n locations
  Clone ID: PAT_TA_854
atcatcgaaccctccttcccttccgcccaacctacccccgcccccgcggcgcgcggccgaggcctccattcctcatggaagccgctgccgctgccgctgcgagccccgatagctcgtcgctggaagccgtggccaccgtcttccggtcccgcgtcaacgagctccaggacctcgcccttgcccgcaacatgtacccggaacggcggtgaccgacctcaccgccgtggacacgtcggtgacggccatggaggcacaggtgcaggccatccgccgccgcctgcaggaggagctcgacgccatcccgaaggccaaggtatcgttgccagttctcgtgatctattggacatagctgctgaggcagtgaaggggaagcacttcctggaagctgattaaaggggcctgggctaaaacttgatcacacaggcaaagctatccttaccgtccttcgtcatcttggtcgcatccatgaaacccggattgggcatcatcgggtcttcatactttcaaaacaatgctgactgaaggggttgttataagcattatgatttgatgtggtatatggccggggccacacattcttgcagcctgtttgttacggcttagtttggtttgcaattgtagtagccttggtgtaatttccgacgaatgattgattcagttgtaatacgttcgtttcttcattttttttatgggagtttgttccttctcctttgtacaaagacatgcaaagcttttgcgtgagaaactcccctggccgaacatgggctgtcggatcgaacatggatgctacatattgcagtggagggatctcaggcccataatatacactagaggctaactcgcacactgctgcgatctttttccgttgccaatttctctgtttctctgagaagccggtgtagtaaatagcaatcatgtaaagggagtacttgttaaagtggggtgtgtacctatctcttgttcataccctcacagtgggggatgagaggcgcanaaatgtggatcga

SEQ ID NO: 855 - DNA, 1253 bp, Triticum aestivum
  Clone ID: PAT_TA_855
ccgagcgctccctccttccctcccgcccaacctacccccgcccccgcggcgcgcggctgaggcctccattcctcatggaagccgcagccgcggccgctgcgagccccgatagctcgtcgctggaagccgtggccaccgtcttccggtcccgcgtcaacgagctccaggacctcgcccttgcccgcaacatgtacccggcaacggcggtgaccgacctcaccgccgtggacacgtcggtgacggccatggaggcacaggtgcaggccatccgccgccgcctgcaggaggagctcgacgccatcccgaaggccaagaaactagtggagaagtccttgaagcaacagcagaagttgcagcatatgcttgcaaacatgccacctgggatgcgtgaggatatcgttgctactcctctggaacaaagcttgatgttgcccgagtgctttaattttaacacagctgttccagaatttctggactctgattttaagattaaggaagagccagttgcagctcccaaaaaggggaaaggttcagcacctcgttggtatatatccactgaggagcttgattcattgtcatcgtacatgagggggaggctaacattggagaaggttaacatttcgataaacgaggtggctacatatgcagatgctaatgctcatcttgttgcatgtcctaagaaaaagttatcagaagacacatgggaaaaagctttggaactaagggacatagctgccactgaggcagtgaaggggaagcatttcttcctggaagctgatataaaggggcctgggctaaaacttgatcacacaggcaaagctatccttaccgtccttcgccatcttggccgcgtccatgaaacccggattgggcatcatcgggtcttcatactttcaaaacaatgctgaatgaaggggttgttataagcattaagatttgatgtggtatatggccggggccacacattcttgcagcctgtttgttacggcttagtttggtttgcaattgtagtagccttggtgtaatttccgacgaatgattgattcagttgtaatacgtttgtttcttcatttttttatgggagtttgttccttctcctttgtacaaggacatgctaagcttttgcgtgtttttagacaacaaggtcaacaacccccctaaaagaaactacactggctgaacatgattctgggctgtcggatcgaacatggatgctacatattgcagtggaaggatctcaagcttataatata

SEQ ID NO: 856 - DNA, 940 bp, Triticum aestivum
  unsure (1)..(940): unsure at all n locations
  Clone ID: PAT_TA_856
tcggcacgaggcttgatcttcggaaaagctcatcattgcaatggatgctgcatttgggatggaatatctgcactcgaaaagcatagtccattttgatttgaaatgcgacaatttacttgttaatttgagagatcctcagaggccaatctgcaaggttggagactttggattatcgagaattaagcgcaacactttggtttctggtggtgtacggggcaccccccacgcgtccgcaccggagctgttgaacggtagcagcagcaaagtgtctgagaaggtggacgtgttctctttcgggatagcactatgggaaatcttgaccggtgaggaaccatacgcaaatatgcattgcggcgctatcatagggggtattgtcaacaactctctccggcctccagtacctgaaacctgtgaccccgaatggcgaatactgatggagcaatgttggtcggccaatcccgatatccgcccctcgttcactgaggtcacagataggttacgagccatgtcagcgacgcttcagtcaagggcacaggccccaggaagctgatgaatcttacatgccatcaaccagcaaaagattgccggctaatccccacgggctcctttttgtgcatagacgagtatatagcatacctgtatttatggtcacactgtattctgtttgatgtatctatgcttttttttttgactattttatagggtttctgaagtatgtatgtatctgagttaacatgtagtgcaggcttttctagcctcggtcgcgtttccagcaatttttttgtgtgtagtttgcgaagcttgtgatggtctgccagaccactcaagcttctatttttgggcctttggttgtaaaagtatgagcattgtaattatatagcagatgaactggcaaaaaccatactgccacttttnaacctttataaatttagaaataaag

SEQ ID NO: 857 - DNA, 847 bp, Triticum aestivum
  Clone ID: PAT_TA_857
aattcaaaaaaaaaaaaaaaaaaaaaccacggacatttcgatccatccatcagtttgatcaattcatccggctgctgtcgtgagctagccagccgtctcgatcgttccggacctagctagctagctcctgcacacccgtacgtacggccggtagcagtacagatctccatcgatccacgcacgcacacgtacgcagctgagcttgctcgacctagctcgatcaatggcctcaaccggagtttcgcgtaggtcgtccatcatggcgtcccggctgagcgcgtcagcggaggccatgcgcgcgagcgagggggggaagcagcgacacgccgtggtggcgcggcgggtggagtacgacgaggagtctctggccggtgaaccccaatacgacgtgttcatcaaccaccgcggcgtggacacgaagcggacggtggcgcgcctgctctacgaccgcctcgcgcagagcggcatccgcggcttcctggacaacatgtcgatgcggccgggcgaccggctcagggagacgatcagcgccggaatcagcgaatgcagcgtcgccgtggccatcttctccccgagctacttcgactcggagtactgcctgtgggagctcgccacgctcgtagagtcacgcaagaccatcatccccatcttctacaacatcaagccctccgacctcgtgctccccgaggccctcgccgcctccgacgactacctcccgcaagacgtcgagcgctacaagtacgcgctccgcgaggccaagaacaccgtcggcctcacctacgactcggccacaggggacatagccgagctggtgtcagcggcagccgacgcggtgctgtacacatgg

SEQ ID NO: 858 - DNA, 409 bp, Triticum aestivum
  Clone ID: PAT_TA_858
cccacgcgtccgcccacgcgtccgcccacgcgtccgcccacgcgtccgatgactacctcatcttcaactataacccaaagatgcacaatgttttggaggttgccacatccgagtacaaggcgtgcaacatcagcgccgccccctctagaaattttacctcgggccatgatcgtgtccagctctttggtgttgtggcctcctacatatgcggcactcccggacactgcggtaggggtataaagatccacatgcccatagaagataaggaatgatatttagattatcaaaaatatgttttttagagtaatcaaaaatatgtttgtgggtacatgtatgatggaagaaataactctgatatgacttctttgctaaaaaaaaaaaaaaaaaaaaaaaaaaaaaactcgtgccg

SEQ ID NO: 859 - DNA, 526 bp, Triticum aestivum
  Clone ID: PAT_TA_859
cacggtgaacatctaccaagctgcttgcccagtctccccgagtctgtctctccaaacgccaaagccatcaagactcccatccttctgcttgcagaaaaccttgttgtcagcaatcgatttcatttcggcaacaggacatgatgatcaagtgcaataacacaggctttctgtagataccttcttggtaaatatggtccagctatttgttgattgtttagcgtttatacagccagcgatggatgagtcggtgtcagcgagctatagccttctgcagcctggttgaggtgaatgatgataataggatggtttcgtgtgctgcttcatctccgttgcgcatctgtaaaagtttgtttaggggtttgccttgctttgctatgctttaggtagtgtagggtttctccttccttctcttttgacttgtgtcaggagatggcagtttgtaagctggaagaggcatttttttagtgctctagaaggcagattatttttttaggcttagcttaatatgttgaaagtattttagctc

SEQ ID NO: 860 - DNA, 1105 bp, Triticum aestivum
  unsure (1)..(1105): unsure at all n locations
  Clone ID: PAT_TA_860
cccttacacagtagttctctttgatgagatcgaaaaggcgcatccagacgtcttcaacatgatgcttcaaatactggaagatggaagattgactgacagcaaggggcggactgttgatttcaagaatacactgttgatcatgacatctaatgttggaagcagtgtcattgagaagggaggccgcaagatcggatttgaccttgactatgatgagaaggacaccagctacaacaggattaagagcctggtgactgaggagctaaagcagtacttccggcctgagttcttgaacagattggatgagatgattgttttccgccagctgacaaagctggaggtgaaggaaattgcagacattatgctgaaagaagtgtttgacaggctgaaggtaaaggaaatcgaccttcaagtgactgaaagattcagagatagggtggtggatgacggctacaacccaagctacggtgccaggccactgcggcgcgctatcatgaggctgttggaagacagcctggcagaaaagatgctggctggcgaggtcaaagaaggtgattccgctatcgtagatgttgattcagaaggcaaagttatagttctcaatggtggcagcggtgtcctggagccgctgacacctattttgagcacctaatcatacggagcacatgattacggaacccattgtttcagcacaagctgtggcgtggagctgacaccaattctctttcattaggtggtgttgtgtcgttagatattgcttgcaagcgaggcactagaagattccgtatagctcaccggcaggcctagattttctgtttttgcttttgaaaggaatctggaggctttatttttgggatgccgatatctgccacacgtgtggcacgaggacccccagaccaaacgcccgtccccgtcagtacacattatgccatgtcaccgcatgcatgtataaatgacgaaactgatggtgtcagtgaaaatcttttggaatgacaaaactaatgatgtcaatgggaatcttttgggtttttatttttttatcttttaatgaaaagtccgattgaaaaccatntttannnnnnnnnnnnnnnnnnnnnnnnnnnnnnnn

SEQ ID NO: 861 - DNA, 1062 bp, Triticum aestivum
  unsure (1)..(1062): unsure at all n locations
  Clone ID: PAT_TA_861
ccgccgcgcccatccctcataaagccccgcggtcggtggctcgctggaatccgatccgattccgttcccattcacactccaattccagccggagcggagcggccgggcgccatggcggcggcacgcggcggcggatcggcggcgagggtcggcgactgggacgtcgagctggggcccggctgggactggcgctccatcccgcagctgctctcctccgcctgcatcttcatctgctccggaggctgttttggatgctgtgagaaggccgcaaaacacgtaggcgatctttccaagagcttaatggcccatgcccagaatcccacggtggcagaggaattttggagtacgaccaccatcgaggttgatccggcagacctacgagcaccatacaacacatcctcttgggaccttgatctgcatggagtgggaagcagccataacctgggcgactctgctaatcatggtttttctctttggcaacaaactagggatgagtggactgagaatacaaggttaaggcaagaacctgtggtgaagcagatccaggaaccagtgttgagttggaatgcagcgtatgaaagtttgcttggatcaaataaaccattccctcagcccatccctctacatgagatggttgatttcctcgtggacatctgggagcaagagggactgtatgactagcacagatgtgttcggcgagaataacatagctgtagttctgatgtggtaacgagggtgtggcctgtcatactggtttttttgtgcatggaggcctgttgtgcttgttgaatacaatcctgtgggctgtggcggttgtattggtagaaagaacggtccagatttaatcaccttgtcgaatttgtcaaagaaagcagctggagagaaagatgcgtgacagcgatttgtgaacataaatgtcatctgtattgattgagaaatgagaagaagaaattagcttttaaaaaaaaagaaaaaaaaaaatgtcnggtgaaananngnnaatttgngggaaacaaanaaaaagggcannnnnngnnatttgggatgggaaaaaantagant

SEQ ID NO: 862 - DNA, 621 bp, Triticum aestivum
  Clone ID: PAT_TA_862
gaggcagcgggccccaagtagccggcgccggcgcagccgccggcaccgaagcggcggaagatcgaaccgtctcggaggagcagacctccttctcaaactgctattgataaggacaaagtggcggcatcatccaattcatcggtttcaggtacaccgctagcaagagtggatctcaacaaagttagagaggcaaagagatttgctgtccttcaagcacagcacgagggatgcctgggaagcttcaaaagctttgattctctgtttggaaattatcttgttcctgttaccccaagtgatgacttctttgagcaaattgcaaaggagtgacccaacaaatttgacagccgtgaagaggtaggatgatgatcctgctctatcctgctacatgcctcgacattattcctgctagatttactaacagaaaaatagtgaagatctcaagacaaaatgtattttatttggaaattgaggttttgtgcttcaaatgagaaactgattttcatgcatgcttgtagatcttcaaatgagaaaccgattttcatgcatgcctgtagatacccctaccttgtaagatgccccacagtgtctgaacgttaggctgctccttttgcaaaaaaaaaa

SEQ ID NO: 863 - DNA, 1258 bp, Triticum aestivum
  unsure (1)..(1258): unsure at all n locations
  Clone ID: PAT_TA_863
cttctcacatttcgtgaccaacctgcctgcatttcaccagattttggtcttcgtctgcgtgaagtccgtgccagtgccctatgttccagctgatgagcggtacctcatcgggcgcatcggccccaggcagtaccggatgtacaggtgcattgtgagatacggttataaggatgtccagaaagacgatgagaacttcgagaaccacctggtgatgagcatcgccaagttcatccaaatggaagccgaggaagccgcctcttctggaagctacgagtcatcgaacgagggaagaattcatacacaccaccgacacaaccgcgaaccggtctgatcatgagagactccaatgaaggcacctcctttaccaggctgcagcaagtccgagaccctccagagcctgcagtccatctacgagcaggagtcgggcggcctgagccgccgcagggtccgtttccagatcgccgaggaggagcagatcaacccgcaggtgagggacgagctgtcggacctcctggaggccaaggaggccggcgtggcgtacatcatcggccactcctacgtcaaggcgaggaagaactccaacttcctgaagtcgtttgcgatcgactacgcctactcattcctccgcaagaactgcaggggcccgtcggtgacgctgcatataccccacatcagcctcatcgaggttggcatgatctactatgtctagtgtaattttttgtctggtctttcggatgcctgtcagtgtcaccgagctttcaggcgatgtaaagatgggcggtggccggccgaacaggctaaagctgccatcgttctgaattccggggctttggtgaacatgtaaatacagcatgtttcagattttcagttcaccataggcttcatctcgttcgccatcgactacgcctactcgttcctccgcaagaactgcaggggcccgtcggtgacgctgcacataccccacatcagcctcatcgaggtcggcatgatctactacgtctagtgtaatttttcgtctggtcttttggatgcctgtcagtgtcaccgagctttcaggcgatgtaaagatgggcggtggccggctgaacaggctaagctgccatcgttctgaattccggggcttcggtgaacatgtaaatacacgacgtttcaggctttcagttcatgatagttaacgtcattactttgatccaacaagctacaaagttaaagctttcaattcaatgatantaacgtcattacttnnaaaaaaaaaaaa

SEQ ID NO: 864 - DNA, 1454 bp, Triticum aestivum
  unsure (1)..(1454): unsure at all n locations
  Clone ID: PAT_TA_864
tctgaacaggtggtagaattggattttctttatcctagtgaaggtattcaccggcgatgggagaatggatatagaataacttctacagcagccactggtgatcaagctgcttttatattgagcattcccaaaagaaaattgacggacgagacacaagaaactcttagaacatccactttcccaagcaaccatgtgaaggagaaatgggccaaaaatctttcatgaaactctatatgctatacaatgtagcagaagcccgacttcgcagtcacatagagaaagggaatgaagatggattgtttattagttcggtagcatctacagcaaagctttgggcccttattatggacgctggaactgggttcacatcccaagtttacgaactttcacaaatattccttcataaggactggattatggagcagtgggaaaataactactacatcagtgccatagcaggagcaacaaatggaagttccttggtgttggtggtggtgcaatatgcttttgctccggtcccgttgctgctttacagagtatgactcacggcctcctcctcttcgagagactgtaaactgtgagtgcatgttacataaatggctacagcagggacccgctggggtgtagtaatgtcaaggaactctggatattctgaacaggtggtagaattggattttctttatcctagtgaaggtattcaccggcgatgggagaatggatatagaataacttctacagcagccactggtgatcaagctgcttttatattgagcattcccaaaagaaaattgtcggacgagacacaagaaactcttagaacatccactttcccaagcaaccatgtgaaggagaaatgggccaagaatctttacattgcctctatatgctatggacggacagtgtcgtgagacttgcagtcacaccaactcagtcagggctgagcatattaaaatgagttgacatcgaaaaccacagcaaatttagttgctgctgtgttactctgtatgtgtaggtaaattgcgtagatgaaccttacatcatggccagagcaggggcgctccagaaagaactgggatgaaggtggaccacagctagccaataagaagatggaagaggatgcgtgatccggctggtggtgctgcagcatggttttgcttcggtccagctgctgctttacagagtatgaatggcggccttcgcctctttggaggactataacctgtgagagcccgttgtgtatatagctctatcatgtccttcattttgtaagtggaaacaagttccatattctcagatagactggaagtgtctaaattattatgtgaggtgaactcatgaattcggtgtatcgattccattattaaaaaaaaaaaaaaaggcccctagagctcattgcattgatgacttcttgaattcctttaaagtgtaaaaaattagattttttnacacactna

SEQ ID NO: 865 - DNA, 1626 bp, Triticum aestivum
  Clone ID: PAT_TA_865
cgcccagcattcccgcctcccgctcgcgtcgtccgcggcggcccaccgccgcccccaccaccccgagcccgcgcaccccaccggacccaggccgactcgcgtcggcccgaggggtccccgatccccaacccccaggcacagaccccggagaggagcaaccaacgcccggctcgcgtcggggattggagctcccgccgaccagccatggttgagtcggaggtcgacgcatcggcggcagacacgggcacggccacggccagggcctcggcggcggtgctcaccgccgccgctgtcgctggcaagggggcctcgccggcggaagctccaggcggacgagcgatccgccatgtctcggttgaatcggaggtcgacgcatcggcggcagagaccgccacgtcgcacgcctcggcggcggtgctcaccgcgccgctgtcgctggaagggggcctcgcggcggagctccagcaggccatccttgggcagagggggctccgccacttcgggaacgtcaggccgggcgccgatctctcgcacttccagctgcctgctacgttcaacctgccaaaatcgcagctccagttgtacggagaaatagtctactgcgacggagacgactacctgagcagatgcggcaaaggcaaggacagcctcgagcgctttacggcggtcgtcgcatggagcatctcgacgacgaggccgcccatcttcggtttcgctccttacaacccggtcctcggagagacgcaccatgtctccagagggtcactccatgtccttcttgagcaggtgtgtcataaacccccggtctctgcacttcacgctaccgatgatggcgggaacgtggagcttgtctggagtcaacacccagtgccgaaatttaatggtgctagcatagaggcaacggtgcacggcaagaggcaagtcaggcttccaaagttcaacgagacatacgagatgggctgtccaaaccttctcatcaggctgcttcctgggccctccgtcgagtggtctggcaccgtcaggatcgtctgcaaggactccgggctcgaggcagaattgagctaccacagaagcaactccttcatgggaatgggaggtgacgggaggtgcgttaagggcaaggtgttccattcatcgagcccgcaggacaccgtcttcgagatcgatggctactgggataggactgtttcgctcaaggatgttgagagtggggaggtcttggttctctacgacgcgaacctctccatcgcgaacctcgtcacaccggaggttaaagacgaagagggcttgtcatctaccgagtcggcggtcgtctggagcgaagtcagcgaggctatcctggcaaaggactgggagaaggctagcgaggcgaagcggaaagtcgagggcacggctaggagccttgagaaggagaggaatgagaagggagaggtgtggatgcccaagcacttctcattgtcccaggacaaggatgggaactgggactgctgtccattagagaaatcagtgcgtccagctcctatcgttgtaccttctccttcttcatgacactacattacatgtaataacaatgttaaatcatataatcaagctgaccattcttttttaaaaaaaaaaaaaaaaaaa

SEQ ID NO: 866 - DNA, 751 bp, Triticum aestivum
  Clone ID: PAT_TA_866
cccacgcgtccgggcagccaaacgcgagatccacatatactcccacaatacgcgaacgcgaagccatcgatcggtgctgatagatggcgcacgggcaggagtcgtcgacgcaggccgccgcagcgccagcgctgtgcgcgaacggctgcgggttctacgggagcgcggcggccaagaacatgtgctccaagtgctacctagagcacctcaaggccaccgatacggccacccccgccgtcgaggggaagacgaagatcaaggccgacgtggccaacctcgtctccaacttcaagacgtcgctgaccctgcaggactccggcgctgccgctgccgccgaagcaccggcggccgaagcaccagcgaagaaggcggcgccgaccaggtgcatggcgtgcaagaagaaggtcgggctgctggggttcgcgtgccgctgcggtggcaccttctgctcgctgcaccgctacgtggacgggcacgcgtgcgatttcgactacaagaaggtcgaccgggagaagatcgcccagcagaaccctctgatcgcgccgtccaagatcgacaagatttgaaggcagaagggagttcaaaacatgtactacagagttttttctaggttcatgtacatagctactctatcttatctttcgatcactagcgtacgcacttgctgcgcattggacgcgatcttacttatccttagtgacctattacatggtaccatcttgttattccattaaaacataaaaaaagaaat

SEQ ID NO: 867 - DNA, 1061 bp, Triticum aestivum
  Clone ID: PAT_TA_867
gggaacgcgcaggccttcaacctcacagcactgcgcaagctcaacgacgtgaagagcaccgatggaggcaccacactgctccactttgtcatcgaggaggttgtgcgcgcagaggggaaacgccttgccgtcaaccgcaactacaccatccgccgctctggtagcctcgccaagagcagcgtcgatggcggaatttcagcagctggctccgctggccaggggccatcacgcgaggacaggcagaatgagtacttgaacctaggattgcccattgttggaggtctcagcagtgagtttgccaatgtgaagaaggctgcaactgtggactacgatgtgactgccaatgaatgcacaatcttaggcaaccgactcgcgggcatcaagaagctcctggagacctgcggggacgatggattctcaagagggttgagaggctttgtcaatgctgcggagcaagagctgaaggcactgagtggagtgcaggagaaggtgcttgatctggttcagcggacgacggagtactaccatgcaggtgctaccaaggacaggaacgcgcatcccctccagttgttcgtcattgtgagggatttcctggggatggtggaccaggcatgtgtggacatcaagagaagactgcagcagcaaaagaagccaacacccccgtcatcacagccaacaacggcggcggctgctaaggggccagctgaagccgctaagggggcagctgatggtgctaaggcggtggctggtggtgcggcggcagcaccaccggctcacaaaccgccaccagaagaagcagatagcaaaaggaagagggtcatgccaagattcccaaacttgccagcgcactttatgaaggacggcgcagactctgattcaagtagtgatgaggaatagaatgtatggggaggtgtaaatggagattgtttgcattggcttgaattggttgttttggaggtttaggttagctgcagactgtacataatgaaattgtttgtgttggttcttttgtgcaggtgtttacatgagatgcatggggttgctgtggccgcgggggcgtg

SEQ ID NO: 868 - DNA, 570 bp, Triticum aestivum
  Clone ID: PAT_TA_868
cttctcacggacgccgtccatgatgtaattattaagttgttccgttaattaatttctccaattgttttcatggaagcgaagtgcatatatttgttctcgcggacgccgtccatgatggctttgatatgaacgcgagaccccttcagaaggtgaactacagagatatcagttttttcagccctgatgatcaccatgaacgttattatgcagccgctgatcattaattagctgaagacttcagccagccacagggatagacagcatgcgtgttaatttgttggcaacgacgaagaaaagcgatgccaaggaaaaatttgcaacgacgatgattctgcaccaagcggggatgtttgttaattccataataaaattgaagtcacggacatgtttttggtgttgttttcaatacctggacaacaagactccaatctttgtagaccatcttatttgtgttttccttctttatatttcaataaaaagcgcatctcggcgacttacttcttcaatcattggacatctgattcaatctagtgtgccatcttattacatagtctagtgtgccattatatt

SEQ ID NO: 869 - DNA, 788 bp, Triticum aestivum
  unsure (1)..(788): unsure at all n locations
  Clone ID: PAT_TA_869
ttccattccaccttcccacccatcgccctgcctgcctacctcttccctctctccctcgtccacgcctccggtcgttccccttcttccctctgctgtccactcaccggacgccatgacggaggacgccgagggatgtgttgctgtggcggtggccgaggcggcgggcatcatctgctcgctccgcgcggccgacctcgccgggtggacgccgccctggaaggccagcgggccgccgtcgtccgaagccgcggcgaaggaggagacggcctggccggcggttgcgcgggggaagcggacgcggtcgtcgcgctctggctccgcggccaacaagaacaaggggcgatgggcccgcggcagccccgcgtctccgctcgactacagcggcggctccggctccggcgcgtccaccagcggcggcgaggacggcgccttctgctcgccgccggcgacggtcgccctcgcccgcgggcacgccgtggtcacacccaccgccgccccagcttcttcctgcctggccaaggttggctctgcgggaggagcacggcgcccattgatcctgccggtgccgccgctgccccgcatcgccggccagaggtcaggggaagaagatgaggnctccggaggtgaagcagctggtgctgtccctgtcggcggagaacgtcggccttcgccaggagatggagtcgctgcagagggcctgcacggggctgtccaaggagaacggcaggctagagacaaggctggagcattcatcctcctcaagcaagcggagaagacccggtgcaaaa

SEQ ID NO: 870 - DNA, 919 bp, Triticum aestivum
  Clone ID: PAT_TA_870
ctgggccctcgccctcctcgtcggcggcgtcttcgcagccgccgccgtctctgctcgcggaatggaactcctacgccgccgcccgctccgccggggaggacgtcggcggaggattcgggatcgacatcgaggccgccgtccgctccgccaacgaccgcgtcaccggcaccttcggcgtggtatctaaaggagttagagggttccctggcagcttccagtcctcaacaagcagtgttccatctggcaaatctctcatgtatttcggtctttttcttgccagcggcattttcctagttttcatcgcgttcacaatattcctgccagtcatggtaataatgcctcaaaagtttgcaatctgtttcactatgggatgtgccttcatcattggatctttctttgcattgaaagggcccaagaatcagctctatcatatgatttccagagagaggttacctttcaccattggatttgttggcagcatgtttgctaccatctatgtgtcaatggtgctccatagctacatactttctgttctcttctcttgtcttcagatccttgcgctagtatactatgccatctcatacttccctggtggatctgctggaatgaagtttctgtcatctacccttgtggcctcagtgttgagatgcttcgggcgatgagctcacccgttagttgctctcacccatctgtctcagcctgtgtttcagctcagtaacattttttggcttttgctttgacatggagagagtgtgtcaaagatgaccttggagcttgtgttcacagatatacatgcatgtccaacttaccgatagtattactgattccatggaaactctgctcgatgagatgatttgttctttatggagacgtgtggaatcgaaatttaacaaacagaaagatagtttgtgaatttagg

SEQ ID NO: 871 - DNA, 943 bp, Triticum aestivum
  Clone ID: PAT_TA_871
gcccaccgcaacctccttacccccccgccgccatggcctcggcctcccttccccgaccgccaagacgccggcgcggcgcctgctccccgtcaccgtcagggccatggcgccgcccaaccccagcaaaagtgaacctgctgcggcggcgagccccccgttcccgcggcggcacgtgctgctggcgggggctgccgtgggccgccgcgccgctcctctcccggcccgctccggcggcattggcggcggcggacggcaagtacatggcggtcatcgaccgcaaaggccggctactcctcccgtctacccgctcgggaccgcagcaggggccctgtgccagggcagcacccggggtacaaggacgtgatcgagccgctggagagcgtcagcatcaacatgatccccaccaccaaggaagacatccgcgacctcggcccgcccgaccaggtccccgggccttcgggccggaacgttctatcccctcacatgcaaaacaccaagttgaacgacgccaaagtgacggttgtcgaaagaaaagcccgctatgctttggggtacctggcgcatgctccaggttgcccaagacatggacttggcacgtttgccagggcgaatggcaagttctagcacgttggcgacgggcgcaaacgagaggagatgggacaagatgaaggataggctacatacaatcgtcgacttcattcaaaatcgaaacaaaagtgtgaggggtatttgatgcattctgctgattttctatttttggtttgttcgttttcggagctacagctggcgtgaggttcaatggcaaatgtcgggaatacaaattctactgatcttttttcttttcttttcttttcttatgaaatatgtgatttcaaatactattgtctatatgtatatcatttcaccctctataatgcgatccttggagtaccggccaagggag

SEQ ID NO: 872 - DNA, 755 bp, Triticum aestivum
  Clone ID: PAT_TA_872
cccacgcgtccgcccacgcgtccgcccctggttccagcatcgccgaacccgaaccacaccgtccggtccaccccgagaggagagcgcagccacaggccacagcgacatgccggcgacgccgaccatcatcggtgccctgctggggctgggcacccagatgtactccaacgccctccggaagctcccctacatgcgccatccctgggagcatgtgctgggaatgggtctgggtgtagtgtttgtaaaccaactggtgaagtttgatgagaaggtcaaggtggaccttgataagatgcttgagcgtgcgaaacacgccaatgagcagcgctactttgaccaagacgacgattagctgttcaaatttgtttggcggcaaccgggctttttgcagtttgctttggtcacaaaaactggctccgcatttcatctgcgatagtgtaataaactgatgttttacagtacttgggttgtacttgtacgggaggccattttatggtacttcaatctgattgtttatctcgtctgcagcattattatcagtttgctttggtcagaaaaactggctccgcatttcatctgcggtagtgtaataaactgatgtttcacagtacttgggttgtacttgtacgggagacctttttatggtacttgaatctgattgatcaccttgtctgaagcatcgttattcaagttcaaaagatgacttatggtccctgttggtcgtgcaatataacttatctactaaacaaaaaaaa

SEQ ID NO: 873 - DNA, 748 bp, Triticum aestivum
  Clone ID: PAT_TA_873
gggctgccgacatcagccagatccccaccccctaccagtagtgctctcccggtgtgacttgcgagctcgatcgcgcaatggcggctcgcactgggaaggccctcgccttggccatgctgatctccttccttgtggtccaggggacaacggggaaactgacggcaaactgctactgcgtgttctacaattggtgctttaacattggccctaagccacgcgaccacctcatctgcatggagaaaagcctcaagcattgtttcaagggatgcccgcgtactgctactactccttacgtgacgccactggccgatcttgtcaaccccgttacagacgagcgcagcatggccgttcctgccgggggtgccgatcacggcgagttccacatcactgagggcagcgtggaggctcctgccgggggtgccgatcacggcgagttcaacgccgctgaagaggatgcagctccatgagggctgcgagaggctggctggagacttggaggacagacacagtttggccgcggtataggccgagaaactcttcagaataaaagccttctcgtagtgaaagtctgtctgtcatgcactgtacaagatctctggctctggcaataaataaacataacaaacataattacgtactagtaaatgcttgtcatcttcttgtacgccccggatgttcaaaacatgatgaactgatgttgcatgtgctgcctggacaaaactcaagaggttttatactaaaaaaaaac

SEQ ID NO: 874 - DNA, 646 bp, Triticum aestivum
  unsure (1)..(646): unsure at all n locations
  Clone ID: PAT_TA_874
cccacgcgtccgcccacgcgtccgctcggattcaccaccatctccggcggcggcggcggccgcgacaaccgactccaccaccttccttccacccgcccgagtagccaaaacagaagcccccccgagcaagcgagcaccttcgagcggctcgccggaggaagcggcccgccgccgcaggcaggccagaggagatgtactgccagtcgtgcaagaacgtgtacgacgaggaggacgccgggacctgcaaggagtgctacgaggaggccagcgagacggaggaggagctcaagcgcgagatcgacgacctccgctcccgcctcctcttcctgcgcctcccctcccccacgctcgacgcctccgccgccgggcactccgacctcctcctccacgccatccccgcctcctcctcctcgtcctcgccctccccctccggngacgccgacggggcccgcctcgacacccccgccgtccctgccaaccgcgtcatcctcgcaagcaagtctccaagttttaaaacaaattgcttganaagtganaatgggaagagagccgggagcnggntcaatcaaanatgttacgaacgtgtcctaatgaatgtcctccgttgcttttcgttccaactaacaatgttncacgggggggaggg

SEQ ID NO: 875 - DNA, 1424 bp, Triticum aestivum
  Clone ID: PAT_TA_875
ccgccccccagaacacaccgcgcgctttacgagagcagagaaccagagggaactcgtgcttagctttcctgtagcttcgtttgcaccatccatgtccgacttagctttcctgtagcttcctttgctcccatggccgatccagccgaggagaccgtcgccgcgcccccgccgaccccggcagcgcccgccgagggcgccccgccgctatcggcggagccgccggccacgtacccccgacacgccggtcagggcgcgcgcgcgcacgccgaggggaactcgtgcttagctttcctgtagcttcgtttgcaccatccatggccgatccagccgaggagaccgtcgccgcgcccccgccgaccccggcagctcccgccgagggcgccccgccgctgtcggcggagccgccggctagcaccgacgcctcgccggagaaggcggccccgcctgcgcctgcgccggacacgacggtcaggtcccgggggttcaggctgctcggcgaggacacctccgtgcacaaggtgctcggtggcggtaaaactgctgatgtactgttatggaaggacaagaaaacaactgctcatagtgatcggtggcacaactgtcatatgggtttaagattgaagtgcttgattaccatctcttaactctgctatcccatgtgatggatctggtgttctggccatcttgttcgtgtggtcgaaagctatgaccttcatcaagaagagtccgcgatattgtcctgtcgtcgagatacctgaagatctcgctgttgaatgtatcacgggcactacgcagcgatgtcaacagatcacttcacttgttgcgcgagattgcaatggggcatgatctgaagaaattcattggtgtgattgctggtctactgggttctgtcagaagttggaagctgctgtcatttcctcaccttgagacatattgctgtcctggtgatccacacggtgtccgatcttgtacgacaagtaccaggacaaggtggatcacttcgccggaaaggcccataccgaggcgtgcaagcactacgaggtgctggaccagaaggttctgagcaagataccccgaggaccggcgaaaaccaagaagacctagaatgctgggtgtctcgtgagtgcatgctgggtcgcttgtggttccgtgatcatatgcgtaatgcgacgagacgtcactcgtcttacggtcttgccttctgctcagcattgtattagctatttgtatatgcaactctgaaaacttcgaactgctacctttctactatcgcagtcgcttgtagatacctgtcctgttacttgtgtgtacgtgcggcagatgtgttctcgtgtggatgttcttagtgaaaacctgaatggatgttcttgaaggaaaataacctgctgaatactactgtactattaattcactatctttgctgt

SEQ ID NO: 876 - DNA, 726 bp, Triticum aestivum
  unsure (1)..(726): unsure at all n locations
  Clone ID: PAT_TA_876
gtcttcctctactacttttatgtgatctcataattggccctctcaaatccgccgtcgctagcagtaaactatttcctccttcttcttcttcttgtttccttttcctgcgtcaacaagtgataaataagaaccgtagcagcagcagcagcagtagccaggtagtagtgattccggtgcaaagatgtcgtcgtcgtcgctgtcgccgggaggtgggaggctgtcgggctcggacggcgactcgggggcgacgttctcggccggggacaaccggcgggagaagaggcggctgtcgaaccgggagtcggcgcggcggtcgcggctgcggaagcagcagcacctggacgagctggtgctccgcgtcgtcgaggagttcagcggcgtcgccatggacatccaggaggagtgcccgcccgacgaccccctgctccggccgtggcagatcccgtaccctgccaccgccatgcccatcgccgccaccgccacgcacatgctccagtactgatcgatccggtgatgattgggtcaataattgaggatcccctgtaggagcggagctgagctgtggctggcaagaggaagaagatctaccctacttggctgctgccttgaggattattaccaaggcgtagtttgctgctatatgttgtgtttattattatgtttcagtaagtgtccgccgtcgtcgtcctcgtcctnccatgtcctatgtaatgtaacagtaataag

SEQ ID NO: 877 - DNA, 922 bp, Triticum aestivum
  unsure (1)..(922): unsure at all n locations
  Clone ID: PAT_TA_877
gaggggatctctcaggaggtagttggtgatcttctgggtgaggaatttgagggctatattttcaagatcatgggtggctgcgataagcagggcttcccaatgaagcaaggagtgctaactcctgggcgtgttcgccttctgcttcacaggggtattactttattttcattgtacttcttgcagacattttctctctattaaattataactcctacctgtatttattttgcgtaggcacatcttgcttccgtggacatggcaggcgtgttggtgagcgccggaggaagtctgtccgtggttgcattgtcagccaagacctatctgttatcaacttggtgattgtcaagaagggcaagaatgatctgccaggcctgaccgacactgagaagcccaggatgaggggacccaagagggcttccaagatcaagaagctcttcaaccttggcaaggatgatgatgtccgccagtatgtcaacacataccgcaggtccttcacaaacaagaagggcaagaccgtcagcaaggctcccaagatccagcgtcttgtgacacccttgaccctccaagaggaagcgcgcgagaatcgccgacaagaagaagaggatcgcgaagaagaancaagaggctgcaagagtaccaaaagctgcttgcacagaggctgaaggagcaaaagagaccgccggagccaagacatggcaaagaggaggcaaagtttccggctgctacaaagtccctgtgctccgcttaagatgtccttcaataagtgggcaaaatanccacaacttcaacttccttgagtccgaattgatgatatttgcgtgaacatgatattaccggtggagnttgtactgaaatcangtangttcnccaagnaaactgtanaacaanattacancaattaatgnctagtaaaaaaaaaaaa

SEQ ID NO: 878 - DNA, 514 bp, Triticum aestivum
  unsure (1)..(514): unsure at all n locations
  Clone ID: PAT_TA_878
ccgaggttttttttttacaacatgaacagcaagtaataacaggcagcaaaagtatcatcaaatatctaaaccaagctatgcaaaagggtcgcaattgacagagtgggaagcaacaaagctcgatattcacttccttcccctgcccttgctcatgaagtggtggcgcttcaacctcttcttcttgaactggtccgacttgatgttctcggcgaatggcatgccgaggagcgcgaggagcctctgcgcctcgttgtcggtcttggcggatggtgacaatggtgacgtcataccgttcttcttgccgcccacctcgtaggggatctccgggaacacgccctggtcgcngaggccgatggtgtantgccgtcccgtcgaactgttggggttgcacctaggagtcatggtccaagggagccaaggtgatgagcctatcaggaattgacatcacctccgcggacgtgatggcatacaatgggttcctcgcgatttnactgngacgngtctggctggctga

SEQ ID NO: 879 - DNA, 540 bp, Triticum aestivum
  Clone ID: PAT_TA_879
agcctgaccaaagcaaaaatttccattttgttctgtggcagtaggtacaacatgaactgcaagttataacagacagcgaaaggatcatcaaatatctaaaccaaactatgcaaaaggatcacaattgacaaagtgggaagcaaagctcaaacgccgctcgatcttcactttcttcccctgcccttgctcatgaagtggtggcgcttcaacctcttcttcttgaactgatcagacttgatgttctcggcgaatggcatgccgaggagcgcgagcagcctttgcgcctcgttgtcggtcttggcggtggtcacaatggtgacgtccataccgttcttcttgccgcccacctcatagggaatctccgggaacacgccctggtcgcggaggccgatggtgtagttgccgtggccgtcgaagctgttggggttgacacctaggaagtccatggtcctagggagcccaaggttgatgagcctatccaagaagttgaacatcaccctgccgcggagcgtgacggcgataccaatggtgttgccctcg

SEQ ID NO: 880 - DNA, 825 bp, Triticum aestivum
  Clone ID: PAT_TA_880
gctgctcctccccttccggttcgggttcgggttctggttcggttcgggtccgagagtagctagcctattctagggtttccgtagagaggaggaggacaggaagacagagatccatgctggatacggatatcacgatcatacgcgtactgtcttatctgaggcgccgaccatgatactgttgagcaggtcttcagcacctaggctgatacttcatcagcacaccatagactaccgcaagaccgcgaggtccagagaagactcactttggtgaccttaaagatgaagatcggatgttcaccaacctctatggtctgaatgaccctgttctgaaaggtgcaatgaatagaggtgactgggctagaaccaacgatttagcgataaaaggcgcagactgtatagtgaatgaaatgaagaaatcaggactaccagggcgtggaagtgcagggtttgcttttggcctcaaatggtccttcatgcccaaagtggctgatggacgaccttcttatcatgttggtaatgctgatgagagtgaaccaggaactttgtaaagacagggaaattcattgcgtcatggacccccacaaagctttttgaaagggtgcctgatcgctgaaattcgtttaacggcactcactgctcacattttcctttaaaggcgaatatgtcaaatgaacctttccacctttattacaatctctgtagggaactttattgcattaggtacttattggttaaaaactttattcggccaatgactatttatttggatactcaaattacatattcgtttactgataccctacaatcttagggggacaaaacccg

SEQ ID NO: 881 - DNA, 781 bp, Triticum aestivum
  Clone ID: PAT_TA_881
taggggccttttttttttttttttttgccacaaacacctgattctgatttttatacagatataatatgaatagtacccctaagggctaatatttgctgatggttcgagggttcaccacaatcttcacagcacaatatccagtatgatacaaaacaaatatctgtcagcaagtcaaccgcacgtcaacccatcagaccatgacaagcagccatataccatttacaagaaactaactacattagtggccgccatcagagccatcgtccactgcctttccagcgcctccaccgcatgactttgcgaccgactcaaacagctgcttaatctcaggtgcgcagtgtgtgaaggctcggttccaaaagttgtagcgtgggttctttatcagctcgatgaaggtgatgagtaatccccaggggtgaggacggttcactatcagccgttctaagagaaccctggttacctgctcctggatatgttcctgggcagcttcagcaaatagatacagaatgatgaaggagaagtagtgtgtgtggctattcgggtagcgcagttggttagcaatcgcattcaaaaacaggtagcgcccctctgtatccaagttcgttacaagatatctgaaaaattcagtcgctgtttcgatctgaaaaatatccattgtattatggttaatctgctgtgctgacgcagatgcatttgccttgttcgcttgcaattgttgcaccgcttggatgccaatgtagagaacaagcgaattcatcagaggcacattgtagcgtgtccc

SEQ ID NO: 882 - DNA, 651 bp, Triticum aestivum
  Clone ID: PAT_TA_882
gatgaggcctttctcctctttgagggaagacaacacaatcaaccaggttcttagcgtacaatccatggtcatagatagcttcaagtactctgatgtcaccaggatggagacaaggatttttcgatactgcaactcttccaacaacaactgctgttttctctgtcccattatcttcagaaaaatatggttgacaattatccttctgctctttgctgttctttgaaattctgatgtacacttgaccatattctaattcacctgtttcgtccaaacaaccaataagaacacggcctttcggaacatgaatcttacatctagttcttatgtcagtcagcctattatcctgatgggccttaagaatcatcaacaggtaaggctctaaacttggttcatagccttgcagtaaaattttcgatgctgtctttgtttctgcactaccaatttttcccagaacagagagagcagcttctctgttggtcagcatttcatctaattcacgcatatcattctgttgcatcgactcaaatatctcatctcttatccccaaagttgaaaggagagagataacttcacgattcatatagcatggttgggatttgctggtacttgtaatgttaaacattctgctctttgattcgaatttcttcatac

SEQ ID NO: 883 - DNA, 632 bp, Triticum aestivum
  Clone ID: PAT_TA_883
gggtttgaaagacacttttcaacaaacaacaaagtatgatacgacaaacacctgatttttacaaatataatatgagtaagtacctctaagggctaatacttgctgatggttaaagggttcaccacaatcttcacagcacaatatccagtatgatacaaaacaaatatctgtcagcaagcgcacatcaacccatcagaccatgacaagcagccatataccatttacaagaaactaactacattagtggccgccatcagagccatcatccactgcctttccagcgcctccaccgcatgactttgcgaccgactcaaacagctgcttaatctcaggtgcgcagtgtgtgaaggctcggttccaaaagttgtagcgtgggttctttatcagctcgatgaaggtgatgagtaatccccaggggtgaggacggttcactatcagccgttctaagagaaccctggttacctgctcctggatatgttcctgggcagcttcagcaaatagatacagaatgatgaaggagaagtagtgtgtgtggctattcgggtagcgcagttggttagcaatcgcattcaaaaataggtagcgcccctctgtatccaagttcgttacaagatatctgaaaaattcagtcg

SEQ ID NO: 884 - DNA, 1189 bp, Triticum aestivum
  unsure (1)..(1189): unsure at all n locations
  Clone ID: PAT_TA_884
tggccactatgtgctcttctgggagatcaagtccacctgcgaaggtgtgaagcccctcgaccctcagctcctcgagagctgctgcatctctgttgaggagtcgctcgactacatctacaggcgctgcagggcgcacgacaagtcggtaggcccgctgnagatacgggtggttgaggccggcgcgtttgatgctctgatggatctgctggtcagccagggcagctccatcaaccagtacaagaccccgaggtgcatcgagtccggcctcgcgctgaagctgctcaactccaaggtcaccgcttccttcttcagcccccgggatcccgagtggaccgtgtaagagctttcaggtagggcctaggagagctacatttctccggtctgatcgtaccagcctgctgcttgctgggataagagagtattttctgctgctcgcccttttatattcagagaactactgcttattagcgcattccttgtattatcatcacccaagccctaaaaagcagagtgaatgaagtattcgccagtttttcgctactctctgtatgactgtatgtactccctctgtaaactaatataagagcgtttagatcactaaaatagtaatctaaacactcttatattagttcacggagggagtaccatttacaagaaactaactacattagtggctgacatcagagccatcatccactgcttttccagcgcctccaccgcatgactttgcgactgactcaaacagctgcttaatctcgggtgcgcagtgtgtgaaggctcggttccaaaagttgtagcgcgggttctttatcagctcgatgaaggtgatgagtaatccccaggggtgaggacgattcactatcagccgttctaagagaaccctcgtcacctgctcctggatatgttcctggctagcttcagcaaatagatacagaatgatgaaggagaagtagtgcgtgtggctattcgggtagcgcagttggtttgcaatcgcattcaaaaacaggtggcgcccctctgtatccaagttcgttacaagatatctgaaaaattcagtcgcagtttcgatctgaaaaatatccattgtactatggttaatctgctgtgctgacgcagatgcatttgccttgttcgcttgcagttgttgcaccgcttggatgccaatgtagagaacaagcgaattcatcag

SEQ ID NO: 885 - DNA, 819 bp, Triticum aestivum
  Clone ID: PAT_TA_885
gcacgagggttgagagtgggctttgttctcgaaggttaatgcagtatttgtatcacaagcgttaccggccagataataatcccataacatactggaggaagctcattgatgaatattttgcaccacgatcaagagagagatggtgtgtgacatcatatgaaaagccagggaatacctcagctgctattccacagacatccccggttagtaaaaatttcatatctgaaattattttgaatagatgtttaaataatactccctctgtaaactaatataaaagtgtttagatcactattttagtattctaaatactcttatattagtttacggagggagtacatgccaagtttcctataggagagatgcatgcattgcgccatcatggcgccgcagtgggagtcgccgggggggcctccttgtcgtcggtcttcatgttcatccagctcgatggatgtggctgacgacgacgcgcgggaagtgtcttcgggagcgggatggcttggccgccttcgtcgatgctcgggaggccgtggggagcctccatccggtgcgcgatcgcttgcatcaaggagagcaagctctccttcagggcagcgtccgccccaattggcctccgctgaggtggcagaccaagcgacagagcaatctgcatggcttggtccaactcggcaaacgtctgcttgtggacgtccaaggtgatctgtaggtgggactgggacgactcggatgagtgggagaggagggaggagactaagagaagcatgatcatggtcatcgtcttggccatgcctgttgttttgtcccacgcgtccgcggacg

SEQ ID NO: 886 - DNA, 1568 bp, Triticum aestivum
  unsure (1)..(1568): unsure at all n locations
  Clone ID: PAT_TA_886
cggcacgaggggaacgaactgaagcagagaggagcgactggagcagcccggccgtcggccgccggcgaagctagaatatctgaataacctcagtagcatccatcgagtggtgttctttgccaataagcaagattcttcaaggtgatggttgagttgcaacactgctgatctccatgtctgtggctccacacttcaatcttggacttgttcccagggacatgaatggtggtattccagttagttctgcaaattcctctgggccaagtattggtgttagctctttggtgaccgatggcaactcatcactctctggaggtgcccagtttcagcatagtacgagcatgaatgctgactcattcatgcgccttccttcctcaccaatgtcattttcatccaataacatatctggctcgtccgtcattgatgggtctaccatgcagcaaagtccaccccaagagcagatgcagaaacggagatcatctagtgcaacatcacaacctggaattgaggctgatggtgcatttcatggtcagaagaagccaacggttgatattaggcaagatgatatcctgcaacagcatttgattcagcagctgctccaaggccagagttctcttcatttccagggccaacataatccacagcttcaagcgttaatccggcagcagaaactggcacatattcagcatctacagcagcatcagttgtcgcaacagtttcctcagatccagcaatctcaagttggcatacctcgacagccgcagttgaggccgccgctagcacagcctgggatgcaactacctgggcgtgtttaggacacctgtcgagagcgggctttgttctcgtaggttaatgcagtatttgtatcataagcgtcagcgtccagagaataatcccataacatactggaggaagcttattgatgaatattttgcaccacaagcaagagaaagatggtgtgtgtcgtcatatgaaaaaagagggaattcctccgcttgctattccacagacagctcaggatacatggcgttgtgatatttgtaatacacatactgggaaaggatatgaggctacctacgaaatacttcctagactctgtcaaattcgatttgaccatggtgttgtagatgaatatctattccttgacatgcccaatgaattccggttgcccaatggggttacttctcctggagcatactaaagttgttcagaagagcatctatgattatctacatgttacgcacgagggccaactgagaataatattcactccggaactaaagattatgtcttgggagttctgttcacgacggcatgacgagtatatcactcgcaggtttctagcaccacaggttaatcatctgctgcaaattgcccanaagtatcaagctgctgccaatgaaagtgggccctgctggggtatccaccaatgatgcacaagccaatttgcaacatgtttgcgntcagcatcacaacaactngngaaaaaatncttgaacccccacaagccttaaatgaacatggggctttcctaaaangatacgttccgggtgcttgcaaaatatcaa

SEQ ID NO: 887 - DNA, 594 bp, Triticum aestivum
  Clone ID: PAT_TA_887
ttttttttttaagagaaaaggacggcttgacatcaactgactcagatgaacacaataaatactacatgtttgttatttttgcgaaatacgtaagagaaaagaacggcacatcaactgactcaaacgaacacaaatactacggcgccctgggacaacagggaacagggcaggagttacggaaatgtaaatcgtcgcgttgcgccatcatggcgcccgcagtgggagtcgccgggtgggcctcctcgtcgtcggtcttcatgttcatccagctcgatggatgtggcttggccccttcgtcgatgcttgggaggccgtggggagtctccatgcggtgcgcgattgcttgcatcaaggagagcaagctctccttcagggcagcgtccgccccaactagcctccgctgaggcggctgacgaagcggcaaaaccatttgcatggcttggtccaactcggagaacttttgcttgtggacgttgaaggtgatctgtaggtgggactgggacgactcggatgagtgggagaggagggaggagactaagaaaagcatgatcatggtcatcatcttggccatgcctgttgttttgtgctttgtgg

SEQ ID NO: 888 - DNA, 1234 bp, Triticum aestivum
  unsure (1)..(1234): unsure at all n locations
  Clone ID: PAT_TA_888
cgttctatacgaatttgcctggcaagtgtgtggatgagattgggatgtatattgggaagctgaccgatctgaagttcgattcatcaaaaaagcactaccatgttaaggtgtttgacaagcagcgaagtgacacgacgatgtcttgcaaatgcactgtgcaagaggatgggaagcttgtgatccacaaggttgaattgaaccagatacggcagctggtggaagacatatcctgcctgtccaaagattttgatttaaggctgatgttgcgtacaaaaaggatcctgaagaacatagacactcatctgatatcacttgcagcctgaagtggaaaatgccataaagagcttagtgtcttcagctattgttgatcctgatgccaaagggggacttaaatggccacttgggtttgagtcgattggtgtgctgaccggtttgaccaccggagctccactggagagatttccaatgaagttaccttcaaactaactggcatatctgagagactgcaggatgggaatgaagaggtggacactctgaaggggatgctggagtctgcggtgcagatgatctgggacactgttttgagctacaagatctagccttgagcttgggtatgctgacatacagagggagtacattgcattgtcattgtgtgccatacagttgtttgacgatgctttggtcttccttgctagtagttgctactgcaatgggtgtgggtttgcagacccgctgtgtatatagacttgtagtagtatttagtactccctcagtaaactaatataagagcgtttagatcactaaaatagtcatctaaacactcttatattagtttacggagggaatagtagttacaacatgaacagcaagtaataacaggcagcaaaaggatcatcagatatccaccagaagctgcttgcacagaggcttaaggagcaaagagaccgccggagtgagagcatggccaagaggaggtccaagctttctgctgctaccaaggctcctgctgcctctgcttaagatgtttacagtctttcattagttggacaaaactaccctctactttcagntttcttgagttggtagttgatgatattttgcatgaacatgggtatttatcggctggagtttgttactggaattctatgttagtttctactcaagtagagctgaaagcaataggtcttatcatctgtttgaaatgttctagtacctgcccgggcggccgctcgaa

SEQ ID NO: 889 - DNA, 1113 bp, Triticum aestivum
  unsure (1)..(1113): unsure at all n locations
  Clone ID: PAT_TA_889
ggctccaataaaaacctttaattatcccactgggaatggtcagcctttaggacagcattatagatcatctgacatccattgtaccgctagattaacctgaggtgctcgacatgacaagagcaagagctcacgaaaatttacagcaaaactaaaaagaaacagactgtcccaaagaatccccaacactcataagtcataacacaaacagctcacagtatgcataaaacattctctaatgactaccatcagcgagaactccctcttctgcagctttacctccacaagaccttgcaacagactcaaacagcctctcaatctccggtgcacagcgtgtaaaggatcgagcccaaaagctatagcgtggattctttatgagctcaatgaaagtaataagtaatcccccagggatgaggacgattaactattaggcgctctaaaagaactctagttatctgctcctgtacgatatcctgtgttgcctcagcaaacaagtacaaaatgatgaaggagaagtagtgagtatgattgtttggatagcgtagctggttagcaattgcgttcaggaggaggtaacggccttcggtatccatattcactataagatttctgaagacctcagtggctgtttcaatctgaaaaacatccacctgaggacctttggttcatttgctgcgctgatgctgatgcatttgccttgttatgctgtaactgttgcacagcctggatgccaacatagacgaccagcgaattaattaagggaacattataacgagtcccagcaacattagcttcattctgaggcagcagcaacttttgcttcagatcattcaaaaaggatgagccttctggtctcttaagatactcatcgacttcagccttcatatgctttgacttgagggcaccatcaacatctgacatgattcgtggaggtaatgaaatttcagctagcagatcaatcttcaaattaggggtagatgggtctggaagtctcatgttgcgcggaaaagcactgagaatgacattgcgcatttgaatgcaactggaagggatcacgtcacaaaaantgaagtgatagtcacacagaaattcaggaaagtcatggagtagtacctg

SEQ ID NO: 890 - DNA, 842 bp, Triticum aestivum
  Clone ID: PAT_TA_890
cttgggcaattccagcatcccatgtcgttccaagcaaggtatgtcccagcaccagcataacaatttccaaggcctgggcgctagtccacaattccagcagcatgtgatcaatcagctgctgcaagaagccaagaacaccaatagccgcgctcttgctcatcagcaacaacagcagcagcaccatcaacagcagcagcagcagcagcagcaacatcaacagcaacagcagtctcctagcactcccaatgcaaatgggtggtcttgcatctggagccgcggtcgccaacatcgctgctagcggagagcaggcacagcacatgaataacggcgcagcaaagggcgctgttctgatgggtatgacggggcctagtaatctgatcaacagtggagctcgcatggtccagcgaagcagcagtttcaagtcagtgagcagcaacccggctgcttctggcggcaatgcggcgaccccaaaggcggagtctgtgcatgacatggacgacctggaacatctcatctcccacgaacttgtggagagcgggctgttcatgggggagcagccaggggacggtggcttctcgtggaacatctgacatcattgtcaactaaagtctccctactccgagagctgtgtttgatggcgatatcgcggtagattattaaaagtttttcttctcttttcgagatcgtgttcgccgcctggaacagtctctggtgatcatagattgatgaaccttcagctatgtgagagagtgagtcggtttggatagcagtgcaacccagtgttattaactagtatggaatgacatgatgtggttgtcatttgtgctgctaaaaaaaaaaaa

SEQ ID NO: 891 - DNA, 952 bp, Triticum aestivum
  Clone ID: PAT_TA_891
gcggccgcccgggcaggtactctgatgtcaccaggatggagacaaggatttttcgatactgcaactcttccaacaacaactgctgttttctctgtcccattatcttcagaaaaatatggttgacaattatccttctgctctttgctgttctttgaaattctgatgtaccagaagctgcttgcacagaggttgaaggagcaaagagaccgccggagcgagagcatggccaagaggaggtcgaagctttctgctgctaccaaggctcctgctgcctctgcttaagatgtttacagtctttcattagttggacaaaactacccactacttccagctttcttgagttcgtagttgatgatattttgcgtgaacatgggtatttatcggctggagtttgttactgaaattctatgttcgtttctactcaagtagagctgtaagcaaccaagtattatcatccatttgaaatgtccagtacaggatggctctggatgatcatggagaggctcaaagtgggcaatgcaaagctagaagagatcgatatgcttcaggaggtgaccaagcagattgaaggccacacgatctgtgccctcggggatgctgcagcatggcctgtgcagggtcttatcaggcacttcaggcctgagctggaaaggaggatccgtgatcgagctcacagcgagctgctgatggcagcttctgcatgagcaccacttctgttttcctgattttattcgcagaaataatgcaaactggtgaagctcttctgtactagcagatgtagcttaccttattggtttgaaccttttatgtccatgttcatttgatgtggtaatgaagcatgatagctttgattgtgcaagtagatgtgagatccaggtaagggatagtttatggttgggaatagaatatgaactctttaatgttaactatcctcacactctgagtgaactct

SEQ ID NO: 892 - DNA, 1001 bp, Triticum aestivum
  unsure (1)..(1001): unsure at all n locations
  Clone ID: PAT_TA_892
ttttttttttttttttttttttttttttttgttttttttttttttttaaaaaaagttgatgccatagtgtgtaaatacgttctgacataatatactctataagcaacaaacaacaggtagtaccatcacaaatggaaaaagagagacagagagaagattgcaatgtacgctgcaggtttcgtaggcaagggtactactgtactaacaaaggggcaataatttagataaaactccgtcttcatctacaacaacaacaacaaaaatcccatctaacccccctccggtatttacacgaggggggaagatactctccggcgccgatcagcagttgacgccgcactgccccatagcgacggctttctgggtatcggatatgaaagggtcgatcttcacccacaggagggagaagatggaggcgaggaggatggaccaaacaatgacgatggttggcgtgcggttctgcttccccatgagacccttgaggaaggggtagagatggaggatcacccagattgagaagaagagctttccaaagagtggaccccaggactggtaaccgctgttgatggcatatgatatgcctgccaccatgcccaccaggttaatcacaaggacggtggtcggagggatgaggagactcgtccacttgaacacatatagctcggcaaagtcgccgtcctcgtcgtttgccttcgaggtaaccgtgaagttggtgtcgatcccggccaacaccttcagcagaccctggaacactgcgaaaagatgggcagatgtgccaccaataacccaaaactgctcgttcctccaccagtcctcgatgccgacaccactccatcggagctccaatatacccgtggcaaagatggaggcaaacataagaataaagaacatcccagcatagttactgatctcaggaatgataaatttgttggtgaggagacagatagcaggaagcacacaataggcaataagtgggagggatgttattggataancaatgg

SEQ ID NO: 893 - DNA, 937 bp, Triticum aestivum
  Clone ID: PAT_TA_893
ttttttttttattcatattccatggcacggttgacactagtaattgcagaagatccatattccatgccacggttgacactagaattgcagaagagagagttgatgcaacagctgccttatataaatagtcggtgtcacagggggtataaatacaattctgacataatatactctaagcaacaaagaacaagtatcacaaagggggaaaaaaaggagaaaaaatcacaatgtacgctgcaggtttcgtaggcagtggaggcttgactgtttggggttcccagcagcatgggcgacaagggtactaacaaagggacaataatttagataaactccttccgtcttcatctacaaccaaaaaatcccatctaaccccctccggtatttacacgaggggggcagatactcactcttgagcgccggcgatccgatcagcagttgacgccgcactgccccatggcgacgggccttctgggtgtcggaaatgaacgggtcgatcttcacccacaggagggagaagatggaggcgaggaggatggaccagacgatgacgatcgtcggcgtgcggttctgcttccccatgagacccttgaggaaggggtagaagatggaggatcacccagatcgagaagaagagctttccgaagagcgggccccaggactggtagccgctgttgatggcgtacgatatgccggccaccatgcccaccaggttgatcacgaggacggtggtcggggggatcaggagactggtccacttgaacacgtatagctctgcaaagtcgccgtcctcgtcgttcgccttggaggtgaccgtgaagttggtgtcgatcccggccagcaccttgagcaggccctggaacaccgcgaaaagatgggcagatgtgccaccgatgacccagaactgctcgtttctccaccagtcctcgatgccgacacc

SEQ ID NO: 894 - DNA, 1067 bp, Triticum aestivum
  Clone ID: PAT_TA_894
ataacctacccctcgagccaccgcgccgccgccgccgctccccagcgttcgggttgctcgccgccggccagctcgcgccgcaactccgccatgaagttgaacatcgcgaaccccaccacggggtgccagaagaaggtcgagatcgatgacgaccagaagctgcggaacctttatgacaagagaatctcccaggaggtagttggtgatcttctgggtgaggaattcaagggttatatcttcaagatcatgggtggctgcgataagcagggcttccccatgaagcaaggggtgctaacttctgggcgtgtccgccttctgcttcacaggggcacaccttgcttccgtgggtttggcaggcgtaatggtgagcgcaggcgaaagtccgtccgtggttgcattgtcagccaagacctgtctgttatcaacttggtgattgtcaagaagggtgagaatgatctgccaggccttactgacactgagaagcccaggatgaggggacccaagagggcttccaagatcaagaagctgttcaaccttggcaaggatgatgatgtccgcagctatgtcaacacataccgcaggaccttcctgaacaagaagggcaagaaggtgagcaaggctcccaagatccagcgtcttgtgactcccttgacactccagaggaagcgcgccagaattgcagacaagaagaagaggatcgccaagaagaagtcagaggctgccgagtaccagaagctgcttgcacagaggctgaaggagcagagagaccgccggagcgagagcatggccaagaggaggtcgaagctgtctgctgccaccaaggctcccgctgcctctgcttaagatgtttacagtcattcgttattagctataatagcggaagaatttctcgcactttgttggatgatatgaatctagctgctactttcagcgttgttgagttgtaattgatgctgttttgcgtgaacatgggtaccttatggtcaggagttcgttgctgaatgaacaaatttgcgtgaacttcggtaattcatgcagttttgtgtgaacatggaatcttatcaaaa

SEQ ID NO: 895 - DNA, 1642 bp, Triticum aestivum
  Clone ID: PAT_TA_895
cctgcgcctgcgccttagccttcggagcgaatcgagccgacgtcgccccccacccacccggccgcgcccacctccggagcaggacgcgatggcagacgacctttgggagaacaccaatcatctgcccagggagctcccgtgaagtccaaggtacgtagtactagtacatgtgtgatatatactcgcaacaacttaactgatgcatgcatcggccctccctcaatatgccgatgctcctcgatatgaagtaccctcgctggctagtgctacggaagcagcttaattgattccagcgactgcaacaagcgtacgtacctaggccaagcaggctagctgcctgctggatggattcctcgagcttaccatgcgacgctagcttgcactagccaacagtaggcacgcacaccaaccgccaatccctctttttgttacctttttcctgatgcaaagattgcacgtgtacacgagtgtacataggagctgcatgtttccctaaacctataggtacgactgatcagcgattgatttctatcatatcatagccggacatgactcgtggttaaaagctactccctctgtaaactaatataagagcatttagattacttaaaatagtgatctaaacactcttatattagtttacggagggaatagtagttacaacatgaacagcaagtaataacaggcagcaaaaggatcatcagatatccaatatctaaaccaaactatgcaaaaggatgacaattgacaaagtgggaagcagcaaagctcaaacgccgcctgatcttcactttcttcccctgcccttgctcatgaagtgatggcgcttcaacctcttcttcttgaactggtccgacttgatgttctcggcgaatggcatgccgaggagcgcgagcagcctctgtgcctcgttgtcggtcttggcggtggtcacaatggtgacgtccataccgttcttcttaccgcccacctcgtaggggatctccgggaacacgccctggtcgcggaggccaatggtgtagttgccgtggccatcgaagctgttggggttgacacctaggaagtccatggtcctagggagcccaaggttgatgagcctatccaagaagttgaacatgaccctgccgcggagcgtgacggcgataccaatggtgttgccctcgcggatcttgaaactggcgacggagttcttggccttggtcttgacggggtactggccggtgatggaggcgaggtccttcatggcggcctccagacccttgttgttccccgcatccacccccagcccgcagttcaccacaatcttctcaagcttgggcacctggtggacattggtgtagccgaactcctcggtgatgatggggatgaccttggtgtcgtagacggtcttgaggcggtgcaccttctgggcctcggcggggtcacgaggatgatgccggagggcgtggccggcggcggcttgggcggcgcctcggtcgcggcggaggcggcgacgcggatggcgcggcgggggaccggcgagcggaggagctgcaggccgcggcgggcggagggggcggcgacggggaagggcgccggcgcggaggtgggcagggtcaccgccgtggctgccatcggagcgtgcggggagaagcgggggagc

SEQ ID NO: 896 - DNA, 1888 bp, Triticum aestivum
  Clone ID: PAT_TA_896
cgtgcgtctcccccgtcagagtcgagggctccgctgcgagcgcctcaaaggtcggcgacacggcagcatcaggcacgacagggtcccaggaggatgtgcaacggcggcaggggcccgccatactggacagctggtgtcacctccgccccagcccggcagacacccttgttctccggacgtccttcaggaggattaagcgatccgaacgaggttgcggccgtcatactcggcggcggcaccgggactcagctcttcccactcacgagcacaagggccacacctgctgttcctattggaggatgttacaggctcatcgacattcccatgagcaactgcttcaacagtggcatcaacaagatattcgtcatgacccagttcaactcggcctcccttaatcgtcacattcaccgcacctacctcggcgggggaatcaatttcactgatggatccgttgaggtattggccgcgacgcaaatgcccggggaggctgctggatggttccgcggaacagcggacgcgtggagaaaaattatctgggtgcttgaggactattataagaataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtggtccagttttctgagcagccaaagggtgacgatctggaagcgatgaaagtggacaccagttttctcaatttcgccatcgacgatcctgctaaatatccatacattgcttctatgggagtctatgtcttcaaaagagatgttctgctcaaccttctaaagtcaagatatgcagaactacatgactttgggtctgagatcctcccgagagctctgcatgaccacaatgtacaggcttatgtcttcactgactactgggaggacattggaacaatcagatccttcttcgatgcaaacagggccctctgcgagcagcccccaaagttcgagttttatgatcccaaaactcccttcttcacctcgcctcgatacttgccaccaacaaagtcagacaagtgcaggatcaaagaagcgatcattctgcacggctgcttcttgcgtgaatgcaaaatcgagcacactgcgttctcacgcctaaactccggaagcgagctcaagaatgcgatgatgatgggcgcggactcgtacgagaccgaagacgagatgtcgaggctgatgtcggagggcaaggtccccatcggcgtcggggagaacacaaagatcagcaactgcatcatcgacatgaacgcgaggataggaagggacgtggtcatctcaaacaaggagggagtgcaagaagccgacaggccggaggaggggtactacatcaggtccgggatcgtggtgatccagaagaacgcgaccatcaaggacggcaccgtcgtgtagagcgccgccgggccggcgcgacggggttccgcgacaacctctgcgctgcgctgatcgtcgtcgtcggcttctcggggccgggactggaggagtgacccggggacggggggcgtttgaagctttgaatggctgagactgaaagtggaggcgcgcgcaggcagcatcagtagtaagtagtaagtggtagtaagtagcagtggaacaaagtaatagtcgttcgttttgcccctgtaataaataagaagaggctgtgtgttgaggtaaagaagtggccgcgagcaaacaaactcccgggggatgttcgtgtaaataaaactctatcgggcgacttgcgaaatttcgggggtttttcaaaaaaaaaaaaaaaaaaactcgaggggggggc

SEQ ID NO: 897 - DNA, 957 bp, Triticum aestivum
  Clone ID: PAT_TA_897
atcctttcctatttctgttgctccgatggcaggtatggtgtggcagatataacatcatgagtgccggccggccaaaattacacacaaacacatccgaccaaacgtagtactagtaaagaaacagtagcaggaaggaaccagaggaattactactggtaggcgatcaatttcacaagcgcttaacttgggagaggcaacgtacgtagttcaccagcaactgcaacacaaaagcatgcacctggaatggtagcaacgcgtgcacaagctagtcgagcacctgtatgtgcttgtctatactatatatagttgtcgatcggcacgagtgaaacactccacgctcgcgcgccacccggaaagcaagcacgtctcagcgcacaccatgaaccgcataactgtctgtctgtctgtgagaggacttgcatgcagactacctatccacggggaggaaccttgacatcggtatcgaaccgggcagggaccgccggcgcattgccgcccagcttcacgatttcgctcaagtcttctttcgccgacttgaccatggcgtgcagcttcttgttcatcgtcttgctcgcgttcgccagcgactccttgctcatgttctggtcctgtagggtgttgaaagtgtcctccctcttggcctggatcgtgttgaggtagtcgatgtacttgctgatcagcctgttcacctggggttttggagacctgtgctcaggcaagaacttgaactttgggagcttggattcggcaaacttggacttcacgggagctccctgggcagatgattggtgttctcccaaaggtcgtctgccatcgcgtcctgctccggaggtgggcgcggccgggtgggtggggggcgacgtcggctcgattcgctccgaaggctaaggcgcaggcgcaggcggcagcgtccaggaggaggccggaatggaggagacgcaagcctcgtgccgaatt

SEQ ID NO: 898 - DNA, 895 bp, Triticum aestivum
  Clone ID: PAT_TA_898
tgcataaggtgtaatctacaatacccctgtggttgtgcagagcaactgcagcccagtagtcaatgcgttggtgtaccaagagaaacctttcggcgatcggctgcattataaaggaaacaaacggagcagcgcgcgagctagaacagtatggtattggtaggaaggtgttgtttggtggtatattgcagggctctgttccaacctgtgtgattgtaatatccaaaactatacttcctaattaacacacaacagcaggttcacagaaaaacaagaatgttgactttgcaaggctagaaatcccaatattatggtaactactccctctgtaagctaatataagagcgtttagatcactaaaatagtaatctaaacacttttatattagtttacggagggagtagacaagaaagcaaaggtacagggtggcaaacgatagatcagagcttattctagcaggtagcatgcatggagctagcttcgcttgatagacctagcttgactcctctctagtaggcgacgatcctgagcccgaggctcttctgcgcgtactcgatgagtccgtccacctcgccgtcgtcgacgtagccgtcgccgtcggcgtcggcgtactcgatgccgcgcttgctcttgtaccccgagaagcgcgtccggatggtgcgcatcgcgcaccgcagctcgtcgcggctgatgcggccgtcgcggtccacgtcgaaccgccggagccactccttgaactcgtccaccgtcatgtccccgtccagcgaccttgtcgccgccgtcacgttcctgatcgccatatcaaactgatcagtctccggccttccttgctccgacgagagctaccttggccgtggatgtatgaatttatgtcacctgcagcccggggatccactag

SEQ ID NO: 899 - DNA, 750 bp, Triticum aestivum
  Clone ID: PAT_TA_899
gatgggacaacctgcttgcagttatccctggcggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgacgaagcagattgaaggccacacgatctgcgccctcggggatgctgcagcatggcctgtgcagggtcttatcaggcacttcaggcctgagctggaaaggaggatccgcgatcgagctgatagcgagctgctgatggcagcttctgcatgagcaccacttctattttcctgattttattcacagaaataatgcaaaccggtgaagctcttctgtacaagcagatgtagcttaccttattggtttgaaccttttatgtccatgtttatttgatgcgctgatgaagccttgtgtgctttgatggagaagtagaaacgaatttgaagcattgtaccctgtatgttacatgagcctgtttttcttctttaatgttataaagaatgactatcctcataatctgaggaactctaaaattatgtcggcatctgaggctaat

SEQ ID NO: 900 - DNA, 2334 bp, Triticum aestivum
  Clone ID: PAT_TA_900
ctcgagttttttttttttttttttttaactgttttcaattgttgcatgatatgtttattgctcagggaacaacaacaaaatctagacatggctaatacaaacacctgaattttacaaatataatacgggcagtaccccaacgggctaatatttgcattcactgtgaagcgtataatggttaagggtttcaccacgcaatatccagttacagaagagacgcaatactatatgatactagaaaagaaatatctgtgagcaagtcaaccgcacgtcaacccatcagaccatgacaagcagccatataccatttacaagaaactaactacattagtggctgacatcagagccatcatccactgcttttccagcgcctccaccgcatgactttgcgactgactcaaacagctgcttaatctcgggtgcgcagtgtgtgaaggctcggttccaaaagttgtagcgcgggttctttatcagctcgatgaaggtgatgagtaatccccaggggtgaggacgattcactatcagccgttctaagagaaccctcgtcacctgctcctggatatgttcctggctagcttcagcaaatagatacagaatgatgaaggagaagtagtgcgtgtggctattcgggtagcgcagttggtttgcaatcgcattcaaaaacaggtggcgcccctctgtatccaagttcgttacaagatatctgaaaaattcagtcgcagtttcgatctgaaaaatatccattgtactatggttaatctgctgtgctgacgcagatgcatttgccttgttcgcttgcagttgttgcaccgcttggatgccaatgtagagaacaagcgaattcatcagaggcacattgtagcgtgtcccagcaacattagcttcattctgaggcagcagcaacttttgcttcagatcattcaaaaaggatgagccttctggtctcttaagatactcatcgacatcaaccttcatatgctttaacttgagggcaccatcgacatctgacatgattcgtggaggtaatgaaatttcagctagcagatcaatcttcaagttaggagtagatgggtctggaagtctcatgttgcgcggaaaagcactaagaatgacattgcgcatttgaatgcaactggaagggatcacgtcacaaaaactgaagtgataatcacacagaaattcaggaaagtcatggagtagtacaagcagcactctcatagttcctttgtacataaggtgcactggttctaaaaggtcggcagttctcaaatacggttccatgaatttgaacagatcaataagtagtcgttggaaaaaaggccaccctttttgtgaattgcccgtcagcagtcttgccataaaggttctatgactcaccaactcaagccaagcaaagctcatgctaggaattctcgagggttgcagtacatggaatgcatttgcaaatgcagccaaaacctggaaattagctccatcatgatggagttcagaagtactaagggtcattcagcccaattgataaacagccgaaagtatggtcgggggttaaatgaagctttcttctcttcagcatctttctgaatgaccctaattgtcactgacaatatcttgggaagaaggctgcctttatttggtcctatttccactgaacaattctttatcaccacagacacaagcttcgaatatgaatcaatggggaaatatgatatatgtgatgactgctgagacaatccaccaggagcattaatttgctcagagactagagagtgtgcaacagcaagttccgtgagaattcggaagaaacgctctgtgaattcgtctcccttcagcaggccaatatgttgcaactgcataacaaaacgactataggccgcatcactagcatttggatgatcacatatttggcaccactcagaaaataggtgtgcaacctggtcttgaaaaccaacagaatcagctacagtggcatcgctaacactgttttcctctttgtttgcccggttaggtaaaacctttttatccttcccaaaagcaaaaccaggagcattgttggcattattccttgcaatctcattcacctgttgcatcaactcaggtgaacctgacctccttgaaatctttgatagcacatcaacaacatcctggagttctgagatactagcggagtcctgagtaatcaatgtctggacaagtgacatggcaaattctgttgcaatcttgtttcttccaccgtcaattagctttgctaaatgaacattgtactctttgacatccagcaaatcagaacgaataagggcaaaaatgatttcactattaaacttctcggacgcgtgg

SEQ ID NO: 901 - DNA, 704 bp, Triticum aestivum
  Clone ID: PAT_TA_901
taggggccttttttttttttttttgacaagaacacactttcattttcttccagacagggaaaattaacaacgacggcaaaccgtgcaggaaaggcgagcctgccggccgcctgtgccacacgctgcagatacatcatgatagatcaccgacgcagacgtcggtgcacagattagccaataagtagacaagaaagcaaaggtacagggcagcagcaaacgatagatcagcgcttattctagcagggagcatgcatgcatggatgggtagatatggagctagcttcgcttaatggacctagccagacccctctctagtaggcgacgatcctgagcccgaggctcttctgcgcgtactcgatgaggccgtccacctcgccgtcgtcgacgtagccgtcgccgtcggcgtcggcgtactcgatgccgcgcttgctcttgtaccccgagaagcgcgtccggatggtgcgcatcgcgcaccgcagctcgtcgcggctgatgcggccgtcacggtccacgtcgaaccgccggagccactccttgaactcgtccaccgtcatgtccccgtccagcgaccttgtcgccgccgtcacgttcctgatcgccataccaaactgatcggtctccggcctccttgctccgacgagaggtaccttggccgtctatgtatgaaaatgtatgcgcctctctgaattcgaggcccggccggc

SEQ ID NO: 902 - DNA, 703 bp, Triticum aestivum
  Clone ID: PAT_TA_902
taggggcctttttttttttttttttgacaagaacacactttcagtttctctcagacagggcaaattaacaacgacggcagccgtgcaggaaaggcgagcctagcctgccggccgcctgtgccaaatacgctgcaaatacatcatgatagtatatcacaaacgcacacgtcggtgcaaaattagccaataagtagacaagaaagcaaaggtacagggcagtagcaaacgatagatcagcgcttattctagcatgcatgggtagatatggagctagcttcgcttaatagagacctagctagactcctctctagtaggcgacgatcctgagcccgaggctcttctgcgcgtactcgatgagcccgtccacctcgccgtcgtcgacgtagccgtcgccgtcggcgtcggcgtactcgatgccgcgcttgctcttgtaccccgagaagcgcgtccggatggtgcgcatcgcgcaccgcagctcgtcgcggctgatgcggccgtcgcggtccacgtcgaaccgccggagccactccttgaactcgtccaccgtcatgtcaccgtccagcgaccgggtcgccgccgtcacgttcctgatcgccatatcaaactgatcagtctccggccctccttgctccgacgagggctagcttggccgtcgatgtatgaatgtatgtatctctctgaattaagtcccgaaacggccggc

SEQ ID NO: 903 - DNA, 1099 bp, Triticum aestivum
  Clone ID: PAT_TA_903
cgcccgcgccgccgccgccgccgccccaccgccccccagctcgcggcccgcgagcttgcgccgcaacttcaccatgaagttgaacatcgcgaaccccaccacggggtgccagaagaaggtggagatcgatgacgacatgaagctgcggaacctttatgacaagaggatctcccaggaggtagttggtgatcttctgggtgaggaattcgagggctatattttcaagatcatgggtggctgtgataagcagggtttcccaatgaagcaaggagtgctaactcctgggcgtgttcgccttctgcttcacaggggcacatcttgcttccgtggacatggcaggcgtgttggtgagcgccggaggaagtctgtccgtggttgcattgtcagccaagacctatctgttatcaacttggtgattgtcaagaagggcaagaatgatctgccaggcctgaccgacactgagaagcccaggatgaggggacccaagagggcttccaagatcaagaagctcttcaaccttggcaaggatgatgatgtccgccagtatgtcaacacataccgcaggtccttcacaaacaagaagggcaagaccgtcagcaaggctcccaagatccagcgtcttgtgacaccgttgaccctccagaggaagcgcgcgagaatcgccgacaagaagaagaggatcgcgaagaagaagtcagaggctgcagagtaccagaagctgcttgcgcagaggctgaaggagcaaagagaccgccggagcgagagcatggccaagaggaggtcaaagctttctgctgctaccaaggctcctgctgcctctgcttaagatgtctttcattagttggacaaaactacccacaactttcagctttcttgagttcgtagttgatgatattttgcgtgaacatgagtatttatcggctggagtttgttactgaaattctatgttagtttctactcaagtagagctgtaagcaaccaagtattatcatccatttgaaatgccctattactttattttgctcatttattcctaatttatttgttatactgtttatattctgaatgaaatgtgtcccaattgaaattaaaaaaaaaa

SEQ ID NO: 904 - DNA, 1827 bp, Triticum aestivum
  Clone ID: PAT_TA_904
ttttttttttgcagaagagttgatgcaacagctgccttatataaatagtcggtgtcacagtgtgtataaatacaattcggacataatatactctaagcaacaaagaacagatatcacaaatgggggaaaggggagaaaaaaaatcacaatgtacgctgctgcaggtttcgtagacagtggttctcagcagcatgggcggctaaccaaaggggcaacaattaatttagataaactcctcccgtcttcatctacaaccaaaaaaatcccatctaaccccctccggtatttacacgaggggggcagatactcttgagcgccgatgatccgatcagcagttgacgccgcactgccccatggcgacggccttctgggtgtcggatatgaacgggtcgatcttcacccacaggagggagaagatggaggcgaggaggatggaccagacgatgacgatggtcggcgtgcggttctgctttcccatgagacccttgaggaaggggtagagatggaggatcacccagatcgagaagaagagctttccgaagagcgggccccaggattggtagccgctgttgatggcgtatgatatgccggccaccatgcccacaaggttgatgaccaggacggtggtcggagggatcaggagactggtccacttgaacacgtatagctcggcgaagtcgccgtccctcgtcgttcgccttggatgtgacagtgaagttggtgtcgatcccggccagcaccttgagcagaccctggaacaccgcgaaaagatgggcagatgtgccaccgataacccagaactgctcgtttctccaccagtcctcgatgccgacaccactccatcggagctccaatataccagtggcaaagatggaggcaaacatgagaatgaagaacatcccagcataattactgatctcggggatgataaatttgttggtgaggaggcagatagcaggaagcacacaataggcaataagtgggagggatgttaatggataaacaatggtgttgatgtaagccaccctctccagaagtttcaaccgcccaccgtaattgtaccagataggacaatgtctgctaaacagaatttcaactgacccaagcgcccatcgtagaacttgattaagacggtcagacagattgattggcgcagaacccttgaaacaaggccggggtggcatgcagtagattgatatccaccctcttgcgtgcattttaaacccggtaagaatatcttcagtaactgaaccatagatccagccaatcttctttttccccattcggtcttgtcctcgtatccacagctgatgacatggatggcttcctttagtagagaagctgggtttgttgaaggtggtatgcctccttgagtcataaaggtggatgcagtaaatataggagactgaccaaatcgtttctccgatctctctctgggacacaagcattgacctttcatcctcataaccttctataccctcttctatatcatccatgttgaagatgggagcagaagactcggttctcttcatcattcggtttttgttatccatatagctcttgctctttttctttctaccaccgcagcagctcttaacaacaatgttaggttccaaatcagcctcagttaatacaggatcatagccatacaaggcctgcctgttgaaacagcatcctgtgtccgacatacattggaccctggatgccatctaaacctttcatattgatatcaaagaaaactatgttgcgattagcatatcgatcgtgcaaatcaatgccgtcaaatctttgtggaaattggacatagcaagttttccggacgcgtgg

SEQ ID NO: 905 - DNA, 1373 bp, Triticum aestivum
  Clone ID: PAT_TA_905
gtgaggaggaggcccccttcctcctcctcttcctcctccgattgggtggctgccattgctctccacatcaaccaagctcgagctcccatttcatcaccactctgctagcccgagtctccttcttgaccccccccccccccttggtttcaagtctcgcagtcctcgtcccagtctctttctccttccaagaagaatttctttgggttgagggagctgctgttcttgctaggctaggctagatcagcgggagaggctgggtcgttgttccgcttgaaatctctgggttttgttgcgctggaggttcttgctggccatggtttgtccaggcatgctgaggcgcaatctctgagctttatgaagatcgccactcacctgcgccggtgctgcttcctccagtccttctccgtcgtcttcctctactacttttatgtgatctcataattggccctctcaaatccgccgtcgctagcagtaaactatttcctccttcttcttcttcttgtttccttttcctgcgtcaacaagtgataaataagaaccgtagcagcagcagcagcagtagccaggtagtagtgattccggtgcaaagatgtcgtcgtcgtcgctgtcgccgggaggtgggaggctgtcgggctcggacggcgactcgggggcgacgttctcggccggggacaaccggcgggagaagaggcggctgtcgaaccgggagtcggcgcggcggtcgcggctgcggaagcagcagcacctggacgagctggtgcaggaggtggcgcggctcaaggccgagaacgcgcgcgtgctggcgcgcgccaacgacatcaccgggcagttcgtgcgcgtggaccaggagaacaccgtgctccgggcgcgcgccgccgagctcggcgaccggctgcgctccgtcaaccaggtgctccgcgtcgtcgaggagttcagcggcgtcgccatggacatccaggaggagtgcccgcccgacgaccccctgctccggccgtggcagatcccgtaccctgccaccgccatgcccatcgccgccaccgccacgcacatgctccagtactgatcgatccggtgatgattgggtcaataattgaggatcccctgtaggagcggagctgagctgtggctggcaagaggaagaagatctaccctacttggctgctgccttgaggattattaccaaggcgtagtttgctgctatatgttgtgtttattattatgtttcagtaagtgtccgccgtcgtcgtcctcgtcctccatgtcctatgtaatgtaacagtaataagggttatgtatggttgtgttctatgtatcgtgaatttgtgataattctgttcaatgttattaccatgtcatgttattatgtttgcctc

SEQ ID NO: 906 - DNA, 3091 bp, Triticum aestivum
  Clone ID: PAT_TA_906
cggcacgaggcaccactcagccaccagaagcggaggagaagaaataagaactggtgtggaataaaaaggagaaaacaacggcagaaagaataatatccggagcacgagaccaacgaggaggacgagcggcagcatcacggaggaggaagaacagcgaccgactacgaccgcccgcgagctctcgagcgaaaatatccgaagatccttgctagtttccagtgacgttctatcccattaagcaaggttcttcaaggtgatggttcagtctcaaccctgctgacctccatgtccggggccccacgctccaaccttggacttgttcccagggacatgaatggtagccttccagttagtactacaaattcctctgggccaagcattggtgttagctctttggtgaccgatggcaactcatcactttctggaggtgcccagtttcagcaaagtacgagcatgaatgctgattcgttcatgcgccttcctgcctctccgatgtcgttttcatccaataacatttctggctcttcagtcattgatggctccatcatgcagcaaagtccaccccaagagcagatgcagaagcggagagcatctagtgtaacatcacaacctgtgattgatgctgccgccgcatttcatgctcaaaagaagccaagagttgatattcggcaagatgatatcttgcagcaacagttgattcaacagctgctccaaggtcagagttcccttcatctccagggccaacataacccacagcttcaagccttgatccggcagcacaaactggcacaaattcagcaacaacagcagcatcagttatcgcaacaatttcctcagcatcaacattctcaagttggcatacctcggcagccgcagttgaggccgccgctagcacagcctggaattcagctagctggacctgttaggactcctgttgagagtgggctttgttctcgaaggttaatgcagtatttgtatcacaagcgttaccggccagataataatcccataacatactggaggaagctcattgatgaatattttgcaccacgatcaagagagagatggtgtgtgtcatcatatgaaaaaccagggaatacctcagctgctattccacagacatccccgggtacatggcgttgtgatatttgtaatacgcattcggggaaaggatatgaggctacctctgaaatacttcctagactctgtcaaattagatttgaccacggtgttaaggatgaatatctattccttgacatgccgaacgagttccggttgcccaacggactgctgctcctggagcatactaaagttgttcagaagagcatctacgaccaccaacatgtcacacacgagggacagctaagaataatattcactccagaactaaagattatgtcctgggagttttgttcacggaaacacgacgagtatgtcactcgcaagtttctaacagagcaggttacacatatgcttcgtgctacccagagttatcaagctactgtcacaaaaaatggacctgctggcctatcgaacgatgaggcacaaaaggcttgcaacgagtttgcatcagcatcacgtcaactagcgaaaaatattgatcaccacagcctaaatgaacatggtctttctaaaagatatgttcgctgtttgcagatatcagaggtggtgaatcacatgaaggatctaattgagttcagccacaagaacaagctcggccctatagagggcctgaagaactatcccaagcaaagctgctggaccaaagctcacggtgcagaatttgcatgactcaaaggcagtcaaaacagaaatgagcccccatgtgaataacgaggttccaggtgttggagcaactagtaataatcctgcagaatcctgcagcacaaagcaattaccaacacattctgagaagctcaagtgcaaatcagggtttgcttcagcaggaggcatcacagaatgccgcggcaatgaacagttaccagaatctgtttagaagctcaagcgcaaatcagggtttgctccagcaggaggcatctcagaatgctgctgcgctaaataattaccagaatatgcttaggggctcgagcccgaatcaaagtttacttcagcaggaggcatcgagtatcttcaaaggtcctacagcagtgcacagtgggcattcagctggaagcatctaggtcgttccgtgcggctcagcttgggcaattccagcatcccatgtcgttccagcaaggtatgccccagcaccagcataacaatttccaaggcctgggcgctagtccacaattccagcagcatgtgatcaatcagctgctgcaagaagcccaagaataccaatagccgcactcttgctcagcagcagcagcagcagcagcagcaacaccatcagcagcagcagcagcagcagcagcaacaccatcaacagcagcagcagcagcagcagcaacatcaacagcagcagcagcagcagcaacatcagcagcagcagtctcctagcactcccaatgcaaatggtggtctcgcatccggagccgtggtcaccaacagcgctgctagcgcagagcaggcacagcacatgaataacggcacagcaaagggcgccgctccgatgggtatgacggggcctagtaatctgatcaacagcggagctggcatggtccagcgaagcagcagtttcaagtcggtaagcagcaacccggccgcttctggcggcaatgctgtggcgaccccaaaggcggagtctgtgcacgacatggacgacctggaacatctcatctcccacgaactcgtggagagcgggctgttcatgggggagcagccgggggacggtggcttctcgtggaatatctgacatcattgtcaactaatgtctcgctactctgagagctgtgtttgatgatgatatcgcagtagattattaaaaagtttttcctctttttcgagctcgcgttgtccgcctggaacagtctctggtgatcatagattgacgaactttcagttatgtgagagtgtgagttggtttggatagcagtgcaacccagtgttattaactaagtatggaatgacatgctgtggttgtcatcaaaaa

SEQ ID NO: 907 - DNA, 1108 bp, Triticum aestivum
  Clone ID: PAT_TA_907
tcggcacgagggccgccgccgccgccgcaccaccgctccccagctcgcggcccgcgagcttgcgccgcaacttcaccatgaagttgaacatcgcgaaccccaccacggggtgccagaagaaggtggagatcgatgacgacatgaagctgcggaacctctatgacaagaggatctcccaggaggtagttggtgatcttctgggtgaggaattcgagggctatatcttcaagatcatgggtggctgcgataagcagggcttcccaatgaagcaaggagtgttaactcctgggcgtgttcgccttctgcttcacaggggcacatcttgcttccgtggacatggcaggcgtgttggtgagcgccggaggaagtctgtccgtggttgcattgtcagccaagacctatctgttatcaacttggtgattgtcaagaagggcaagaatgatctgccaggcctgaccgacactgagaagcccaggatgaggggacccaagagggcttccaagatcaagaagctcttcaaccttggcaaggatgatgatgtacgccagtatgtcaacacataccgcaggtccttcacaaacaagaagggcaagaccgtgagcaaggctcccaagatccagcgtcttgtgacacccttgaccctccagaggaagcgcgcgagaatcgccgacaagaagaagaggattgcaaagaagaagtcagaggctgcagagtaccagaagctgcttgcacagaggcttaaggagcaaagagaccgccggagtgagagcatggccaagaggaggtccaagctttctgctgctaccaaggctcctgctgcctctgcttaagatgtttacagtctttcattagttggacaaaactaccctctactttcagctttcttgagttggtagtttattatattttgcatgaacatgggtatttatcggctggagtttgttactggaattctatgttagtttctactcaagtagagctgaaagcaataggtcttatcatctgtttgaaatgttctagtacttcaatttgctcatttattcctaatttatctgttgtatacagtttatattctgaatgaaatgtgtctcaggttaaaaaaaaaaaa

SEQ ID NO: 908 - DNA, 1113 bp, Triticum aestivum
  Clone ID: PAT_TA_908
cgggctgcaggcctcgagcaacgcgcgccgccgccgccgctccccagcgttcgggtcgctcgccgccggccagctcgcgccgcaactccgccatgaagttgaacatcgcgaaccccaccacggggtgccagaagaaggtcgagatcgatgacgaccagaagctgcggaacctttatgataagaggatctcccaggaggtagttggtgatcttcttggtgaggaattcaagggttatatcttcaagatcatgggtggatgtgataagcagggcttcccaatgaagcaaggagtgctaacttctgggcgtgtccgccttctgcttcacagaggcacaccttgcttccgtggttttggcaggcgtaatggtgagcgcaggaggaagtccgtccgtggttgcattgtcagccaagacctatcagttatcaacttggtgattgtcaagaagggtgagaatgatctgccaggccttaccgacactgagaagcccaggatgaggggacccaagagggcttccaagatcaagaagctcttcaaccttggcaaggatgatgatgtccgcagctatgtcaacacataccgcaggaccttccttaacaagaagggcaagaaggtgagcaaggcccccaagatccagcgtcttgtgactcccttgacactccagaggaagcgcgccagaatcgcagacaagaagaagaggatcgccaagaagaagtctgaggctgccgagtaccagaagctgcttgcacagaggctgaaggagcagagagaccgccggagcgagagcatggccaagaggaggtcgaagctgtctgctgccaccaaggcacctgctgcctctgcctaagatgtttacagtcttccgttattagttgtaatagcggaagaatttctcgcactttgttggatgatatgaatctagctgctactttcagcgtttgttgagttgtaattgatgctgttttgcgtgaacatgggtaccttaatcgtcaggagtttgttactgaatgaacaaaattgcgtgaacttggataattgatgcagttttgtgtgaacatggaatcttatcaagaggtactactaaagttctatggtggttcaaaaaaaaaaaaaaa

SEQ ID NO: 909 - DNA, 1426 bp, Triticum aestivum
  Clone ID: PAT_TA_909
cttcctcctcctcttcctcctccgattgggtggctgccattgctctccacaccatccaagctcgagctcccatttcatcaccactctgctagcccgagtctccctcttgacccaccgtcggtttcaggcctcgaaatcctcgtcccagtctctttctcctttcaagaagaatttctttgggttgagggagctgctgttcttcgtaggacaggctaggccagatctgggggagagggtgggttgttgttccgcttgaaatctctgggttttgttgcgctggaggttcttgctggccatggtttgtccaggcatgctgaggcgcaatctctgagctttatgaagatcgccactcacctgcgccggtgctgcttcctccagtccttctccgtcgtcttcctctactacttttatgtgatctcataattggccctctaaaatccgccgtcgctagcagtaaactattttctccttcttcttgttcttcttgcttccttttcctgcgtcaacaagtgataaataagaaccgtagcagcagcatcatcatcagcagcagtagtagccaagtactagtgattccggtgccaagatgtcgtcgtcgtcgctgtcgccgggaggcggaaggctgtcgggctcggacggcgactcgggggcgacgttcgcggccggggacaaccggcgggagaagaggcggctgtcgaaccgggagtcggcgcggcggtcgcggctgcggaagcagcagcacctggacgagctggtgcaggaggtggcgcgcctcaaggccgagaacgcgcgcgtgctggcgcgcgccaacgacatcaccgggcagttcgtgcgcgtggaccaggagaacacctgtgctccgggcgcgcgccgccgagctcggcgaccgggctgcgctccgtcaaccaggtgctccgcgtcgtcgaggagttcagcggcgtcgccatggacatccaggaggagtgcccgcctgacgaccccctgctccggccgtggcagaccccgtaccctgccaccgccatgcccatcgccgccaccgccacgcacatgctccagtactgatcgatccggtgatgattgggtcaataattgaggatcccctgtaggagctgagctgagctgtggctggcaagaggaagaagatctactctacttggctgctgccttgaggattattaccaaggcgtagtttgctgctatatgttgtgtttattatgtttcagtaagtgtccgtcgtcgtcctcctcctccgtgtcctatgtaatgtaacagtaataagggttaattatatgtatggttgtgttctatgtatcgtgaatttgtgataattctgttcaatgttattaccatgtcatgttattatgtttggttccaaaaaaaaaaaaaaaaaaaaaactcgagactagttctctcgctctctctctcc

SEQ ID NO: 910 - DNA, 1516 bp, Triticum aestivum
  unsure (1)..(1516): unsure at all n locations
  Clone ID: PAT_TA_910
gccggccgggttgggctcccccttcttcctcttcctcctccgacgattgggtggctgccattgctctccagagtccaggccaaccaagctcgagctcccatttcatcaccactctgctagctcgagtctccctcttgattccccgtctgtttctagtctcgcaatcgtcgtcccagtctctttctccgtccaataagaatttctttgggtcgagggagctgctgttcttgctaggctaggctagatctgggggggggaggctgggtcgttgttccgcttgaaatctctgggttttgctgcgctggaggttcttgctggccatggtttgtccaggcatgctgaggcgcaatctctgagctttatgaagatcgccactcacctgcgccggtgctgcttcctccagtccttctccgtcgtcttcctctactacttttatgtgatttcataattggccctctcaaatccgccgttgctagcagtaaactattttctttctcttcttcttcttcttctcgcttccttttcctgcttcaacaagtgataaataagaacggtagcagcatcatcatcatcagcagtagtagccaagcagtagtaatttcggtgccaagatgtcgtcgtcgtcgctgtcgccgggaggcgggaggctgtcgggctcggacggcgactcgggggcgacgttcgcggccggggacaaccggcgggagaagaggcggctgtcgaaccgggagtcggcgcggcggtcgcggctgcggaagcagcagcacctggacgagctggtgcaggaggtggcgcgcctcaaggccgagaacgcgcgcgtgctggcgcgcgccaacgacatcaccggccagttcgtgcgcgtggaccaggagaacaccgtgctccgggcgcgcgccgccgagctcggcgaccggctgcgctccgtcaaccaggtgctccgcgtcgtggaggagttcagcggcgtcgccatggacatccaggaggagtgcccgcccgacgaccccctgctacggccgtggcagatcccataccctgccaacgccatgcccatcgccgccaccgccacgcacatgctccagtactgatcgatccggtgatgattgggtcaataattgaggatcccctgtaggagatgagctgtggctggcaagaggaagaagatctaccctacttggctgctgccttgaggattattatcaaggcgtagtttgctgctatatgttgtgtttatttattagtatgtttcagtaagtgtccgtcgtcgtcctcctcctcctccatgtcctatgtaatgtaacagtaataagggttatgtatggttgtgctctatgtatcgtgaatttgtgataatttaatgttattactatgtcatgttattatgtttggtnccagtgttcagtgtagattctgctgtgttccaagtaataatcaaagtgtttgatcagattttacgaaaaaaaaaaaaaaaaaaactggngacacctcggccgcgaccacgttaatcattagtgaattc

SEQ ID NO: 911 - DNA, 1045 bp, Triticum aestivum
  Clone ID: PAT_TA_911
aacctaacgctcgcgccgccgccgccgccgccgcaccaccgctccccagctcgcgccccgcgagcttgcgccgcaacttcaccatgaagttgaacatcgcgaaccccaccacggggtgccagaagaaggtggagatcgatgacgacatgaagctgcggaacctttatgacaagaggatctctcaggaggtagttggtgatcttctgggtgaggaatttgagggctatattttcaagatcatgggtggctgcgataagcagggcttcccaatgaagcaaggagtgctaactcctgggcgtgttcgccttctgcttcacaggggcacatcttgcttccgtggacatggcaggcgtgttggtgagcgccggaggaagtctgtccgtggttgcattgtcagccaagacctatctgttatcaacttggtgattgtcaagaagggcaagaatgatctgccaggcctgaccgacactgagaagcccaggatgaggggacccaagagggcttccaagatcaagaagctcttcaaccttggcaaggatgatgatgtccgccagtatgtcaacacataccgcaggtccttcacaaacaagaaggggaagaccgtgagcaaggctcccaagatccagcgtcttgtgacacccttgaccctccagaggaagcgcgcgagaatcgccgacaagaagaagaggattgccaagaagaagtctgaggctgctgagtaccagaagctgcttgcacagaggttgaaggagcaaagagaccgccggagcgagagcatggccaagaggaggtcgaagctttctgctgctaccaaggctcctgctgcctctgcttaagatgtttacagtctttcattagttggacaaaactacccactacttccagctttcttgagttcgtagttgatgatattttgcgtgaacatgggtatttatcggctggagtttgttactgaaattctatgttcgtttctactcaagtagagctgtaagcaaccaagtattatcatccatttgaaatgtccagtactttaatttgctcaaaa

SEQ ID NO: 912 - DNA, 1122 bp, Triticum aestivum
  Clone ID: PAT_TA_912
ccaaaaccctacccctcgagcaaccgcgccgccgccgccgccgctccacccagcgttcggtttgctcgccgccggcgagctcgtgccgcgactccaccatgaagctgaacatcgcgaaccccaccacggggtgccagaagaaggtcgagatcgatgacgaccagaagctgcggaacctttatgacaagagaatctcccaggaggtagttggtgatcttctgggtgaggaattcaagggttatatcttcaagatcatgggtggctgcgataagcagggtttcccaatgaagcaaggagtgctaacttctgggcgtgtccgccttctgcttcacaggggcacaccttgcttccgtgggtttggcaggcgtaatggtgagcgcaggaggaagtccgtccgtggttgcattgtcagccaagacctgtctgttatcaacttggtgattgtcaagaagggtgagaatgatctgccaggccttaccgacactgagaagcccaggatgaggggacccaagagggcttccaagatcaagaagctcttcaaccttggcaaggatgatgatgtccgcagctatgtcaacacataccgcaggaccttccttaacaagaagggcaagaaggtgagcaaggctcccaagatccagcgtctcgtgactcccttgaccctccagaggaagcgtgccagaattgcagacaagaagaagaggatcgcgaagaagaagtcagaggctgcagagtaccaaaagctgcttgcacagaggctcaaggagcagagagaccgccgcagcgagagcatggccaagaggaggtcgaagctgtctgctgccaccaaggctcctgctgcctctgcttaagatggttacagtccttcgcactttgttggaaaaatctacccgcaactttcagttttcttgggttggtaattgatgcagttttgcgtgaacatgggtactttattgtcagaagttttgttactggagtagctttcttgggcttgtacctgatgcagtttaccatgaacatgatgagtactctattgtcatgagtttgccagagttgtatgttagtttctactcaatttgtcttaaaaaaaaaaaaaaaaaaaaaaaaaaaaaaaaaaactcg

SEQ ID NO: 913 - DNA, 1929 bp, Triticum aestivum
  Clone ID: PAT_TA_913
gccgcggcctcgaagagcgctggttttcccctcctgcacctggcctggagctcgccccgtttctcctccccacaccacactagcctctccccggtttttccccaaatccgacggactcgaggccaagcggaggcggagatggcgctgcggtgggcgctgcttagatcggcggagatctctcccggtcgcaaggctgcacttgagtacttgcattctctatcaaaggcacagcctactcgttctatctcatgtactggcctgcatcctgctggcagatcattcagcacccaggctgctactacatcaagcacaccacagcctccaccaccacccccacctccagagaagactcactttggtgaccttaaagatgaagatcgtattttcaccaacctctatggtcttcatgaccctttcctgaaaggtgcaatgaagagaggtgactggtatagaaccaaggatttagtgattaaaggggcagactggatagtgaatgaaatgaagaaatcaggtctacgagggcgcggaggtgcaggttttccgtctggcctcaaatggtccttcatgcccaaagtgtctgatggacgcccttcttatcttgttgttaatgctgatgagagtgaaccaggaacttgtaaagacagggaaatcatgcgtcatgacccccacaagcttctggaagggtgcctgattgctggagttggaatgagggcatcagctgcttacatctacattcgaggtgaatatgtgaatgagcgtctgaaccttgagaaagctcggcaggaagcatatgcatcaggacttcttggtaagaacgcttgcgggtcaggctatgattttgatgtacatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgcggaggtgtgagaggaggatgggacaacctgcttgcagttatccctggcggttcatctgttcctttgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgacgaagcagattgaaggccacacaatctgcgccctcggggatgctgcagcatggcctgtgcagggtcttatcaggcacttcaggcctgagctggaaaggaggatccgcgatcgagctgatagcgagctgctgatggcagcttctgcatgagcaccacttctgttttcctgattttattcacagaaataatgcaaaccggtgaagctcttctgtacaagcagatgtagcttaccttattggttcgaaccttttatgtccatgtttatttgatgcgctggtgaagccttgtgtgctttgatggagaagtagaaacgaatttgaaggattgtaccttgtatgttacatgagcctgtttttcttctttaataatgttataaagaatgactatcctcataatctgagtgaactcctaaaaaaaaaaaa

SEQ ID NO: 914 - DNA, 1111 bp, Triticum aestivum
  Clone ID: PAT_TA_914
cctacccctcgagcaaccgcgccgccgccgctccacccagcgttcgggttgctcgccgccggcgatctcgtgccgcgactccaccatgaagttgaacatcgcgaaccccaccacggggtgccagaagaaggtcgagatcgatgacgaccagaagctgcgcaacctttatgacaagagaatctcccaggaggtagttggtgatcttctgggtgaggaattcaagggttacatcttcaagatcatgggtggctgcgataagcagggtttcccgatgaagcaaggagtgctaacttctgggcgtgtccgccttctgcttcacaggggcacaccttgcttccgtggttttggcaggcgtaatggtgagcgcaggcggaaatccatccgtggttgcattgtcagccaagacctatctgttatcaacttggtcattgtcaagaagggtgagaatgatctgccaggccttactgacactgagaagcccaggatgaggggactcaagagggcttccaagatcaagaagctcttcaaccttggcaaggacgatgatgtccgcagctatgtcaacacgtaccgcaggaccttccttaacaagaagggcaagaaggtgagcaaggctcccaagatccagcgtcttgtgactcccttgaccctccagaggaagcgcgccagaatcgcagacaagaagaagaggattgccaagaagaagtccgaggctgcggagtaccagaagctgcttgcacaaaggctgaaggagcagagggaccgccggagtgagagcatggccaagaggaggtcgaagctttctgctgccaccaaggctcctgctgcctctgcttaagatggttacagtcctttgcactttgttggaaaaatctacccgctactttcagttttcttgggttggtaattgttgcaattttgcgtgaacatgggtactttatcattgtaagttttgttactggagtagctttcttgggtttgtacctgatgcagtttaccatgaacatgatgggtactctattgtcatgagtttgccagagttgtatgttagtttctactcaagtactcttatcggccatttaatctgctcgttaaaaaaaaaaaaaaaaaa

SEQ ID NO: 915 - DNA, 1183 bp, Triticum aestivum
  Clone ID: PAT_TA_915
taaccctcactaaagggaacaaaagctggagctccaccgcggtggcggccgctctagaactagtggatcccccgggctgcaggaattcggcaccaggccgccgccgccgccgctccacccagcgcccgggttgctcgccgccggcgagctcgtgccgcgactccaccatgaagctgaacatcgcgaaccccaccacggggtgccagaagaaggtcgagatcgatgacgaccagaagctgcggaacctttatgacaagagaatctcccaggaggtagttggtgatcttctgggtgaggaattcaagggttacatcttcaagatcatgggtggctgtgataagcagggcttcccaatgaagcaaggagtgctaacttctgggcgtgtccgccttctgcttcacaggggcacaccttgcttccgtgggtttggcaggcgcaacggtgagcgcaggaggaagtctgtccgtggttgcattgtcagccaagacctgtctgttatcaacttggtgattgtcaagaagggtgagaatgatctgccaggtctgaccgacactgagaagcccaggatgaggggacccaagagggcttccaagatcaagaagctcttcaaccttggcaaggatgatgatgtccgcagctatgtcaacacataccgcaggaccttccttaacaagaagggcaagaaggtgagcaaggctcccaagatccagcgtcttgtgactcccttgacccttcagaggaagcgcgccagaatcgcagacaagaagaagaggatcgccaagaagaagtcagaggctgccgagtaccagaagctgcttgcacagaggctgaaggagcagagggaccgccggagcgagagcatggccaagaggaggtcgaagctgtctgctgccaccaaggctcctgctgcctctgcttaagatggttacagtccttcgtactttgttggaaaaatctacccgctactttcagttttcttgggttggtaattgatgcagttttgcgtgaacatgcgtactttattatcggaagttttgttactggagtagttttcctgggtttgtacctgatgcaggttaccatgaacatgatgagtactctatcgttgtatgttggtttctactcaagtacttgccatttaatctgctcgttacttctgtattatttcccaatttaagtaatc

SEQ ID NO: 916 - DNA, 2014 bp, Triticum aestivum
  Clone ID: PAT_TA_916
catctccttaaaactggcaaaacccccctccacacacacacacccgcggcctcgaagagcgctggtcccctcctgcacctggcctggagctcgccccgtttctcctccccacaccacactagcctctccctggtttttccccaaatccgacggactcgaggccaagcggaggcggagatggcgctgcggtgggcgctgctcagatcggcggagatctctcccggtcgcaaggccgcacttgagtacttgcattctctatcaaaggcacagcctactcgttctatctcatgtgccggcctgcatcctgctggcagatcattcagcacccaggctgctactacatcaagcacaccacagcctccaccaccacccccacctccagagaagactcactttggtgaccttaaagatgaagatcgtattttcaccaacctctatggtcttcatgacccttttctgaaaggtgcaatgaagagaggtgactggtatagaaccaaggatttagtgattaaaggggcagactggatagtgaatgaaatgaagaaatcaggactacgagggcgtggaggtgcaggttttccttctggcctcaaatggtccttcatgcccaaagtgtctgatggacgtccttcttatcttgttgttaatgctgatgagagtgaaccaggaacttgtaaagacagggaaatcatgcgtcatgacccccacaagcttctggaagggtgcctgattgctggagttggtatgagggcatcagctgcttacatctacattagaggtgaatatgtgaatgagcgtctgaaccttgagaaagctcggcaggaagcacatgcatcaggacttcttggtaaaaacgcttgcgggtcaggctatgattttgatgtacatatacattttggtgccggtgcctacatttgtggtgaagagactgccctactggagagtcttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgtggaggtgtgagaggaggatgggataacctgcttgcagttatccctggcggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgaccaagcagattgaaggccacacgatctgtgccctcggggatgctgcagcatggcctgtgcagggtcttatcaggcacttcaggcctgagctggaaaggaggatccgtgatcgagctgatagcgagctgctgatggcagcttctgcatgagcaccacttctgttttcctgattttattcacagaaataatgcaaactggtgaagctcttctgtactagcagatgtagcttaccttattggtttgaaccttttatgtccatgttcatttgatgcgctgatgaagcctgcgtgctttgatggagaagtagaaacgaatatgaaggattgtaccctgtatgttacatgagcctgtttttcttctttaatgttaactatcctcataatctgagtgaactctaaaattatgtcggcatctgatggctaatgtttgcccaagttggtattaaaaatggattagtgggccccttcc

SEQ ID NO: 917 - DNA, 2202 bp, Triticum aestivum
  Clone ID: PAT_TA_917
agctggagctccaccgcggtggcggccgctctagaactagtggatcccccgggctgcaggaattcggcaccaggaccgtctctcctctctctctctctctccccctcaccaccacatcagcggggccacccccggcctcttcttccctgcatttgattgatccgtcgcttgcccggtcgcccgtcgatccgtttacccgcccgtccgcccgtccccggcagccgcagccgcaccgcagttgcaggtggactgcgaatgtcatcgatgcagttcagcagcgtgctgcccctgggagggcaaagcgtgcatctcccccgtcaggagagagggctccgcctccgagcgcctcaaggtcggggacagcaagcagcatcaggcacgagagggcctccaggaggatgtgcaacggtggcaggggccccgccgccaccggcgcgcagtgcgtgctcacctccgacgccagcccagcagacacccttgttctccggacgtccttccgcaaggaattacgccgatccgaacgaggtcgcggccgtcatactcggcggtggcaccgggactcagctcttccctctcacaagcacaagggccacacctgctgttcctattggaggatgttacaggctcatcgatattcccatgagcaactgcttcaatagtggcatcaacaagatattcgtcatgacgcagttcaactcggcctctcttaatcgtcacattcaccgcacctacctcggcgggggaatcaatttcactgatggatctgttgaggtattggccgcgacgcaaatgcccggggaggctgctggatggttccgcggaacagcggatgccgtcagaaaatttatctgggtgcttgaggactattataagaataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtggtccaattttctgagaagccaaagggtgacgatctggaagcgatgaaagtggacaccagttttctcaatttcgccatcgacgaccctgctaaatatccatacattgcttctatgggagtctatgtcttcaaaagagatgttctgctcaaccttctaaagtcaagatacgcagaactacatgactttgggtctgaaatcctcccgagagctctgcatgaccacaatgtacaggcttatgtcttcactgactactgggaggacattggaacaatcagatccttcttcgatgcgaacatgtccctctgcgagcagcccccaaagttcgagttttatgatcccaaaactcccttcttcacctcgcctcgatacttgccaccaacaaagtcagacaagtgcaggatcaaagaagcgatcattctgcacggctgcttcttgcgtgaatgcaaaatcgagcactccatcatcggcgttccttcacgcctaaactccggaagcgaactcaagaacgcgatgatgatgggtgcggattcgtacgagaccgaggatgagatctcgaggctgatgtccgagggcaaggtccccatcggcgtcggggagaacacaaagatcagcaactgcatcatcgacatgaacgcgaggataggaagggacgtggtcatctcaaacaaggagggagtgcaagaagccgacaggccggaggaggggtactacatcaggtccgggatcgtggtgatccagaagaacgcgaccatcaaggacggcaccgtcgtgtatagcaccgccgggtcggcgtgacgggttctgcgacaacctctgcgctgcgttgatcgtcgtcgtcgtctcgaggcccgggagggactgaagaagtgacccggggacgggaggcgtttgaagcttgaatgactgagaaggcgcgcgcgggcagcattagtagtaagtagtagtaaggagcagtggaacaaagtaatagtcgttcgtttttcccctgtaataaataagaggctgtgtgttgaggtaaagaagtggcagcgagcaaacaaactcccgggggatgttcgtgtaaataaaactctatctagacctgtgaaattttcagggggtttcttgtcaaaaaaaaaaaaaaaaataaaaaaaaaaaaaaaaaaaaaa

SEQ ID NO: 918 - DNA, 2356 bp, Triticum aestivum
  unsure (1)..(2356): unsure at all n locations
  Clone ID: PAT_TA_918
tcggcacgaggaccgtctctcctctcctctctctgccctcaccaccaccacatcgactagcggggccacccccggcctctgcctccctgcatttgattcatccgtcgcttgcccggtcgcccgtcgatccgttaacccgccgtccgtccgcccgtccccggcagccgcgccgcagttgcaggtggactgcgaatgtcatcgatgcagttcagcagcgtgctgcccctggagggcaaggcgtgcgtctcccccgtcaggagagagggctccgcctgcgagcagcctcaaggtcggcgacagcagcagcatcaggcacgacagggcctccaggaggatgtgcaacggcggcaggggcccccgccgccaccggcgcgcagtgcgtgctcacctccgacgccagcccggcagacacccttgttctccggacgtccttccggaggaattacgccgatccgaacgaggtggcggccgtcatactcggcggtggcaccgggactcagctcttcccactcacaagcacaagggccacacctgctgttcctattggaggatgttacaggctcatcgacattcccatgagcaactgcttcaacagtggcatcaacaagatattcgtcatgacccagttcaactcggcctcgcttaatcgccacattcaccgcacctacctcggcgggggaatcaatttcactgatggatccgttgaggtattggccgcgacgcaaatgcccggggaggctgctggatggttccgcggaacagcggacgcccgtcagaaaatttatctgggtgcttgaggactattataagaataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtggtccagttttctgagaagccaaagggtgacgatctggaagcgatgaaagtggacaccagttttctcaatttcgccatagacgatcctgctaaatatccatacattgcttctatgggagtctatgtcttcaaaagagatgttctgctcaaccttctaaagtcaagatatgcagaactacatgactttgggtctgagatcctcccgagagctctgcatgaccacaatgtacaggcttatgtcttcactgactactgggaggacattggaacaatcagatccttcttcgatgcaaacatggccctctgcgagcagcccccaaagttcgagttttatgatcccaaaactcccttcttcacctcgcctcgatacctgccaccaacaaagtcagacaagtgcaggatcaaagaagcgatcatttcgcacggctgcttcttgcgtgaatgcaaaatcgagcactccatcatcggcgttcgctcacgcctaaactccggaagcgagctcaagaatgcgatgatgatgggcgcggactcgtacgagaccgaagacgagatctcgaggctgatgtcggagggcaaggtccccatcggcgtcggggagaacacaaagatcaggtgagagagactgatctgtacctcaggaacgacacgtaccgttcggcgcaagtgccacattatctcttaacacgttttgcgtggatacgttgcagcaactgcatcatcgacatgaacgcgaggataggaagggacgtggtcatctcaaacaaggagggagtgcaagaagccgccgggccgggggaagggtactacatcaggtccgggatcgtggtgatccagaagaacgcgaccatcaaggacggcaccgtcgtgtagagcgccgccgggtcggcgcgacaacctctgtgctgcattgatcgtcgtcgttgtctcgaggccgggactgaagaagtgatcccgggacgggagacgtttgaagcttgaatgatcgagactgaaagagaaggcgcgcgcatgcagcattagtggtaaagtaagtagtaagtagcagtggaacaaagtaatagtcgtttttcccctgtactccctctgtaaacatatataagagcgtttagatcactactttaataatctaaatgctcttatatttctttacggagggagtaataaataagaggctgtgtgttgaggtaaagaagtggcagcgatcaaacaaactcccgggggatgttcgtgtaaataaaactctatctagacttgtgaaattttcaggggggttttcccgtcgtctctgtcggtcgacattgccactttcctctgacggtctttcatgtgatggttgctttatctantaagccgggaaacctacnttt

SEQ ID NO: 919 - DNA, 857 bp, Triticum aestivum
  Clone ID: PAT_TA_919
aaattcaaaagcgtgtggtttcattgttgtcttggtgactagcagcgcctcacgaagcactgggaggctttcccggccgcattgcttgccggcggccccggcgcaccgccagccttgtgcctcgctgcacgctggacaacagcttcgtgaggccccgtcgccttgctaggctcgccactcgcggctgcatcgctggccggcggtcccggcacgccgcccgctttgtgtacggccggttgcacgttggacgacagcttcggccttcggaatgcctgctccctgcccccacggcgcctgcaatcttggattctgcctccccaggggacgacgggaaggcagcctgcggcgacccatggactggatggacgacaacttggaagacgtgaaccctatcccgcgtggcgccttgacgctctcccagtctccctgccggatgaggcggcctgtcgtccggctctcgctctttctggcatcacatagcgtatagcagagcggagcgtgtgcgtggcgagctctccgctagcaccacgaaggtcctgcctgaacgacgctcttggctgtgtgccttgtgtgtgatgcttcctgaagaagctattgtgtgtgtgctagatcgtaggcatgcaccagcagtacgtcggcgcatggggccgctctccatcgactcctcgctgccgcatgagtaaggatggcaatgtatagggtacggggcgggtacaaccataccatacccgtgtagtcaatggatataaaattctacccatacttatacccacaggtaagaagctttacacatacccctaagggcacctacgggtatggaactttacacgtacccatatccgacgggtacccatacc

SEQ ID NO: 920 - DNA, 552 bp, Triticum aestivum
  Clone ID: PAT_TA_920
ggcccccctggccccagaaaccccgcagggggcccagaaaaagatgcgctgttcaccagtataaggcgcactgtaaaaaatatcccaaaagaggccccagcgcagttttatgtcgataatgtacttccaaggatcaaagagaaaaagataatgtctatcaaaccattcgtacgcgtccgggggtatgataatgttccaatgaagattaaccggctcagatgcagagttaattatcacgccttaaagtttctacctggcattgaagaaatggctgacaaactggcaacaaggatgcggaatcgaactgggagcgtaaatccatacatggctcttcatcttagattcgagaaaggaatggtgggtttatccttttgtgattttgctggaaccagagaggagaaagcaatgatggctgaatatagacagaaacaatggccaagacgcttcaagaatggatctcacctttggtcttgagcactggaaaagagaaaagaaggccgctgcccgcttgagcctgggaaaataggtttcattctgcgtgcaatgggatat

SEQ ID NO: 921 - DNA, 1003 bp, Triticum aestivum
  unsure (1)..(1003): unsure at all n locations
  Clone ID: PAT_TA_921
gnctagttctgctcgccgtcctcgcctgcgtcgccctcgccgcgctcgtctccgccccctccgtctggtcgcgcctcaacgcgccctacctgtgccgcaggatgggattcgtctccagtgccccggggtgagcaactctctgtgggagaatcctcatgccgccgccacgtcttggaagccgtgtgccgagcgcggcagcgatgagatctcagatcttgtgtcagagaatgaaacttctgggtatatttttattcatgccgagggaggattgaaccagcaacgaatagctatatgtaatgctgttgcaattgctaagataatgaacgccacacttattttgcctgtgctgaagcaggatcaaatatggaaagatcaaacgaaatttgaagatatcttcgatgtagatcattttataaattatttgaaggatgatgtccgcattgttcgagatattcctgactggttcacagaaaaagatgagctgttcaccagtataaggcgtactgtaaaaaatatcccaaaatatgcaccagcgcagttttatgtcgataatgtacttccaaggatcaaggagaaaaagataatgtctatcaaaccattcgttgatagattggggtatgataatgttccaatgaagattaaccggctcagatgcagagttaattatcacgccttaaagtttctacctggcattgaagaaatggctgacaagctggcaacaaggatgcggaatcgaactggcagtgtaaatccatacatggctcttcttctgggttccgtggaaggtatggcgggtggatccttttggcattttgctgcatccagccaggggagtgcactggcggccgaatgtagacccaacccttcgccaagccccctcatggtgacgggcccatatgcccgctctggacaatgattttagcctgaggagaataaggtcacagagtacagtagttacatatatttctcttgtatatatgcagaatggatctcacctttggtc

SEQ ID NO: 922 - DNA, 654 bp, Triticum aestivum
  Clone ID: PAT_TA_922
ggcaccagctaaactcctcccccggcgcgcccacgacgcaaccgctcccaatccatccatcaatcaatcaatcagccaatcgccagtgtttcccaaccgaaaccgcctaatccatccatcaatcctctgtctgcgccagcccgaattcctcccctcctccgatacgccccctctcccccatcgacaaatcctctgcccttcccctgcttcgcccttcatagccggaaagaagaggatagcctccgccggccgcctcttggtgctttgcttctagagcaggaaacgacgttcttggatcgtcctcgcgactctgccggcgagtgaaaaggaggagaatctttggtgtttggtcccgactctccctccggtcgtcgtttcgtttgccggcacgatgagtaatacgctgctccgaatctacccttccgagctcaacgatgccatttgagctcatggaagtcgaattcaggatgcatcgagcgcgttttgagctcaggaagtcgaattcaggatgcatcgagctcgtcaacaagaccgatcagcgtgtagctttcaaggtgaaaacaacgaacccaaaaaagtacgcggtgcggcctacctccggcatcgtgccgccagggggatcctgcggcatcacgattacgatgcaggcaccca

SEQ ID NO: 923 - DNA, 569 bp, Triticum aestivum
  unsure (1)..(569): unsure at all n locations
  Clone ID: PAT_TA_923
cccacgcgtccggctctgcgcactcgccgtcttcttgctcggcgcccgcacgtaccgctactacgcctccgacggcaagcagcggagcctgttcgctcgtgccggcgaggcttttggggcgtggcggagcagacggcggaagtcgagtccccttgcagtctccgattcgcatgaaggccgtcgacccgcaacacaggcgccggaatacagtgctcaggtcgacgaggaggagcagggagtggtgatcagaaacgcaagctcattggacggaaacatcggcgccggaaggctgttcccagatctgggcgacgtgcctgatctacgccgtggcgttctcccagtcgtccacgttcttcacgaagccgtcggcgacccttgaccggcacgtgggcaagcgggtccaggtgccaccggcttctctgagtccgtccacgttcatcacgaagcatgcggttcatgcccatctacgaccgcgccatcatgccgctcccgcgcgccgcccacgggcctctcctagagcatcaccaagctctcccagtcgggctccgcgcgcgcanccgctnaagntg

SEQ ID NO: 924 - DNA, 782 bp, Triticum aestivum
  unsure (1)..(782): unsure at all n locations
  Clone ID: PAT_TA_924
acnatttgggattggtccggcccccctaantgataanttcgtcttgcccgggattcataaaattcttattnanttccagcgcatcntttcccttgccagggntggtccggacctgctcggcggcgtggtgtggtcctgtccgcaaacgcatcgccctggccgccggccgttccctgcctggcgggtgggggttgccgccggttggggggccncctcgccgacccggacggccatctcatcaagctcaacctccgcaacatcgacttggaagacatgggctactaacattgaggagtacggacatgagtactaacatctacggatgacaactacagctaccccgtacaggagcagatcactgagttgtcggcaggcaagatgagctcttctttggctactttacaacacctgaggtatcttgacctgagctgaaatgacttcaacggcacaagcatccctgtcttcttgtcttctctcaagaacctaaggtatctcaacctctcgtcggcaggattcagtgggagaatacctgctcaacttggcaatctctcaaaattggaatatcttgatgtcagttggaattattattattattatggaaataagccttacataaaaaaaaatgcacntctctcnttgttgaggnatcttggacnttaagntatgtggatcttggntttgtgagggaatgggtttaaaggggtaaaaaaaaaaaaaaaaaaaacnccagggggggggccggtacccnattcccccctanaggngaggtcngnttaacgncg

SEQ ID NO: 925 - DNA, 1481 bp, Triticum aestivum
  Clone ID: PAT_TA_925
ggccttaaacaccagactttttttttttaaacaaaaattgcaccttacgatatcattttcaacaccaagtaaatattcacgacaaggggtatatacgcaaatcatcacccctgacagctcccacagcgaacccatatcccccgtgcatggagatggaccaagaacagggttgcacagcaggatcaaaacaaaggagaagaagatgggactctgttgagtagcaccgcaaggccacacaggttacaggcgagagctaccgactaagtaaaactgaggggaaacaatcaacaccacgccacgatatgacaccgccgagagtccagaaccaagggagagttttaggatcgatgagcgctgggtctgagggtttgcttcataggaacacgtcctgctcgagcagcttcaccacctcgtcctggttgttgagcttggccacctcgatgggggtcttcccgtccagattttggagcgtgacagcagcgccgtgcttcaagagaagatccacgcattccttccgaccgtatccagcggcatagtgcagtggggtgttcttgttcttatccagtgcgtcaactgcagcacctgcctccagaaggatttctgcacacttcaactcgccgtatccacatgcaaaatgtaaggcccttcttccctccacatcttcttcatccttgtttgctccaccatctaatgctttcttcagtccctctgcatcaccgacactggcggtgttatggacaatggactcatcatcatcctcgccttcttcatcagtttcttgaggtccagatagtacagtggaagtagcagcatctactgggaagttcaatgacatagcctggccaatcttttgaagaatctcagggtcattccagtacttcaccattgcagatggaccaccacgctctatctcatcaagaattggcttcaaagacggatcatccttgatacgggccattcgctcttcaagctgctctttgtgagctggactagtcaagttctcaagcatactggacattgcaggatcctgcataagagtattcccaagacgctccgccattgacataaactgaggattctgcataacttgtgtcatggtttccatgtatgcttgaggatccaaatttggaacaccctgttcccctgcaccctgcgcacttttctgaagctgctcagccatctggttgaatacagggtcgctggcgatttgctcagccatctcccttatagatggatcattgagcaagctgctcatgttggagaaatcaaaaggactgggcaggcctgcaccacctgttggggaagcccccttttttgcctcagacagcccctccgattttgaatctttgttctggtcggaagccatggcggatccgacgggggcgggcgggcggcggcgacgcggaggaggcttgcgagggagggaaggcagcagcggtgaagcggcgaagggtaggaggacgcgtgggcggacgcgtggg

SEQ ID NO: 926 - DNA, 1308 bp, Triticum aestivum
  unsure (1)..(1308): unsure at all n locations
  Clone ID: PAT_TA_926
gcagagagagaacgggacatcgaaagcaggaaggagaaacagctactgcggaatggccggtgagggggaggtgcaggtaatagagtcctgctttggaatggccggcgaggaggaggtgcaggtggtcgagtcctcgttcccacccccccccctcgtcccgcccagcagagccttccccccaccccccctcgtcctccgccgcccctgctccggcgacgcccccctcgtcctcgcctaccgccggccagcacccgccagcgccctcgtccccttcgtccccagggccggccccccctgggccgacgccctcggccccttctaccccctcgccggccgcgtgggcgctgccctcccccgctggctcacggtcgcctccaccggcaagggcttgctccgccttctggccctctcccgtcgttccaggggtgacgtcttcgtccccacaccgtcctcaacgcaaggaaggttgtttgttccccacgtcgacaactcagacggcctcttgtgggctgcacaggtgacatttttgaagtgtggtgggggtggtcttagccgcggcccacctcctcccggcatgggctgcttccgctgtggtccgcgactgggctgtggtgaagaccccctaccacgaccgcaacctcttgattgcgcgcaacccaccctttgtccatcccgacaccctctcccttttttgcctcaaggtaaacatgtcacagctgtcggggccagttgtgaacgaggttttcacccttggcaagggccaagtttccactctcaagcgcatctgcggtggcgacatgagcacctttagtgtcgtgagtgcccacatgtggcagtgcatgtgtttggcccggcggctaccgccgaactgcacgacgcgcctcgtgttcccggccaatgttcggcgcagtatgacgccgcctcttccggacggctacttcggcaacgcgataacatacgtaagtgttgccaacgtagcacggggcatcgcctcaggtgacctggcctacatagtgcgccggattagagacagcctcagccgggtggacgatgagctagtgcattctgcagtcgactacctcgagctagcaaagacggacaaccgccctgctacaggagtttgccagcgacagatatgagatggttantggcttggatccggtgtatgatgtggtttcagttggggaaaccattggctatttgcgtgctgatcaaaccgcggaggtattgcacctgattgacancggcatggggatggagcataccctatcagtgttttaaggttcattccaaggattaaacgttgtt

SEQ ID NO: 927 - DNA, 473 bp, Triticum aestivum
  Clone ID: PAT_TA_927
gttcttacagaacacttgacttctatacttccatgcaagtgtttattcataggagcaatttttgtcttctcaggtactgtacttcgtacgaaccccctgatttctttcaggctctgaaagtaagagctcctgaagatataccatgtcatgctattgtgctagtaggggctgtcaagaaaaagggcaagctctcttactatttcttgaatgcctggaagcggttctgtgctcgtaggagtgaggatggcacgttattggcctatggaataggaaaggtaaatgctaataggtcatataggaatgtcatcaaggtatcttgcttcaaggaagctccaaatgagaggagtttcacgcaaaacatgaaactgaacacagcattgcttgttggggacctgcctaagagggaacctaccttcaggtgaatgctgtctgtttgctactctagttgtgtttgctactgtagttgtctgtaa

SEQ ID NO: 928 - DNA, 609 bp, Triticum aestivum
  Clone ID: PAT_TA_928
gccggccggtccgggaaccccactgtaaacgcagctaaagaagacgctgttgaaaggatcaaggaaatcactggtgggagaggtgtggatgtcgctgtggaggcacttggcaaggcattaacattttcccagtgcacccaaagtgtacgagatggaggtaaagctgttatgatcgggcttgctgcaacaaacgtagtaggcgaggtggatataacccgtcttgttcgccgacaggtcaaaatcattggctcgtatggtgcaagagccaggcaagatcttcctcagatagtcaagcttgctgagagcggcgccttcaatctcgagaacgccatatcaaggaaatgcaaattcgaagaggcgaacggcgcctatgaggatctcaaccagggcaagatcgttggccgagctgtagttgaaatcatgtagtgctgactgcaagatgatcatgtggtcgaaagtctgggtcaaacaaataagaatatgccgcggcaaccccgcgaactcggtttgtcttgcagcatggtctcgctccctggtttgtgttggatgcaaaaaattgttgattgaaagattgttgtgctcaaaaaaaaaaaaaaaaaaaggccccta

SEQ ID NO: 929 - DNA, 1585 bp, Triticum aestivum
  Clone ID: PAT_TA_929
ccccgcccccaagttgcagttggtggtgttgcagagttccgttggcaggcacaccatgtccctctccaccgcctcccgccgcgccctcagccggatcggtggcgccctccggcggtccttctcgtcgtcgtcggtgccggacgcctcggggtaccacgtgtccggtgggccgagcttcatgcgcgcggccgtgttctgggagcccggccgcccgctcaccatggaggagttccgcatgccgcgccccaaggccggcgaggtcctcgtcaagaccaaagcttgtggagtctgccactctgatctccatgtcatgaaaggcgaactccctttcgccatcccttgtgttgttagatctgagatcaccggggaggttgacgaccatggcatggacacgcccggagagattgttaaggttttcaatcgtgggcaatcatgttgttggagccttcataatccccggggggattggtttttattgtgggaagggccaggaagccttctttgagtttttttttgagaaaattgttgctaaagagaacactatactatggtaaaacccgactatttctacgcagcaacggaaaaccagtgtacatgtacagtatgggcgggcttgcggagtactgtgttgtgccggccaatgcactagcaattcttcctaactcgtgcccgtacacagagtcagccattctaggatgtgctgtgttcaccgcctatggcgctttgaggcatgctgctgaaatgcgtgccggtgattcagtagcagtgattggggttggcgggggtggatcaagctcattacagatagcaagagccgttggagcggcctcaatcatcatggtagttgttctcgatgatgataaccccaagatgcaaaaactcggggcgcccccccccgtaaacgcagctaaggaacccgctgttgggtcgagcgaggtacgccccggtgggggatgtccggtgggcgacttggaggcatgatgcctcccagcaccagctgcccagtgcacccaacccgcaactcgcccgcgggacttttttctgggtgggatcgctgcaccaagtgtagtaggcgcggtggatataacccgtcttgttcgccgacaggtcaaaatcatcggctcgtatggtgcaggagccaggcaagatcttcctcagatagtcaagcttgctgggagcggcgccttccatcgcgaaaacgccatatcaaggaaatgcaaattcgaagaggcgaacagcgcctatgaggatctcaaccagggcaagatcgttggccgagctgtagttgaaatcatgtagtgctgacaagatgatcatgtggtcgaaagtctgggtcaaacaaataagaatatgccgcgacaaccctgcgaactcggtttgtcttgcagcatggtctcactccctgatttgtgttggatgcaaaaaattgttgattgaaagattgttgtgctcacaaggaaatggctatctcagtttgttcttctttccatcacatactgtgaatattgggtatacactttgcttatacatcaaaaaaaaaaaaaaaaaaaaaaaaaaaaaaaaaaaaaaaaaaaaaaaaaaactc

SEQ ID NO: 930 - DNA, 684 bp, Triticum aestivum
  Clone ID: PAT_TA_930
cccacgcgtccgaacatactcaattcacaggtgcataaccaactcacaggtcgcgcaggacgaaaggaattgcaccggtgcgatcttcgtgtctgtccaccatggcggcgagtagtcaaactgaggagagcatgatgaactacgattctccggcgtgcggcggcgacgcggcagacacggtcatcgaggacctccccacggacgtgctgtccctcatgctccgccggctcgacggcgcgtcgctggcggcgctcggctgcgcgagctccagcttccacgacctcgccaccgaccccgacacatggcgcggactctgcctcgccctgtggccatcggtcgccggcctcctcgacaattcttgctgccgcggaaccggcgacggctttcaccgggcgctcttcgccgacgcgttcccgttcccagcgacgacggcggcggccccgggcacggtcgcgcccgccctgcctagccggctcgtgtccgcggtggacctgcaccacaagggggtctgcatcatgtcgcgcgtggtggagacggacgcctcgtcggcgtggttcctgggctcgccgttccgcgtcgacgcgcttctgcaggagggcttctcggcggcgtcctcgatcacgccggcggagctcacgctgagctggcttctgctcgacccgacgtcagcccgggtggtcaacg

SEQ ID NO: 931 - DNA, 498 bp, Triticum aestivum
  Clone ID: PAT_TA_931
cccacgcgtccggcctcgcctcgcctcccctcccctcccctcctccgccgcctttctaccccactttccaggcgccggcttgtcagatccgggcgccagcttcagggaaacgcttgtaggattagttctcgtaccgacgacggccctagatgtgaaatttgtacgggtggcacacaaaattacaatccattttggtggtgcaggtttgctgaagagtgatgaccaggaggcaatgtggcgtggggcaatgatgctcagtgagaatgcgaagaacatgatgtgtatctgtgctgctgctcaagatgatggtgcgatggactgaagcttgcactgatgtatttccgttatttattaatgaaaaggggcgatgtgcggttcaaaaaaaaagtattaacattgctgatgtaaggatggtcggcacatctgcgggtgaaacgtgactaatatatatcctgtgtgtttgagctgagaactcaccttgctccgttaaaaaaaaaa

SEQ ID NO: 932 - DNA, 1322 bp, Triticum aestivum
  unsure (1)..(1322): unsure at all n locations
  Clone ID: PAT_TA_932
ccatcctttgcttctgcttgaagtggtactctaaaattcgttttgttttggcgttacaagttggtggatcttaaacttacccatagttacaaaatagtgcagtgagtctcacaggtggttgtgtaatagtcagttgtgctggtttttcaatttgagtacgagaagtggtactctggtattaactgccttttcaaatcacgttacttctttttagatttgagttttccctttcgtgtcatgatggttctgtacctaggtctcgccaatggttgtgagtggatgcataaatataaccactttttgatcggtatatcaaatccatgggctgttgtgaagcttgcatgtatttatttcttctggtgtagcttcacaaattcctatcacattggtttgcgccctaccttgggtttctctgttttggatgtgccttgttcttttccttgttctttctttgcttgctgatctagcttttcactttccattttttcacagaaaaagggcttggttaaagcataaggacaatgatcccgttttttctctataggcctccccttcttcaaatgaagctccaaccttagcaagggtatggtagtagatgatgtatctgttttgtttgtgtcgacagacaagcggttggttgattctgtatacacatcctgcaaactaagcttagcaaatagcaataaagcttcaacaagtgtgttcgctgtcatctccctttgaaacaatgtatcatattctggttttctaatatgtattgtacaacatatgactatccaaattattctctgtagataactacacgcttatctacttgtcgtaccaaaatggttcgtctttatcaaaatccatgtttccttgttccttcctatatctcagttttagtattgtattgcttttgttttcggcagtcacctgcctatttgtatgagagatttgttattgacctaaggccaagtgtatcactatctatttatcatccttggtgttggtatccagacgatgagtatgatgatgccattgattcacatgatgatcttggtgatgagtatgatgatgccactcatatgttggtgtgaggaaacttggtgatggtattggtgagagcgtagagaaggaagtgaaggttccctttgagagaaagatgaaagattagtggttccattcaattccagatgtaacacgtgtgtatgaatcatggtgttatcttagatatgcttggttgatattttcttcttctattttcaccatancatttatgtagaacccatttaagagagccatatgaggaaaggggaaaactgattacataaatctatcta

SEQ ID NO: 933 - DNA, 1125 bp, Triticum aestivum
  unsure (1)..(1125): unsure at all n locations
  Clone ID: PAT_TA_933
ccggcacgacgtccaggcgcagcaatggtggcaatcatggtggagaggtgggcggggttcgggtcggcgacggcgaccgtcatctttctctggcccgtggtgcagaaatacgtaccccccaccttccgcctctatctcaccgcctgggccgccaagctcgccgcctgcttcaacccctacctgcagatcaccatctccgagtacggcgcggagcgcttccagcgcagcgacttcttcctcgccgtcgaggcctacctcagcgaggcatgcacccgccgcgcacgcaagctcaaggctgaactcgtcaaggacagcaagaacctccgggtcaccgtcgacgaccacgacgaggtcactgacgacttctccggcacgaccatctggtggtacgcctccaagcggcagtccaaggcccaagtcatcagcttctaccccggcgaggacgagcggcgcttctaccaggtcgtcttccacaggcgccaccgcgaccttgtcgtcgactcctacctgcccttcgtgctcggcgagggtcgcgccgtcaccgtcaagaaccgccagcgccgtctcttcaccaacaacgccagccgcaactggaacccctaccgcagcaagagcgtctggagccacgtccccttcgagcaccccgccaccttcgacacgctcgccatgcaccccgatgagaaggaggccatcgttgacgacctcatggcgttccaggagagcaaggactactatgcaaaggtcggcaaggcgtggaagcgcgggtacctcctttatggaccgcccggcaccggcaatccaccatgatcgccgccatggccaacttccttgactacgtcgcccacgcgcgcggggccggcgccatcgcgcccttgtgagcctatcgccgcctcgtggcggcgcgacagctccggcccggacccctcgcgtccgctggcgctcgcnagtcccctccggtgcgacactctcccnaacgctcctcgtaggtcccccttggctcggcccacaaggaccggaggctccgcatctctacaactgtcaagacttaaatttctgtttactataactcacttagatagctattactttngcaagttggtttccgtggtangacgcangtaaaat

SEQ ID NO: 934 - DNA, 1040 bp, Triticum aestivum
  Clone ID: PAT_TA_934
attcggcacgaggcaggggcggatcgcacgcgaccgcgacggtgattgggatttttttcctccatcctcccattccccgttcccactccactcctcactacgccggcgacgagcgaaaccccaattccccacgaaatccctacggcttcgcggcgagctagccggcgacgagtcaattgacggagaaaggtgacgcgcccagcgaaggatcccgcccagcatccgacgggtgagggcggcacgcgcgtgccggagaaggaggagaaggaagtggcgatggggaaggagaagaaggaagcgacacgaagctctgcgcgaagcgggggacgacccggagacgcgagatcctgctgattcgacgcctcgaggaaaaaaccaaaattgaaaaactaggggggagggcatctttttcagtatccctggagtggcagtttttaagatggatgactacccatatcaacagaatggcgagggtgcagcaagaaccgacgcggcggccaggaacaaagatgtgggtttacaagtccgtaggcgaccaagaaataatcaggttcagtctgggcaaaggcatgggacaacaaacgcatagggaaagtcacaaaagctgacaaaaaaccagagggtggatacggcaagcttcccaagaaaggtgcaagacaatagtcaagaaacaattcaagagccagcaactttatctagcatcatggttgtacaggaggcaagaacagggagatcagatttggggcaaagattcaagtcagccttgcaacattttttggctacatggaggcaaatctgcaagtagtatagcaatggggggtaggtacatctgaggagttcaactagctatagtagaactaaaaagtatctcatggtcaaaaaaattccaacgaccctgttacctttctggcagtttgcccagttctggcaatttttttgcccacattttcttcagattgttgcctgatcagcacaaagagttgcagagaaagattgttgactgatcagcacaaagagttgcagagaaggttgtgttcttc

SEQ ID NO: 935 - DNA, 350 bp, Triticum aestivum
  unsure (1)..(350): unsure at all n locations
  Clone ID: PAT_TA_935
cccacgcgtccggacgagctagctagagacgctccaagtcaagctaccaaggcgcggagaattctccgggttcacgtacgtagcatagcaggctaggtgtctcgccggccatggcgacgccgcaggaggtgcgcagggtcgactcgttctcgcagctgccgttcatccggccggcggtggcgcagcagcagcagcagcaggcgagggagaccatccggctcttcggccgcgagnnttctccaacaacgacgccctgctgcagcagcagcagcgcaagcaggaggccggcgccggctccccggacgccgccaacgggagcaccgtcacgtccgagggcaacggcggcggcg

SEQ ID NO: 936 - DNA, 621 bp, Triticum aestivum
  Clone ID: PAT_TA_936
cgtccgggcgacacggcccacgcgtccgcccacgcgtccgctcccctccctcccctcccccgcggctgccatggcggccacgctcctccgccgggcgctccagctccgccgcgccctcccctctccagcttccttgcgcaccctcctccccgcggcctccagccgcctcctctccgtcaccgcctccacccagcagaacaccgccggcaccgccatcgacctctccaacgacgagagccgccgccgcctagtcaacagtctgatgtacaggagcaagcagaggggcttcctggagctggacctggtgctcgggacctgggtggagcagcacgtccgctccatggacgaggccaacatccgctccctgctccagatcctcgacctcgagaacccagacttgtggaaatggcttactggtcaagagcaaccgccagagactgtaaactctaatcctgtatttgctgccattaagtcgaaggtgacggataacctgagcaagcactcttccccagagacccggtcagcgcctggccagccttgggtgagagggtgggatgacaaggacaagaggggtctggatggacccaagtacggaaaccagtgataaggtgcttgaaacca

SEQ ID NO: 937 - DNA, 1114 bp, Triticum aestivum
  Clone ID: PAT_TA_937
gtacgccggcacggaccggtacttcccggccggacccacgcgtccgcccacgcgtacgtcgagccggaatggggagaggcgacacggcccaccagccagccacgccgctccctccccgcttcgcgatcccctcccttcctccccctcccccgcggctgccatggcggccacgctcctccgccgggcgctccagctccgccgcgccctcccctctccagcttccttgcgcaccctcctccccgcggcctccagccgcctcctctccgtcaccgcctccacccagcagaacaccgccggcaccgccatcgacctctccaacgacgagagccgccgccgcctcgtcaacagtctgatgtacaggagcaagcagaggggcttcctggagctggtacctgggtgctcgggacctgggctggagcagcacgtccgctccactgggacgaggccaacatccgctccctgctccacgttcgcttcaaccgcgagaaacccaaagacttgttgccagatggcttactggttcgacctccaagccgcaagactactgtgaaactcttaatccgtgtaattgctgacacttcagtgactggaggaaatctgaataaccttgagcaagcactctttccccagaagacccggtcatgacgcctggccagccttgggctgagaggaggtgggatgacaatggacaagaggggtctggagtgggacccaacgtacggaaaaccagtgataaggtgcttgaaaccattatcgcagtcctaaaagctcagcttgttatcctcggtgtgtatgatgcttgtgtaaataaagcaagtcatggttagtgacgcgctatgatttgtattggtatttgatttgtgctagaaataaggtttcacttgttcccgtcgagggaaacgtgttgactgtagtggtactgtgcagccaaatgtatctccatgttcaagatcggaattaactatgtatgcacaaatcactggcgcattttctctcaattcagaaattactatgtaattatcatttaattaaataactgtgatgaatgtgttaccaagaactttaggcctaaaaaaaaaaaaaaaacgctcttctcaattttctccccctttat

SEQ ID NO: 938 - DNA, 653 bp, Triticum aestivum
  unsure (1)..(653): unsure at all n locations
  Clone ID: PAT_TA_938
tgcgcccacgcgtccgcagcttgttcggcagcggcatgcccaacagccgcgacctcgaccacctgctcgcccgcagccccgttctcgacaccctcgccatcgtattcagcatgatgttcgagcgcgtccacctccgcagccagagcctcaagtgcgtgctcctccggcgttgcttagtggaggaggtcgccgtcttgaactccccgctcctggagcgcctcgttatgtggaaactcgtcgtcagtgaagacgattcggtggctgtgacggtcaagattgctgctgcgcccaagctgcgggtgctcggctacctagagccaagaattcaccagctgcagattggcgacaatgtcatcaagcctgacacgaaggtgagcccaagcaccatggttccgagtgtcaagattctggccttgaaggtgaactttggtgtctttgaggaggtcagcatgctggccagcttcctcagatgcttccccaacgtcgaaacgctgcacatcgaggtcggtcataaccgatgaacccactggaaggcaccatgccaggttctggcgagagctccgtcctatcanatgcctgaagtcgcatgtcaagaagatgatgatccctgaatttcgggggggagcaaagcgaaatcaacttcctgaagttcg

SEQ ID NO: 939 - DNA, 855 bp, Triticum aestivum
  Clone ID: PAT_TA_939
cacagcgccaactctcagtccacctcggaattctaccgcacaaagggccgagctgaggaggttgcccgcagccttttccccgagaccactatcgtccgccctgccccgatcttcggttttgaagacaacctcctgttgaagctagctggtgtcactaacctttttacttccaataacatgcaagagaagttctaccctgttcactcaattgatatcggtgctgctcttgagaagatcttctttgacgacaccactgcaggacagaccttcgagctttacggtcctaagaagtacagcatggaggagatttctgtcatggttgacaaggagatttacaagcagcgacgacacctcaacgtgccgaaggctatcttgaagcctgtcgctgagctgctgaacaaggtgctttggtggcacactatgtcggctgatgaggtcgagagagagttcttggaccaggtcatcgatcccaaggccaagacgtttaaggacctcggcatcgagcctggtgacattatcaacttcacctaccactatctgcaaggattccgaaggcagaacttctacgatctcccccctgcgacagagaaggagaagcgggaagagaagaagtacatccacgttctggatgaattgtaaagaaaaggaatccaatttttgcgtgccatggatgctgcaaaggcagttggtgatcaagggctaagcggacagggataatagtccgtgtatataggaccgcataaactagaggtgtgcgagatccaacaattgcacaggttttctttggattgaaagcatatcaaataattgaagttcaggaagttagtccaaaaaaaaaaaaaaaaaaggccccta

SEQ ID NO: 940 - DNA, 926 bp, Triticum aestivum
  Clone ID: PAT_TA_940
ttcctgttactatacccccgtttacattcactcatttttgtaaattgtttgtcgtttgttctcggtgatgatcaacactgattagatgtccgatacaatccattccttaaaccatggggacaatacgaggcatttgtctgagagaacatcccttgttcatcgctttttctgtgaagctgacgtgtttttgcatcttcccctgttttccgtagctcttggttctctgtgatgatgaaaacagatgacgagtctgatgtaatccattctattaaaccgtgtggacaatcgaggcatttgtctgagggaacatttgcttagtcaaattctttgcttgcgttaaagttattttggtaggatttgtgttgctggcatgatgaggaatacaattgttgtcggatctatttgatgataaaatcctcctactcattctgaatgtcaagtcgcagcaaatatcgttttcttttatcaaaccatgcaaatatggttttctaatgaaactcttacacctgtggttctctctttgttgcacatgtgctgaaggttttgtgccaacacatacgaaaggcatggcgtgatcataatttttgactactgaagtaaaatgtttagtaaaatttgcagatattatgtaacctaaatgaaccaacgaaagtgaaaccaaaacgcagttcttggtaccttccgcccagaagttgcaaggaatgcaacgaagactccacagagcaaaacactagtggccagattgttgtaaaaaacaacatgacaggcttctccatgaatcaagttctgaacattttgttaattttttttggtaacaccgaattggactgtgaggacccggcgtttatgcacattgatgctggagaaggaccttctaccaggcctgacaatcttcatcaaacatgatgggatttagcaaagttcag

SEQ ID NO: 941 - DNA, 729 bp, Triticum aestivum
  Clone ID: PAT_TA_941
atttctttataaaagttatgttggacacttatcttctctttacttatcgtttcgtgggactacgaaaaagttcatctgtgtgtaactacaaggttctcgaagtccgccctctcattgacagggtgaaagttgtggaatttttgctttaactgtctggagtaagatgacaggacatacaaagatgcattcaaggtaagctcaagtgaaattaggtgtgcacaagacaattctttcaagttgcgacctacattgtggtgtctccgttcatcaagttctgagcaccagctccagtgaaattagatgttcatccagccatactcctaggtggatttctttggcctgcttattattgtgtatttagtggttatgcacatgcctcatcatctgatatttctgcagtagttactgaaagcaatctgaggacaaagctttgattgttgttgtagttgaagattcagagttgcaaggcaggcacagttaacagggataagaaactatagaagatttatcaaatcagacatgggcttggttatgcactgaatcattgtgggggatctgaggtaatcagaccatacacccaaacttaaaattttacttgctttttaaatgtttaggaggcagaatgatgtttgatatgctagactgaagtacacaccttttaagagtatatcactgatactctagtcaccaataaaaatggaagtgctgaaaattactttgtaaggaaac

SEQ ID NO: 942 - DNA, 868 bp, Triticum aestivum
  unsure (1)..(868): unsure at all n locations
  Clone ID: PAT_TA_942
ccacgacgcaggcaggcaggcaagaagtggtagcaccgcactagcgcactccgtccaccccggcagtccactcccagcgccgcccgtcccgcgaccgccgccgccgccgccttcggggaagaccgggatggccgagaagccggcgggcccggcctccaggtccaggatccggggcgggctcgccccctccgcgccctcctccaggagggtggtctcgatggcctacacggcggctccgcatcaggccaagaaggttcctgagccgaaggttgtgaagccaacaagaaccacgccggccaagaggcggcagcagctggatcaggcgcagaagcagagggaagagctcgctgcgttgcaggagcagcttggtggcttgcaggggaaactgcttgagaaagacgaagctctgaggtccgcaagagaacttgattggccggatcagtgttgcgaacgaagaggtggatgaattgagaagccagcttaatgataaggaatcgcttgttgagtctactggctccgagctgcatggcgcaaagattatgttggcaggagaagcaagcagcattggagaagctagaatgggaggcaaagatgtcaagtacaaaagttgaagaacttgaagtggatgttgcctccatggatgttgaattccccgccttgatggnattcaggaaatacagagacaacgactccatcccacgggaatntgacgatcaccttggaattgacatnaactgatatacgtagtgtatgtacgggaaaatggcaagaattacctagnacggtcacacccaagnaaccacgngattctaagatactagnagtaacccacgtttcccactacgaaaattncagccctcatccaaan

SEQ ID NO: 943 - DNA, 753 bp, Triticum aestivum
  unsure (1)..(753): unsure at all n locations
  Clone ID: PAT_TA_943
cggacgcgtgggatcatttctcgaggaatgtacggatttctcaaagtgacgcaatgctatgatcttcaaccatgaaaacgaaactgtcagcgctgatggcctgctcctgtgatctcatagcattgtgtcaaggagcaggtggagagggagaaagagaaagggagaatggaagccaagtgatagacaaagagagtgaaagcttttgttgaattctcatggttggagatactgcaagaattctgattcggcacggccctcatggagacaatggagatggtgttcagcggtgcgctcagccagagtttgcctcttctgcaatacgtccgacatttgctgattcggcagggcccctcatggaaacaaattcagggcgcagagaaactaatggagcaaccaggagtcccaatcatttgaaggcagaacattgaacatatcagtgatcggacactcgagacaactcttaatgagttcttagcaaccgaagacagaatatttgcgtaggatgcaacaaagcttgcatgtcatgagattattgaatgcgttgagtaatttggaatggaaacatttttggttaaataggatgctcttgagattatttctcatgccaacatggcatgcccgagcgaaaaatgtgccaccctttgacaggaccatgccttgttagaggaggtttctggttggataaatgagaaggccatgatgcctatttggnctaagatgactcctaacattgtaggtattacagatggaacn

SEQ ID NO: 944 - DNA, 775 bp, Triticum aestivum
  Clone ID: PAT_TA_944
ggacggcttcgaccccatgaggtacctcaggatcgtcaggaaggaggggctcgagatctcgcagccggcgctggaccaccggtcgcagatccaccaccggctcacggcccgcgcgcgccacggcgggacggtgcaccggcggttctacaagacggccggaggcgggaggtgctacggcaacagcacggggccgccgtgcacggggtgggtggagatgatggtgccggtgttctcgcgggcggcgtggcggtgcgcgtggcggatgatccagaacgacctcgtcttcgcctgggggctcgacttcaagctcgggtactgcgcgcagggcgaccggagcacgaacgtcggcatcgtcgacagcgagtacgtgctccaccgcggcatccccacgctgggtgacggcggcggcaaggggcccgcgccgaaggcgaaggcgtcgtcggcaacgtcggcggacaggtatgcagtgcggctgcgatcgtataaggagctgcagatattcaacaagaggtggaaggaggcggtggcggaggacatgtgctggacggacccctacccgcagccgccgacgccgacgcccaagggatgacccacggtgcccgccgccggcgatgtcctttgcggttgagtagatgacatagaagatacatcaaaatttacaggtctagagagcttcagataacatgtcatgtacagatctctttctccccggtcaataagataggttcaaagacgatgtaattatcataattttcggtaaaaaggtggattaatg

SEQ ID NO: 945 - DNA, 654 bp, Triticum aestivum
  unsure (1)..(654): unsure at all n locations
  Clone ID: PAT_TA_945
gcatttcttttggtctaggacaaagggtatgtggaagactggatttgatattatcatggaatgatagctattagcgtgttcctggctctcgtttgctgttattccttcataattgcaacaaagtgagtattgtaggctcagagagaaattttttgaattttgtagcctgcatctttattttcttcctcaacaattcatgatgtaccatgtagtaattttgatttttcattcagatgttattttctttacaaatccgcaagcaacacacaattcatgtttgttgttttagtcttgctaattcttgacacgttcccatgtttgttctgtgagagagctcctgatgtcgtatctatgctcattcttaaaagatacttgtttggttgattgctttatgaagaaagtagaccattttagatcgaagatatggatttatgacaacttcgagatgagtttggctgatgatgaaactttcaaattaatgacagtttgatttagcatgtggttaggttatgctcttatgaaatgaatgttcttctgtaataccagtttcaagtacttttgattgataatattgaggatatgtagataagacaaatgttttctatgaagaaaaaaaagggatgcanatacatatcttgctctggcgtggcctaa

SEQ ID NO: 946 - DNA, 1318 bp, Triticum aestivum
  Clone ID: PAT_TA_946
cggacatgctgttccgcacacatccgagcggctctcccacaacaaaagttagttacactatcacttcctctgcggtggcccctgatggcactgaagctatcgttggtgctcaagaagggaaactgcggatctataccatcggtggggatactgttacagaagaagcggtacttgaaaaacaccggggtcctattactaccatacattattcgccggatgtttccatgttttgttctgctgattccaacagggaagctgttgcatgggatcgggcaactagagaggtgaagctgaagaacatgctgttccacacagctcgggtaaactgcctggcctggtcacccgacagccgtttcgtcgccacgggctcgctggacaccggcgcgatcatatacggcgtacaccagcaagcggccaaccgcaccactatccagccagctcatcgcggcgggttccacgggatctgctatcctgacgatgacactgtgatgagtcacttcgacaacgcgtgcatgcgtgtctggaaactggtctcatcagtaggcgctcaggctcctcccgatttatttgttgccatggacgcgaaactgcggaaacatcgctatggtcggccgctggttccctgtttcccgcaggccgcggtggcggcgctttctagcctgtgttttttttttctgtgtgatgtgattctttcgtgtgcgccaggaagaaagaaccctactgtcatcgtttccttcccacgcatcgtctggttttgtggggtgctgagaatacagggggtgatggtgtgttgtgagtgttttgtcccgtctgccgtttcgtggcctcggggtcgctggacacctgcgcgatcatctacgacgtagacaagccagcggccagccgcaccaccatcaagggagcgcacctcggcggggtccacgggatctccttcgccgacaacgacaccctggtgaccgccggcgaggacgcatgcatccgcgtctggaaactgacgcaccagtaggcgctctcatcggtcgctgttttccgcgggccgcgctgtctagtctgttttttttctctctctctgtgatgtgattctttcgtgtgctcctggaagaaagaaccctactgtcatcgtttccttcccacgcgtcgtcgtctggttttgtggggtgctgagaatacaggggatgctggcgtgttgtgatatctttgtctctgtgctcttctccctggagtggttatattttttttcctgtgtttgccccctgcactggctgtcaataactgagacaatatctgtacttgcgttttcataaatcatcatacgcat

SEQ ID NO: 947 - DNA, 514 bp, Triticum aestivum
  Clone ID: PAT_TA_947
aacgccgggcggaagaggagcagcatgcagggtgaggtcgagaaccagctccctgctgccgccgccgccgtggcgaggaagaggagcctgcagggcggcgaggtgaggtcgaagagggcgtcgatcccggcgaggccttggacgtcggcggctgctgctgcgcagaaggtggtggtggctcctggttccaggatgaccaggcagcagcagcagcaggcggcggcgagcagcaacaagaccaaggggtgggtgaggtgaggtaggctgcgagcgtttaggtgcgtgtgttgtagtagatgagatgagatgagatgagatgagatgagacgggacggggacgggacgccattgcatttgcattgctctagtgatgaccgacttgtgtgtaactttgtttgtttgtagtatttgtactttatactagttggtacgtactgcagagttgcagtgaatgaatgaatgaatgaatcacaacctgtgtgttgttgttgttgttgttgttgttgttgttaaa

SEQ ID NO: 948 - DNA, 905 bp, Triticum aestivum
  Clone ID: PAT_TA_948
gcacgaggggcctcgccgcctgcggcgtcatgatgagcatcgtctccaccgccgccgacctcatgcaggacttcaagacgggctacctcacgctcgcgtcgccgaggtccatgttcatcagccagatcatcgccgccggcttgggctccgtcgtcgcgccccccgtcttctggctcttccacccggccgtcggcggcaccggcctcccccgcgccgggccccccgcgcccgccgccgtcggctaccgcaacatggccatactcggcgtcgacggcttctcctcgctccccaagcactgcctcacgctctgctacgtcttcttcgccggcgccatcatcatcaacctcgtcaggcccacgcgtccggccaaggtcgccaggttcatcccgctgcccatggccatggccataccgttctacatcggctcctacttcgccatcgacatgttcgtcggcaccgtcatcgtcttcgtgtgggggatcgtgaacaaggccaaggccgacgcgtttgcgcccgcggtcgcctcggggctgatctgcggcgacggcatttggacgctgccgcagtccatcctcgcccttgcaaaggtgaagccgccgatttgcatgaagtttctatcgagatccgtcaatgccaacgtggatgcctacctaggaaattaattagctgtgaggcagttctcctttcttccttgaaaaaaaaaggaaagcatccctgtctatagtttgaagttacacgttctgtactctatcatcatcatcctataatcacgactgtatatggattaattgttacgtatggtgattttgtagctaatgcacataagctttaaggttgtgcttgttaataagtggctatagggatgtaaatggcaaataagcggcgtctacaagtcccgtttggtt

SEQ ID NO: 949 - DNA, 746 bp, Triticum aestivum
  Clone ID: PAT_TA_949
cccacgcgtccgggtggctatggaaccttggaggagttgcttaagtcatcacgtgggcacaactaggagtaaacaagaagccggtaaaaactaacttccatttgttgttgatgcttatcatacaaaaatcatacagccccaatcatcctgggatgatgtgtttgtctgcaatatatagtgacttggtcatcagcatgcatgcatctcccctagtcatctacgcattagaccaacagtgaacatattaaagttagttgccaagagcaagtgtgctactactagtctactacataggagtgatttgtgcatgcaagtgatgtgcgtacttgtacagtgctcctatataaaggcttggtggccctgtgccgcaagctagtgtgctactacagaatgaacattaatgcatgcaagtgtttgcgctagctatagtggtacagtttgggtaaataccttactgtttgtgctacagaattggaatgagtgttggtggtgttagtttatagttaagaaaatttatcacctactcaatttatcaagtatatgctcttttttatgtggtatttaacgaaattgtaccaaaataatatggtatatccgtatatatcgaaaccttgtcgagggaacatcaaggcttcattactgccttgatgtctcattcaattattacttgacttcttaatatagttgtatgattaacccttctgtttcccttctttgggttgcaagcaacaatttcattggtgctg

SEQ ID NO: 950 - DNA, 560 bp, Triticum aestivum
  Clone ID: PAT_TA_950
gtgcaagaagaagtgcatcgtcggttgctacaaggacctgccgccggtgtgctacaagatgtgcgtctcccagacctgcctcaccctgccaccatgtaaacgaggggattgcttcaaagcatgcgggatcaaatgcttccacaaccagccgtaccccgggccaaacccgggtccaacacctcctaggcccatgccaccgccgccatcacctccgaagcccatggccgcggccgtcgcccatgccaccgaagccatccccgccgaaggccgctgccaaagccaatggctactagttgtatccgcgtcgagcaacactagcaacaactgatgggtgtacgtcggtacgcgacgaaggtctatgcacacatacattcaaaaaggacgatatgaatatatgaaggcgccctatatgattgctacattttctttcttacgacaaaggatgaattttatttactccctcaatccatatatagagggtgtctaatatattttcgagatggtctttgactattgataagattaatagtatatgagatgtataatgtgaaaattatctc

SEQ ID NO: 951 - DNA, 549 bp, Triticum aestivum
  Clone ID: PAT_TA_951
gaaggggtccgaggagaaagagaggagaatccaaggaaggagccggcggcgatggcgtggcgggcgagcctatcccggaacgtgaaggagatccgcttcctcttctgccagtcttcccctgccagcggccccgcccgggagttcgtgaagaagaactacggtgacatcaagacccgcaaccccaccctccccgtcctcatccgcgagtgctccggcgtcgagcctcagctctgggcgcgctacgatatgggtgtggagaggtgcgtgcgcttggatggcttgacagaagcccagatcgacaagaagttggaggagctagccaaggcaggagttgcttaaagctaaaaactgtcaggctagccaagttttcttgcgttaaatcttcacaaataagagaaaagttaacatgggatgttacgttatcttgatttcagtaccatgactactcaagtgttgaatttgtacaactgattgctgagaaagtaactatttttcctatcgttcttcaaggactgttttcaccaaaaaaaaaaaaaaaaaaggccccta

SEQ ID NO: 952 - DNA, 1082 bp, Triticum aestivum
  unsure (1)..(1082): unsure at all n locations
  Clone ID: PAT_TA_952
gatggtccccaacaccccgcacaagccacacacctcaccagggtggcggagctagcatggtctccacggcggcggcgaagaccgcaaccccgcaggtcgcagctgcacccctggccggagaaaggacccaggccagagaagagaaggggtccgagaagagaggagaagagaagagaatccaaggaacgagccggcggcgatggcgtggcgggcgagcctatcccggaacgtgaaggagatccgcttcctcttctgccagtcttcccctgccagcggccccgcccgggagttcgtgaagaagaactacggtgacatcaagacccgcaaccccaccctccccgtcctcatccgcgagtgctccggcgtccagcctcagctctgggcgcgctacgatatggggcgtggacgaggtgcgtagcgcttggacggcttagacagaagcccagatcgacaaggaagttgggaggagctagccaaggacaggagtttgctgttaaacgctttaaaaactgtcaggctacgccaacgtttccttgcgttaaatcttcacaaataagagaaaagctaacatcggatgttacgttatctaccatttcagtaccacgactgtactcaagtgttgtcatttggtacaactgatagcggaggaaaggtaactatttttcctagcatggcttgacagaagcccagatcgacaagaagttggaggagctagccaaggcaggagttgcttaaagctaaaaactgtcaggctagccaagttttcttgcgttaaatcttcacaaataagagaaaagttaacatgggatgttacgttatcttgatttcagtaccatgactactcaagtgttgaatttgtacaactgattgctgagaaagtaactatttttcctatcgttcttcaaaaaaagtattcagcagataagttcaatttctaaaaaccatactggtcatacttagtactcccttcgttttcttaaaacttagtacaacttcgaccaccctgaataccccgtcaggctcttctaagccacgttcctcaattcactatgangacccctngganaccgggggngtccatn

SEQ ID NO: 953 - DNA, 828 bp, Triticum aestivum
  unsure (1)..(828): unsure at all n locations
  Clone ID: PAT_TA_953
acggagtatagtttttgtactatatatattcgattttgtagatatgagcacatatttctataaactttggtgaaatgtagttggagaacatgttgcaagttggctttaatgcatgtacttctcaagcaaaagatcatgctgtagaaagctttttagaaacttcttctcttgaacccacttagagttaaaagaagcatgtaacggagccgaacaaatctcatttccagaagcttttggttctctgatgtgagatgtttatgtcacagaagacagcccatcatgttatccaaatgcatgtccttttcgctttgcaatcagtcgttcgcgccgcgcgatacagttcagtcaagagagttccccagtcaaatcgaataagcaaaattctggtgcttcgtcttcttcgggttgtctgcgaaaacatacaggaacctgtaaaagaaaggcaagctgcatgcggccatggaaatggaacgcaggtgctgatggtggctgcctggagctttcttgtgtttttccacggtagacgatgtgtacaagttagcttttagatcttctaactgaaggaagaacctttgggacatttcgcaagtttgtaaaaaagttggctaatgcttcttcggtgagcattctgcaagttgatttccaatgttttctggaccanaagtcgctataaaaccagcgaaacactgacctaatcctgaccatggagtagcgacccctgtcagaaacttcttctcttcaactggatagagcgaaaggagcatttaccagagacgagcacgacatatcatncatctcatatgctttgaagcagaatacccatgcttt

SEQ ID NO: 954 - DNA, 1323 bp, Triticum aestivum
  Clone ID: PAT_TA_954
gggcctcaagtttgcttgcaaatagttggcattcattccgaaaagctagcgagctgccgaatgggggtggaataatgtctcttccagcacaagcttctcgctcatcgcatgccccatacataccgtgatgtgctctaggtaactagtagttggcattccagcagcaaagcttcagagctgccgaatgggtggtataatgtctcttccaacacaagcttcttgctcatcacatatgccccatgcataccgtgatgtaccctaggcaaacacgaagcaggtccccacgtaccaaacttacacaaaaagcagggcactcgcggcgctcatcttggatggaggtcctacaaacttacaggtcatgcgagaagcggctaacaggagaagagagagatcactccaggagaacttcgccttcgccgatcgctttgttcatgattttcgtcgacacgtcttggtcttctttctgagcgtcgccgccgccgtcttctttattgctggccggagtggaagaggtgtcggtgttgttaccgccattgtccccgtctctagatgtggccttttgggcatcggttgaacccgaagccaccgtagtcccattcggtggagaattcagctcagctgatgtcaggtcagctaagagttgtgtttggttgtttgatgctgctgttgaattcactggctgctcatgttgacctttcaaagaggttgaattacttgtcactgatccagcatagttgcttgtcacatttactggagttggatcagtcttgctttccgagaccatgctgggagtgctcatgtttgggttggacgacgcattagatcctgaagcctcgtgctccccgacagcattgcttccattcactccagggccccggaatgtaattccatttgataaattggtggtgccttcaaagatcctatccatgttcttcagctgttcgtcggggagaggattcgtgacttgggcatcatggtccacagaacttgacacattctcgcctccagaactcttctccatggccttgcgatcttcctcctccttgtgctcaggttcctggttttcatgaggacccgcagttgaagcatcatccacgaacaagatattctcttgggcatgatgggtcagctcatcttgctgcgatgccggagggtcatgtgttacagcgctggatacatggtcaccatggaaactcttctcctgatcctcctgagagcgctctttccgctcttcgtcctcaaacacagccctgccgtctgacccttcatccttgttagccgagtgctccccaggctcaggaagatcctcatccttgtccaggt

SEQ ID NO: 955 - DNA, 161 bp, Triticum aestivum
  Clone ID: PAT_TA_955
tgcacgcatcaagatggggctgattgcattcttttgttttgattgaagagtgtttttgtaaaataccagggactattttgtgaatttagaataaaccctgtctaaagtcgttacttgtgaaccattatgccacatcagcaaaagttgggcccatatgtcat

SEQ ID NO: 956 - DNA, 697 bp, Triticum aestivum
  unsure (1)..(697): unsure at all n locations
  Clone ID: PAT_TA_956
cccacgcgtccgccacgcgtccgatcatgcaggatatcaagagcagatgtcacattggccagagcagccagttaatgtgataatcaagtggttgaagagtcataacaaatcatggaccgttgctgattttggatgtggcaatgcagcagttgctaaaaacgtgaagaacaaggtcttctccatcgatcttgtttcagatgacccttcagtgattgcttgtgatatggctcataccccattggagccatcctctgtagatgtggcgatattctgtctttctttgatgggaaccaactttccgagttatctacaggaagctaacagagtcctcaagccaagtggttggcttcttattgcggaagtgaggagtaggctagacccgaacaccggaggtgctgatcctgataagttctccgaagccatcagccagcttggcttttcccttgtttcgaaggatgagaagaacaaaatgtttgtcctgttttatttcaggaaaaaggaaaagagcaaggtggcgaaaaacattgaatggccccagttgaaaccttgcttatacaagcggcgatgatctcatcctccactatggtcgctccagacctcttccagagtgtggttaaattaatcgatgtcttgtgctaaactagtcatccttttctactcctatntcttttacctttgggcagctgtatgttcaaag

SEQ ID NO: 957 - DNA, 677 bp, Triticum aestivum
  unsure (1)..(677): unsure at all n locations
  Clone ID: PAT_TA_957
aaattttatatatataaaattattttgtttatttatgttatttttaatttttttatattttgtttttttttttttttttagagaaaataaaggtcgtatttgttagtgtaagtcttaatccgaatttataattacataaattctcggacaaaaaaatacagtataaaggaactgctgtgctaaataaaaaaggagaagtcggaagatggatcacttcttgcggttcctcgcaaggaacccatccataaccgccttggtcttgatcgtctccgcttgtctcctcgacgccgtgccgtgctccggcgacgacgcaaccagcagcaggctctcggccgccctggccctggcaggcggccatgttcgcgggaagaagcagagcaccgcggtggtaagcagcgtggccacgagccggccgcagaacatcatcatcaagaggcacaccagcaccgccgccacgccgaccgcgggcgacctcttctcgtccggccgcttcttcgccggcgttggcaccacttccaagcacaacgaggaggaggaggaggaccgggagcaggagcgggaggaggaggacgaggaggaggccgagtccagcgacgacgcggtgctgagcgcggacgaggacggcacngacgacnacttccccgcgctggcagcgatcatgtcgtatgcaacgtagt

SEQ ID NO: 958 - DNA, 653 bp, Triticum aestivum
  Clone ID: PAT_TA_958
caccagtccactcctccacagctagctctagctccttccgtctcctacatacaaatccattccgtggatcgatctctccgacgatgcctcggctgctcctcttgtgcctggtgtccagccatttcgcggtgaccgccgtcatggcgcggcagttccccgtcttcctcgtcgacggtggcgccatggcagcagacgccccgtctgcttctgcttccgatgcctcgcgtctgcataggcactcccttttggagtccagattcgcagggtcgccgatgggctcgtctgaccacggactacggcacggccccttcgacaggcacttcgccgggggcaagatcatactcggcggcctcgcggtggccatcatcgccgcggtcttctgctacatccgcatcaccagggccaagaagatcgtcgagccaaaaacttagacttctttctcttccctggttaatatcataccttgaacacttccttttcgtctttctttgtagcgaggacatgacatggggaaaaaacaaatgtaacccacgtagatttcgttgtaacatgcaaagaacagttaattaccggcgatgactgatgacacagcgtgattcgtctcatttcttgcaagtccagtgtgctgtgtaggccttgctgaaatccttttt

SEQ ID NO: 959 - DNA, 616 bp, Triticum aestivum
  Clone ID: PAT_TA_959
caactggaaggatggcctgttgataacagtttggtcatcctgtagagggaagcatagatggatggaaacaccggtcagcattaaacagcatgacgctctatcaaaaccgcgtcatgttacctgtcttctggcacatttctaacattgtgcatgtttctatttcttagactttagttcctgattctgtagctcgttaatttggtggaagaaagccagcattacacgtgctttggaggattgaacttgcagaaagctcaatcagttttgtttagtgatgatcaaactaaatacttttgttcttcaaaaggtctgatgtgccatctcatagcttggtgtggaagaacacctatgtttatcaacagcattatgcctaccgcagttcatctcataccttggtgaggaagaacacctatttttatcaatatcaatcagtgcttggtcagttcagtacgtgaaatgaatcacaattttgctggttcttttgcatcttcttttgtgaagagtcacttagagaacttgatggaacgagtgatgattcaggcagcccttttgtctgattacaatggtaattgtggtgttgcattgcccggagagtgaatcttctgctcttcagatt

SEQ ID NO: 960 - DNA, 605 bp, Triticum aestivum
  unsure (1)..(605): unsure at all n locations
  Clone ID: PAT_TA_960
ggccgggccgggtattccaaagaagaccatcctatcgttcttggatcagataaaatattgcagtcgtggtcgatcggctgcatcatgggaaagtgcactaagcaagttcacgcaccgttgctacttcttctcgtatgcttcgctattcatgggcagtttgaagccatcggtgtcaatggcgagcgtattcctccgtggtgcacaaagagtgcaactataccaatctgcaacccagataaatatagatgctattgttgtgttcaaaattggcaatgctacaaaacaatggatgagtgcagagtcaagtgtgcatatttacctccctcctcttcctctgtacttccatgaaaccgggttcttatcatgagctggaagaaaaatgaataagatccagacaataaacaatttgctatgaatttattggcaattattgtttgcagtttttggttgccaaaaaaaaaaaaaaaaaaaaaaaaaaaaaaaaaaaaaaaaaaaaaaaaaaccccccnnnnanaaannnnnnnnnnnnnnnnnnnnnnnnnnnnnnnnnnnaannnnnaaaaaaaaaaaaaaaaaaaaagggggggnnnnnnnnnnnnnnnnnn

SEQ ID NO: 961 - DNA, 1574 bp, Triticum aestivum
  unsure (1)..(1574): unsure at all n locations
  Clone ID: PAT_TA_961
gactgggaagcatcttgctgagcactgcagggctgaatatcccaaggtcacaaatttcatcttatggattcttgcagaactggctgtagttgcgtgcgacattcctgaagtaattggaaccgctttcgctttgaacatgctcttcaaaattccgatatggtgtggtgttctcataactgggctcagcactctgatgctcctgttcctgcaacaatatggggtccgtaaactggaatttctgatagcatttttggtattcttgatagcaacttgcttcttagttgaacttgggtattctaaaccaaattcttcagaagttgtgccgagggcctttttgttcctgaaattaaaggagatggagctacaggtcttgctatctcactacttggtgctatggtgatgccgcacaatctttttctccactcagcattggtactatcaagnaaaagtaccaagatcggttcatgggatcaaagaggcctgtagattctatatgattgaaagtgcatttgccctcacagtagcctttctgatcaacatctctatcatatctgttagtggtgcagtttgcagtgcagataatttgaaccctgaagaccggatgaattgcaatgatctagatcttaacaaagcttcattcttgttaaagaatgtcctcggaaattggagctcaaaggtgttcgctattgccttattggcatctggccagagttctacgattacaggaacttatgcaggacaatatgtcatgcaggggtttctggaccttcggatgacgccctggttacggaaccttctaactaggtccctggcaattgtgcctagtctgattgtgtcactaattggcggttcctcagcagctgggaagttgattatcattgcatcaatgatcctgtcatttgaacttccttttgctctggtaccgctccttaaattcaccagcagcaaaacaaagatggggccacacacaaattcaagattcatttccgtgctcacatgggcgatcggctccttcatcatggtcatcaacatctacttcctgataacgagcttcgtcaggctgcttcttcacagcggactatccaccgtctcccaggtgttctccgggatattcgggttcctcggcatgctgatatacatcgccgcgatcctctacctcgtcttcaggaagaacaggaagtgtaccttgccattgctcgagagcgacgcgaagcttggggacgcaggccacaccgagggagaaggttctctgggtcatcttccgcgggaggatatctccagcatgcagcttcctcatcagcgcgctgcgtctgatttggactagccgaagtagccgcagtgaggaaactagatatgttttctgatcatggtgatgatgcagtagctgcataactgaacagttaggtgtcatcaggtattgatgcagataaccgaagtgattttatagtggccgaattaaaatctttcttacggaaatggatagttggtatagttgccaataattttcggcggtactgccgattgtagacaagtgggtctctattatatctagaaagagaaaaagaatgaatttc

SEQ ID NO: 962 - DNA, 1032 bp, Triticum aestivum
  Clone ID: PAT_TA_962
ccagagaccttacaccagcttgtgtaaggaaagtcgttcccccgtcctcacccagcgaagaaatgggatcatattggggctataaagtccgctatgcttcaaatttaagtggtgttatcaatgattcaccatacaaggaaggatatgatcatatcattggcacttcagagcatggcgaaaccattatttcatctgagctaatcttaccttcattcaggcaccttttaattgcgtttggtggactggctggtctggaagaaagcatcgaagaggacccaaatctgaatggcaaaggtgcaaatgatgtattcccatcttatttgaatacatgccccaaccaaggtagcagaacaataaggacagaggaggcacttctcatatcccttcaatacttccaagaccccatcaggcgagctgggatggcgagttagagggttttatgcgacacatgcaaatacaacattgcacttacccaaggattggttttaacgcttggaacagacatggaatgctgggtggtcatgtcatgtcgaagatgcaccttgggtttgtttttggtggtcaatcgctggattgtagcacctacgggctttctgctcgggtcaagcactgtaaatgcaaagaggaggtgcaagaataggcgatagctttaacttctatttttgaaatgggcaagacacacattttcatgaattaagaagagaacttgcctggttaattagaggaaaaccgggcaaaagccgagatagcttaaacattgatgctagcattggtagagttttcttaagggagcattgatagagttgagaagatcagtgccacacaaaagtgtttagagagggagcataattattcgtcggtttatttgctccaaattggctaaaacgagtgttctattttatttgctccaagttgtcttatctatgatgtatcacctatttattttcacgcctggcagctttgtaccactgtatcaagcttcagcttactgtatttggctggcttaattaatgacttagaaggtttctatcc

SEQ ID NO: 963 - DNA, 698 bp, Triticum aestivum
  unsure (1)..(698): unsure at all n locations
  Clone ID: PAT_TA_963
atatcagggcacaaaatgctttggatagcgtatgtactcatgtcagttgcattccatgtcttttgtctcgtctattttatttggatcaggagatggaaaattaaggtaaccattctcggtgtcgtcactatcatcctcacatcgagatgtctccaacaatgccgccatacatgtccctcgtgttgtcattgtcatcctgataggcagctcgaatgcttggttagaggatcccaggtgcaaggcaaaccgccatcttctctctcactgttcatcgtctctagacgcaccgccgtcgacatcagctaccgcctatacatatgatccatgtatcatctttagtatctctcatgctcaggagaggcagaggtcacccagctagctcgtgcagcaccaagggcgatggagatatgcaagcacattagctgatgagaggatgtactaaatgttatgcagaaaccaaatgaataacttttcttgctcatccctatatcatgttctcagtcttgtatcttctgatcagttaagtcatattggcttgtgatcttttttccattcagtcagtctcaaatctcatcttggcatatacataagaaagaaagagccaagagcatgtgaaatgtatctgtacatgtctgccacataanttctagctttatttgctccgcgaaaatagttgcacgggaaggcgtatgagatgc

SEQ ID NO: 964 - DNA, 1067 bp, Triticum aestivum
  unsure (1)..(1067): unsure at all n locations
  Clone ID: PAT_TA_964
gnngnntnnnntngacgccctttccggcccccccccccctccgccccccacgcgtccgctgcctagggttttttgacgccctcgccggcccgccgccacctcctcccttttcacaagcgctgcccctccactaccaccgtagcaccaggatgacggcgcagactgccgaggagctcgccgcgcatatcgagcaggagcagctcgaggcgaagaaaactgaggcagaagaggttgtggttgaggatgatgatgatgatgacgacgacgatgaggatgatgatgacaacgatgatttggatgggcaagaaggtgatgccagtggcacatcaaagcaaagcaggagtgagaagaagagtcgcaaggcaatgctgaagcttggcatgaaatccatcactggcgtaagccgtgtcactgtgaagaaaagcaagaatatattattcgtcatctcaaagccagatgtcttcaagagcccaaattcagagacgtatgttattttcggtgaagccaagattgaggatctcagctcccagctgcagagccaggctgccgaacagttcaaggctcctgacctgagccaaatgatctcaagtcctgaggcgtcgggcatggagaatgatgacaacgaggttgtcaacgatgaaggagtcgagccaaaggacatcgagctggtgatgacacaggcgggcgtctcaagggccaaggctgtcagggctctcaagtctgccaatggagacattgtcactgccattatggaggtcacaacttaagagtatggcgacatttctggaactagttgaaccatttctctttgagcgatttgcagcttgagttggtacagtgtttgctttgcatctctgataaggtcgtttggacatgatcctgcctgcggttaagttggtacagtgtttttagcacggacatgtcagtggtggcaattttctggcatgtttttcacctttgactgaaatattattagatttaatttaaataaaccccgttgtattctttgtaacagataaaaataacatgattataactgttaagcagtaagaaaacgaagctgaagt

SEQ ID NO: 965 - DNA, 691 bp, Triticum aestivum
  Clone ID: PAT_TA_965
gagctaatggctttctacatgaacctgagaagaagcaagaacaacgagactgcgatggagctctttggtgactgctcgctcacatttgatgacgaccagccaacgctctcatgcaacctctttgactctatgcgcgttgacatcagcttgacatgttcaatttgcttggacccaatgtttgatccggtctcgctttcctgtggccacatattttgctacttgtgctgctgctctgctgcatcggtgacgattgtcgatgggttgaagtccgcagatcacagatcaaagtgccctttgtgccgacaggctggggtctttcctaatgctgtgcacttggacgagctgaacatgctactaagctatagttgtccggagtactgggagaagagaatgcagatggaacgagttgagcgtgttcgtctggctaaggagcactgggagtcccagtgcagagcattcttgggcgtctgatggaacatgtagacttcgtacaaaaatgggattccccattgctgttggttagatcttgatttggcatgactgtaatatatttgtatctatcctgctgaatgaattggtctgtaattgggaggtcacttgtgcgcctagatgtaaaaaggggtaaacttgtagtgattatctgaatgtaaaattgcaagtatgtttataattaatccggactgtttggatt

SEQ ID NO: 966 - DNA, 646 bp, Triticum aestivum
  unsure (1)..(646): unsure at all n locations
  Clone ID: PAT_TA_966
cccacgcgtccggcaggactatatttggttgatgtctggataaaagtcttggctgaaaaatgcttggcctggagcctccttgcaaagtgcacggactatgtttggttgatgtcctgaagaaatgtatattgacttgtgctatttgcattagaacacttgtccttatgtgatataaagtttgcatttttagtgtcttgtgcttccattactagttgcatgtttatgatacagcaggtttaccattctatgagagatccattttgagtttccagttttccaaagacacacaagttgatggaggtttgtaagatctacatacaagcagttgacgatttggaagttctacagcggctgaaggtttggaagacatacaattaagttggtgtagtgataatgtagtgcatctagtttgttgaacctggagacattggcaggttctgcttattttggtggttgttttgctacacaagtcactggatgctcattttggttgtgtggcacatctagaaacataagtattttttgtgccagcacaacgtccttatgtatggctgttcctgtagtatgtatctagaaacatacgtantatctggcatgtatgttatattgaaggagtttaaggtttgatgaggcaaanaaaaaaann

SEQ ID NO: 967 - DNA, 409 bp, Triticum aestivum
  Clone ID: PAT_TA_967
caagcacaggctccgcagcgactagaagcagtgcgcgtgagcgcgtcactgccacaccgcgtacgtacgtaactacgagctgtcgccccgcccacctctccggcgacgcacgtaggcctccatccagcagcgtctccatcaaattgattaattgcgctttgaattactcttcttcttcctcgcggtactctcttccttgattgtagaaggaacgagtgacgtactaccatacttcggctagttacttaatgcttggttgatttttttctttcgaaactaatatcgcgtcgagtttttaacagcgaccgtagcactccagtttgtcttaattttttgttgtatttgttcttgtaaccaagtttttttggctgggtgccgaattatattgtaccagttttgtttttggctt

SEQ ID NO: 968 - DNA, 1705 bp, Triticum aestivum
  unsure (1)..(1705): unsure at all n locations
  Clone ID: PAT_TA_968
cacatctcggtccgcggctacgacatcatcgacgaggccaagaaggagctggaggccaagtgccccaacacggtgtcctgcgccgacatcatctccctcgccacccgcgactccgtgaaactcgccggcggcccggactacgcggttcccacgggccgccgcgactcgctcgtctccaaccgcgaggagtccgacgacaacctgcccggcccggacatccccgtgccccaggtcacggccgacttcgtgaaggccggcttcaccgccgaggagatggtgctgctgctcgccggcggccacagcatcggcaaggtcaggtgcatcttcatcgagcccgacgcctcgcccatggaggcgggctatcacgccagcatcagcaagctctgcgacgggcccaaccgggacacgggcttcgtcaacatggaccagtccaaccccaacgtcgttgacaactccttcttcgccaacgccatcgccgagaagatgccgcggacccgtggccgcctcctcgccatcgacgagaagacggggcccctgctcaaggacatgctcaacaagcccaaagaggacttcatgtcggcattcggcaaggccatggagaagctcaccgtgctcaaggccatcaccggcaaggacggcgaggtcaggaaggcatgcaacgagttcaacaaccccatgtccagcgacggcccctcggtcatacggatcagctccgtcgaccccgaggtcctggatggcttggcggccggcaacaagcaggagcaggtgtcaagcatcgtctcgcaggggcacgcggacgcacagccggaggccgccgccggcaacgcggacgctaaggccgagaagccccacaagaaggcgtccggcaagcacaagctccgcagcgactagaagcagtgcgcgtgagcgcgtcactactacaccgcgtacgtacgtaactacgagctgtcgccccgcccacctctccggcgacgcacgtgggcctccatccagcagcgtctccatcaaattgattaattgcgctttgaattactcttcttcttcctcgcggtactctctcccttgattgtagaaggaacgagtgacgtactaccatacttcggctagttacttaatgcttggttgaatttttttttcgaaactaatatcgcgtcgagtttttaacagcgaccgtagcactccagtttgtcttcattttttgtttgatttttcttgtgaccaaattttttagcaggtgtcaagcaccgtctcgcaggggcacaagggacgcacagccggaggccgccggcggcaaggcggacggtaacgccgagaagccccacaagaaggcgtccggcaagcacaagctccgcagcgactagaagcagtccgcgtgagcgcgtcactactacaccgcgtacgtacgtaactacgagctgtcgccccgcccacctctccggcgacgcacgtaggcctccatccaggagcgtctccatcaaattgattaattgcactttgaattactcttcttcttccaatcggtactctctccctggattgtagaaggaacgagtgacgtactactatactacggctagtttctttatgcttggttgatttattttttcaaaactaatatcgcgtcgagtttttaacagcgaccgtagcactccagtttgtcttaatttttggactgtctattttacatccggnanaaaaccaattc

SEQ ID NO: 969 - DNA, 821 bp, Triticum aestivum
  Clone ID: PAT_TA_969
aatcgttctcttttttttttttttttctttccttagaacacacaatctttctttcgtatccaccgggggaaatttttttttgcttccagaggatgcaccatgattctttcgacacacccgaagaacccaagattagttctgacttggcactcacactcactccaacagcacagctaactgttaaaacacaagcgaatttggcttgcttcctcagcccgaggaacgaaccaagatggtagtagaaaacaaacgtgagggagaatgaatttacagggagacttggctccgccatggaccaccgtcatcatctcgcttgaggttgagggaaatgtacactcgctcgcggacgcaaactcgctgctggctcggctatttacacgggcaggcacgccggccggctggccagcccagctcgtctcgctctcgccaaggggaaaggggaaaaacgcacgcacgcacgcacgccacctggcatgcatggccaaggtggaattggttccagctgaagggtatcatcatcactccgccgcaacgatcgccgccggcctagtagcgcgcaggctcgcgctccgcggttgccgtagcatctcgatcagcgcccgaccatggttttgaacgcggcgttctcgtcgcggatctggaggagggagagcgtggcgatctccttctgccgcgaggtcccgacctccaccatctccaccagcacggggatgccgccctcctccacggtggcggagcggccctcggcgaagcccaccagggagtggagcacgtaggcggcctttccaccatgccggactcgcctcgtgcccgaattcctc

SEQ ID NO: 970 - DNA, 648 bp, Triticum aestivum
  Clone ID: PAT_TA_970
gcgaatttcaccttgcagactatgctgtcgctcatcaggcattggctccatgggacctaaaagaagcagacatggtttcacaagccttgggggcaaaaccgaaccatgaaccagatttggcacattcatccttgtattgaagttgatatcacctccatcatcatcatcatcatcatcgttgcaatggcttcctagacctctgtgcactcagacaaacatggctgcgtatgcagtgaacttgtgtgatgagttgaactctatggcttgtaccgaagtggcatatgaagatctgggatgaattcaagcattccgcatggtctcaacatgcaagggtggctcgaatgtatccctggacagtagttttaggtcagcgtagcagaacccatgttgttgtttgttcagagaaaactgacaccagactagaccccatcttttctccctttgttgtacagaccatagctccgtatcctgttcctagcaatcacctaactcatagtcggtcgtgttaaaagtcgtcgcggtttggcggagatggttggcatctgcaggttgctgcagccctctgtatatcccccagctgcttatactggtcaccatttataactgctaagtgccagaaggtgccaaaagaagttatgattttcctcc

SEQ ID NO: 971 - DNA, 424 bp, Triticum aestivum
  Clone ID: PAT_TA_971
gccaagacgaagatgagcagcagcaactccaaggcacacaatgcagtgagacaggaaacttaagaagaacaataagcagtatgaagacctgatccagaagtgcagagataatccagagagttttgaagatcacattgcagacaaggtttcggatgatgatagtggtgatgatggtagtgacgtagatattgtggatcctgaaccagatccagatgacagtagcgatgacaataagagtgaactgggtggagcctgggaaaagaagttgagcaagaaagatgagattatggacaaacagttcttgaaagaccccagtgagatcacatgggatattgttgataaaaagcttaaggagattgtggcgtcgaggggtaagaagggcactgggagaattgagcgtgtggagcagcttacattttttgac

SEQ ID NO: 972 - DNA, 569 bp, Triticum aestivum
  Clone ID: PAT_TA_972
ccccgcgtccggccaagctgcttttgcaaaaatgcctcgcacctggcgcaagcagcggcgcggaagggggagagggagcagagatgagaagttggtaggtacggacggggtcgagctcggagtcggaggggagctggaggatgtcgcggacgatggcgcggtcggcggcgtcgaggccggtgcggcgggtgcgccaaagggcctgcaggatgtactctaccgagtccttggagcgcgcgcgggccagcagcgggaggtgctcgtgcccccagagcgccgccgccgatgacgtcccgtgctccatcgccggccgtgttctgccgccgcgtgagggggggactatggtcttgtgggctaagacagaagacatgactgcgtagcagcgaaggcgaagtcgatttctagcgggctgaaagtagtccatgggccataactgaggagctccgagatcagtcaaagaaggaccatttcgcgcaccaggcccatccactagcagcatggctggctcatcgaaatcactggggaaaaactagtacccctaaaaaaactagaaataactagtttttttt

SEQ ID NO: 973 - DNA, 390 bp, Triticum aestivum
  Clone ID: PAT_TA_973
gcctcactgtcgatcttgttcgcgactcggccacgcctcgactttgcatttgtcaaaaccgacgacgccccgccgtcccgtgctaccggagtcgtcgccccgcgtcgtcgtcgtgaggagatgccgtcccggttaggctaggacgaagtggacgcgagacggcgcccccagctatctccccatctccgcgtcaaccgcaggaaggtgagcacacgacggctgccttcagcttgctctcttgcccgtgcaccctggcgcctgggctgcctcgcacgcgcggggcctgcgttctttggctgtgttgcgtgagcttggtgggtgggcgtgttttgtgtcggtgaggtgctctgtagcggccaaatgcaattgatgttatcctccgtactctta

SEQ ID NO: 974 - DNA, 553 bp, Triticum aestivum
  unsure (1)..(553): unsure at all n locations
  Clone ID: PAT_TA_974
cccacgcgtccgcccacgcgtccgcccacgcgtccgagaatatcaaaattccaacatgcatatcttctagatagcatcacacaatcttgtatttgactatttttaggtctcatctttccatgttataagatatcgcgtagcctattctgatgtgcatctattccattctcgtgtacttgcttttgtggtttttcattcctgaagaaatgggcgacatcaaggtgccaagactgttatgcgttctactactcatgccacttcttttagttccttgctcagaagccaagacctgcgaggtagctagcagtacctatctgacaatagcatgcagggtggatccatgtgctaaagcctgccacaaggagggttttaccaaggggttatgttacatatacccaccatttacaattctttgtatctgcgaaaaagagtgttgaacaaagaaaacgttgcaattcgcgtaggatgtgtgatgtaacaaataataaggttgggtagtatgatgaattaataatgagaaatgatagaaggggggccccattttaaggnttcc

SEQ ID NO: 975 - DNA, 751 bp, Triticum aestivum
  unsure (1)..(751): unsure at all n locations
  Clone ID: PAT_TA_975
ggtaccgcctgcaggtacccgggtccggtatattcccggtngtacgacccacgacgtcaccgccttctacgagttcaacggcgtcagggtccaccacaaggtatgcgcccatggcgaggacgaggattcgggcggccagtcctcgggctccgccgtcgccaggagtcaggccgggctgcccatagtgctgcttcacggcttcggcgcgtcggtgttctcctggagccgcgtcatgcggccactcgcccgcatcgccggcgccaaggtcctcgccttcgaccggccggcgtttggcctgacttcccggaccagacggtccggcgatgacaccaagcctctcaacccttactccatggccttctcggccatggccacactggcattcatagaccaactcggccccgggaaggccgtccttgttgggcactctgccggctgcctcgttgcagtggaggcgtacttcgaggcgcctgagctggtggtggcgctagtgctggttgcaccggcgattttcgcgccgaggaagggtgagaaagaaaacagcgttangggagcaggaaggggcagacaagaaggattctgatgataacaatgcagcaccaaatccatttgctaggatatggagaggggttcttggcatgtgtatgtggcttgcaaggcttgttcttaaattttggcaatgcaaaattgcaaggataacggtcaaaaacctttttcttctcatgggggcttttctacgctcttcattggc

SEQ ID NO: 976 - DNA, 598 bp, Triticum aestivum
  Clone ID: PAT_TA_976
cccacgcgtccgcccacgcgtccgcttgattcatgtcaactaatgcatcatgtgctttgcgtgttgtttccaatgaacgatggtcaccgccatgccctttggctttggcgccggtaccgaggggacggcggtggctgtatcatcacttccttgtccagctactatgtcttggcagattgcctcctccttggccactacctcagctttgtcggcagcacaatgacactggttcggtggcgatggttgccttttccttggttctggtgcacaagaaaccgtgtgttgtgtgcgtccaacatcaccagcgagtgtgttggcatgcgcaagccctcactcgacacctccctcccgcccctccggtgtatgcttcttcaactctggcatagattgcaaaggagctggccgtgcaggggcatgggatcccggtgacagtggccaacaccacctacatgggcatggaggcgctccatgccgtcggtggccttggcaagctgcccgtgtaccagtatctatggaaggtctatatttggcgttgccatgcctgacatcactcaagtattccggcaaccagattcttgtggtttgtgatgatctttga

SEQ ID NO: 977 - DNA, 1170 bp, Triticum aestivum
  Clone ID: PAT_TA_977
gctcgccgttcggcacgagggagctccccgacctgtaggttcggcccagtcttgttgtctttgtccagctcaccatggtcattgacggataccaacactaaaggtgcacaagagaaaacgagtggggtgtgtgtgtgggagaaggagcccgagattactggcgagtccgtcgccctgcgctgctgctcacggacccctcccacattggtcctcagctggcctctacttcgttggctggctttggaaagcagttgctcgtgccgggccctccggcccccgtgtgtgtggtccgtccaacctccccagcgattgcggcggcccgcgccgccccccgccctggcaccccccccggccccccccggctacccgccttcaaggccggcgtcgacctccaggcagtccgccggcgcggggggctgcccctccagccgcaactcaccgacaccaactgcatcggccccttgacgcccaccactgaaggtccagaggagactacgagttgtgtgcgtccaccatcacctgctagtcaggtcgcattcgcgagccctccctccgtggcgttactccagcctccctgccgttctaagactacggcataggtgcacaagagactgccgtgtagttcgagctggggaggaggcacccaacatcaccagcaagtccgtcgcccatacaccggcgctcaatgagtgccctgcccctccggtggcttattctttgactccgacattgttttgagaagtcaccaagtttgaggcggagcttgtgcattgctgcgaggagctgctggagcaaatcgagcatcctggggcgagactatgctgatcttgagattgtctgcgttgtcgtgcgactttggtaaagagtttcctcggtggtgccaattttgtacatgtagctagtgttgaaatgaaatggcaatctgaagatttgtactatatattttttgttttcttggtcgtgctgtagcaaatgagattgttgtcgaggtggtgtaagtaaatggctggctagatgcttgggaaacctacttactatataggtggtttcctgtttcgtggctgagccgcctatctatgtatatggctctagtgttgtgatgtaaatgatccagaatctcattcccctgtgacggcacataattgttttatcaaaaaaaaaaaaaaaaaa

SEQ ID NO: 978 - DNA, 624 bp, Triticum aestivum
  Clone ID: PAT_TA_978
cgtcaccctctaccagcggctccccaccaacgtcacgctccccaaggagctccacccggtcttcttcctcttcgtcgccgcgcccagcgtcgcctccatggcctgggccaagatcaacggcgagttcgacaacggcgcccggattgcctacttcattgcgctcttcctctacatgtcactggcggtgcggatcaacttcttcagagggttccggttctcgctggcgtggtgggcgtacacgttcccgatgaccggcgcgtccatcgcgaccataacgtacgcgacggaggtgaccaacgtgctgacgcggacgctgtcgatcggcctctcgggcattgccaccgtcacggtagccggcctgctggtgaccaccatgttccacgccttcgtgctcagggacctcttccccaacgacgtctccatcgccatcacccggaggaagcccaagttcagcaagatcctcgcgcacttccgctcctccagctccgacatgaaagagctcgtgctctccgtctccaagtcgcccaacaccgacttccgattccctcggtcacagacaccgatccgtccgtcaccaaaggcaaagccgagccgtaagagcgacaccccgcgcgctctctcgcg

SEQ ID NO: 979 - DNA, 1378 bp, Triticum aestivum
  unsure (1)..(1378): unsure at all n locations
  Clone ID: PAT_TA_979
gcacggccgtgggcaaaaaggcccccggccggccctctcgcgccctccttctagcagcgccacataacaatttggtatcagctaacttcggttcgatcatgtcttcaccgccgccaagcccgtctcttccgctgccggtcacttcgtcgcctccggcgaccaccatgaccgtcgcctcgctcctgcccgcgccgggatcctccgtcgggcccgcccccgccgtcctcaccccggaggaggtgttcggggtgctgcgggacctaacccaggcggtccaggagatccacatgttcttggccgggtcctacgggccgcccccggctgcgccgcccatcgccgcctccgcgccgccgtggcagccgccgcaccaggcggcctttgccgcgcttgccgggccgctgcagctgtcatccatcgccaccaccgcccaaccctggctgcagtggcaaccgccgctcctagcggcctccgccgcgcccggcgctttnaagcagcagccgctgccgctgcccggcgcgacaccacagcagccgctgcagctgcagnagccaccgccggtcagctccaccgcccagtatgggatgccctacgacgggactgcgatgaccttgttcccatcagcgccgccgccatccaggggcgtccacatccagcagatcaagtccctgttgtcgccgtcacgctttccgtcttggatcgctacccgccacgtgtcgncggcggtgaggctgcaggctgctgcgcgcggcctcctagcgtgtcggcgtgtgcgggagatgcgtggtctgcagctgccgctcctccaagttgcccttcgctgtgcaaaggacctcgatctcgtccgttgcgtcggggatcttgggcatgccctgttttccccgcaggcagcaacctcaaagtctgcgacatcggcggttgagggggcgcacccctcctcatcattctccatcgcaagccctccactcttccatgtgcggtgcagaccaacagccatacacatgcactcattttgtccagatggtgtccatgggtccaggtggctgtacatgtgcatgtccaaaataaagcgtcctagtctatttcagattgagaataataaaacaagccgagatgtaaaagacttgtttttaggtgttagatttgtgttgcgtcgagtcatggttataagttggttaggctgcagctcgaggacaagctgcatgtccaggtaggatgtagtgttagagtatgtaatgggcctaggcccattaatcttagggttaattagagataaggatcgcttgcttagagatcaagtaagccttgcttgggagtcaagtaaacctctctatataaagagaggagatgtatcaatctaatcaagcaagaattaagaagg

SEQ ID NO: 980 - DNA, 1086 bp, Triticum aestivum
  unsure (1)..(1086): unsure at all n locations
  Clone ID: PAT_TA_980
ttgtcatatattgttaatgaacttgaaggatgtcgtgtttttaacaactacaaagaacagtagttttgatgttttaaaaatcttactagttacaatcttatgactgtgttagagtacgtaatgggcctaatggcctgggctggcggtatagcccgttagtcttagggttaattagagataagggtcgctttcttagggatcaagtaagccttgcttgggagtcaagtaaacctctctatataaagagaggagatgtatcaatctaatcaagcaagaattaagaacggtatgtccgggaaatcccttccctcttgcccggccgtgggcaaaaaggcccccggccggccctctcgcgccctccttctagcagcgccataacaatttggtatcagctagcttcggttcgatcatgtcttcaccgccgccaagcccgtctctttcgctgccggtcacctcgtcgcctccggcgaccaccacgaccgtcaccccgctcctgcccgcgccgggatcctctgtcgcgcccgcccccgccgtcctcacctgggaggaggtgtccgggatgctgcgggacctaacccaggcagtccaggagatccacctgttcttggccgggtcctacgggtcgcacccgattgcgccgcccatcgtcgcccccgcgccgctgtggctgtcgtggcagccgccgtaccaagcggccttcgccgcgctcgccgggccgctacagcagccgctgcagtcgccatccatcgccaccaccgcccagccatggctgcagtggcagccgccgctcctggcggcctccgccgcgacagcgcagcagccgctgcagcagccaccgcccgtcagctccaccgcccagtatgggatgccctatgacgggagtgcgatgacctcgttcccatcagcgcatccccgtacatccagcagtgtccctgttgtcgccgtgcgtcttgtcgcgatgtcggcggcggtgaggctgcctgctgcggtgcgtgtgcgtgtctgccttggttgcgccgcccatcgccgcccccgcgccgttgtggttgccgtgnaatccaccgaaccaggcggcttcgccggacc

SEQ ID NO: 981 - DNA, 656 bp, Triticum aestivum
  Clone ID: PAT_TA_981
cccggtgcacgaggcgtccgcgaagctcttctcaccaagatatctggggagacggcgtctgcgactgtcaactccgggtcgttgtccgacatgtcgaacctcgtgaacgcgacgctctacggtttcgaggattaccacggggtggacatcggcgtcgtgaaggcggcccggctttggtacagctccacggcgggagaaatgccgctagagatccagcttcaagaaggtgacaccaggctaggattcgccgtgagccgtactgaagagggtttcatctacatatcttcggtggtcgacgacgacgaggacagcgaggcgccgtcgacgcggtccgggctccgcgatctgttcaaccgggcgaaagtggcatccaagctgttgatcatatcaagggtgtccaacgagaaggtcctcccctgggatgatctccagctcaggcgcggtccgttgcttcgacaccatctccctcagccagaagctctccctgcaccgcctcgcgctgcagcccatccagctacacctgctcatgtgggagaagcccgtcggtgtcgcggcgcaacgcgtcgttctttctccgaaaatgcccttcccgctgtcgttgcctcctcaggtacccctaagcatcatcgagagccctgacataagagtagatgctg

SEQ ID NO: 982 - DNA, 607 bp, Triticum aestivum
  Clone ID: PAT_TA_982
gcgcgaggccaagcctcacagatcaccacacacagcagcagcaccaccgccaccgccaccgccaccaccaggaagcgcagtagtcgacgcagctgagccatggcccgccgcacggccctcatcctcgccgcgctcctcctcgtcgcactggccgtcgcgccgttggccaatgccaagaaggccgccaaggaggagaagtcctccgacgccccctcggccgacgcgccggccgccgactcgcccgcggaggggccctccgacggaccggcggctgcccccgggcccgagggcatcgccggcctctcgcccgacaacgacgacaacgacgacaagtgaacccgagtgcatgcccttctggaaggatccgctccatgctgaccagatcgtccgcatggattttagtttcgagacaataataataataatactgctacgtgtaggcctgttgccctgctaggaggatgccgtcgtaattcaaattttggtttttccgtcttttcaagtgttattatgagccgtgttccttaattcgtgttatttgtaataacagcatttaccgagtcaaatatttctgtgttaccttaaaaaaaaaaaaaaaaaaaaaaaa

SEQ ID NO: 983 - DNA, 965 bp, Triticum aestivum
  unsure (1)..(965): unsure at all n locations
  Clone ID: PAT_TA_983
cctcgccccaatccagtattccccgtctccctccgggtctcccgagaaaaatcgtcgccgcccatctgccccatggccgcggacaaagcactctgccaacgccatcggcgctgcttcaatgggcttgtactctgactcagatcacgagtttgatgagggcctcaacctggtctgccattcctgtatcatcacgggtgacgctgttgtgcacagctctcctcctaccttgatgcccacgggatccacaacccaccggaaaggagtagcggcgccctcacaggttggaccactcccggatccgtcgccgccttcacagccaggacgggccgaccaccgagggcatctttctccaccacttgtgatgagtggccgagccatggagcggaggcggcggggagtactgattatattggaaggccaaggtgcgcctcctgccgtgggctctcgcctgctcctcggcctccccccccctttcgtcggccccccgccatggtggtgctgtcctcggcagtggtcccgcctgtggtgtcgtgctgacttgtgcttcccgccagggagtgtttccgcacgcgggtcttgtcgggggtgctggcgcctgcctgcttcggcggcttgcaaccgttggattggtcgcatcttgttggtctcgctactttgttgggtacttcccgccgaggatttgtgaaatacttaagaactgcatgcgtttgcctactcctcctgtttgggcgcatgcatgctgtactttgcttttgcgtcagctcgtcttaatggctcggggtccttcctccgccacactaacgacgacccaatgccatggtggtggagaccacaacagatgtcaaggcagaggagaggtgtttacatttttttcctggcagtgagtgtttacacaatctagacatgtctatgatgcggctccagccagatttggggactataaccaaaatatnatcgcaacaaat

SEQ ID NO: 984 - DNA, 495 bp, Triticum aestivum
  Clone ID: PAT_TA_984
ctcgaaaatcgtaggctcttctcgagcgcagcaggcgaacagacgcgacgacctgtacttctgacttgtgcatgcatatgagggccattagcgcggcagcgagcggcaatggcaaagccaaggtggtcattgtgatgggcgccacggccaccggcaagtccaagctggccgtggacctcgcgctgcggttcggcggcgaggtcgtcaactcggacaagatccaggtccacgacggcctgcccgtggtcaccaacaaggccaccgtccgcgagcaagccggggtgccgcaccacatgatcggcggggtgcaccccaacgccgactacgccgcggcggagtttcggcgcgacgccacgcgcgccgtggagtcggtcctcgcgaggggccggctgctcatcatcggcggcgggtccaacagctacctcgaggcgcttctggacggcgagcccggggttcggccggcggtacgactgctgcttctctttgggtggacgc

SEQ ID NO: 985 - DNA, 793 bp, Triticum aestivum
  Clone ID: PAT_TA_985
caggccacaactctctcccgtcccccactcctcacgcctcgccgccctccctcgcttcctccgccagcctcctccccccttgtcgggatccctccttctcccacgccatgatgaagcccgcgggcgcgggcgccggtccgggcactggcaccgtcgaggtccgcgtcgagcgcccgcagcgcccgcccgtgcaccccaactcggcacgcctcagggcgcgcccctactaccgccgatggacgccctggctcgtcccggccgcctccatcgcctgcgtcgccgtcttcctcgtcaccatgttcgttaacgactgccccaaccgcagcgccggcaactgcaccgcgggctttctcggccgattcgccttccagccgctcaaggagaacccgctcctcggcccatcctccaccacattgctgaagatgggagctctagatgtatctaaagttgtgcaaggtcgccagggatggcgtctgattacgtgtatctggctccatgctggggggttgttcatttactcatcaatgttctttgccttctatttattggtattcgacttgaacaagaatttgggtttgtgaggattggtcttgtttatctcatttctggttttggtgggagcttgatgtctgctctcttcatccgagcaagtatttcccgtggtgcttctggtgctttgtttggactgattgggtcgatgctttctgaactcatcacaaattggtcactctatgcaaataaggtggcagcattactaaccctggtacttgtaatcgtggtgaacttggccctt

SEQ ID NO: 986 - DNA, 1348 bp, Triticum aestivum
  unsure (1)..(1348): unsure at all n locations
  Clone ID: PAT_TA_986
gcaaagcgagggaaaacgaaccaacgagcaggggaagaaggtccaggggcggcctggcggaggaatcggcgcgggggaaggtcccacctacccaccgagcgatcgaccgggcgggcggcgacccatggcggcgaaggggcatcagatccacccggccgacggggcgatgaagctcagcatcggcaccgatcccggcatagacgccagcgtggcgatcgtgatggcgttccaagcgccgggcgtgcacggcccagggctctcctccaccttcggcacctgcaccaccgctgacgccacccgcaacccattcgtaccgtgtgggaagggtggccgcccgcacgtcacggtggcggagcggagcgccgaggctctcaagggcaggtcagacggaagttgccgcgtatgtttacgtgtccgctggcgtcgggaacgtatcagttaccggaaccgaccatcatgacagcaagagcaaaaccagccccaagagcggctgggttgctagggtgtcgcagtttccccaggcgagggtctgcgctgcatgctcgtcgggccctctctaaccaaacccgcacaagtgagcaacaagtgggcctccctcttttctaaggtgaggatgacacccgtgctgcgcggggcctcctcctctttggagcagggaacgccacccctgcagccgaggcaaacatccacagcgacccggaggcggcggacatggtgttcacgtcgggcgcggacatcgcggtggtcggcctcaacatcaccacccaggtgagcttcacggaggcggaccttgtcggagctgaggagctccgggggcaagcaggcgcagttcctctgcgacatctgcaagttctacagcgactggcacctccgactcgtacggcgaccccgccgtgttccttgcacgtacccgggtgagcctggccgcgctggtccggccggagctcttcaccttcaggaagggcgtggtgcgggtggagacccagggcatctgcagaggccacacctccatggacatggggctcaagaagttcaagtcggagaacgcgtggtcgggctacacgcccatctcggtggcgtggacggtggacaaggccaaggtggtcgccttcgtcatggagctcctcaaaaattaatcaggagttcatgatctgtatatctggtcatcaaatgatttgaaattgtagagatccgtcggtcgatcgacccgtgatttatgtgtaccccattctgacgctcttcatgtagacacattgtctcccgtggattattgaactgctcgttgtcttaattatccatgatgggactccactacccgaatnactgggtatccnccaaaaaaaaaaaa

SEQ ID NO: 987 - DNA, 1048 bp, Triticum aestivum
  Clone ID: PAT_TA_987
tagcgtggtcgcggccgaggtacctaatgtttcaaacatgcagcggatgcatatgctccaaacaaaagttcagcaaccacagcaacaacagcatgctcagcagccaccaatgggtttgatgcaacctcagtctcaacacagcctaccccaacagtcgcaacagcatcttatgtcacaattccaatctcagcctaaccaactacaacatcaatcagggatgcagccgcaatcctccatgcaacgacgacttcaagcttcaggaggcatgctcttgcaacaaaataacatggatccgattcaggcacagaggggccttcaagaagtttcctctagtacatctgcggactctactgctcaaacaggtgatgaagatgaagatgcagattattggcaagaggagatatatcaaatggtcaagatcatgaaggaccaatactttgcagacctcagcgaactgttcaataaggtatgtgtgaagctacagcatgtcgagagcatgatacgacctccgattccatccgagcagtatgatagaatgaagagctttaaaacgatgctggaacgtatattacaaatgctgcagattagtaagagtatcatccaacctgctatgagggacagagttcctcaatacgagaaacagattatcaccatcttgaattgtctaaggaagccagtgcagccacaagtacagcaatagtttcagcagagccacctgcaggacaagctcttcattctagcatttcgcattagcaaagttattgtagagtttggttagaagactggtggaggaagtttcggtttgaactgaattatgggtgctgggaaactttcaattttcttcttctttactactccctctggtcacttttataagaccttgaagacctttcagacaatatgcaaaacagcctattttgagttgtctgaaacgacttacaaaagtgaatggagggagtaattgagatcccatctgtatgcacctgaaccgtgcttgaactgatgactggggccgatctcttggagagaggctcggtgaaataggcat

SEQ ID NO: 988 - DNA, 1168 bp, Triticum aestivum
  Clone ID: PAT_TA_988
gttcagttgcctgacaacgcaagtgaactgaagcaactgaaccagatgatacaatgtccttgaagagctgcagcggacagatggctttcggtgcctggagaaatcggtggtagagaccggagagacagggccatggtcgctgtgcaccgtgacccaggtggaggagaccaagatcgtcctccggatggtgcccatcttcctcagctccgtcctcggatacatcccggtgccgctcatcctcaacttcaccgtgcagcaggggaacaccatggacaccaagctcggcggcgtccacatctccccggccacgctcttcgtcatccccaccgtcttccagatggtgatcctcgtcctctacgaccggttcatcgtccccttcctgcgcaggatcaccggatacgtgggcggcgtcacgcatctgcagcgcatcgggatcgggttcctctcggccaccgtggccaccggcgtcgccgccctggtggaggccaagaggaagagggtcgcggaggagaacggcctcatggaagccaccaccgggatccccatgtccgtcttctggctgacggtgcagttcttcctcctcggggtggtggacgtcacctccttcgtggggctcctcgagttcttctacagcgaggcgtccacggggatgaagtccgtcggcagctccatcttctactgcatcctcggggtgtcggcttggctggggagcctgctcatccaggtggccaaccgggtcaccaggcgcgccgacgggacggggggctggctggacggcaccaacttgaacatgggcaagctcgacaacttctactggctgcttgctgtgcttgagctggtggcgctcttcgtctacaccttcttcgccaggaggtatgtgtataggaatgagcagaaggggttgtggatgtggacaccaaggttccaacggaaggtgccacctttggtgatgtgatgatctagactagactagatgatgatacacgaccaaactagacaatgccaacttcattggggcgtacaactaccaactaccactctcagtgttttgactgaaccaatatggatgggccgggatgttatatgacttttttgagtgtttcactaccgtgtaaattataaaaaaaaacattcggtgtgctcaaggtaaaaaaaaaaaaaaaaaact

SEQ ID NO: 989 - DNA, 1288 bp, Triticum aestivum
  Clone ID: PAT_TA_989
gcacgaggctcatctccttcctctccttcttcctccgtctctctctctctctcgctgcgggctgctccctcagcgtcccccccccggcgccggcgtcgcgcggcgagcgggctgccgagcgggccctccccaccaggagcaccccatcaggcgacacccggacacacagccgcgcagtcccccccccgtctccgcagctgccggcccgctcccccacgttcccgaacaaacccgccggtgccagccgcggctggacatcgcgccctgaatgcgctgcaggcacggaaatcaaggggcgcagggggaaaggcatggacgaggcggtgcagatggcacggaccatgaaagagaagctaagcagatgcttccaacgcgtgcgggttccaggtccatgcaagatgtcctatgctcatgcatccaaggcgcgctggttccagttctcaacaatacgtcaaccggtcatccttatccaggcatcactgttcctattaacctggagaaagtcagcgctgaagattatcgcggcaccgatgctaaagctttaggaaagaaagaaagatcttgagaaatctgggaaaagctatgcagagaagagtacatagaagtagttcagagctggattttaacagtcaccggagtaaagctctctgatgaggtgattcgcgtgatcgacaccagcagcatcatgcagatgtttgagcacagagtccatggaataggtccagagcaggccagcgccataggggaggaaatcaaggagcggcgtgctgcggccatggatctcggcaagaagaatgctgaggtgcaaaagaatttcagggagatgctggcgcttgtcaaagcgcaggagaaaatagtcaaggcactgagtcaggtcgatccgtggctcccttttcatttcgcctgccagtctctttacttggtcgatatatgtttgtggatgtgcctgggagctaagcttaatgcttggtgctgaaacacggaaaatgtggtcccgacgacttaccagagtgctcttgtcccgtgcactggtctgttcattgcatggcatggcacgtggattttaggacaattttatatactggccggggagcagtgaggagtttcagctgctcatcgggattggttgtgatcctcttcttctggggcagcggcgcggttgccctcgcatgcgccggcgcgccccttgcggcctcgtccgtgggcctaccttgccccgcccgtgctccccacgcaactgggattttagaacaattttatatcgtggcatggcagcagtgacttgttt

SEQ ID NO: 990 - DNA, 1559 bp, Triticum aestivum
  Clone ID: PAT_TA_990
caacactttgaagctacaatcaagtcgatcacgactcacaatcaaggtcaagcaaaagcttcgttgccagcaggatgccgagggcgtccaagaagaatgcagcggtcggcgtggggctccctcctgggcagctgcctgggcgggggcggcgggaagacggggaagcaggtccgccccggccctggcccgaggaagcgcgagtcgtcggcggcagcgggggccgggcagcggctgtcgttcacggacgtgatgagcgcggcgtcggagcaggagctgtcggtgtcgctggtgggctcgaacctccacgtgttcacggtggcggagctcaaggcggcgacgcagggtttcctggacgacaacttcctgggcgagggcgggttcggccccgtctacaagggcgccgtcgacgacaaggtcaagccggggctcaaggcgcagcccatgtctcgccgtcaagctctgggcacccatggctacgccgcaccagagtacatcctaactggtcacctcacagcgaaaagcgatgtttacagctttggtgtcgttcttctggagatcctcactggaagacgagccgtggacaagacccggcctagtagggagcaccatctagtccagcacatgcggtcgtggctcaaagaccctgaaaagctaggaaaaatcatggaccctgcgttggagggtaagtatgccaccacggcagctcataaggcagccctagtggcataccagtgcctgagtggcagcccaaagagcagcccggacatgtcgaaggtcgcggaagacctagaactgcttctcaacctcgtggatgatgtgcccggtgagccggggttgcatctagcttcacaagatgaccctaggaaggaaagaacaagaaacacccagggcgcccagggccataatcggtagcagtcggaggtgatcttcctggggcagctccggcacacgaacctcgtgaagctcatcggttactgctgtgaggacgagaacaggctgctcgtctacgagtacatggccaaaggcagcctcgagaaccatctcttcaaaaagtttcctcccgttctgtcgtggtcaaccaggctgaacatcgcagtgggcgccgccaagggcctcgccttccttcatgacgcggagaagcccgtcatatatcgcgacttcaaggcatccaacatcttactcgatccggactacaaggcgaagttatctgattttggccttgcaaaggatggaccagaaggtgacgagacccatgtctcgacacgtgtcatgggcacccatggctacgccgcaccagagtacatcctaaccggtcacctgacagcgaaaagcgatgtttacagctttggtgtcgttcttctagaaatcctcactggaagacgagccgtggacaagactagacctagtagggagcaccacctagtccagcacatgcggtcgtggctcaaagacccagaaaagctaggaagaatcatggaccctgctttggagggtaagtatgccaccacgggagctcataaggcagctctggtggcataccagtgcctgagtggcagccc

SEQ ID NO: 991 - DNA, 1336 bp, Triticum aestivum
  Clone ID: PAT_TA_991
cctatgtcaaattcctggctccgtccctggtcgctggcggcacaaacgcgtcgccgggcaaggacgcggtgtgcttggtggacgcggaggcgtgccagggtgactcctccgacccccggcaaaaagcgaagatccggatgctgctgctcctgttgttgttggtagcctgaaagaacggcagaccgcggcgtcgtgctcgcctcggcctttcccgggcttggtcccgagctacaaggtccataggatgtcggtcgccgggttcagcccgcaccacccgaggaagaaatcggccgtcgtcaggctctccttccggaggaggtcgtacgagggcgatgagatgaccgaaatgactggctcggccaagtacctgtaccggccgagagcgggcctgacgctgccgtattcggccggcgagaagccgtcggagggctgctggtcggccctcgagccgtcggcgttcagggtcagaggggagggcttcttcagagacaagaggaaatccccagccccaaactgctccccctacaccccgatcggagcggacatgtttgcctgcccaaggaaggtccaccacatcgcgcagcacatcgcgctcccgtcgctcaagccccacgacgccttcccctcgctcctcattgtgaacattcagttgcctacctaccctactaccatgttcggcgagaacgatggcgatggcgttagcctggtcctgtatttcaagatatccgagagcttcgacaaggagatctctcctcagctcaaggacagcatcaagagtgttatgaacgaggaaatggagaaggtcaaggggttcccggtggacagcaacgtgccctacacagagaggctgaaaatcctggccggcattgtaaaccctgaagacctgcagctcagcgcggccgagaggaggcttgtgcagacctacaaccagaagcccgtgctgtctaggccccagcacaaattctacaagggctcgaactacttcgagatcgacatcgacgtgcaccggttcagctacatatcgcggaagggccttgagaccttccgagagcggctgaaacatggtgtcatcgatcttgggctgaccattcaggcacagaaggctgaggagctacctgagcatgtgttgtgctgcatgaggctgaacaagttggattttgcggacaacgggcaaataccgacgctcataacctccagcgatgaatgaagctggaaaatgtactgactttgagagtgagagagacaagctgtatatagcgggagatagaggtaggaactaacgcaaatttgttgggtaacggtgtattgatcgtgcaaataatcttgtgcaccgaat

SEQ ID NO: 992 - DNA, 1028 bp, Triticum aestivum
  Clone ID: PAT_TA_992
tcgacactttccccctccccaaattttcccctccccgcagcccgctccctcctcagcgcccgcactgtagcccgaccgctcggttccaccgccgtgggctgtagccgccgtcgctgccatggccaacgacgggtcccccaagtccggtgacatcccgccctaccccgagatgattatcgcggcgatcgaggcgctgggcgacaagaacggctcagagcaagtcggccatctccagctacatccgaggagaagtacgagggcctcccctccgcgcagccgcctccctccctcaccggcccaacctcgccagcatgaaggaggccggcaagctcgccttccgtcaaggcaacacctaccccaaggccgacgctccctgccgccaccccggcaaagcgcggccgcggccgccccccccacggcaaaccaaggcggcgcgcaaggccccaggcggccgcccaacggcccgcaacacgcccaagcgcggccggggccgcccgcccaatcgtcaaggaccgaatgcccgacgccggcaagggcgccgtcgacaggggccccacaggcatggcccggggccccgggggccccacgacgccctgcacgcccaacgaggcgagggtgcccaagggctgggggctctgttgttcgcctggccggctccgctcctgccaagcgtggccgtgggcgcccacgcaaggtggcggtgtgaggcctgcgtgctgatgccttccggtctgtgtatctcgctgtggttgcgacggtggtaagctcctaggtgtgaccgtgcttcttcgatttgtgctccgtactaattgttccgtcggcttagttgctcagtatgtgctgtaacctaatcgagatgagtgtgcacaatggatggatggatgtttttagcttcggttgtagtagttgactgtgctgctgtgagtgaacatgttcaattttttttatggccatctctgttgcttccgcattatgatgaagatgtttgtcctggggttgggttgttttcttctaaagaaaaaaaaaaa

SEQ ID NO: 993 - DNA, 614 bp, Triticum aestivum
  unsure (1)..(614): unsure at all n locations
  Clone ID: PAT_TA_993
ctcgtgcctcttagcttcgtagcagccttggcctacttcaaggtgaaagcaactgctggttagtttgatgacaacgaccaacatggatcaaaccaccagtgttgcggcatgtctcaccatatcgattttctttctcaccatcaaaatgatcaaaagaagaactctgcaccaagagggaccttcacttccaccagctgtgagtgttgtttcactgtcagcatatctgcctacatttctatccaagggcctatctgccgtgattcaagacctacacacaaagatgggtagtgtgttcacaataagtctttttgggctgaagaaggtgaccttcctggtaggaccaagaggtcacagccatttcttccaaggctcaagaacaagagatcaggcatccgatatctacaaatcacggtgcctgtttttggccgacgggttttgtatgatgtggacttggctactaagagcaggcagattaacttttgtctcgattccgttaagccaatgaactttagaggcacctttcccccggtggggaggggaggggacgctccagcgcgacacatgggtantgcataanataatgggactgtctgcnatgaaaccatgtgctggaa

SEQ ID NO: 994 - DNA, 1136 bp, Triticum aestivum
  unsure (1)..(1136): unsure at all n locations
  Clone ID: PAT_TA_994
cgattttccggacgctctcttcccggtctctcctggcctcgctccccccggcggtgctggcatgtctggctcagacatgactgcttgcaagcagaccgcatccacgggcgccgccgccacctactcggcagacagcaagtcgggagcgaagagccggggtccgccggaacggaacaattcggccgagcgaagcaatgggagggaggccacgggcagatctgacctgtcgagcaatcatgacgggttgccagcaaaccacatccatggggatgttacacggggagtaggccgaaagcagctcggcagcaaagagagctggagcggaggagcgggagccctccgccaagtgcaggtagcagaactacttcaggggcgagtacgcggaaagcggctatgacacggagaacctcgagacccttgacatgtaaggttttagacgcctgtaaactctgatgagcattgcaatggaaaagtcgttgaatgaagagctcgccccgttcgcccaggttcacctaccagaacgccttctggatggacaacttcaaaggagtctatgaccagccgtccgtagatgctattaaaaggaaagctgctgaaaaccggaaatcctttagcgattcggactaagccccttatgtggccattgcacgtgtgtacaaagtactcattgccgaggcatacgagttcaagaagacactggaagttgacgctcgcgatgacggacaagatgatgaatctgaaaatgtgaacagccaagatctctaagatgtgtttgaatagaaatgtcttggtagatggcagaattactgcaaccaactccacaaaacctgattctgtctgggcggcacttggagggttgagatgcaggtgcagttcaagctgcccatatggacaatactagttcaaaatacgtttgtgctcctggctttagatgttgaagtcttttgcatattgttatgtttggttagtaaatttgaatggccgttaagttatttcactactaagccctgtgatgacattgtgagaatgcaagggactgacccctaccaagagggggcatgttgtattatgtactactaaccgcgtgagatgtacattgcagtatttaactangaaatagtaattcagaactcgct

SEQ ID NO: 995 - DNA, 597 bp, Triticum aestivum
  Clone ID: PAT_TA_995
cccacgcgtccgaagaactctctacaatacttaccaacgaatgggttctctgcatgtctcctgcagtaccactcaacatagcaagcttcagagggtttaccaactcctgtttttccatgtgcacccgttctggctccatttcttgtactttgtaaccatctccttcttaggtttcgtgatcctgaaagccctgcccatgaagaccagcatggtctcgaggcccatagaccttgacctgatcttcacctcggtgtcggccaccacggtgtcgagcatggtggccgtggagatggagtccttctccaacccccagctcctactcctgaccatccttatgctcctcggcggcgaggtgttcaccagcatgcttggcctttactttacctacatcaagtccaagaagaaagaagccccccatgaccatggtgatggtggtggcaaagtcgaaccagcaccgtctagcctagagctccctgctaccaccttcatggacgatagcactgcacagaaccagatggagcaagggttcaacaaggagcagccccgatacggccgagccttcctcaccaggttgctcctgttcatagtgctgggcta

SEQ ID NO: 996 - DNA, 998 bp, Triticum aestivum
  Clone ID: PAT_TA_996
cacacacgaaccaccagccatggacgccaactggggcgtcggcgtcggcgttgacctgaacgcccggccgcccaccggcggcgacgactggcgcgcccagcccccgcccggcccccccaggccgggcgtcctccacacgattcaccagccgtggacgcctactggggcgttggcgttggcgttgacctgaacgccccgccgcccaccggcggcgactggcgcgcccagctcctgcccgaggcgcgcagcagggtcgtcaacaagataatggaatgtctgaagaagcatctgccggtatcagtgccagagggactgaacgaacttcaaatcatcgctgtgcggttcgaagacaagatctatgctgcagcgaccaagccagtctgattatttgcgcaagatctctctgaaaatgctatctatggagacgaacgacacaaccgtgggaaatgctcaagatgattcgacactcaaactgaagcctcggtcaagcatcattgtttaaggaatgcccgacggaaccccctggcagatcacccaggggccaaagccccatctgccaggatcagggccaggccgcctgaaccgacttcccgaacgccctgtgcgacgcgggaggagattggcgcccccagctacagcccgaggcgcgcagcagcatcatctttcactgaaaaggcaacctatggagaggatatcataacatcctcctgaaaatgactgagcgatcccaaaaaaatacaaccccggtcaagatgcataagctggcgattatcgtgatactaagttcgctagtggcgggaggtctcgctgtattcgctctcgctggtgccggtggcgctgccggctccccgtgttcctctggggtgtccgtttccactcccctccgctcatggtctccctctgccctgctgtcgtgcacgtgcatctgttgtgcccgtcatggcgcagcacctggcccggcagccatggagctctgcatctgtacaagcttcttccct

SEQ ID NO: 997 - DNA, 1572 bp, Triticum aestivum
  unsure (1)..(1572): unsure at all n locations
  Clone ID: PAT_TA_997
gcacgaggaggcgatcgcaccacggtcccgtctcgcacagccgcgcattcgcaccaccaggcccgcgtcgcacgcattcgcccgcctccctgtccaccctccagccacaagtgacaactgacaagtcctcctgacctcctccccctcccaacgcgctccgccgggtcgcatcgccgccgccgccgccgtcgaccgaacccagtccaacccccgttaaaagcccggccggcgcgcgtgctcgcttctcacttcattttaattctcaaagaaaggaaagggagaaggataaagaaacagaccaacaaatccactgacggccggcggggaagaaaaggcgagaagatgggaacagtgctggactcccacttcctggcgctcaccgccctcgtcaccgtcgggtaccagctggtgttcttcatcatcacagccctcctccgcttcgacaaggtcacggatttcgcaggcagtacaaattttgtcataatcgccgtcctggtagcagctttgaagggaacatggcacttccgtcagatcgtgttgacagtgcttgttataatctggggacttcgtctggcagtgtttttactaatgaggattttgcaatggggagaggataaacggtttgatgagatgcgcagtaacttgggaaaattagctgtcttctggacatttcaggctgtctgggtttggactgtcagcttgcctgttactattgtgaacgcaagtagcagaaacccttctattgaagctcgggatatcattggttggataatgtgggccatagggctagctgtggaagctatagctgatcagcaaaagcttaaattcaagaactctccaagcaataggggaaagtggtgtaatgtgggcctttggagttatactcggcacccaaattactttggggagatgttcctttggtggggggtgtttgtagcatcaaccaccggttctctcaggagctgaatggcttgtaatcttggggcccatcttcctgacgctcttgcttcttttcgttagtgggatcccacttcttgagtcatctgctgataagcgcttcggtcggtctgaggaataccgcacatacaagaaaaccacaagccctcttatcccattgccgccggtcgtgtatggagccctgcccgattggttcaaggtggcattcctcctggagctgcccctctacaaccccggaccggaacgcgaccccgtcagctgagtgatgaatgtgcattgttcttctgatcacaagtgattatacatgtaatgtaccgcttttattctggatgggtgattcttttgcccattgatctcaaggggttacggtgaagtttgtccatatgtatctatcttcccgggatgttcaaaagcatagattgtgtacttgtctttaatagggatattgtgtacttgtgttaatagtggaaaagtttgattttatgttgtacccaaagtctgaatttttctcntagtttctatgggaattttactctttgtcacgaactccatttaaaatccctgtctcttctcgggcttcgatggtttgtgaagcttgcatgagttcatatttaa

SEQ ID NO: 998 - DNA, 1009 bp, Triticum aestivum
  Clone ID: PAT_TA_998
ttttttttttttttttttttttgccaaacccaccttccataaatttcacgtttgttctgcaaaaaaggggcaaacgttgtgtttctttggtccaacctccatgtacaacatgtgtcttacttacttattacagtatttttaaaacacaacattttgtttttctcagaaaaccagagagaatttgttacacccagccaaccaaacgcatacgaactcaccatgcatgaaaggaaccattaatactcattttgtaatagttatctcaaacaaagagtttatttctttcttccagctaacaaaccaaccgtgaacacatcctgcatcgccggatccaacaattctcattttgagttcataagctttagcaaacaattcctctctgttttccttgaaaagaagataccgtgcgctgaaccaaaccgtgtcatccgtaggcccaccatctcccagtattcttcgggagcaaggggatggagtcaattgctgaaacaacagcggacaaaacccatccggcaaagaaagcaccggtgccatatatgacatatgtggccatctccttcaagcccaactggcgcttgtcggcagccacctcgtcaccgccgatgtccaccgccaccaagttgtgcccgaacggcgcggccgcggccatccttattgcctccgtaacccccacctccgtgccggagcagcgtagcccagtagttgggaggccgcggcggcggagggagagacgggcaggcaccggagcggcgagcgcgacgtcgcacgggggtgcgcgtcggcgcgggaggtggggaagggcggcggcggcgggggtgctgatgcagagcaaggccgccattgcgtcagctttgttccggcgcaggccgagggagagacgggcggacaccggagcggtgagggcgatcttgcacgggggcgcgcgtcggtgcgggaggcgaggaagggcgacgacggcgggggtgctgatgcagagcaaggccgccattgcggcaactttgttccctcc

SEQ ID NO: 999 - DNA, 874 bp, Triticum aestivum
  unsure (1)..(874): unsure at all n locations
  Clone ID: PAT_TA_999
atttcccatccttcaacaacaagccatgaccagctcgcttctggcgtggccttcctgaacgatgaaacgatgcgtctcttcctcattcgccatggagagacagtcgacaacgtcgcaaacctctatgccggctcgcgcgattctgccttgactgcccacggcgtcatgcaagctcaaaagctagcatctcaccttgctgagcacgtcaccattggtcgcatcttctcttcaaacctcagccgtgcggttcatactgcacaggctatcctcgacgcgcagaaatgcgcaaaggatctgaaattggtccaggcgccggagctgagggagaaggactttggtacgggcgagggcgcaaagtttgggtccgcgaccaagcatgagggttccgagacgccgcaagcgatgagaaagaggattgatgttttcttggacgagcatttgcctcgactacacgaagactcgaccgtctgtatcgtcgctcacggtatcattcttgggacactttacaaagccctccgcgacagaattccatccacgtctacagcacccgatgccgcaccagaaggccgagcagaatctgcttttgctcgacccacctggagcaacaccgggtatgtggaggcactcatcacgaccaacgcatctaccacagataaaaatgtgcaaatgcgcgtcgtgaaagtcaacagcgtcgaacacctcaaaggtctgagaaagacccgagggcggattggcagcgccaagttcgacgccaaacaaaagacgatggactctttncttcagtctgtgtcgcgaaagcgcaaaatcgaagaatgagacatcgtctcacgataaatggtctcttgctactggcataacatcatgtctgatggcc

SEQ ID NO: 1000 - DNA, 530 bp, Triticum aestivum
  Clone ID: PAT_TA_1000
atattcctaagtttattaatatggactttttaccttttcacgccgaggatagaaaacctggtgtcgactacgttagatgccaaaaagaattcgagatccagatgctgttacttcaacaagacatccaaaatcgcttcgggtggaaccaacagcggggagatggatatggggtttgcaaaatgtcctggtcttctaatcagaatgccttttcgtcgagtccaccacaagagcggaccagaaaagcgtagccgatccctagcatcaggtcttaagcggggtgctacagttacatctgctacgtgatgatagacgcttacaccatggtcaacctatgcttcgtaggcaacgacatacgagggactacaatagacacgagagcgggtgaaggataatgcatgcatggattacttggaggagcggacgacttgatgatttacgaatctttatatatcacactgttggaactatttcgtctttcttcatctaggaaagaatttatcccttgcaaatttctgcccgggctgcacaag

SEQ ID NO: 1001 - DNA, 685 bp, Triticum aestivum
  Clone ID: PAT_TA_1001
gttgcaaaagaggtgtcggcggcgaagcatggcccaaggagcgggggaaccgggtggccgtcatcgacgtcagggatgagaacggtgcatatgaggcgcacatcgcggggtcgcaccacttcgccagcggcagcttcgcggcgcggctgccggagctcgtgcaggccaccagcggcaaggacaccctcgtcttccactgcgcgctcagccaggtgcgaggtccgtcctgtgctcggatgttttcagactatctatcagagtccaaggaagattcggggataaagaacatcatggtgcttgaacgtgggttcaatggatgggagatttctggccaacccgtgtgccactgcaaagatgctccttgcaaaggcacatgctcttgatcttctgggctaccatctggtccatttctactcagcttttgaatgatctgcgattcagcatcgctgctgagctagtcctttctcattgagatgatgatgcataacaatccattgaattccgcaatggcatgtctttaaacatttcatttacaaatatatgacacgtcttttttccagatgatatatgtacatggtatacctaaatataccttgtgcgaaaaaccttctttaaatgtaccggggtggttgtagtggcctggaccagggagctgggcgtgtttgcttttgaagaaaaaaaaaaa

SEQ ID NO: 1002 - DNA, 1273 bp, Triticum aestivum
  unsure (1)..(1273): unsure at all n locations
  Clone ID: PAT_TA_1002
gtgtcggatgagttgacgcggcaggacgagcggaggcgagggcgaggcgaggcagcgcggtaggcgggggtgcggccgaggtggggcggcaggcagatctggggaatctggcaggagcggcggtggggctgcgggcgcgggggcgggcggtgggctgggcggacggcgcggacgagggcggcgagggggaggactgcaggctcaggccctggcggcggaggctgctcgcgtccatggcgttctcgtggccctaggacctccgcctcgccggaggcgccggcctgattacgggcggcggcgttgtgcttcccacgcgccccgaagaattctgaattcttgcttaacaaaacgagaaagcggatcctaatccttcgtgggatccgcgtcggttcttgccctcgccgcgtcgaatccggcagcttttctttcctcctctgaatccctccgcccggccagccgccgtcgactgagccggcggttgttgggatcttgcgtcgcggggcgatccggcccggggggagatggccggcgggaaagagccgatcgaggtgaagttccgcctgttcgacggcacggacatcgggcccaacaagtacgaccccgccaccaccgtcacggcgctcaaggagttcgtcctcgctcggtggccgcaggacaaagacattattccaaaaactctcaatgacgtgaagctcatcaatgctggaaggatacttgagaataaccgggactcttgccgagtcgcgtgtcacagtaggagaggtccctggaggtgtaattacaatgcatgtggtagtgcgccctccacaagttgacaanaaccagaagcagctgggcaattcccccaagcagaacagatgcggatgcaccatactgtgatacggcacccccctggtgatgttcgatgcgcctagttgtagaatttctcttgtgcttttgttgcgtccacgacgcggtgtgtattcattttgacatccagttcatggagccattgaaactcgatctagaaacgcatgcatgtactcctgaaagcatgtttgggaatctggtgggactggctgggagtgaaggttcctccttgggatgttgctgatgtgtgcaggagtcaaggaatggatcggatgcttgctgttgtgtaaattgtaatgtggaaacaaccatcttttcatttttcctttggctatgtttgacattatatcgattctttttagcgctgctgtttgccatgtaaaacagatatattgtaccattggaatatatatacggttttgct

SEQ ID NO: 1003 - DNA, 1854 bp, Triticum aestivum
  Clone ID: PAT_TA_1003
gccccccccccgccaccaccttccacctcccccccccccccctcgccgagtcgccgtcccctcgctttcaaccccccggacgaaagcaagtattcctcgcaagaagcggaccccgggccgatttgggtggattccgtgcggccccttctgcgccatggacttctgatccggggcctctcggatcttgggaggaagggggtgggcgggcggtgggcggtgggccgggaggccggcgcggagatgggccggcgggcaggagccgatcgaggtcaagttccggctcttcgacggcccggacatcgggcccagcaaggtacgacccccgccacccaccgcctgcgcgctcaaggaattcatcctcagcccgggtggccgcaagataagggaaataactccgaaaggtggcaatgacctgaagctcatcaatggcagaaagatatagggacgataaccgtacactagccgagtcgcgtgttagaataggaacaagtccctggcagggtcaatgacattgcagtagggtaaattcgcccggaaaaatgttgaacaaagaatgctgttgtaccacgctcggcaattacccaagtgatatgaacatcccgaatacccaccaataagtgtaaatgcgggtgcacgaccttgtgccattgttcatttgcggcctccatggtagtgatgtttattcgtgctgtccgttgcgtcaccagtgaccatgtttaactatatcttttgactcacgcatgtcctgcatgaatggaatacctggaggcggtaacggctgggcaatgaggatatcccacctgcgccttgggatttggggggaggcagcactaaaagaggtatcattctgttactcttggtgtagtgtgagatcgggaatacaagatggtttctcatattttctgctttctctatttttaatatgttgattttatgtgttgcaagtggcgaaatatgtgctctcgacaaattgttggcatagaattagaagccggatctagaatattcgcagagattggtggccgcctctccctcagacctgcatcaaactcttgtaatcaggattgacacctcgaatgaagatcacgagaagtaaaacctgttggttacaactttacatgtacattctgtgggatctgtagcgttgtactccttatattagttcaggtttaaggaagacatgggtgttaaaaaggttaaaaaggaagggagaaaaaaagaggggtatgccaatgtggagattgactgataggtgatactacagtatacattgtttcccttttgttttaatccaacgtgctgctaccttgtcttttgaccatgcattcaccgtcaggctttgtgtaatttgctgcttcgtgcactgttgtacgagtagacataattattttcagaaatccgtgttcggttccacagttccttaatcagcaattcagcatatcactgtatttccacacgaaacatggtcacatgtaacatgatacaaacatctgctaacttgcaggttttgttacctttaactaaaagagctgatcttaaactatcaggtgtttgtgacctttgttgctaatcatatttattcttttgccagccaatcactctcgccttggtatatgtgggaacaacattaaaagatctatcagatgtgacacatggatggagtgagatctcgactaccagatgggtgagcaattgagtattgtagcattttcctgtattaatttttggagtaggtatcatggtttgtcatgagtccataattattgtctgacgtttcctctgttgtatggctttggggttcttccaggttccttttcgatcattcctgcttgccttgaaccatgtgacggttat

SEQ ID NO: 1004 - DNA, 690 bp, Triticum aestivum
  Clone ID: PAT_TA_1004
caagttcatcatggggctccagttccacccggaagcgcatgcgcaaggagggctccgacgagttcgactaccccggctgcgccaaggcctaccaggagttcgtccgcgcgtccgcaaggcgaagctggccgccgcgcatgctcatgtgcacgtccagagcgcggtcaccacgccggcgaaattgaaccacgaaatggagaagcagcgcaaggtgatcggccggagcgtctcgctcgccaagaacatgtacatgttcggcaacaacaacagcgcgcagcatccggcgcagcaccgggacggggacctggacggcggcgcggagttcctggagtcgaacacggcgctgagcgtgcagcaggagaagtggctgaagcagatgggcgcgacggtgcggaatgcgtcggggtacatgaacaggctcaaggtgagcgaggagcgggaggcggcggcgcgggcgctcatggcgaagatgtcggtcgcccagctcgccagcctcgccgccttctaccgcgccatgggcaacgtctgctccgaggtgctcgacgccaagctccagccgccgtctacaaccctgcacgagtgacctgtgcgctctgtctctgtgaacctggccggaaatgcttgctcagttcatcagaaatcaaatgttgcatggcatcctgaattaattaaaccgtgtgatgttgatgc

SEQ ID NO: 1005 - DNA, 1254 bp, Triticum aestivum
  unsure (1)..(1254): unsure at all n locations
  Clone ID: PAT_TA_1005
gcacacacacacacccccccgnnagcgcgagnaagatgcagcccaagatcaacacgttcttcaagcgccaggccacggggccggattcgaacagcgaagcgacggaggcgaagaggctcaagagctgcggcgacggcaaggtcctcaacaagaagaggaactacgggcagttccacctggagctggggcagcctgatttcctcctccacatgtgcgcggcctgcggcatgatgtatgcccgcggcaacgacgaggacgagaaggtccacagggcctaccacaagagctacctcgagggcgtcccgttcaagggttggcgcgaggaaaccgtggttatgaggtccgagggtggtgaccggataattctagcaagcggtgaaaactcatgcatacggaacagcaaggttcaggaggtgatcaaagtggtggagaaggagctggggtttggtgaaggccagctccttcataagctctgcaaggtgtatctgtttgtatctggcgggaggatagcggggtgtctagttgccgaaccgataaaagcagcacacgaagttattccaagctctgcatcggaaaaccgaagcaatttgccggacaataaaactgaatcagcacaggcaaagcatacattggagtttgggaaaataagcttcaagagggaagtcctacgacggcataatcaccccgacaagagtaaagaagagtgccagggccctggtgccatagtctgtgaagaagaagctgtgcccgcgctctgcggattccgggcaatctgggtggtgccatcgcgcagaagaaagggaatagcgtcccagcttgtggacgctgcaaggaaaagcttctgtgaaggcggcacgttggggatctcacaatgtgctttcacgcctccaacctctgaagggaaggagctggcatcgacctactgcaagaccagtgcattcttagtctacagggatggagatgtataggagaggtgctcccaaaactggaaacccatgtgttgaacagttgcaaaagtcgtcatgtcgaatacttgacacttaaataggtcattctgctctcctggtgctgatgattcaatgcacataaagttcctgttcttaacatgttttgttattcctcagcaaagatagtgtaattctgtaacaagctatttcattatcagtttgtcaatatagccaaggccgtcgtgtttagacggttgtagagaaaaatagcagtgggcaaacacagccagagtcgnctnaattctca

SEQ ID NO: 1006 - DNA, 764 bp, Triticum aestivum
  Clone ID: PAT_TA_1006
ctcgtgccgaattcggcacgagagtggccgcgcgtccgcggccggggacgacgggctgttttcgtcctcatcgtggtccgaggaagagggcaaggaaacgtccacgccaggggcctgggcctgcggcttgcgccggtgccgggttctgccgggcgggctccatatcccgcctcccatctcaggtggccccgggtggtggccgtcccccgtgcccgctgcctgtacccgagaagaagaccgaggcacctacgcaagggagctcagagcaagggacatccaaaggcaagcaacaagaagaaattagaattaccgatgagccgccactaccgcagggtgggcagaagaggcagcgcagcgatgatgccccaggagaaaccgctgacctgcagggcaagcttgttgagattctagaccggagcagccggatggtggcggcgcagctggaggcgcagaacatcaactgccaactggatagggagcagaggaaggaccaagtgagcagcttgctaggtgtgcttggcaaggtggctgatgccctctacagaattgctgacaagctgtagtttgcccgctgtaaacgtcttgagcaaagtaaataattactgcaaataagaagggaaatagcatgaaattataagaatgtacagattggtagagtatctcggcattcggtttttcttgtagactggttctgaaatttagtcagaaacctgaaggagatggcctgttttcctcaaaaaaaaaaaaaaaaaaaaaactcgaga

SEQ ID NO: 1007 - DNA, 1887 bp, Triticum aestivum
  unsure (1)..(1887): unsure at all n locations
  Clone ID: PAT_TA_1007
cctcgtgccgaattcggcacgagggcgcccccagtgcccaccccccccctccccctccccccccctccccccccccgccgccgccgctgcgctaagtccaagggctgcgctcgtgcacgggaaccctcggggccgctgacgactcgctggatctgcttgcttgagtagcggtgggctggagctgcctgtctgcctgcgcgcgctgcgagggtggcggtaacttcttctgcggtctcggatcgcgtcggattcgagtttcccgggcggctgttccccggggctggaaggtggattaggctgcggttgatcaggatatgatggcagctgtttaaggttggtgaaatgtctgtgcggatatcataagtgcaaacatatttattgaactgacaacggcaaggcagacatattttgagaatataagtaatgggttgttctcctttcttctgctataaaagtggggcaacacgccagcaaatttctacgcatactgaagacctccctggtgatattaatacaataagatacacttataaggagctagcaagggcaacagaaaattttaacccatccaacaagattggcgcggggggttttggatactgtatataaggggcggctaaggaatggaaaacttattgctgtcaaggtgttatctgtagaatcaagacaaggactaaaggagtttctgaatgaactgatgtcaatttccaacatatctcatggcaatcttgtcagcctttatggctattgtgtggaaggaaaccagaggatccttgtctacaattaccttgagaataatagccttgcacaaacacttctaggttctggccgcagcaatatccagttcaattggagaagtagagtaaatatttgccttggtatcgcccgaggattagcatacctccatgatgatgtcaatccccacattgttcatcgggatatcaaagcaagcaatatacttcttgataaggatctcacccccaaaatttctgatttcggtttatcaaagcttctacctccaaatgcgtcacatattnnnacacgggttgcaagaacattaagttacttggctcctgagtatgccattcgaggacaagtgacacggaagtcagatgtttatagttttggtgttttgcttcttgaaatagtcagtgggagatccaacaccagttcaagattaccctatgaagaccagatacttctggaaaagttcccagaggttaccaatggggttctcctcttgcagacatggatgtattatgagcagggagatttggcgaaaatcatagacagttctgcgggtgatgatttggatattgaacaagcctgcaggttcctgaaagttggacttctctgtacacaagatgtcacaagacatcgacccactatgtcaactgtcgtcagcatgctaacaggcgaaaaggatgttgactcggagaagatcagcaagcccgctacaattagcgactttatgaaccttaagatcaggagcatgaggagagaaaataacattgctttcgcttcatcctccacgttgctatccactatcatggcacactcttctcctttgttgtcgcaagagacgacacaagcctccatcacattcaccacaatatcagagcgtgagtgacctgaagttggttgcaaatacggagaccatgtagagaagtagcatagccagatacccctttttccagaagtttccttcgtagtgtatagattcactttgtttatagtgtacacagcattgctgggacaaagaagttcatgagttttactttgtgtgtacaatactagattggtggcgcaatgccattgtatatgtgtgcatgtacatcctgtccgttgtttgtttgggtggaaagaaaatagtacatgtttgaaaaa

SEQ ID NO: 1008 - DNA, 734 bp, Triticum aestivum
  Clone ID: PAT_TA_1008
cccacgcgtccggtccctccccccaaattccccgacccaccgctcccaaatcccatccaaatccctccacatcctccaaaggtcggattttcagagggcctccgcccccagatcggggagggatccccgtttcctctggtgggtcggtccccgccgtccttttcttgatctttttcctggaggggaggttcttggatggggtgcctgccgtgcttcgggtcgagcggcaagggggagcctgccaagaagggcggcgcgcggaaggacgttccgtcggatcgccgcgccactggggtcggatcagataaaccaaaaccacaaggtttattggactctaagaaggatacagttatcccaagggagggaaacaatcaacatattgcagcacacacattcacttttcgtgagcttgctgctgccactaagaacttcagacaggattgcctattgggcgagggaggtttcggccgtgtatatagaggacgtttggacaatggacaggctgttgcagttaagcaacttgatcgcaatggacttcaaggcaacagagagtttctggttgaggtccttatgctcagtctattgcaccacgataacttggtaaacctaattggatactgtgctgatggggatcaacgtcttcttgtatatgaatatatgccgctaggatcacttgaggatcatttgcacgacattccacctgaaaaggaacctcttgactggaatacacggat

SEQ ID NO: 1009 - DNA, 611 bp, Triticum aestivum
  Clone ID: PAT_TA_1009
tcgcggccgcgtcgaccgccgacgtcgaccgctccgccgccgccccggacgcgtgggcctgatctttgcagctggatgactgggtgctctgccgaatctacaacaagaagggcgtcatcgagcggtacgacacgccggactccgacgtggccgacgttaagccggcgccgccgccggctgccaagatcccgcggcaaggccagtaccacgctgggccagcgatgaaggtcgagctgtccgactacgggttctaccagcagccgtcgccgccggccacggagatgctctgcttcgaccggtccgggtcggcggaccgggactcgaactcgaaccactccatgccgcgcctgcacacggactccagctcctcggagcgcgcgctgtcctcgccctcgcccgacttcccgagcgacatggactacgcggagagccagcacgccgccggcctcgcgggggggtggccgggcgacgactggggcggcgtcatagaagacgacgggttcgtcatcgacggctcgctgatcttcgacccgccgtcgccgggcgccttcgcccgcgacgccgccgcgttcggggacatgctcacgtacctgcagaagccgttctgaatg

SEQ ID NO: 1010 - DNA, 1346 bp, Triticum aestivum
  Clone ID: PAT_TA_1010
gaggcgcctgtcgcatgcccccgaactcgacgccgcagcgccgcgcgcagcagcagcagcaccaccaccgccccgtcaccgccggcggcaggagccaggaggcggccatgtcggcggtggcgtccgacgaggaggcgttccaggaggtggacccgacggggcggttcgggcggtacgcggccgtgctggggctcggctccgtcaagaaggtgtaccgcggcttcgaccaggaggagggcatcgaggtggcgtggaaccgggtgcgcctgcgcgcgctggcggagcgcgacccctccatggtcgaccgcctccacgccgaggtgcgcctcctccgctccctccaccacgaccacatcatcggcttccacaaggtctggctcgaccgcgacgccggcgtcctcaacttcatcaccgaggtctgcaattcggggagcctccgcgagtaccgcgaccggcacaagcacgtctccctcaaggcgctcaagaagtgggcgcgccagatcctcgagggcctcgaccacctccacacccacgacccctgcatcatccaccgcgaccttaactgcagcaacgtcttcatcaacggcaacaccggccaggtgaagatcggcgacctcgggctggcggcgatcgtggacaaggaccacacggcgcacacgatcctgggcacgcccgagttcatggcgccggagctctactcggagacgtacacggagtcggtggacatctacgcgtacgggatgtgcgtgctggagatggtgacgcgggagatgccctacggcgagtgcgagagcgtggtgcagatctaccacagcgtcaccaacggcgtgccgcccgccgcgctccgccgcctcagggacccggagatgcgggccttcatccagcgctgcatcggcaagccgcggaaccgcccctccgccgccgacctcctgcgggaccctttcttccacggtatcgacgacgacaccaccggcacgctcagctagcagcgcccggtggcgagggtggatcggacgtagtagcagtgttaacttctccgtgttgttgttagtggttagctagtagtagaagcacgacgctgagtccaaatgattgtttgatttgtgctccagcaagtaagcgagcaaaatgtgtaaagatcatgcatggtctcgacggaattcgtctgggccagtctgtattcttattgttgcattccagtagtacagtattcttattgagaaggcatcatgggctcatggcaattaataactgttcacctgaatacaaatgaggaatgagccagcgtttctcttcaaaaaaaaaaaaaaaaaaaaaaaaaaataaaaaaaaaaaaaaaaaaaaaa

SEQ ID NO: 1011 - DNA, 628 bp, Triticum aestivum
  unsure (1)..(628): unsure at all n locations
  Clone ID: PAT_TA_1011
gcgcccgcgccaccgcaccggctcaccaccacacagacaagcaagaatggcgatcgccgtgagcgggcgccgtgagcggctgcggacgcgcggctgcggcgcgctcggctgcggcgcgtcgggggccgtggtctccgcgtgcggcgggctgcgcgtcggggagtcctgtttgcgggcggagtcggtgcgcgcggcggacgcggcggggattctcgccgggctctggggatcctctccgggctgtcctcgccgcacgtcgtggcctgcatcggcggcggcggcgcccgcgacggctcttcgcccctcttcctcgagttcgcccccggcggctcgctcgccgacgaggccgcgaggaatgggggccgcctggaggagcgcgccgtccgggcgcacgcgacggacgtcctgcgcgggctcgcatacatccacggcaagtcgctcgtgcacggcgacgtcaagtcgaggaacgtggtgatcggcgccgacgggcgcgccaagatcgccgacttcgggtgcgcgagggccctcggcgaggcgaggccgatcggaggcacgccggcgttcatggccccggnnntggcccgtggggaggagcagggcccggccgcngacgtgtgggctctcggnn

SEQ ID NO: 1012 - DNA, 829 bp, Triticum aestivum
  Clone ID: PAT_TA_1012
ggggcgacattcgccccaccattcttccgttgccctgattgattctctgacgccatggccgcccacggcaagcccaagcccaagccgcccggtgcccccgcgccgccgccgccgcccccgccaccgacggcggcagaggcgaagaagggcttcatgcgccggatgttccccttcctcctcgccgtcaacgccttcgtcggcgcctacatgctcgtcaggacctactacaaggactccccggccaagaccgccgacgctgcctctgcaactgccacggcgtccaccgccgtcgagtcccaggagcctgttgccgccgtcgcgcccgtcaagccggtgcttccgccgatccccgaggacgagcagcgccgggtctacaagtggatgctggaggagaagcgcaaggtgaagccgcgcgacgccgcagagaagaagaggcttgacgacgagaaggccctgctcaagcacatcatccgcgccgacaccctcccggtgctctgaaacgagagagcctcaccacaccaccaccagactggactgctctgctgttggaataattaagctggcactgcctctgcctaattgatggtttgattggatttagttagttagttgattgtgtcgtgtgctactcttatttttatcctcttataaggtactcctagtttgatgccaagaggcccatctcgagctgctttatttatgtggatgcaggcagactggtcttgttgcttgtgttgctctatgcttcttaagataaggatttatgtcgaactcaataattttctgtggatgtggatgcaaactgctcctttgtagcgaaaaaaaaaaa

SEQ ID NO: 1013 - DNA, 726 bp, Triticum aestivum
  Clone ID: PAT_TA_1013
gaggaattgggggcgagagagagagacgcacgcagcagagcagagctccacccgaggggagaaggaaaagagagctccggcctcgcccctgcccgcctgcctgctgtcccaagccccaagccaagattctctcgtcgcgtcgccgtaaatagcgccattcgaacgcgggctccgagctggtgtgtccaagaagtcgaatttggaggagaaaatgtcggtgatccatgccgacgacatcgagatatcgctctgcgacggcaactcggaggacgagcgccgccgccggaagatagggtcgctgcgccgcaaggccatccacgcgctcaagaagcgcggcaggcgtcgcgtcgacttccgcttcccgccggccatctccatcgaggacgtccgcgacgccgaggaggagcgcgccgtctccgccttccgtgagcgtctggccgcgcacggcctcctgcccgacaagcacgacgactaccacatgatgctaaggttcttgaaggctaggaaagttcgacgccgagaaggcaatgcagatgtgggcagacatgctgcgatggaggaaagagtttggggccgacacaatccttgaggattttgagtttgatgagctggatgaggtgctgtgctactaccctcagggctaccatggcgtcgaccgtgaaggccgacccgtgtacatcgagaggctcggcaaggtcgaccctaacaagctcatgcagatcacct

SEQ ID NO: 1014 - DNA, 1355 bp, Triticum aestivum
  Clone ID: PAT_TA_1014
tgctgcagcaaggttccctgctctcattctctccctatctctacatttgcttctttctcccgctctgccgagctgaagaagcggagtgttgatgagatagttggaagtggagaccggcagaaccgtggtggcggaatgaagtgctgcagcaagacatatttacaatcagcctctgtgcggatagaagaaatgagagtgaaaagacgtgacacagagcaatggatggcacatcgattacttcctgagaacctcaaggggcgaatattgcgtcatgagcaatacagatggcaagaaacaagaggggttgatgaagagggccttcttatgaatcttcccaaggatcttaggagggagataaaacgacatctttgtctatcacttctcatgagggttccaatgtttgaaaacatggacgagcagctcttggatgcaatgtgtgatcgtctaaagcccatgctgtacactgaggacagctgcataattcgagaaggagaccccgtgaatgaaatgctttttgttatgagaggatatctcgagagtatgacgacaaatggtggacagagcggattcttcaactccaatgttctcaaaggtggagacttctgcggtgaagagctcctcacttgggctcttgaccccgctgcagtttcaaaccttcccagctcaaccagaacagtgaagacattgtctgaagttgaagcctttgttctgagggctgatgacttgaagtttgtagccacccagtttaggaaactccatagcaaacagctccagcatacctttagattctactcacaacagtggagaacctgggccgcttgttttatacaggcagcttggcacagatattgcagaaagaagctagaggattctttgtttgagaaggagaagaggttacaagcagctattgtaagtgacgactctaccaagctcagtctgggcgcggcactgtacgcctcgcgttttgctggcaacatgatgcggatcttacggagaaatgctacccgaaaggcccgtttgcaggaaagggtgcctgcaaggttgttacagaagccggcagaacccaacttttttgccgttggagagtaattttgacataccctgctacaagcagaaagtcacaacccaactggtaaagtttgttcttgtgccctcatcttctcccagctcggctcagtttatgactggatgctgtacctgcccgggcggctgctcgtacaccctcggcatgcttctgcggcgactcgggcatacatccatttcctcaagtccatacatgtgctgtgtttgtatattgaaggtatctactataagcattccacatttattcgtacctgaattggaaacatgaaact

SEQ ID NO: 1015 - DNA, 957 bp, Triticum aestivum
  Clone ID: PAT_TA_1015
atattctcgaaacgccaacccaaccaaatccatcatcgccatcatccccaccttattaaaccaaaaacccgcgaacctgatcctccagtgctgtccgccatcacagcgtccgtgatagtgttgtgatccgctgatcattcgctgttagctcgcggagcaagctagcgttcgtttcttgcagggagagtgatcggtcgggcgggtggcatgagcccggggagcggcaagctgcggtggctgtggagggcgccggcgcgggcgttcgggcgcgcgcgggacttctacgtgcggagcatcacggggtgcgcgcgctacgtccccgccgacgcggccttcggcgcctacccggtgctcgtgcccgcgccgctgccaaggagccagagctgcggctctggcgccgactatggcggcgaggaggacctccgggagctcatccgcgcggcctcgcagaggcgcgacggcgagcagcagcggcaggccgaccgtctccatgccgtgcccaggagccagagcgtggcgggggcggcgtccatggcgccgatcgacgaggacgcgccgtgcgagttcgccgccggcgcgggcgccacgctctactcccgcagccagagctacgccggcggcgccatgggggccaggaagtctcactgccacagcaaggcgtcggtcttgggctgagctagctgccggctgctcctggactgctcgtgtgtgatcaggtcatgcttgccaaaaattgttcatgctgctccgatcatctgaaattgggattttgagcttgtaaatacgatacagggaggaattcatgcatgtgtaatctgcttgtttcgttttactctcgactatgcttcaaaaatcatgggttccatgatcattctcttgtccctgcttgataaaaaaaaagaatgtatcatatttaatctatttctttcatcatcttatatcatacaaattattagg

SEQ ID NO: 1016 - DNA, 706 bp, Triticum aestivum
  unsure (1)..(706): unsure at all n locations
  Clone ID: PAT_TA_1016
atggaggacatcgtggagcccaagccgacatcacaaccagagcctttagcaggtgaggaccaactttagtcaggataagtgtactagatattccccttcaaaatggccaattgttggcgcccttcccgctcaatatttgggaggaggcccagggcctttgcctacaaatagggctagccaccacaagatagaaacaagggaatcctcaccaggaacccagtagagagagcgactgaactccccctagtagttcatcgcactaaccaaaaatagaccctcgccaggctgttcttcccttgtactattcatcatcagtcccagaggcaatccaccacaccacacactagagtagggtattacaccacaacggtggcctgagctagtataaacctcgtgtcccttgtgttgttcatcgggtagtctagattcgtagcgaggagttcgggcatggattggtaggaggagatctccgcgcgcaccccagagttcgaaccttaagggtttagacggaacccgatatctgacatttggcgcgccaggtaggggtgcgccggaatctttcttntgctgttccgcgttcgatcgatcatcgcatccatggctgacactcgctaagttcgtgctgagcgtcgggctgctctcgccgcccgcatcacccagacggctcccgttggtgggcctcgcgtggccccggatattacggacc

SEQ ID NO: 1017 - DNA, 735 bp, Triticum aestivum
  Clone ID: PAT_TA_1017
tccgtccctcctcccgcgactcggccccctggcccccgcgcggggccgggcctcgcagcgcggtccccgggtagcttcctcaggtgctgcctcgccaggctggctcgcggggaggcggagagatcaaggcggggtacctcacgaggtgcccgtgatgcaagccatgacgacccaagccaggcgggcgccggcctgggcagtgtccttgtttcctcttcggtgcaaatggggcaagcgcaggccaaggcatcaggcaaaggttaccatttcggtccaacaagaccaagaccagcagaacggcaggatggaggtcatcgtggagcccaggacggcgtcatcgtcagagcctttggcaggcgaggaccaactttagtcaggataagtgtactagatgttccccttcaaaatggccaattgttggcgcccttcccgctcaatatttgggaagaggatcagggcctctgctctataaataggactagccaccatagaggtagggagtcgtgatccggagcaggaacaacaaagagctagcgacaaaccaccccccagcagtcacaaggcccttctacgtacacttcttcatcggcaggccctcccttgtattgttcctcgtcagcccaagaggcaatcctcgtcccccatacttgcgcagactattataccccacgggtggcctgaaccagtataaaccctgtgtctcttgtgctgatctttttgtagtttagatcctag

SEQ ID NO: 1018 - DNA, 910 bp, Triticum aestivum
  Clone ID: PAT_TA_1018
ccgtccgcccacgcgtccgggaaagaggcccggaatcacggaccggccccctccacctttcggtttcgctcatgaacccccgggtggtgaaaaccgaggcggccgacgagcgcctcacgccgccggcgactggcgccggcggcggcggaccgcgcgccccggttcagttcatagagctcagcagcagcgactccgactctgacggcggcgtcggcggcagcgcaaagaggtcccgcagcgcggcaggggacagcgccgcggggaagcgggctagggtttccgcggggcccgtggtcggcgtggacgtgccaccaggcttcctcgatccgctaccggcgcctccgcagccgtcgaggggcgcgacgaagcagttctggaaggccggggactacgacgggaacccggccgggggtgcggagccgccgccatctgcatctggattggaacatgtccgcgtacatcctaaatttttgcactcaaatgcaacaagccacaagtgggctctaggggctttggctgagcttctggacaactcactcgatgaagttagaaatggagctacgtttgtgaacattgacatgttggagaatagtaaagacaaaacaagaatgctccttgttgaagataatggtggtggaatggacccagataaaatgcgtcagtgcatgtccttgggttattcggccaagagccaagttgcaaataccattggacaatatggaaatggtttcaagacaagtacaatgagacttggtgctgatgttctggtcttttcccgtagccgtggaaaagaaggcaaaaggcctacacaaagcattggcatgctatcttatacctttttgaggagcactggtaaagaggatattgttgttccaatgattgattatgaaaaaaatggactgaattggac

SEQ ID NO: 1019 - DNA, 512 bp, Triticum aestivum
  unsure (1)..(512): unsure at all n locations
  Clone ID: PAT_TA_1019
cctgattcctgtgtgtgggccctccgggatctccacgccacgcctgtggagaaagccgcatggcgcataccctgtggcgacgaagcgcacacgggatttgtatctagcctcactttcatgtcagctctggtttgctccatgtccatagtcttagcagcttccctaactccttgatacaagtgctggaaacacaggacacggtgcattgatatggtcggcagaaaatgactttttttgtcgcaagacttgtgcacatcatttcacgcgtacttttacgcgtcatttgcaaaaaagaaaagaaggatgaagcgagcacttgtggtgagtggatccgctggacagggcctccatgaagcctctctgcacttcacctgatcactctcttattttactactccctccgtccggaaatacttgtcatcaaaatgaataaaatgggatatatccaccttttaatcaatttgatgacaagtgttttctgacggagggaatactntgccganggcttgtcn

SEQ ID NO: 1020 - DNA, 1435 bp, Triticum aestivum
  unsure (1)..(1435): unsure at all n locations
  Clone ID: PAT_TA_1020
gcacggcagagccatgggggtggccaacgcagcggaccacggcgcggcgccttcagggattcatcctgcctgctgccgcctccttcctccgatcaaccggcagcagcgcaccctgcccctgcacggcctcaccttcgaggacaaggacatcttcgacgtcgccgtcagcgtcaccggcttcggcaccccggactgggcgcgggcgcacgcgccggccaccgccacggcgcccctggtgctgcccgcgctggccgccggcgccacgggcgtgggcaagtgagggatggaatagactacctacagcatcaacggcgagaacgcccactacggcaccccggccaacccgtgcgcccccggccgcgtccccggcggctcctccagcggctccgccgtgcgcccgtcgccgccagcctcgccgacttcgccctcggcaacgacaccggcgggagcgtcagggtgcccgccgcctactgcggcatcttcggcctccggccctcccacggactggtctccgtcgagaacgtcgtccccatggcgcagatgttcgacaccgtcgggtggtttgctagtagatctgcctacgctgtctcgtgtcaccgacgtgatgctgccgccggtgccagctgccgccgacgatgatgccgagataccacgacgaccgagccgtgtcatcattcctgcagactgtttcaagatcttgggctctgtggacgaccacacctacgagatcctcaacgcttcagcggccaagatattcggcagtgatgcagtggtggacaatggaaaccttggtgattttgtctccagcaatgttccgagcatcgggcaagttcatgaccgacttgtctgcggtcgaagcatcatcgtccgtgtgtgccgcctctgtctgccatcctcacgtgtcatgcgagttcttcaaaaggtctgaattcaaaagcaaaccaacgcgggggggggggtcatgctgcggccaagccccggcccccgcgtccgagagcgggtgcaggaggccatcgcatcggaggatgaatctgccatggatgatcttcatgccgtcaggactgaattcaaatctgcgttagccactcttctaaaggacgatggaatcctggcgatccctacagtccccggcgccccaccgaagctatgcctggacgcggcactgctggaggacttccgggcgagggccttctcgctgctgtccatcgccggcctgtcggggttctgccagatcagcatcccgctgggcacccgtaacggcgtcccggtgtcagtgtcgctgctcgcgggacacggcggtgactgtttcctagtcgctgtagcccaggagctccatgaggcgctccaagccgaggccgcggcagcctggggctcgtcagcttagcccaattctgtcatatncttgctgaatnccncgagtacaataaattgtgtg

SEQ ID NO: 1021 - DNA, 642 bp, Triticum aestivum
  Clone ID: PAT_TA_1021
gagggagagatcccctcgccgtggtctctcttccttcccccacctccctcccccctccggtcaccggcgcggcgaggcggccaccgctgctgtctcccccctcttcctccctctccgcgcgatagggtctggtggagcggattcgtcccgaagtcgatcgaactgattcgttcgtaatggcgaacctgcagccttccgtccccgagccctcctccttcgcaggggcctcgccgccgtctccatcctcgatcggtggaggcgctgcctcggcggcgcaggagcccaggaagatggcgtcggcggagcagctggtgctcgacctctgcgaccgcgagctgcgcgagaacgccctcctcgagctgtcgaagaaacgagagatatttcaagacctggccccgcttctctggcactcttttggcacaattgctgcactgcttcaggaaattgtgtcgatctaccctgcactttcacccccagttttgtcggcaggcgcatcaaaccgagtctgcaacgcacttgcacttcttcagtgtgttgcatctcaccctgataccagaatccctttcttacatgctcatgtgcccctgttcttgtacccgttcctgaatacattcagcaagacaggcttttttgagtacttgc

SEQ ID NO: 1022 - DNA, 1274 bp, Triticum aestivum
  Clone ID: PAT_TA_1022
cccacgcgtccggggaggagtttcgctcgagctatcgctcgtgccacgaagctggcggtgatccctgcactagcatcgctactgggcggcctgctgacggcctgtgctgcggcgtcgggcggccacgtcgacgggagggacatgctgaggctggacaggttccgcgagtggaaggccactcaccaccgttcgtaacccagcgcgcgcaaggggccagctgccgggcgttctcggcggtggcaatgatggagagtctctacttcatcaagacggggacgctggtgaccctgtcggagcagcagctggtggactgcgataagtacgacggtggctgcaaccgaggctactaccacagggcccttccagtggatcatggagaacggcggcctcaccacggcggcgctttacccatacaaggcggtgagaggcgtctgcatccgcgccaagcccgccgtcaccatcaccgggcacgcggcggtccccaagaacgaactggccctccagagcgccgtcgcgaggcagcccatcggcgtggccatcgaggttccaaccagcatgcagttctacaagagcggcgtcttctcggccccctgtgggatccagatgagccacgccgtggtgaccgtcggctacggcaccgacgcctactcggggctcaagtactggctcgtcaagaactcgtggggccagacgtggggcgaggccggctacatccgtatgcgccgcgacgtcggaggcggggggctctgcggcatggcgctcgacaccgcttacccgaccatgtgatgtcaatcatgcaagcgcacctacgtacgttccgagttaagtaaactcgcaggcagcagcatctgccctagtagtactccatcgtgcatctgtgacgtcctacttatgtcgtcgattacataacgaggctattatacgtatgtggtgtgtgtactacatgtgtaataacaatatagtatcgtgggtgttttcttgttaaaaaggtaaaatgtcccatggggcgaggccggctacatccgtatgcgccgcgacgtcggagggtcggggctctgcggcatcgccctcgacaccgcttacccgaccatgtgatgtcaatcatgcgcgcgcacctacgtacgttccgagttaagtaaactcgcaggcagcagcatctgccctagtagtactccatcgtgcatttgtgacgtccaacctatgtcgtcgtttacatcgcgaggctattatacgtatgtggtgtgtgtacgtgtaacaatatagtatcatgcgtg

SEQ ID NO: 1023 - DNA, 798 bp, Triticum aestivum
  unsure (1)..(798): unsure at all n locations
  Clone ID: PAT_TA_1023
ggcacgagcccgttcctatcttcttctcttctcgtgtagggttactaatcctgctagggttcgtcggagctctgctgttttttctcctccctcggctatgttgctcgtttctgctctctgctctattttcatgctatttgtgttgtaggttttgaaggtattgatgttttgaagctgtttgtgtatgcaggatcagtaactgcggattttcttggatcaaggatttactttggcgaatctgctccttttttgtatggtttgccctgtttgtcgctgtcctggtgctccatgcttttcgtttgtgccagctgatgaagtccttgaagtttttgatgttgtccttgatgattttttgctttacgaggatggtggtttcagaagatgcagcatctaaaataaaattcagacaaaatatactggagatggggcagcaaataatgatatacctttgcctgatcagaagcaatttgatctccaagaggaactaaactttgggaaatcgaaggagaagtatattgccagcaataatcctgtggagaattacccaagaaatatcaagaagacaggaggagatctgagctttgtttctgcttccaagggtggcggctgtgtggatgtccnangaacaaagcaaanggggcaaggaggaagaccaatgactgtacgttaatggttcttaatttaacgggtttcaagcctttcctttcngggctanacaatagcanaagaaagaacagaactacgacctttgcatatgggtgncacgtccaatttgggcatcatttcaaaaaaaaaaaa

SEQ ID NO: 1024 - DNA, 512 bp, Triticum aestivum
  unsure (1)..(512): unsure at all n locations
  Clone ID: PAT_TA_1024
cggacgcgtgggccgtgaagaagtagatatactgcatcacatggggagctgcgcgtccaaggacgacatggcggcgaggccgaggaacgcggcggtgcacccgtgcccatggattacgccgacgacgctgccggcgcccggccagcgggtcgccgtgcggatgcgcgccagcgagttccgcgctctgcatgaagccactggtagggataccagcggcagagatgccgacgccggcgtcggccgtgccatcctggacggctgcgtcaccggtcggtggacgtggtcactagcgtccgcgtcctactttgcaggctagccacccatgctgcgcatgcagtcatgcacatagatgacttgtgtacataatactagtgcatatgaattcgtctctacatacatagcttcacaaacctcctgatccattcgtctatgtgcgtatgtagttgtaattgaggaaagacgaattggatttgtggcacaaattacaaaaaaaaaaaaaaaaannnnnnnnn

SEQ ID NO: 1025 - DNA, 835 bp, Triticum aestivum
  unsure (1)..(835): unsure at all n locations
  Clone ID: PAT_TA_1025
ttgcgctcgccgcccggcctccagttcaggacactcgcccgctctccagttgccagatctccagccccaggagctccgaagcagcctctccaatggcggtcaaggtctatgtcgtgtactactccatgtatggacatgttgctaaactagctgatgagataaagaaaggtgcgacgtcagtcgaaggtgtcgaagctaaaatatggcaggtccctgaaactctccccgaggaagtacttggaaagatgggcgcacctcctaagcttgatgccccaatcatcacaccacaagaacttgcggaggcagatgggatcctgtttggttttcctacaaggtttggcatgatggctgcgcaaatgaaggcattctttgacgcaactggtggcctgtggagggagcagagtcttgcaggcaaacctgcaggcatcttcttcagcaccggtactcagggtggcgggcaggagactacagcattgacaacggtaacccagttgactcaccacggcatggtgtttgttcctgtcgggtacaccttcggtgccaagctgttcgacatggacaaagtgcagggtggcagcccgtacggcgcaggcacatttgctgcagatggttacgaggtggccatctgagatggagctggagcacgccttccaccagggccagtactttgcgagcattgcgaagaaactcaagggatctgcttgacctcttctgtctgcacatatcgtaaaaaggcatttacatgagctccaccgtattgtcaatagcttgttctcttcttttgtggtgttttagaatttgtgtgtnctctgtggaacttctattgcggcgtgcg

SEQ ID NO: 1026 - DNA, 730 bp, Triticum aestivum
  unsure (1)..(730): unsure at all n locations
  Clone ID: PAT_TA_1026
tttttttttttttttttgtacgaactatatatatatatatatatatatatatatatatatatatatatatatatatatatatattgtatatataactgaaccggcgttcttacagttcatgttcaggaatcttcccaggttctccgtcttccgggtcaccgggtctatgccacgcccggtcttcctcagatcattgaactcatgcagctgcttctcgttgctatttccactgctgatcccttctggaaccgcaccagtcgcctgcttccttgagctcgcatcgaggaaatacttggccagctgggcggtgttcatgtcctttgcatccatggttagaattgacttcatgaacatatcatgcatgctggttaccttagggcgagcggcggaagaacaggcagtgtcctgcagagaatcatcctcatcgtcttcatccatgaggtccgacgtgaggaaggagtcggtgtcggaaccatcacccaaggaatcaaatgaggaagagaagccagaggagaaatcactgtcagaggcttctcctccttggtgatccatctcctgtctgttgtctgttgatgccacgaagtttgcaaagtgcatcgcccagctgctctcgccggccgacatggacgccgccgctgccggctggctgatgcaagaagactgtggcgatgttgtcttctnccatgtgtatgagaaactgcaagcagaagcaggccggcagcagtgataa

SEQ ID NO: 1027 - DNA, 886 bp, Triticum aestivum
  unsure (1)..(886): unsure at all n locations
  Clone ID: PAT_TA_1027
gcgtccgggtcccccggctgatatcggactcaacctacaacatcttcacgacggtttgcaactactcacggtatgtgagcgagtattaccacggctccatcagcacggtttgcgacagggtgatgagccaagtgaccagagagacgagcagattcgtggacaagtacgatgtcaccctggacgtctgcatttcttcggtgttgatgcagtcccaagtgctcaccccaagcccaaattctaccgagcaattgaacagggcgctcgacgtgtgcgtcgaggacgagacgatgaactacctcaaccgaaaagatgtgcaaaaggcaatgcacgctcagctcaacggcgtgcccaagtggacggtctgcagcagtgttcttgagtacaaacagctggacctgcagatcccgaccatcaacatcgtcggcgcgctcgtcaagtctggcatcccggtgctagtttacagcggtgatcaggactcggtgatccccctgacgggcagcaggacgctggtgcaccgcctggccaagaggctccggctgaacgcaacggtgccgtaccgggtctggttccaagggaagcaggttggtggatggacgcaggtgttcggcgacgcgctgtccttcgcgaccatccggggcgcgtcgcacgaggcgcccttctcgcagccggagaggtccctcgtgctcttcagggcgttcctcgccagccggccgctgccggaatcgttcgaatgacctgacctcaactcaagagacagttcgtgttcttgtactactatctaggagtagtagctaagagtgcatgcgtcaatcacctttcaaggttggaaatctaatcaaaaaggtncttcgcaagtgtaatcagttactncccccatttccactat

SEQ ID NO: 1028 - DNA, 977 bp, Triticum aestivum
  Clone ID: PAT_TA_1028
gcgtcggcgatctcgctcagaacccaaacattgtgtcaatcatacgcaatgaactctcgcccattgcatcaaccaaagtagcagcccgcgcggctgcaagggacacagttggaccgaccttgacatggtttttctacaacctcgcccaccaccctaacgtggtttcaatcatccgcaaagaactctcacccattgcatcacgcaaagtagcggacgatgtagatgccatggtgatctttgagccgaacgagaccaaatctctagtctatctgagagccgtcttgtacgagactctcaggttgtacccaccagcccctctcgagcgcaagatggtggccgctaatgatatcatgccgagtggtcatgaggtgcatgccggcgacaccatccttatttctctccactccatgggaagaatggagggtatatggggtaaagactgcctcaactacaatccagataggtggctctcggaggatggcaacaagctcagatacgtaccatctcacaagttcttggccttcaactcgggcccgaggatgtgcctcggcaaggacatcgcggttatgcagatgaagacagtcatcgcctcaacgctgtggaactttgatgtggaggtgatggaagggcaaagcatccaggccaagccgtcttgtatactggagatgaaaaatgggctcatggttaagctgaaaaagcgagaaatgtaacattacactctcgtgttatgtaaacgtacttagcaccctttccggatccttggcacttaaagccaccccggaacggacagtgagtgaggcggccgcgattcctgtagccagggtgtagcacaagctacgaggcagaagagctagcttgcagcatgtgcaagcgctagagccggctcttagtcttctcatccaaccatgtgtgcttttctgccttcttcatatgcaagaattaaatgctaagccaactttaatagcaatttaaagaca

SEQ ID NO: 1029 - DNA, 1090 bp, Triticum aestivum
  unsure (1)..(1090): unsure at all n locations
  Clone ID: PAT_TA_1029
gccttccgcacgcgggcccgtgggggcgtccctgtggtgcgcccacccgccggcgccatgggtagccccagccgggtgcgtcggcatccttccctccctccggcggcgctgtgtgtttccagtggcgtgaggtgcatgcgcgcccccacgcgtccgcactcacgcacctgggaccaggggccgtttccttctccccacaaggctcgaggaggcccgaagatatcctgaccagggacgtggggccgtcggaaccattcataggtttcagccgggaacttcggcaaggcttactcctttcggcgccgattaagcattgatgcggcttgaggagcataggcgcatgggccgtgcgcgtctcccgcgctaggaggcaccggtcctcgttatctgctagcatccaccaggaatcgatccactataatgtttgctctgagctcggctagtgttgatgcctcaagggttaatacatgtcagttccatgttgcataaaacaactgtaaccacgactaaagtttttcagtttcaaaagaagcatactggagttgcagctgaaccgttcttctgttggatgaagaagcaaatgtaattagaaaattttacttagcaataattgtagtttgcattgatagattgaaaaatgtaacaccattcagaagatctttttctttggtcgaattgatgcaaatgctatggtgtaatattctcctatctattgttctctatagtaaaatatatatgaatgatagtaatgtctgtacctataacattggtatgtatttaaatccctgcatatgtaaaaaaaaaaaaaaacatacggatagacatgttgcattttagattncgtcaatgttcggcccctaagtanaatcccngctccgcgttgcgcctaaaatgcgtcaagtgtgggacccttataaccactgcatcgaangttacccaanaatgaaggcagaagctccgacaagccaagtgntcatgantaagtatnaatacaaattanntgtganaaaaatgtaaaaagggnnccaagagttagcttaaatcaacacnaagngnagacacaattgntnaanaggggaatnttggcatg

SEQ ID NO: 1030 - DNA, 804 bp, Triticum aestivum
  Clone ID: PAT_TA_1030
cccacgcgtccgcccacgcgtccgcccacgcgtccgcccacgcgtccggctgcacaagattgctctggacattgcaaaagcactcgcttatctgcatgacacttgtgtacctaggatccttcatcgtgacgtgaaaccaaacaatattttgttggacactaaccataatgcttacctctcagactttggactggcaaggctcttgggaaattcggaaacccatgcaaccactggtgttgctggaacttttggatatgttgctccagaatatgctatgacatgccgtgtttcagataaagccgatgtgtatagctatggtgttgtactgatggagctaatatcagacaagaaggccttggatccatcattttctccttatggcaatgggtttaacatagttgcctgggcatgcatgctgctccgccaaggccgtgctcgtgatttcttcgtcgatggtttgtgggatgtgggcccgcatgatgacttggtagaggtgttgcatttagcagtgatgtgcaccgttgaatcgctctctatacgaccaactatgaagctagttgttcaacgactaaagcaactccagcccccaatgcgagaacaccgatgagggcgcatgattcacttactgaacatgtagaaggtacagataactgtaacttgggccccttgatgatttttcttcttctaatcaattgcttaactagattttatcttgtagatcccagctttgtataatataagttctccacttaattgccaactactgtatctgcagatatgacaagcagatgtaaattaacaatt

SEQ ID NO: 1031 - DNA, 784 bp, Triticum aestivum
  Clone ID: PAT_TA_1031
gagcaagaccaggatcagcaaagaaacatccaagaaatccaatggctgacgagtcatggaggctgcctagttcagtgcagcaactggctgccagcatacaggagccaccaaggcagtacttgctcagagagcaagaaccgcttggtgggaacctggctggtaccgagatgccggagcccattccaacaatcgatctcggcctgctgtccgcatccaacgatgcggaggaggccgccaagctgcggtcagcgctgcagacctggggattcttcaaggtttctaaccatggaatggagacctctctcatggattctgtgatgaacgcatcaagggattttttccgcctgccgctcgaagagaagagaaagtacagtaacataataggcgggaaacatttccagatggaagggtatggaactgaccaggtgaaaactcaagatcaaaggctggactggtccgatcggctgcatcttaaagtggagccagaggatgagagaaaccttgcccattggcccatacatccaaaatctttcagggatgacctgcatgagtacacatcgaagagcaagagaatcaaagacgacatccttcgggcagtggccaagctattggagctcgatgaagattgcctagttaaccagtttagcaacagggctctcacttatgctagattcaattactatcccccatgtccaagacctgatcttgtcttgggcatcaaacctcattctgatgtctatgctcttacagttcttctaatgacaaggatgtcgctgggctgcag

SEQ ID NO: 1032 - DNA, 1087 bp, Triticum aestivum
  Clone ID: PAT_TA_1032
gaattcggcacgagaaactattcagttgggctggtatgctgttatggaggaaggtggatcctaaatttccttctaattgaagtcatgacacactttttccactacaacgcgtttgtagtcagccgattatggcggcagttgacaccgtttgagatcttcatcattagttatggggtgttgatctttatgtggttaaaattcttccttatttggcgctacttcaggttctggtcactggtaggaggagttgagacacctgaaaacatgcctaggtgcataaataattgtcctgacctggagagtttctggaaaagttggcatgcttcctttaacaaatggctggtcaggtacgtttacatacctcttggtgggtctcgaagaaaactacttagtatctgggttgtattcacattcgtagcagcctggcatgacctggaatggaaacttatttcatgggcatggttaacatgcttatgttttgtccctgaaatagtgatcaagtctttttccaacaacttccaggcaaaaagtacccttgggcggttcattcgtcgtgaattatgtgcaattgctggtgctgtgacagtcagctcccttatggtggcaaaccttgttggctacgttgtagggccgtcaggcattaaggttctgatgtcgcggatgctccacaaggatgctcttcctggccttggcatcatattcgctactttctatgtggccgtcaagcttatctttcatgtacgggacgctagaaagacttaacgggtgacaagaacaactatgcgggtttgtctgtgaactcggtgacgttgcaggcatcgtgataacataacaggcttccaccactgctttgttggctttgtttgacacaagcaaaaaagctcatgtaggcattgaccctgggattccttcgctgtgggttggggcctattaggcctgctggtgttctatccctgcgtatgatcttttgaatttggttggcctggggtgacatcacggaacgtatgcttgtaacgacgattcccgttttgttgcttcaatgcctgcgaccggcaactcgtcgtttttcgctactaaaaaaaaaaaa

SEQ ID NO: 1033 - DNA, 668 bp, Triticum aestivum
  unsure (1)..(668): unsure at all n locations
  Clone ID: PAT_TA_1033
naatcngtgccatattgcattggttaggtcaantcaggggacangcntaangacaatcatcttcctttctttcattcctccttaggcntgcattgtatatngtatatgtagattcttcttttcccacacggaggagtgagtacaaatggagctagcagtcacaatgtgctaaataatcaattaacaatgtcgatcttgtctcacaacggaaaagagggtgctaatgtgggaacaatgagcaatgtactatgcgaatttcgcaatcgaccgatcgatgtagatattactgttaattaagcggtattttttgtagaaaaagaatccatcacaaaaatgcttctaggactagctgctagagtcatgtacctaccaaatgctggtatggcctattggtatggtgagatgggaggagagagatgagggggagaggttgagatggacatgtcgcttactccttccattccattccatggtggttggcttctctttctggttgggcggtgctatcttttctcatttcttttctttttcttcttctttcctttcttgatatgtgaggagtagggagttcttcctttctgcgtgctcttccttcccatggtatctttcctggcacttgccgatcaccttttgatcatggatggattggatgggcggcattggtcacg

SEQ ID NO: 1034 - DNA, 1104 bp, Triticum aestivum
  Clone ID: PAT_TA_1034
gcccagagcttccgtcgtcccccaggaaggtagagcgaggagcaggaattcacccctctcgccaccaaaccggcgattcggtggccgatcaaggtgttcgtggaggaggcgcggaccaggcgtttgattgttcggggcacccagccggcgagtcggtggcccatcgacggctgcgtggaggcggctcccacctgccgcccgggcgccccgtcagcgccagcgcgtcgggcacctgctctctgcagcagggagccggcagcgtgggcctgcgccggtccccccgccgccccggcgcgtctgcgtggctctccgggccgcggcccctggcggcgcgccgcacgcggcgctccctcgcgtccggcccgggccgcgccgcctgccgccgggcgcaccccgccgccctgcgctccgggcccaacgacgcgcccggccccgcccccgacgcctacaacgactactaccaccgcaacgccgcctccggcgccagctgcaactccagcggcaccgccttcaccaccaacgacgaccccagctcggggcagtgcgtcttcgcgggaagctccatggcgggaggctccaacggcacgacgccggcggcgagcgcccctaccagcctcttcccgccgtcgaccttcacgccgggcttcggaggggggcccaccagctccttgacccctctgggggacgacgcggacagcgtcatggccggcgctcgccgggcgctctgcgtgctgctgctcctgctgccgctcttcctcttctgatcgacgcctccgctcgactgtaaattctactccatggcatggcattcgttgcattttactagggaatattactatcaggtcacatgtttttgttcttcagaagtaaaccatatgtgggtgtacatgtcaggtcggatcttctataaaccaaactatactatatgtaaaggtatgtttttcccttcctgaaatctaaaaagtgcgtgcgcgcgcgttggagaggacgagcggccgctcggtcactcgcatgcatgcatacatgcgtttgtctggtagtgcatgtgattactggcattaaatgcggttagacttataacatgtgaaggacaaaaaaaaaaaa

SEQ ID NO: 1035 - DNA, 1882 bp, Triticum aestivum
  Clone ID: PAT_TA_1035
gctaatatgaagaagattgatggtgctgaatttgaaaatgtctctggttgggatgatgaaattgatgatcacgtggaagatgaatacaatgatgatcactcaccaggagatcggtggtctcaagttcgcaagggcacaaaaatcatggttcaagttgtcaaggagggattgggcacgaaaggtccaacactgagtccctttccatgcttaagaagccgattttggatattggtctctcgtggcaacaaagttggagtttcaaaaaagattactgggatagaacgcacccggttgaagggcattacaaagttattacgacctcctggatttactctgacggctcgtacagttgccgctggccattcttgggaggagttaaacaaggaccttgatcggttgttatctacctggaaaggaataactgaacatgctcaatctgctgccctagctgccgaggagggtgtggaaggtgctattcctgttatgttgtatagatcaaagggccaggctctatctattgttcaagatgattttaatgagaaggtcaagaggttggttgtggattctcctcgcacctaccatgaggttacgggctatctccaagaggttgcacctgagctctgcaatcgagtcgacctctacgagaaaagaactcccatattcgatgaatataagatcgaaaaggagatcgacaatattctctgcaaaagggttgtgctacagaatgggggttctttaattatagaacagactgaagctctagtttccattgatgtgaatggtggccacagtatgtttggtcaagggacgtcgcaggagaaggctattttagatgtcaatcttgaagctgcaaagcaaattgctcgtgagctgcgcttgagggatattggtggcatcattgttgttgattttatcgacatgacggacgattcaaacaaaagattaatctatgaagaaatgaagaaagcagtagaaaaggaccgctcaaccgttggtgtttcagaattgtcaaagctaggtttgatggaaataactagaaaaagggttcgaccaagtgttactttcatgatcagcgagccttgtccatgttgccatggtattggtcgtgttgaagctcttgatacgtccttttctaagatagaacgtgaaatctgtcgacgcctggccgtctctggtcataatccagatccagaaaaaccaaaattgtggccaagatttttgcttagggtggaccatgagatgtgcacgtacttgacgtcaggcaaaaggactaaattagggatccttagtagctccctcaagtttgggttttgttgaagattgctcgaggttttacacggggtgcatttgaattgctaccatattctgatcagaaggacacggatgagcagaaggaattatcaccagagtcaccacctccaagggaagcaggaagaccgagactgtctgtttttcctataaagaaatggatgagccgtgcaaagcgagccaagtgaatatcttgcaaagatgagacgaacttttttttcaaagagctgaactgaatcccagattgacaaggggtgattttccgagggctttgctgtgttccaacggtgatcccaacagcggatattcatgtttgcttggctaaagtttggacaactactgtccttgattttgtagttgccactcagtgaagtttaacgtgaaatgtgggaagatcgtaggacgcaatgaaattagattgtgtgaaagctgtgggggcagagcatagttacgtagttgttgtatcgccctagtcagattttttgtttatttattcaatcattgttaaaacattaaatgatactccctctgttcggtaatatttgtcgctggggcttctttccgcccaaaaaaa

SEQ ID NO: 1036 - DNA, 1438 bp, Triticum aestivum
  Clone ID: PAT_TA_1036
gcccgcccacgcggccgcccccgctctccgtccgaacaggagcggagagaggagcacaggagagccagggagctcgctcgctcgctaccggcggacggagaaaccccaccccgccccgcccagccccagcagctcgccggccaccgccggaccttcgcccgctcccgccggtccgctcgaattccggggccctcgccgccgcctgcgccggagaaggaggaggaggaggaagcgggaggagcgtcggggttttggcgtggctgagtccgtcggtaaggtcgcgggttttgcttcgcttgctcggattgccggagggtatgagagacgaaaacaacagctagaggatagctcagattaagctctttcatcaaggatagaatgggtggctgctgctgttgtgcatcgagagcggaagcggacagagcaccggttcatatctatcatcagcaaaaccaagaggagcatgaacctttatcttctgcctttgatggatcatctccagcttctgctatagtcgcagttgacacgaatctggacacatccactcctgacacttatcgggcaccccctgcaccattgccttatgatgttagtttgccagttacagaaaacccagatctggagaagtcagatatcaaaagcaaaacagatgatcagcaggaatctctgaaggtggatgaatacgaatcatgtgaaaaaggtgcccctgaagataagatcgaggaggaggatgtttgccctatctgccttgaagaatatgatgaagaaaatccccgctctatcaccaaatgcgagcatcatttccatctttgttgcatactcgaatggatggagcgaagcgagacttgcccagtctgtgaccagataactttgatagatgagatgtatgaatagcatgttgaccctggtggatcctctctaggagctcgtgcgtgcctaccgaggaggtttagtactagtccttttctctatggggaagtaaaatcagcaactactctgctcctaatatggtagtatgatctggtggaggtgctactggaatgcatcttgggagaacaaatgggaaataatgaaaaacacaagcatcaagaaatatgttacctaaaaaaacatccatccctatgtttatactagcatttgtgtcgagctgtggctgtttatggtaacaggaggattagctggctgcatctgcaacatgcacttcatactagtcgaaactctgaatctagctctcttttccttttcatgctttctggattttgggtcggtgttttctgtgattcgtcgagcgtctgtataaaccatcacatacttactagatatagggtgacagcaagtataaaagaactggttctgaattgtgtcttcatttgtatatccttaccccctgaatcttctcctgtttggtgaaaaaaaaaaaaaaaaaaaactcgagaag

SEQ ID NO: 1037 - DNA, 903 bp, Triticum aestivum
  unsure (1)..(903): unsure at all n locations
  Clone ID: PAT_TA_1037
gaccacctccgaccccacactcgccgccgagatagccgcggccgcggcgggggccggctgcgccgcagtggacgcccccgtgtcaggcggcgaccggggcgcccgcaacgcctgcctctcgatcttcgccggcggcgacgcggccgtggtggcccgcctggcgcccctcttcaagctgatgggcaacgccctctacatgggcgggccgggcgcggggcagcgcgcgaagctgggcaaccagatcgccatcgcgtccaccatggtgggcctggtggagggcatggtgtacgcgcacaaggccgggctggacgtgggcaagtggctggaggccatctccacgggcgccgcggggtccaagtcgctggagctgtacgggaagcggatgctggagcgcgacatggcggccgggttctacgtccggcacttcgtcaaggacctcgggatctgcctgtccgagtgccagaccatggggctggcgctgccggggctcgcgctcgcgcaccagctctacgtgtcgctgctcgcccacggcgagggcgggctcggcacgcaggcgctgatactggcagtcgagcggctcaacaacacctgccttgacaagaaaggggagtgaaactgtgaaagcctacgagagcttggttgatgcaatgcaacacgagagaattgtctcctgctgtgttcccttgtggatatgggacttctgcatgctctgtctgttcatgccttacagtgctctaaggttcaaataagattgcaaaaatggagtttttcacttgtattgataatattcaactacccctatttggccttcttgccggtgctgtctggactgtttgccggtaatcgtgccaagtgaatctatgagccctccctgttgctcagcctggagataaaggggttatn

SEQ ID NO: 1038 - DNA, 545 bp, Triticum aestivum
  Clone ID: PAT_TA_1038
gcttgtgttccagcctgctgaagagggctacgccggtgcttactacattttagaggagggtgtcctcaacgatatctctgccatctttggcttgcatgtcttcccacatcttcctgtaggcatcgtcgcatcgcggccaggtccatttcttgcagctgcagctcggttcaccgcaacgatcactggaaaaggcgggcacgccggtaaccctcacgatgccgttgaccctgtcattgctgcttcctccgccattctcagccttcagcaacttgtcgcccgcgaaacagatccactcgagtcagttgtggtgtctgttacacagctgagaggaggtgatgcttacaatgtaattcccgaatctgcgtcgttcggcgggacctttcggagcatgactgatgaaggcctgtcatatctaatgaaaagggtgaaagagatcgtagaagcccaagcaaccgtgcaccgctgcgcagccactgtggatttcatggaggagaaactaaagcattacccagccaccgtcaacgatgaggggatgtatgcccatt

SEQ ID NO: 1039 - DNA, 1216 bp, Triticum aestivum
  unsure (1)..(1216): unsure at all n locations
  Clone ID: PAT_TA_1039
gtgcagacggcgaacctcccagcctgacctcgcgatgcagatcctccgtcggaaccttctcgaagcttcccgccgcctctcctccctcctccactctccacctcccgccgcccacgcacacgcccatgccgtcgccaccctctccgccgcccggcgggatccgtccaccggctccctcgccaccacgccgtgggccgccacgcagcgccgcggcgcgaagatgctcggctccgacgtgaaacttggaaatgtgatacagagaaaaggtgtgtgattagctgattacatctttagtgttttgttttttacttccaagtatcgtggattactacttatccatcttttgggccaaccttaaatcaaggccgcatttatcaggtgataaaatcgcatcattcacaccaaggaagaggaggagccacaatacaggtggaactgagggatgttgacactggtaacaaaatagttgaaagatttcgtaccgacgaggctcttgagagaagtttttgttgaggataagcctttcacatatctgtatcaggaaggagacaacgtggcacttatggagcctaacacgtttgagcaactcgaggtttcaaaggaactgtttggcaaaaacgctgcatatctgaaagatgagatgaaggtaactctacaattttttgatggccgagcgttgtctggctcagtgcctccctcgtgtgacttgcactgttgttgaagcacagcctaatgcaaaaggcctaactgntacacctcaatataagagggtcttgctggataatggccttacagtacttgccccgccttttgttgaagtgggtgagaacatcattgttagtactgtggatgattcatatatgactagggcctaagggttgtgtcatatggtgctttgttctccgaaattgggcttcgacttgtactcaccttcttagataagtttgctaggccatagacataattctgaatctgcctcctcaaaaaaggcatccagttttaccaggaattcagtaacaaacaacacatttttgttcttatagatatgttttggggaagcgatgtacacgctgacattaagatgtgttgcccttttataacttggtagttttgtgaagtgaaataatactgggatgtgctgtgcaaaacgccaatcatatatgaataagaagttatattgttgttccttgtaaaaaaaaaaaaaaaaaaaaaaaaa

SEQ ID NO: 1040 - DNA, 1048 bp, Triticum aestivum
  unsure (1)..(1048): unsure at all n locations
  Clone ID: PAT_TA_1040
ctgccgtcgtcgtccccggcggccagccggccgtcgtaccgcatcccgtctctaagttcccgttcctgtgggacaccaaggcgaggcaagggaagatcagccgcgccgccgagcagagggcggcgctgatcaccctgggagcgaccaccaccagcaccactgaggagaagcaacgcctgccgggggaagcgggcagcgtggatctcttgctgcctctggcgtacgaggtcacccggaggctggtgctccggcagttgggggcgacgtggctggcccttacgcggcgtcgctgggccaaggtcgtcgaggccgttatccaccagggcatcgtcagatgccagtcgttcacgctcatcggcgtcgcaggatcgctcctcggttcagtcccatgctttctcgagggctgtggcattgttctgcagtccttctccttgcagttccgtgccatgtcgcagacgatagatccacgccgagatcatcaaacttctcatcgaagcattagacatgtttctgatcggcaccgccctgctcacgttcggcatggggatgcacggcatgttctacggctcccagcgcgtccaggagcccatctacgagaggctgaagaaagggcgaggatccggtccgtcacgcaggccaagtcgaggttcggccacgccgtgatcctgctgctccaggccggcgtcctcgagaagttcaagagcgtgccgctcgtcaccggcctcgacatggcctgcttcgccggggccgtgctcgcctcctccgccggcgtcttcctgctgtccaggctctcggcgcatccgcagccatgcaacaagcaagcctccttcgcgtgaacgtgtccgatgtcactgcaaaacatgcaatattcgtttgttctttcatttcaagttagcgaagcaagaaatagtacttactaatagaaaaaccaaaacctgtgatgctcttgtgcctttttcgtcttttccctcactgctcgtagcggtttaatttgtagcttgagagcaatgtcaataaagattctcggggtaggaagaaaaggnnntgc

SEQ ID NO: 1041 - DNA, 350 bp, Triticum aestivum
  Clone ID: PAT_TA_1041
caatgatcaattcattcataagctagtactaattttacatgctcggatgtgatcttactctggtacaaacatgttgttggagcaaaggcatggaattcctatattacagacaaaacccaatccgtttgatcatctgatcgaggaggcatctgcctgatcatctcatcaagatcgatcgatccaagaacaaaatactgacagcatcgacaagacttactactttaccggagcacgcacgcacgcacgcacgcatcatgggggaattgctactatggggtggcatgggcatggcgtcacaggctgaggaagcctctgccctggcgcgccggcaccggcgccggcggcgggcc

SEQ ID NO: 1042 - DNA, 1056 bp, Triticum aestivum
  unsure (1)..(1056): unsure at all n locations
  Clone ID: PAT_TA_1042
cccacgcgtccggcgctacactggacgacaaggagctcgagctctaccgcatcttccaggccatcgacgtcgagcacaacggctgcactcctccccgaggagctctgggacgccctcgtcaaggctggtactagagattgatgactgaggagcttgcacgatttgttgagcatgtggacaaggacaacaatggaattattacttttgaagaatggagggattttcttatgctttatcccaatgaagcaacaatcgagaacatttatcatcactgggaaaagagtttgccttgtagaatataggtgaacaggctgctataccagaaaggcttaagtaagcatgtcagcgcaagcaaatatctgatagcaggaggcattgctggcgcagcatctcgtactgcaacggcaccttcttgatcgtcttaaagtgatcatgcaagtgcaaacaacacgtactaccgtcacacatgcagttaaggatatatttatccggggtggtctattgggattttttagaggtaacggtttgaatgttgtaaaagttgctccagaaagtgcaataaggttttatgcgtacgagacattgaaagagtatattatgaacagcaaaggagaaaataagagtgcaggttggtgcttctgaacgcctcgttgctggtggtttggctggtgcaatagcacaaacagcaatttatcccatagatttagtaaagacggggctgcagactttctcttgcgagagtggtaaagttcctagtcttggtacattatcaagggatatattgaagcatgaagggcctcgaacattctaatagaggtctgttccaccttgccgggggtgccctccccggagccggctgctgatcttgcnngtataacaagactttgaaaaaatgcctccaagacatatntcataaagggcanccgaanctgggnccnccaaatnaaaaattgggtttgtgggaacggtccccgggagcccnngggancaaanattttntttaacccttttanaaggtttattaaaaacaaaancgggaaagctcaaacaaagccn

SEQ ID NO: 1043 - DNA, 1279 bp, Triticum aestivum
  Clone ID: PAT_TA_1043
gccggcccacgccggtttctctaaaagagcccttgcacgtcgctcgccgatcgatcgccgaccaaccggaggagacgcgcctgaataagaagacgaccgtgcgtccccattgctcggccgatcaccggcgcgcatcgccatgtctttcaccggcacgcaggacaagtgcaagacgtgcgacaagaccgtccatttcatcgacctcctcaccgccgacggcgtctcctaccacaagacatgcttcaagtgcagccactgcaaggggaccctctcgatgtgcaactactcttccatggatggtgtgctctactgcaagacccatttcgatcagctcttcaaggagacgggcaacttctcaaagaattttacgccaggtggcaaatccgcagagaagggcgaggcaaaagctccaagcaagatgtcatctgccttctctggaactcaagataaatgcgcggcctgccaaaagaccgtgtccccaatggagaggcttaccctagtgggcgaatgctaccataagagctgcttcaagtgctcgcatggtggctgcatcctgacgacctcctcgtacgccgcgctcaacggaatcctctactgcaagatccatttctcacctcacagctattcgaggagaagctaagctaatctcatcaagaccgcgcaaacaaagcaaagaagcgtggtgtctgcgcctgcgccgcggccagcggcggggcggaggcagcagctgctgctgctgcagcagcagcagagccggaagcaccaccgcaagatgaagaatagagcaaagattaggagcaaaccaaaggaaatcgcagaaccaaatattatatataaaaaaaggctccgcaatttacagatagtaatttgcaatacttccttccctgcttccatttttgtatggcctctcaaagcttgcttttgttcaagctggaattgtatcatttctcgaaaacttgtcacctggacatgaaactattggtttgtacagccaaaaatattactttgcgttgcacgcatactttctttgaattctctgaacataagggacaaagacatttcttttagggcctttttgattcaaatgatttgtaaaggaaatttggaggattccagggtttctagcctacatgtgccattccaaaaattcatgaacatgacatcccttaagtgtaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 1044 - DNA, 1001 bp, Triticum aestivum
  Clone ID: PAT_TA_1044
cttgtgggagagtgcactacgaaaaccccaaaatggttgtcggttgccttgtggagcacgataacaaggtcctcctttgcagaagaaagattgaaccggcttatggcctttggactcttcctgctggttatttggaagtcggggagtctgcagcagaaggagcctcaagggaaacgttggaagaagcttgtgcagatgtagagatagtttcaccttttgctcagttggatattccgcttattggccaaagttacattattttccgagcaagaatgaagacccccagtttctcacctggatccgagtcgctagaatgtgcactttttgctctggatgatataccattcgattctctagcattttcttcaatcatcgtcactttgagaatgtatattgaagatgtcaaggctgggaacatcaaattccattattgcactataaacaagaggatcggggccggcccttcagatctccgtagctttgatatcgacaaccatttagccgtgtgagtttgggcaaggtttgagacccttcgcggtacataatgttgattggctcttgttaaacaccagccgcgagacatcgacacagcaatcacattggtcgtcgatagagctgggcatgggtgggggggcctttggtcatcgcatggcatctggccacagttgtggtagattgtttaagctgctgctggaattgtaaatgcttgtgtttctcgaagtcccttttcagccctttttccttttccttttcaaaggatgtcttgagtgattcaatagatggtgcatttagatttttgtcagcttacccaaaagatttgtgtcgcgagtgtcatggcaatttgaaactaaattctgtaattgtttttccgactgttcctgcaaactcttcagttactacgtgtgggaaatatactgtgatgccatgtaccatgccacctcggccccgacctcgctgtttcagaaaattctgaatgttcacaggaaaaaaaaaaaaaaaaa

SEQ ID NO: 1045 - DNA, 1857 bp, Triticum aestivum
  Clone ID: PAT_TA_1045
gaattcggcacgaggggacgcagaaaaggggacaaacggtgcaccctccactaaaggcagggatctggctcaaaggaaccaagaaaggagtggccgagagtcaccggattttgaacaccgtaggctcacaaaatccttgaggtctcctactaatgatgcaaaaagagattccacacgtggcagtcctttgaaggacactgggaaacatatgcccagtcaggacagcacaaataccagtggagacgaggaagaaggcgggcgtgcaagggagaatgcacggaaggccaattcatcacgcagggtatccaaggatttctcagctgatctgcaactaaaggaagtcaacgttgataactcaatccctggagaaaaaccctcttccagatcaagacagtatggcggcaaggatgtccccaagaaatatgataatcagctatcagattcttcagaagatgcgcttgatggtgcgtggtcgcggccccggggtgattcccctgatgattctcccgtgaaacggcagtcccctagtagagccggcgactcttatccaaaggatgggattaacaatgagcgtgccaaaacggattcacttggtgcttcttatgatgctattgcagcgaagaaatactctggtaaagttgatgaagcttcccaatcagatggtggaagtcctcttcaaaaagctaagaaaagaacatatgacagtaaacacattgatcgtcgcagttcgggctcagaagaatctgagaaacacagatcccagtctgagaagcgaggacataaaaagggtcacaagcataagaagcattatgatgatagttttgattctgattctgactcagatgacaaggagtccaagaggaggaggcgagaagagaaaaagctacgaaaagaggaaaggcgccttagacgtgaagaacggcaccgcagaagggcggaccgtcatgccagtaaacagagattgaagtatgctggttctcccctgtcagatcttgagaaggatcgtcaatctggctcagatgctgatgttgggaagaaaggttcatacactccgagagaagaacctgacccaaacaaacttgaaattgagcttcgacagagggcccttgaatctcttgcaaagaaatcaaagcatgttgttactccgtcttcagatgtcgagaaggaccgtgaatctgactcggatgctgatgttaggaagagagtttcataggctggctgagaagaatctgataaaaataaacttgaagggttgagcttcgggagaagacccgtgaaactatatagatcaaagaaagctgccaatcactaggctggggaatttctcgcaatgcatttacacgtttctatttttcaagagcatatctatatgttattgaagtgtgctcatatgatacctgtttaatgttctgtatgtttatgtggcagttgatctgagtaattgacgattcctgagctgtttccttgttgcagctgctttcaggcttagctgcttttatctggtaatgtttgccttaacatgtttgttcggaccaaaacattaagcagcacctctgcgtcttccggctggttgcacctttgatgattgtgaaactctcctaaagtgctcctgtttcgttttggttgctgctccttagaatgaggtttgtgcagtaagttcttttgtgtgtgtgtgtgtgtgtgtgtggctatgtcctgatgaagcaaatgaaatttcttgtaagcatttgaaggttgctaacttcccactgaatgcccatgagtattctactgttgaatgaacatgagttgtccttttctattttgtggttcctagcattcaggtgcaagtcttgggcaggagttaaaaaaaaaaaa

SEQ ID NO: 1046 - DNA, 855 bp, Triticum aestivum
  unsure (1)..(855): unsure at all n locations
  Clone ID: PAT_TA_1046
cccacgcgtccgcccacgcgtccgcccacgcgtccggttttctccaatcatggcagcatggactttcaccactccgatggttggaatatacagcatttttcgttactaccctggcatattcaaagccatttcgccacattatattgttcatttcttcctgaagaataaaaaggaaggctggcagatgcttggtgcgactgttctagccatcacaggtgcggaagctatgttcgccgatcttggccacttcagcaaaaaggctattcagatagcatttctatccagcgtatatccttctctgatcctcacttatgccgggcaaacagcatgccttattaaccatctcaaagacaccgaccaagagaacattggcaaagtcttcgatgatgcattctacaaatttatccctcgccctgtttactggccgatgttcgtcatcgcaacactcgcagccattgttgcaagccaatccttaatctcggcaacattttctgtcatcaagcaatcagttgtcctggactacttcccacgtgtcaaagtggtgcacacatcggatgaaaatgaaggggaggtttactcgccagaaactaattacattctgatggtgctgtgcgttggtgttatactaggctttggaggtggacaagcgatagggaatgcttttggccttgtggtgatcatggtcatgctcataacctcaatcatgctgactcttgtgatgatcatcatatggagaacgccgcccgttctcatcgcggcgtacttcgtcccgttcgtcatcatggaagggtcctatgtcagtgccgtcttcaccaagttcacgggagggnggctggcttcccttcgccatctccg

SEQ ID NO: 1047 - DNA, 1949 bp, Triticum aestivum
  Clone ID: PAT_TA_1047
gccccgactgctcccccgccgccgccgttcctccgccgccgcccgctcccttctcgctgcctcctcccacccgccgcccgcccccgcgcgggccccctcccgcccccccccccgcggccgtccgccccgggcgcaggcggtggtggccgggggcggcggccccgcgggcgctcctcctggccctgcccgccagcgcccggagcttcccctccatttcgtccctctcgcgccgcggaggctgcggctgccccggcgccaggaagtacacggggatggtggaggactgctgctgcgactacgagacggtggacgccatcaacgaggaggtgctcaacccgatcctgcaggacctcgtcgctctgcccttcttcaggtacttcaaggttaagttgtggtgtgactgccctttttggcctgatgatggcatgtgtcggctcagggactgtagtgtatgcgagtgcccagataatgaatttcccgaaccattcaagaagccttacagtggcctttctcctgaaaacatgatctgtcaagaaggaaaaccagaagccacggttgatagaacccttgacaccaaggttttcaaagggtgggttgaaaccgacaatccatggacatcagatgatgagacggataatgctgagatgacttatgtgaatcttcaacttaatcctgaacgttatactggttatactggtgattcagctagaaggatatgggacgctatctacaaagaaaattgcccaaaatatccttcagaagatatgtgccaggagaagaaggcactttacaagctaatttcaggattgcactcctcaatatctgtacatattgcttatgattatcttcttgatgaatctgctaacttgtggggacataatctttcgttgttgcatgaccgtgttctgaagtacccagagcgtgtcgaaaatctgtacttcacatacctatttgttcttcgggcagtgactaaggcggcagattaccttgagcaggcagagtacaacactggcaatcctgaagaggacttgaaaacacaatctttagtgaggcaattgctttacaaccacaagttaagatctgcatgtccattaccttttgatgaagcaaaactgtggcaaggtgaaaatggccctgagttaaagcaggagatccagaagcagtttagaaatatcagtgcaattatggactgtgttggttgtgagaagtgtcgattatggggaaagcttcaagttcttgggcttggaacagcgctgaagattctattttctgttgatggagagaacaatttgaatcaacagttccagctgcagcgaaatgaggtcattgcactggtaaatcttctgaataggctgtcagaatctgtcaagtttgtacatgaaacaggatcgtccagccaggaaatcattaaacaacagagcttttcaactttgcaaaagggggcttcctgaccaaatgtgaaaccgtattctgcaaagatgcaagagggcaagttgtttctataactcctcttctccatactgggagagtgatgtacatgcagggagcagcttcctagggttctacagatcgtagacaaaagatatgtagaaaactttggaagccaaacaaagacaagtttacccctttttttctttcagttttagtgggacatatccctttcaaattttgtatgtagtgtagacttcacctcttttctgtcgaacttccagttagtgacattttatctttcctccgttgactgataatacatatgactgctaacgaagtaaggccgtttgtcaatccaaactgtttgcatgtttcatcgacttgattatatgttctccatcattcttggaaatgacgggaaagatagcgtgtcccgtggtcgccagtttgtaaacaactaaaatctcatccgaaaatgagttacagaagatggtccctatgatattggaagattttat

SEQ ID NO: 1048 - DNA, 1479 bp, Triticum aestivum
  Clone ID: PAT_TA_1048
tcccgcggacccggacaattgttctactacgtaatttacttgatcatcatcttttacccttattattacatgagcattggatgccttgatggatggtatccaagccagccaaaaggcacaacacttgacgggcaaaaaaaatctacacagatcgcacgcaggcgcatgcgcacatttgtccacaaatcaatcccacaaatagaagaagaaaagaaatgaaaataaaacataacaacaaacgaataatcaaaggcgatcgatcgatgcagatcgatgcaaatttaacacatgaaaaacgttagcgataggaacttggagagttggaaagcttagtggtggttgacgaagcggcacatcttcctgatctcgcccttgctgccgtgcggcatgggcagcttgctgagcttgacgagcgagtcggagaagtcctcgtcccacagcgtgccgttgtcggcgtactcgtgcacgtggccccgcgcctccttctccgtcagcagctgccagtcggagttgaaggtgacgatcctcgccaggttgttgtggtagtagctgttgtccaggaagtccttgaccttcctcagcttcgggaggaaccccgggacggcggccgccaccgcgccggcgtcctcgtccctgatgttgttgggcacgatggggtccgggcccttggcgcacttgccggcgaggaggccccggtaggccgggaggatctggtcggcgggggccgtgagccgggcgcggagcgacgagcagtggcccacgcccacggcgtgcgcgccggacaggatcaccagctcctcgatggtgaagttcttgcgcttgaagttctggatgagctcggcgatggtgaaggtggagtcggggaggtcctgctgcgcctcccccgcgtgggagtgcaccccgtccaggcgccccgccagggcgtcgaagtggacgtggccgttgctcagcaggctggcggcgtcgcgggcggcgaagatgaggatgtccgcgcaggagacgacgccggggcaccggtcctccaccgccgccttgatgtcgtcgagcaggtcgaaggcggccaggccagatgttgatcggcgccgtcttctccgtgtgcgggttctccggcgtcgggtccagcagcaccgacgcgtcacagcccctgacgaagcagtcgtggaagatgaggcggacgagggcggcgccgctcttgcggttggccttgatggccctggcgacgtgccacttcaccacgttctccacgccccggcagctcttgtcgtagtaccccaccttgagctcgctcgcctccgccgccaccgccgccgccagcagcacggccaccgccaccgccgccaccgtcctcatcatcctcgccgcccgaccagctcacgcacgcactcacgcacgcacggcgccacctacctgccgccgacagaagcagcggctgcgcttgctcgctcgagtggccggcactggctaggagagcagtgcagc

SEQ ID NO: 1049 - DNA, 519 bp, Triticum aestivum
  Clone ID: PAT_TA_1049
cccacgcgtccggcgagcagctggcggtgttgggaagcgtcgactccacagtgcacaaggtatgaagggcttcagcggccctggtatgcattatcaccggcgtgctgagtctgctcctgatctgcctccttttgaccctgggcgtgctggtatacatcgttacaacagcagctccaccatggccgatgtttttgaggaagatgaagaggatgatgacaatgctagatctggaacaaccgatgactcttcggaagaagagactgactctgacagcgacgctacacctccagccggtggtgttcgagaccctcttcgtcattcccaggataagctatcagtgcacaacatgagacgaactacttctagccttagcgacaaggatcaaatatccggcagtacggtcagaggcgaacgctcaaggtcatctcttcacgaaagtgtcatcgccgaggagttcccaagtgtaatattccgttcgccattcatgcctgcggaacgatgcggcactgccgactccgc

SEQ ID NO: 1050 - DNA, 1012 bp, Triticum aestivum
  unsure (1)..(1012): unsure at all n locations
  Clone ID: PAT_TA_1050
ccgcgggaattcgattcgagcggccgcccgggcaggtaccgcaactgatgctccacnnnnngatgcaagcaatatcactgcactgcagctcatgttctgcaaatgttgggttgagctttccgtcgtattcagaaggtcaatttgagcttccgttttcaagcattagagccccacgcgtccggccaattactccaaggttcattcatgtgagctctgcaggagttacaagacctgaaaggtcagggctagatctaagcaaacaaccccccgccgtccgcatgaacaaagagcttggttccattttaacttacaagttgaagggagaggatttaattcgggaaagtggcgtgccctacactatcgtgcggccatgtgctctaactgaggaaccagctggagctgacctcatatttgaacagggggataatatcactggaaagatatcgcgggaagaagttgcccgcctttgtgtcgcggctctagcaagcccgagtgcatgtggggaagactttttgaggtcaagagcaccgttccatttagcgaaccgtttgtgatcgatccttcaaaccctcctcctgagaaggactatgaagtgtacttcaaagaactcaaagatagcatggccgcggccgaggtcctggaaggaacacctgctctagtctgaagaatacgtcgaatgcggaatgtcctctgcttcaagagtgaactttgcttgtgctttatgttcagtatatagaaaagaaaggaagtccccatgaaactgcagaggacttgtggctatagagctaggctgtgggattgtcatagagcagctttctggtaatttactgctgttgtttccactgattctgtagtataggtaatttgtctaggtagaccgttttggtaatgtgaagtgagaatcaccagtgcatagaaaaaggaggtttacagttcctgcctatggcttctttccttcacctccaggcgtgttttattcattcttcctgcaaaaaaaaaaaaaaaaaactcc

SEQ ID NO: 1051 - DNA, 902 bp, Triticum aestivum
  Clone ID: PAT_TA_1051
tccaacagaagtgcagtggcatgcgaaggcacgaattaatgccggtgctaatttctatatagtgggtcgtgatccagctgggatgggccatccaacagagaagagagatctgtacaacccagaccatgggaagaaggtcctaagcatggcccccggtctggagaaactcaacatattgcccttcaaggtagcagcatatgatacggtggcgaagaagatggctttctttgaaccttcacgcagtcaagattttctgttcatctcaggaaccaagatgcgcactttcgccaaaactggagagaaccctcctgatggtttcatgtgccctggtgggtggaaggttcttgttgactactacaatagcttgcaaactgaaggagctaccgcccccgccgctgctactgtatgagacaagctgctgcatggctttgagatcatttgttcgccggccagaaatggtgaatgcaggggattttaaaaccgttccttctttttttccgccctttcttttaagtttttttgtaggttgctagtttattgatgccatcagatcctccaattgttcaaattttttctttcaaaatagaaagaaagattttgaagcttggcactggaactcaaaactgttaacagattgagcggtcgcaaattctgttattatcctgtgatgactctgacagtccaactagccaataaagaagttcattgcaactgtgggagctcatccaagatcagactgcaattaatatccatattatgacacaacggagtggcagagttggcattacggtggattattagatgatgacagtccaacttatcaatttagtttttgtactatattcgacaaagcctcccgattcaggatttaaacaaagaaatacttataattaaaaaaaaaa

SEQ ID NO: 1052 - DNA, 665 bp, Triticum aestivum
  Clone ID: PAT_TA_1052
tacgcctgcggttccggtccggatttccggtcgaacacgcgttcgcccacgcgtccgcccacgcgtccgcggctactgcggcaacatgggcatgtgcagctacaaccgcacgtcgccggtgtgcggctgcccgtcgcggaacttcgagctcgtcgacgcatcgaacccccggagcgggtgcaagcgcaagaccgagctccaaaactgcccgggcaactccaccatgctccagatcgacaacacgcagttcctcacctacccgccggagatcgcgatagagcagttctacatcggcatcacggcatgccgcctcaactgcctcgccggcagctcctgcgtcggcgccaccgcgctttccgacggctccggcctctgctggctcaaggtctccaacttcgtcagcgcctaccagtccgcgtcgctccccagcacatctttcgtcaaggtctgcttccccggcgtccccacccgcccgtcagcgccactaacgcgtcgtcgccggggacctccggcctcatggatgatttatttatttattttcctctaaatcatactgctagcaaagcttggcacccgttgcagaactttgtgggctaagagaaataaataaagagtacacccttttacaaaaataatctgtaaagttattcagattgcttatttat

SEQ ID NO: 1053 - DNA, 806 bp, Triticum aestivum
  unsure (1)..(806): unsure at all n locations
  Clone ID: PAT_TA_1053
cgtncgcccacccgtccgtccgtcccgaatccgtcgccacgactgccgccagagggagaggaactggctccgctcttccatgcaacaacaccaacgccatcgtctcctggaggagtgggtgggaggagaaggcggcggcagtttcgatctgtcatctgcctcgacgggggagaaggcggatcgatccgatcgaagtggctgccggaaggatgggacgaagaagtcgtcgttggctggccgagggtcaggtgaggactaggggaagcggctacgagcacgccatcggtgttggatcgatggtgtcatgcctctgcggccgggattaggctaggcagatgagaagcagcggcgcgcccccactccaccgagcttcatatcaatggcaacatcagcgaggtgagcagcggctaaaggctcccacctgaagaaatcgaggcgttggcggcggagtcgatggggagaaggccccgccttgatgcagttggagacgctgctggcgctcagcctcaaacagcaaagtcaccttgtaacgaaggtttcacaaaattcaaacatacatcatttccatgccaggttacatattttaggtgccagaggattgtcgaaagaaactcagatgtttgagaaattctactcacttcaagctctcatcacttgcatatctatgtgctacccacactgcattttgttttttgaaatggccgtctcctaccaggcaccgcccaggaacttctcaggcggcagatttcggcttgtcaacaagtgacgagcgtaaacagtgatgttcgtaaggatttggtctacga

SEQ ID NO: 1054 - DNA, 581 bp, Triticum aestivum
  Clone ID: PAT_TA_1054
gcacgagggcgcttcctgctgcctctacagttctgcgccccctaccccccaccaaccccatcgtctcttcgccgcgtctccgccgcctccccgcgtctgtctgcccctctgcctctgcggtcacatcctcccaccgtcggagtgacctggagatccgcccggaccatcttcgccgcaaaatctcgccggaggagtcggcacagaactaggcgtcgccggatatggccatggcatcaccttggcaagctgggagatacataaacatcgaggggatggcgcgcccggtggcggtggaccaccgcatcagcctcccctactacttccgcatcgccgacaatcttctccgccaggccaacatatatcgagaggaaaagaacctcatcgacctgtacattatcctcctgagatactcgagcctgttgtctgagacgatcccgaagcatcgtgattaccatgcattcaagtcaagagaaaaggaattcctgaagaaagggccgcataactcagataaactcttgaatggtatcagtgagctctaggctctgaagccgattgggaaacaacaaattgctgaacttaat

SEQ ID NO: 1055 - DNA, 962 bp, Triticum aestivum
  Clone ID: PAT_TA_1055
agtcggttccatgcccagcggtctagcgcccacgcgtccgcgtccagctaatggcgaactagggtttcggcccctcggccccgggccggcgacgcacttcgacggacgggcttcgcaaggcctcacccgctgcgcgtgcagacccaaagccgctgggaaccctgggggtcgcatgatccccgcaaccacccccgccgccgcccctcgcggcatatccccctgcccaccgcctcgcccagccacgcctccgggcgtccccctccggctccgctcgcgctcgccaggcgccgcctcggagcgcagcgcacgcgccgcccgacatcgcatctccccgatttggggtggctgcaaaaccccacggctcccgcccactatcccccccatgcagccgcacccctcccctggctcccaaccaggtcggagcggcggcggttgcaagaggagaggaggagcgcgcgcgagagctgtacccatgtggtggcagcattaccaccgcaaccacatgggacatgacaaggagcacttctttgccgtggctacgggtgatttcaggcgcagtatgtgcataccgtgggaggttggaaaccatttggggagcatgatctctgaaaccatcaaactagaagctcctaatggcatattctgtattggagtgtgtagaaagccgggtgaactagttcttcagtctggctgggataagtttgtcgcaatgcatcacgtagaagaaaattattctttttggtttgtgtaccgtgggaactctacctttaaggttcatatattcaatcccaacggtcgtgagaagactacttcctgttctcaaccaccttctcagagctttgggggtgttccatctgccgctacttgcgatcatcatgtgctgaatggatatgaagctcacctactgaatgatcctgcacctgtggagtttggggtcgatttggaacctcatagctccggca

SEQ ID NO: 1056 - DNA, 1006 bp, Triticum aestivum
  Clone ID: PAT_TA_1056
atccccacgcgtccgctcaacttctaactttcttttccgttacgaccgcttcctcttttctatcaaaccaatacccaaaatcttccacaatggccactgagcgtgaaagcaagaccttcctcgcccgcctttgcgagcaggctgagcgctacgatgagatggtcacctacatgaaggaggtggccaagctgggtggagagctcaccgttgacgagcgtaaccttctcagcgttgcctacaagaacgttgtcggtacccgacgtgcctcgtggcgcattatctcctcgatcgagcagaaggaggagtctaagggatccgacaagcacgtttcgaccatcaaggactaccgcaacaagatcgagaccgagctcgagaaggtctgccaggatgtcctcgacgttttggacgacttccttatccccaacgctgccactggcgagtccaaggtcttctaccacaagatgaagggtgactaccaccgttacctcgctgagttcgcctccggtgagaagcgcaagggtgctgccaccgctgcccacgatgcttacaagagcgctaccgatgttgctcagactgagctcactcctactcaccccatccgtctgggtcttgccctcaacttctccgtcttctactacgagatcttgaactcccccgaccgtgcttgccacctcgcgaagcaggccttcgacgatgctattgacgagctcgactccctgtctgaggagtcttaccgtgacagcaccctcatcatgcagcttctccgcgacaaccttaccctctggacctcttccgacagcgccgagggtgagctgccggtgctgctgatgctcccaagaaggaggagggcgaggctgccaagcccgccgaggaggctgctgaggagcccgcgcctgctcctgcctcctaaatctatcaataatccccctcgataccacatgcgtctcggcatataggaaccgagatgtattctcgccccggttacacttgtctgcccctggacaca

SEQ ID NO: 1057 - DNA, 764 bp, Triticum aestivum
  Clone ID: PAT_TA_1057
cccacggactgatgtgcactgaatatgtcgtcctgatggcacatatgttcgacactgcccggccccgtcgtccttatgcgatatttgccccgcgatggagccagtcgaacatatgttgctttcactgcatggccgggtcgagctgtggaatgccctggggctagacatattcctaaagcactatactcctcctactcattgtctttgtttccttcgaggtttaggacagttcgtaatacgcgtcttcgatagtatgcacatctccaaaacggtatcctgcatgagcattgcagaagtgtggaccaaagaccttgtcatgaagggcttgacatattcctcaaaaagaaagtgtgagttgggtgcttcagattatctcatgttttcaaggcctcaaaacaatgatgcatgcagcccatcattttttatctgacacagtaagtgtctgactttgcaatagtgtccttttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggacccaattttactaccccgggcttgcaaggtaaaagtttttttttggggcccccaaaattaaattcaggggccggggtttaaaaagggggggaggggaaaaccccgggggtaccccaattaaatggctttgaagaaaatccccttttcgcaagttgggg

SEQ ID NO: 1058 - DNA, 882 bp, Triticum aestivum
  Clone ID: PAT_TA_1058
taggggccttttttttttttttttttgagaattttttcattcaaatcacgaaacagtacaaagtagttgatccttacaagcacactgaaacgtaaacacaaaggacgatgaacaattagtgtaccctaagccaaacgtaacacaagaagagctgtggagccttttgacatcatccctgaatcttgagagaagacccctcaagcagaaggatccgcaaccaggcgcaagcaggtcatcatctccgaccacggtacaattgccgccatgctactttctcctttcttgacaccagcgctgagagggcatgggcatcaatccaacacacctgcaacggccgtcgccagctttggctttgagtaccgcgaaaaatgtcccttcctgatggaagagaattcgagtcatccgaccggtccagcaccgcggccgggccatccacccgggcaaagcagaatctccctccagcatcagcgcagaggaaggagaagaacagccgcaacaaatcataccgacaaggaagaagaagggtcttcgtctctgttgaaggggtggagagggttggtggaatagttcagcccacgaccggccggcgatccggggatccccaacaccgctggctcctagacgaaggcaaaagcctcgcctaaccgcgaacggagcccggagaaacttattccgacgtgacaccaccgcaacggcctcggcagcgtctccctcaaccctaaccctaccacatacccacctagtgaacagacccgaggttccccctccctcccgccgttggagcggccgacggagagagagggaaccggcggcgtcaccgacggcacgcaagggaccctagtcgcctccttatcgcctcaagcgatccaacttttccctcgt

SEQ ID NO: 1059 - DNA, 594 bp, Triticum aestivum
  Clone ID: PAT_TA_1059
tcctcctcccgcaagccgacctacgcctctgtacgctcggcgagtccgagaaaagtgcgggatgaagacgaggtcgcagaccaccccgaagcccctcaatacggtgcggctgccccccgtagagagcccccgcacgaggtcgaggccgaagccgaagccggagacgcggaagaaggggaccctcggcgacctccgccgccccaagaagcccccaaccgccttcttctattttatggaggatttccggaaaacgtttcaggaagaaaatccaagtgtaaaagcaatgcaggatgtagggaaggcatgtggtgagaaatggaataaaatggcatttgaggaaaaggtgaagtattatgatctagctaccgagaggcgtgctgagtttgagaaggcgatggctcaatataacaagaaaaagataaatggtgaattgtccgtagaatcagattagaattgaactttgggttctgttgatgccataagttaactggatgaatcattcaattgtatattacatgccagagcattgtatgtattctattatctatagatggctagaatgctaactggatgaatcattcaattgtatattac

SEQ ID NO: 1060 - DNA, 737 bp, Triticum aestivum
  Clone ID: PAT_TA_1060
atgctgcccaaccgcgaccccttctatacgtacgacgccttcatcaccgccgccaaaaccttcccggatttcggcaccaccggccaacttatgaagcgcgagctcgcagccttcttcggccagacctcgcacgagaccaccggcggaggctcagaagggggatacaagttcatagaggagataaacaagaacgatccactctactacggacggggaccgattcagttgacagggcagtccaactacagggccgccggggccgcgctgaaccagcccctggagagcaacccggagatagtggccaataacccggtggtctccttccagacggccctctggtactggatgacggagcagtcgcccaagccgtcctgccacaacgtcatcctgggcaactggaagcccacggacgccgacaacgccgccggccggctgcccggctacggcgtcatcacaaacatcatcaacggcggggtcgagtgcggcatgggccagatgccaaacgaccccaacgcggaccgcatcgcctactacaagcgctactgcgacatgctcaacaccacctacggcgacaaccttgactgctactcccaaaagaatttcgctggctaattttactattgagcttagcttaccacagcgcagtggacgcaactaaattctatgtctatccattatgaataataagtggcatacgccatcgtggaataaagatccatcggtacgggtgcgccgtt

SEQ ID NO: 1061 - DNA, 1009 bp, Triticum aestivum
  unsure (1)..(1009): unsure at all n locations
  Clone ID: PAT_TA_1061
ggccgcatcgatcgccggcgcgcgtgctcgggtgaggggcggcgccctcgtcggcggcggatacggctacagccgcggcggaggacgagacggcggaagccgtgggcttgtgattgctgtgctcgtgggctttgatggaggatggaagggaggacaacttcgggaaggtacgccgcccgccagtgtcagtcctccggccggactacgacgccatcgcgctccaagacttttgcctccaccccatctacgcgcgtcgtccgtccacgcgggtgccggcggctaccgcgccccggaggtgtcgtacacgcggtgggccggtggcctacgctgaaggcggatgtctactccctaggcatgctcctattggagctcctcaccggcaagtccctgacgcatgcttccctgtaggagggcgtcctgccacggtgcgcgagcttcgggccggccgtgtcttccaacttgggtgtcgtccatggtggggagaggagcagcagtatggggagagggagagaagcggttggaaacgccggaggtggggagagaagaagccgtacaggaagaccgagagagacgactggacgcgccagnngtggcaggtaggccagttaagcggcggtgctggtcatgacggtgtcgccgcaagctggctcggtggcgccgagtttggcatggctgacgctcgagttatgttcgacataatgcctgtaaagtgaacaattgcaaaaattgccactggacagcaccagaccacgcactgccaccggcgcctggaagcttctgccttctcttccgggctcaagctcactgccctgccagcaagcgccccagccaaagctcgagcaatatcgccgccctgtccccatgttcgtgctaccacttctgctccaaaaaaggcttggtgatgaccctcgagctcacagtctgttacttagtgaagataatgaaaagcttaaattcaatttggaaactatacatccctcaagcacttcatatggtggtgcatacacta

SEQ ID NO: 1062 - DNA, 882 bp, Triticum aestivum
  unsure (1)..(882): unsure at all n locations
  Clone ID: PAT_TA_1062
gnnngtnntgnnttatnnancgactcaaccctcttaaagggaacaaaagctggagctccaccgcggtggcggccgctctagaactagtggatcccccgggctgcaggcactgtagtcaatagaacaccaagcaccaaaaaggcaacctcttcctccagagaagagtagatgagaagtgtttggatggacaagctcctccttgctctcgctgtcaccggtgccctcttcatgtccaatggggttggcgtcgccgccacaccacaaacgacatgcaaggcagcggccaacattgacaagcgcgtcaactatgatttctgtgtgtcgcagctgctagatcaccacgagagcagcgaggccgacacatggggcctcgccaagatcgccgccttgatgggagccaacaacgccgctcatgccaaggccgacatcgacgccttgctagcaaagccgggcaccggagaccagatgaagcgtttgctagggcagtgcaagggcttgtatgatcgcacgttcatgacgttcgtctacgcgcatgaggagcttaagaagcgcagatacgcctcgggcaaagagaaggcggcggagactgtggcgctggtgcaccagtgtgatgaggccttcgtggaagctcgagtccgctcgccgctcaccaagcaaagtgcggactccgtgcagctggccatcatctgcacggccatcaccaacctcatcaagtgaaatgaaattctctaggactttttttcttcagttgctagtagagctgccatggagcagccgattgaataaagcgcctttcctgagctgtcatcacaacattttgttttcctcctaatgactaatgattagacgtgacgtgttaatctttgtctcgtgccgaattcg

SEQ ID NO: 1063 - DNA, 1007 bp, Triticum aestivum
  unsure (1)..(1007): unsure at all n locations
  Clone ID: PAT_TA_1063
gcaatggcgtggggagcaacggaacacacgagagaatcaactgaggacgctagggagctagctcgctcttggtccactggaacccacaatggatcttgacaagacgaacacggtgggcggcgacggcgcggcgaacgggcaggacctagagcaggctcgccgcggccaggagcttcccccgcctgccggccatgccaccaagggcctcgccgtcggccacctcatccgggagctggtgctagagggcgtggcgacgttcctggtggtgttctggtcgtgcgtggcggcgctgatgcaggagatgcaccacagcctgaccttccccacggtctgcctcgtcgtcgccctcaccgtcgccttcgtgctcggctggatgggccccgcgcacctcaaccccgccgtcaccttcaccttcgccgccttccgctacttcccctggcgcaagctgccgctctacgtcgccacgcagatcggcgcctccgtgctcgcctgcctctccgtcaacgccatcatgaggccgcacgacgacaacttctacggcaccgtgcccaggccccccggggccggcgcccggctcccgttcctcctcgagctcctcgcctccgccgtgctcatgatcgtcatctccaccgtcgccacaagcaacgccagcaaggcggtggtagggatctccatcggtacggcggtcgggacgctcgggctggtcatcgggcccgtgtccggaggctcnatgaacccggcgaggagcctgggcccggccatcgtcttcggccgctacacctccatctggatctacgtcgtcgcgcccgtcgccggcatgctgctcggcgcgctcttcaacaaggccgtccggcagtccgacgcgatcgtgggcttcctctgcggcggcaggggcgcgtccagcagggtggtcatcgtcggtcgctccgtcacaggagcgcctggaacgaactagccagctagccgttttggaagtggcatcagttgctgtagtccacttgtaagag

SEQ ID NO: 1064 - DNA, 493 bp, Triticum aestivum
  unsure (1)..(493): unsure at all n locations
  Clone ID: PAT_TA_1064
aacgccantggcggggtaatagatcatataggcgaattggtacnggcccccccttgganggcagtgcgcgcngtgtcccacgggtcgtgcccaccgcgcngagttgtgcgttgcatggagcacagcggggcaagcccgccgggtcgcctccggggcggcggcgcagcaaacccatccttcttgagcggaggacggctgatcaggattaaaaatcccttctttctcttgctcacccacgcgtccgctttgatttgtatcactacttccggcactctctccgtgcctttgtgatcttgtgtatgtagatgtatggtttggctgtaaaaactaacttttttggattgattagtgctcttcgttcttgatgctcaacagcagagacaagagaatgtgttatctgttgaaacttgaaagaggaaaaaagaaaagacagagtcaaggttttgtctcccaaaagaaccaaacaataggaagaatgattcaaagattgcag

SEQ ID NO: 1065 - DNA, 1066 bp, Triticum aestivum
  Clone ID: PAT_TA_1065
cccacgcgtccgagttttattatgattctgtttcaatattcttctataatgttctgaatccacctcaatttccgtctgcatgctcaaataagctagagaagtactataaccgtggggctggaactaatgagagcttactgtatgagatcataaatggtctaagggctgctggtactgatgcaggaagttcatccgcagctgcagctagtttcaccaatgccacaaaatcagtagttgaattgctgacggagagggtcaatcaactgtccgttaaaaatgatagtgacttggatttccttttggacgaaaatcataacctcactgaaatggaagagaacactgcagagtctcatacacaggataaggcgaacaggcaaagtgaggagtgctgctcatacacaagttcaaaccgagagagctggggaagatgttcttccttaggggcagcgagtgatgtatcatcctccggcgaacgtcctagggtttccgatcataagcataagagcatgacactaagagctctggcaacaccattgagacggatacggcggaaaccactcaccataccaaaggagaggaagaataggtctctatggaagaggctaaaccaggagaggcatgatatgggggagagcttaacccagcgtttcaggctgtgcctccagggccaggctcagcacaagagaacaaagtcatctttgacactgtgaatactcagtttaacccagacaaaactgttaggaacacgatgattccccgacgaaatgcgccttgattttgacctttgggcgccaaccttgttgcatactcaccactgaatttgtgaagccggccacgtaactgtttgcctttgttcctcagatttttccacgttgcttttgtagatcctgagtttgtagaattgtagtgtgacccctcctggtgtggggaaggaaccgtgcatatcaacagatcagtaggtttttgagtttaaattgtattgttacacaacacgtcatttgtttgttgtttgggaaccttattacttcgtgctatttggttaaggggcagattgcccatgaaccgt

SEQ ID NO: 1066 - DNA, 642 bp, Triticum aestivum
  Clone ID: PAT_TA_1066
cacatctccccggggggcagcacatatcatcgtcttttgcctgtagcatgatgtggttgtcgaagccgcaacaagatctatgcatccgcatcatgatctggggcggcatcgacatgtccgtgtcgcacaaggaggaggaaaccgggtacgtgacccttgccgcctggttcgccgtggaatccttcgacgtcacacggatcgccgcgaggaaccagctcagccataacacatcgctctccttgctggagaggcacgcctacgaggggtgcatgaaggactacgcgctagcgggcagacacatcacccgcgtcgccaacgagatgctacccagctgccgcttcacggacctcagctacgagtacaaccgtgcgctaaatagcatagttacttgtatgaatcggctgtcggcgctgactcacgtgaacacgcccctcaaccccatggtgttggccggctaaatagcataagtgctggcgtaccatcttgcttcgcctttggtcgggttgtcacccctggaccccatggtgttgccccacaagaccaacaatggtggcgaaccactttgctacttgatgggggaaggggataaaccaaccaataaaataccattgggcggatttggggccggggttggctaatcta

SEQ ID NO: 1067 - DNA, 755 bp, Triticum aestivum
  Clone ID: PAT_TA_1067
cttggatactgaaaagaaaatatatcaattcaatggtgctaactccaatattcaagaaagagccaaagcactggaagtgatccaacatttaaaggacaagtaccatgaaggagtttgtgatgttgcaattgttgatgatggaaaattgcaagcagaatcagattccggtgaattctgggtggtttttggtggttttgcaccaatagggaagaaagctataagtgatgatgatgttattcttgaagctacaccaacaaagctttacagtgtcaataatggtaaactgacgttagaagatactgttttgacaaaatcaattcttgagaacactaaatgctttttacttgactgcgggtccgagttatatgtatgggttggtcgagtaacacaggtggatgatagaaaagctgcaagtgtggcggttgaggaattcattgttaatcaaaataggccaaagacaacaagagtaactcaagtaattcaaggttatgaggaccatacgttcaagtccaagtttgattcgcggccggtttctttcgcggctgccgccagcggcggcgttgcccgacgccaaggggcggccctgctgcagtcactcggtgctgcttcgcgtgcctcttcttcctccccgcccgttgtggacgttgttcccgcgctcctagttggcgctggggcccctctgggcgggggtgtggttcgcagggccacgcctgctcttccgaaggaagattttggaaaatttcatagtgcggatt

SEQ ID NO: 1068 - DNA, 1066 bp, Triticum aestivum
  Clone ID: PAT_TA_1068
gccggccgggcctgcgaaaacaacaaacaagcaaagcggacggagtccactcgtccctccctcccgatccccaccaggcctaacccagcaggcaggcaggcaggcagcagcagctccgcctccgctagggttcccatccccaccaggccaccaccaccagcagcagcagcatggactccggcggcggcgactcgtccggcagcgcgggcgcggctgctgcggcggccaagtggcggagggaggcgacgcgggcgttccagtactacctggaccggtcgacgccgcacgcgacggggcggtgggtgggcacgctggtggtggccggcgtgtacgcgctccgggtcttgtccatccacggcttctacatcgtcagctacggcctcgggatctacctcctcaacctcctcatcggcttcctctcccccatggtggacccggagctcgacccctccgccgccgccgccgggcccgccctccccacccgcggatccgacgagttcaagcccttcatcaggaggctcccagagttcaagttctggtatgcaatcacaaaggcttttgttatagcttttgtcatgactttcttctccgtgttcgacgtccctgtcttctggcctatactgctctgctactggattgtactctttgtgctcacgatgaagcgccagattctgcacatggtcaagtacaaatatgtgcccttcaacatcgggaagcagaaatacggcgggaagaagggtggcgcgagcagcagctcgtcgaaagactgatccccggtgtgcaaggggagaatggaagggcgggcggaagatacagtcgaacgacaaggcttattccatgtgctacatagtaccaacaagtgtaatacttcattcatgatatctagagagagctaggagggacattcgctgcttatgtttccgacatgggttcacggtttaattcgatatattcgtgttacttgtgtcactgtcagtcattgtatagcgtgatcgattctttgttgtcatctcggctcctgttgctccaaatgttgttgcagcaaaaataagtatgcggtgccgtg

SEQ ID NO: 1069 - DNA, 2272 bp, Triticum aestivum
  Clone ID: PAT_TA_1069
gccccgtgccccggagcctcgcccggctcaccactatgtttgacctcagcgaggcacacgctcacagcgttgttagcaagatgatgatgcacgatgagcttcatgcaagctgggaccagccaaccaagtgcattgtattccagaacgtggaatcaaaccaggcctgcagggactaatcttccagatgactgataggctctctgtccttgtggagagcaacgagagggcgtatgaggccaggactggtggtgcccttgagggtgcaccaccccaggcgcaggggtgatcaagactcgtccaatatgggaaagtggcaggagaactttgtatcgtcacaaggcggccgccgcggcggtgggaggtctggttatgctggtagaggaggctctgggcagggcggtgggtaccaaaatgacaggggtggccagggttcccgtgggggctatggtggtggttctcggttccaggatggaagggctcgcaaccagtctggttcctcgtctagaggggatggcaatggacgcatggtgaacctaaacaggcctggtagaaattagaagtctgatagatttgagataaatttccgagcaaggttgccttgaagcattgtttccgcaccgttcagaacttgagtcgttgtttgctctatttttgtagcttctgttgtctgtcataaatctaccaagaagtcttgagtaatagttgtctggtttgtatcatgggagtgaggactacatattcactcctttataacatcaagttactattttcccccgggcaatgctgtgtcacatatatcactatgcaatctctgatgaattttcagttgctcgtgacttgctcttaatgagtcgtttacaagatgggattcaacttatggacatctcatctcaagattttatacaaccgggtcatggcccaagtggggttatgggccttccgagctggtttgatagctgatgctcatggttgcctgtctgagctatatgcaactggaagagtgaaagagttgcttgcacaaggtgtccagtatagtcgataccatgagagaactcctgaacaggaacgacttgagaggagaaggatgatgccttaccatatgcatataaaccttgaacttttggaagccacacacttgatctgtgcaatgctaattgaggtcccgtatatggcttccagtacttatgacaagcggaggcctatgagcaaaacattccgcaggcttcttgaaatgagtgagaggcagacttttgttggacctccagaaacggtgagggatcatgtaatggctgccacgagggccctcaataagggtgaccatgaaaaggctttcagtgtcatcagttctctggatacctggaaacttttgaggaataaggagcatatccttgagatgctgaagcttaaaatcaaggaagaggctcttagaacctatctcttctcttactcgtcttgctacgagtccctgagccttgaccagctcactactatgtttgacctcagcgaggcacatgctcacagcgttgttagcaagatgatgatgcacgatgagcttcatgcaagctgggaccagccaaccaagtgcattgtattccagaacgtggatcaaaccaggctgcagggactaatcttccagatgactgataggctctctgtccttgtggagagcaacgagagggcgtatgaggccaggactggtggtgcccttgagggtgcaccgcccaggcgcaggggtgatcaagactcgtccaatttgggaaagtggcaggagaactttgtatcgtcacaaggtggccgccgcggcggcggtaggtctggttacggtggcagaggaggctctgggcagggcggtggttaccaaaatgacaggggtggccagggttcccgtgggggctatggtggtggttctcggttccaggatggaagggctcgcaaccagtctggttcctcgtctagaggggatggaaatggacgcatggtgaacctaaacaggcctggtagaaattagaagtctgatagattgagataaaattcctagcaaggttgccttgaagcattgttcccgcaccgttcagaactcgagtcgtcgtttgctatatttttgtagcttctgttgtctgtcataaatctaccaagaagtcttgagtaatagttgtctggtttgtatcatgggagcgaggactacatattcactcctatatttggcatcaagtaaaaaaaaaactcgagggggggcccggtacccaattcgccctatagtggctcgtattac

SEQ ID NO: 1070 - DNA, 846 bp, Triticum aestivum
  unsure (1)..(846): unsure at all n locations
  Clone ID: PAT_TA_1070
ggtcctggccgggccaccatggggccagccctgtacaccctcaccgctcttcatcatcgcctcctgtccccgtcatggcgtccctgctcgtgctgagggggacgtggtatggtacggttcggcctgcgacacaaccggactggcttagccctcgcaatccgcaccccccccgcccccacagagggcgttcttcttccatcaaggttgcttccaaggtagtcttaaagacttcaacatatcccaacaagcggaatgttgcgtatggtactattcgaagtactgatccaagaactaaggctggtggtattgagttaggtgctgaatttgctcttgtgcgcatagacgaacctattcttgataatgaggagttggtaagggaagtttctgattgcaagacaattggcgaggctttcacttcaggatacttaattgcctggccttcagcttttattcgagagaaggatggttgatttgcagttgaattcttggatcaagaagcaaataaaatctgaagattttagctaccaatagttgtagtttacattgatagatttaaaagtgtaatatcatccagaagatctttttctttcatcgaattgatgcaaatgcgacagtgtaatattccccatagttgtgttttctatcctcaaaattatgactgatatctttattgtaatgcatatgtatcatacactcttctatattcgtaataaatatcttcgtacgagtttctgtatgtgtactgcttcagtttaaatatcattttgatatgctgccaagcataataataaaatgattaaaaatttatgcnnnaaaaaaaaaaaaaaaaaaaaaaaaaaaaaaaaa

SEQ ID NO: 1071 - DNA, 901 bp, Triticum aestivum
  Clone ID: PAT_TA_1071
cattcttcacggcttcgccctcaattctcgctgcttcttctacccggagaagcttctagaaacaccatctccgatccatcagcccagccaggcctacctgctggtggaagtcgacacggcgtgctgttccgtgccgcttccttagcggtcgcgcgaaggatgctggcgtccagggtctggtctaggtccgcgccgcagtcctcgcgcgctttggcttccgcagcggcctcggcggcgaggtcccttctactgaggtccggcatgcagctctcccgggctcctcccggtctcgcagagcggccctgcgcccggatagctgaggctgatgcgccgccgctgtgctcttcttcaggctattcacgaggagaacatgcctgcagaagacgcacatatcaaatacatccagtgtctaatcgagtcacgcctgtcggagggaaccgtcatgttctttatgcaagttatctttcacagaaccaacagaactacagatctttttcggcttcgtccgaccaagagaggatagaagctgcaaacaggataatacatggtctgccaaggtgtgtgaaaattgtagaagttgggcctcgagatggactgcagaacgaaaaaaatacagtgccaacacctgtaaagattgagctcataaagagattggcaacctctggattatcagttgttgaggcaacaagttttgtctccccaaaatgggtgccacagctagctgatgcgagggatgttatggaagtggttcggaatattacgggtgtaagctttcttgtattgaccccaaaccttaagggatttgaagcagcagctgcagcaggtgccaaagaagatgcaatatttgcgtcagcttctgaagcattttcaaagtcaaacataaactgttcaattaaagaga

SEQ ID NO: 1072 - DNA, 692 bp, Triticum aestivum
  Clone ID: PAT_TA_1072
cccacgcgtccgcccacgcgtccgctttcagccactaagatccaagggatgggagacggctctcttggagtacactatatccatgatcacagattctacacctaagtcaagagtgccagtatcgaagaggctctctgagatctcatgcccagtgctagtggtgactggcgacacagaccgccttgttccagcttcaaatgctgaacgtctagcgcgtgcgattcctggcgcgacatttgaggttatcaagaattgtgggcacttgccccaggaggaacgagctgaagaattcctttctgtcgtcgaacggttcctacagagggcctttggaactccagatgagcatgtgttccaagcagctgtatgacgatgcatgctggtaaatgcatatgcagaagacctgttctcaaaaaaaaaaaaagaacagatggacctacaattgtctcgacagggataacgagattgcagtttaacgattggagattgcatttctgttggagatccatcatttaatagccatgggtgtttatatacgatgaagcttttgtgcaaagttggataagagaatcttactgcacaaaacccagaggctgagaagaattcattggattgggttggtcccatcgaatcatcaccatcttcctgtaactaaaacttcttatttgtaaagtggtagacgtagagcaaagggt

SEQ ID NO: 1073 - DNA, 568 bp, Triticum aestivum
  Clone ID: PAT_TA_1073
ccccacgcgtccgcttttttgtgggtttttcaagcacaaaaacagagtatattttcagggactttggataggcacaagcaacacaaaaggaaaaaaataaatcaagttgaacccagagaagtacttactatgctatgaaacaacaaatacaagcaaatgggactttttttgtatatatatatataccaaaagaaacttttgatatttacattctaaggactacctggactagaacagattggaagagagaagattagttacagaagttttggtggtggaggtccagagagatcatgatgatgatggggatgcttgagcttgtggagccagtgggctagccatttcttgggatcatgactctcctggcagtttgagcttggcatattgtcaagtgttccatctctttcaagaaccatcttgaacttgtccagtaattgaactatttgccagaattcaggccttttatctgcttgcaaggcccaacactgctcgatcagaacccgtaatgcagctgggcaggtagcaggaatggccggcctcacattcttatcaaaaacagcaaaggctg

SEQ ID NO: 1074 - DNA, 723 bp, Triticum aestivum
  unsure (1)..(723): unsure at all n locations
  Clone ID: PAT_TA_1074
ttttttttttttagttttttttttttgtttattcagtttactttattcttaagaagtagtagattgtttcagtttttcaacaaaaaggttataagctacgcgcccgcgagagagcgcgttagtacacgacgcacgatagctacaaattaaacctttgcccgcgcttctttattctccttcaccgtcgtcggcatcgttcggcagtcgtccgcactcctgacatctactccagacgtgagatagaattctccaacttttagcgatgcccaagcagcaacgagcatcaccaagcgctccaaacgccagacagatgagcccaactgtcagccgtcgccagctccccggctggaccccgggccccgtgagaatttgccgcacttgtacgctgcatgagctaccagcagcagagccgggagggtctgcccaacgatcagaaatatcatgcaacacttctccttcttcttcttcttccaggcattggcattcgctgcagaagccgcagctccacacgctgacgccgcctctgctgatggattgacgaccacattcgctggtgcattgacgaccacattcgctgcaggagctatcaccaccacctgcagcacagccgccggaggatgggctacgttgttggctgctgctgccaccggaggattggcgacgttgttggctgctgctgccgccggagctttgtgccatggcgtnccgcgcgtgcacccctcg

SEQ ID NO: 1075 - DNA, 244 bp, Triticum aestivum
  unsure (1)..(244): unsure at all n locations
  Clone ID: PAT_TA_1075
ttacataagggcgtttnnttttntnnnttttcttaattcattttttgatgcatctgtgaataacccggacgatattcattcatacttgaataatttatacataaaaccggataactttcgacatacttgaactaggccggactctaaatctagcctaaatgaccgccggcgcccgttcccaatgtccggcaggccatgggccctgggaactgaagcttcgactccgccttagcagcctgcaaac

SEQ ID NO: 1076 - DNA, 940 bp, Triticum aestivum
  Clone ID: PAT_TA_1076
cccacgcgtccggccaatcatcgggaaacctcagctccgtgctcgcccgctccttccgtgaggaccatcatacgcacacgctcccatccgaaccctagccttagctaacccggcgcttgccatgctctccacagcaccagccgcgtattccacctccttcgccgcctttcccaccctcgcgcggcgccggcaccggcaccgccgcgttctgctaccgttcgccgcggcgactgacggggcggagcggttcgccgcgagcagctccattgcggattacctccggtaccgccgcccgatgtccggggacctctccgtgggagggggtggcggcaagctgcagacggccgtggtgcggtacgagaagcggtttccatggtcgctcatccacccttttctccgcgttgatttggtttctactgtacacattgctgacaaagaatatttcgataaactccaacaagcacttgaagactatgattgtgttctgtatgaaatggtgataagtcgggataatttaaataaccagcaggacccaacgtttgcgaagaagatgagatcttcgcgcaaaggtttcagtattcttggtttcatacagaaacaaatggctcgtatcctttcattggattaccagctagattgccttgattatggcgatgagaaatggcaacatgctgaccttgactatgagacattcaagctgcttcagactgaaagaggtgaaagctttctcacatttgcagtggacatgaccctgaaatcaactaaagccttggtacaaccaacttctccagatggtcttgatttctggagatccaagttgctatgggcctcgcgtgttctaccaatgccacttattggactatttgttatcaccgggctttgtttgccagtggataagcaagatggatatcctgagctggaagcattatccaaactagat

SEQ ID NO: 1077 - DNA, 870 bp, Triticum aestivum
  Clone ID: PAT_TA_1077
ttttttttttgttcaaaagcaaggcaactttaatttattgattttgcgactaaaagcacagtaaatctcctctgccgtcggccacatcggtgcctccgacgatgccagattccagatccagtacaccagaaagtcgaagcgggaacgggaacagaaacaaaatctagttggccagatctaatacacatcgacgctgtaagcactgaggagcgtaccaggcggcggcaagtgtccatccgactagttcgcttagttggttccatccctgcgcagggcaggggcctccggcgccgccgggacaggctggtaagccttgtcctggtggatgaagaaggcgtagaagccgccgcaggtggtggccgctgccatcgtccagacgacaatcttgactgccagaggcatgatttcagcgactttatagctgaacatgacggtgaggaggctggtgagcgtccagaccgctgccttgatcgtctgccggcgaggagaatgatagtccaaatctttataaagtcgcagacatgcgacaagggcaaccaggttcaagtaagagaacacaacgaagactatggagcccgcgtcgccgttggagcggtagatggccatgccggagttgaaagtgaggaagcagaaaccgagaatcgtgagacacgacaagtctgccattgttggaagtggtggtggtgacgttcactgcaaaggagttagccagcgtttatgtaccttgtacttatttatcagccgttgacttcagactttcagagcgggagaaaatcgaacagcggaacaaaaccatgagctccagcagaatctggaaaatatgatcccaaaggagcgtaccttgtacttatttatcagcggtgacttcag

SEQ ID NO: 1078 - DNA, 1868 bp, Triticum aestivum
  Clone ID: PAT_TA_1078
ctcgatctcctcgtccctttatccccggatccccgcgccgccctcgccggagaggagcccctccgccatccgcggcaatggcgttctccttctcctcgccggcgcagcagaaccctttccagacgccaacgcagcagaatccgttccaaaccccagcgccgcagaacccatttcagactccgtcgccggcgcagactcaggcgccggcgcagtcgccttcgccgttccagtttaacttccagcaaccccagcagcagcagcagcagcaacaacaacagcagcagcagcagcaacaggccgcgccgacggcgcagcctcagcagcagctgatgctgtatacaaaggaggggaagcccgcagggtacaacacgaagtgggatgagctccacgccgactcgcagaaggcgctgcttcagatcgaggataaaatacgggagtacaaggacgagagtgaaaggttggatcagtgcagtcgccttcatgactcctcaatctcgaatgtcaattttgagctcgatgcaagtcacattgctcaggaactcgcagggactgcaaccgtaattgagagagagaaggcatctgttcaggagttgatgactgttgtcaatgaaatgatgtggaacacagaatttgctattcgctcatatatgatgttgagaccaaggttcctcaaatcagccacaggttcttcaaatccttctggacctgctggagctctgcccaatcagcctggaccaaccaatgatttctatagtggcgtcccaaagaggccttccctttttatgctgcaaactgtcaacaagtttgagaagtatcttgacgaatgctgcaagtggattactgaactagagcagctggttcaaatcgagagcaataaaagatcatcatcttctgtggaatctctaccaaaagttatgtcgaatgtgcatgactatttcatctatgtcgcttcaaaggtggaaaatcttcatcagtatgttgtgtcgatgaaaactgaatatctacacggtcagcgccgtctgggcaatgcaaatgatccatttctagaggcaaatagaagagaagcagccaaagaagaagcagctgccaaaagggtccatccgacattgcatttgcctgctcctgtacagcccacaacacaaattgctgcaccagcaacaagccaaccacagcaatctttgctcccttctggaggaacttcctcgagtgccttcacagcttttagcatgccggcctctgctccatccacttcaagtctcttttcaacaccaacaacttcaagtctcacaactaaccttttcggtacaactggatcagcctcgctgtccacaccatttgggacatcctccactcccactcttggatcaacaccaactccgtctggatttgggggtatcaccccatcttttccttcaacgcctgctttaactggaacttcactattctctacgccatttggaggtggtgctacagcttccgggtccagctttggtggcacatctaaagggaggtcaaaggcccgaggccggcgctagacgtaagttgacaatgattggatcggccgtgaaatgcgggcgggcgcctcttgtatctcctgtctactgaggaaagaaaaaacttgtaattaattttccaggcaattctaccggtggagcttgagtgactatctatctattgtcaattgcctggtaccagattcatttgtctaacgcttgttgttagcatcgttctgcctgtggacttccttcagtgctaacaagagctaagcattcctatttttagaggcaaaggttgtaaacttgtaagggcacacctagtttgtgattgtcctcgcggaacctcgggccgatgcggctgcagaacaaaaa

SEQ ID NO: 1079 - DNA, 851 bp, Triticum aestivum
  Clone ID: PAT_TA_1079
gggggctggcagagtatatataaaccggagaacatacctcatattttagttgcaatttcttgaccatctcaatttctgagtcacagctggaatgcacatgactaagatagtcggacaacacgtcactaacgttcaggtgagcgtagtgagagacatcaaaccgtactttctgcctttccaaggcctcttgtttggcagagttcctagccagcactattggattacccggctcaatgaatctgctgccagtgatctgaacgtcatggtcaggagacgctggcgggttagctgaaccgggcagcctgacggtggatggatcgacaatggtttcgtcagctgacggctcaggagggtccaattgagcatggacagccgagtcttctggcgcttaagattgagtgggaggagttgatgttgccggttcaggtgcaggattttttgggtcttctgctggtttaatcaccttggctttcttggactttgcttgaccgccaggggcagtcttgaaagccggaaattgagtttgcgacgagtcgctagaagagcgagaaacctcctgcgaaggtaaaataaagttagtgatgcaaggaaatagatccattaatggaagcaaaagacaaagataaaagaaacctcattctggcgtttttgaggagtttgttgtaaatcggaaggcagttcatcgtcgtcattagtccgggcctgacggcggctttcatgttgttgttttttcaaaagaaaatgagggtctaaataagccaaagggtgtgaaaaccttactctgggttaccagtcgaagtttctgtcttggcaaaggggctgagtcggaggaaatagttcctgtaattcca

SEQ ID NO: 1080 - DNA, 572 bp, Triticum aestivum
  Clone ID: PAT_TA_1080
ttttttttttgttttttttttttttttttgcgtgtgaattaaaataatttggacaaactccttcacgctgcatcctgctttaacatacactagcacactagcactacaaacttcctcaaacctttgatcacatactagtatatatagcatcaagtgcatgcatacggcatacagcacaccacaccacgcccttcacaaatcaagagtccatgcattaatcagcacgcgcagcaaagcatagcgagcatacgtcgtgtgtttccatggatagattccgatggatccgcttgcttgctcagagcttcttgttggcgaggccgagggcgacggagacccatctgggcgaggtgcgcgctgcatgacctcgtagggcgacttgacgtcgcgctcctcgtaccagttgtcgcagtcgccggcgtaggtgctggccgccgtcatcttctccaccaggctctcgctgctggtgccgggcttgtgcatcgcccggctcaccccctccagcgcgtccaccaggtcgtcgtagttctgctcgcacgaccccaggatggacgccatcgggttccgccccagcg

SEQ ID NO: 1081 - DNA, 666 bp, Triticum aestivum
  Clone ID: PAT_TA_1081
gcggccgctcgttgtctaaggaggggttttttttttttttttataactgaacttctcattgccatttcattcgagcatcacgaatcacaggaccaaacgatacgatcatatcaacaccaacaaacacaaccgacacacatccagatcacgagacaggaacagctactacccagcagtattaccggcgacccagacctaggcgcgctccccgcggatgcggcgtgcgagctggatgtccttgggcatgatggtgacgcgcttggcgtggatggcgcacaggttggtgtcctcgaacatccccaccaggtacgcctcggcggcctcctgcagggcggagacggcggatgactggaaccgcaggtcggtcttgaagtcctgcgcgatttcccgcaccaggcgctggaaggggagcttgcggatgagcagctccgtgctcttctggtacttgcggatctcccggagcgcgacggtgccggggcggaaacggtggggcttcttgacgccgccggtggccggcgcggacttgcgggccgccttggtggccagctgcttcctcggcgccttgccgccggtggacttgcgcgccgtctgcttcgtgcgggccatcggcgcgggtggtggtggtgtcttcttggagatcgggtgcggcggcgctgtgatttgttc

SEQ ID NO: 1082 - DNA, 965 bp, Triticum aestivum
  Clone ID: PAT_TA_1082
gcggccgctcgagtactaaaggggcgtttttttttttttttttcacagcgtacgtcaagtcatataggcagtgaaataagggacctgattacatatagtggaattcactgtggctacgagtacatgattacataaaatcgaagctgttcatcacagcgcatatgggcacaggtaatagatagctccggtacttcagggtaaccaaacaaccatagtgactgactgcatcaacagcactgacctagcaatgaagcaagcctagtacttactactagttactagatagattactactccgtacactcatcacactaccgcagcaccaactgcggccggctgctgaggattcatactccacagcgccacagcagcacggatgcagaagagcacggtgagtaggagcttgcacagcacagccgcaatgcggagaaggtaagaaacctcttgagacccgccacagatttgaagaacgagcccgatgagtcccaccaagagcgccaagtggaagaacgccacagacgcgtgccagattagcggccaccgacggacgcgaccctccacatcatccttgacctcgctgccgctgccggcggcgcgcaggaagaagagcaccatcgctggcactatgagtagcagggagagcataccagaataaaccaagatctcccaaactaccgaggccacggtgcagttctcgacgcaggcccggaacacgacgaggtagaggaatgttgcggcgaagaggaagctgatggtgccggcgaagagatggaacagggcatcggcagccgcgcgggccgtgctgctgcgtgccagtgtccccacggccgtcctcaccagcgccggcgagatggccgcttcgcgggcagccagcctggaaacctcctcttcgaacgtcacggccgccatttcggatgtggagtggagtggtcggtgactcggtgtgagtgtgaccctcgtgccga

SEQ ID NO: 1083 - DNA, 1237 bp, Triticum aestivum
  unsure (1)..(1237): unsure at all n locations
  Clone ID: PAT_TA_1083
ctaaaagggcgggtcaaacgtggcattaaatacctagatcatcgtctaaaagtgatttcttagactagatctgactaccatatctaacatgccatctacagcttgagagtgtttccagcaacaccaaccacggccgccttgaccttggaagagccgacaagagagtacttgtagggaatgtcggacttggagatggtacccttgggggcatcgttggtggagccgccgaggtcgacatcgttgacagagatgcttccggtctgcttggagtccttggagatgagagccttcttagcgttgctgaaagcagacgactcaacaagaacctgagcacccatgcgagagttgacaccagtgacgctgatgtcctcgtagtagttgttgaagacgtggacggtaccgaagcggacagagggagcacgagagccaatgttggtccagtggttgttggcgtaggtgacgtggagagcaccagtgtcctcagcagcgttgctgtcggagtggccgacaagagaagccttatggtggtcgtggaagtaggtgttggagatggtgacccagtctgaaagcgtgggtgacatcgaggagaccatcaaagaagtccttgtcctggagaagtcggaggacaactcgcagtggtcgacccagacgttggtggacttttggatgccgatggcgtcgccgttggcagcgacaacgttcttgatggccaagttgcggacgatgacgttcttctgcttgttgatgtagaggccgatgttctcgagagaagcaccagcggcaccgacgatggtcttgtcggacttgacacggatcttgttgttaccggtgagctggcccttgacgtaaatgacctgcttctcgtccgactcggcggccttgctgaactcagcaagggaagaaacagtcacggtagctcctccggcaccaccagtggtacctccattctcggtagtatagccaatgttggcagcatcggtgatggcagctcgcttgccgagagtcttgccaacttgctggacggtaggagtaggaacggcgctggccagagcagcgaggttgaggagaccgaggaacttcatcttggaggtgtttgtaaagtaaaataatannnnnnnnnnnnnnnnnnnnnnnntgtcttttgaaaagtaaagagtgaaagttggaaccagtccaacaaaacgaatgtataaagttaggaagagattaaaggatggtagtcccggcccggccggcc

SEQ ID NO: 1084 - DNA, 913 bp, Triticum aestivum
  unsure (1)..(913): unsure at all n locations
  Clone ID: PAT_TA_1084
gtgtgtgtgtgctggaaattttcttccaacacgtatgtgaaatttggttcactacctaacaataatcatcggaccagtccgacggaccgtcccaaataccatccagccgttttgtcttgtaagaggtcaagacgggaaatttgacccttctagaaagtcagcgcggaccaagaagtgtccagagctcaagagtaataaaagtacagacagcaaaagaaaaagaaaggaaaacagtctccgtccaacttctcgcaatatctatcaatcttgatcgctgcaaaatccaaactctctagtggtccataatacatcgcctcggtgggcataataactctgcttcaaagtctccaaaataaaataaaacgccagtccatattctagcccgtatccgttgtatatcgctgttcaattcaattggacaaagggaatattaaaacaaaacaaaaaagtgtgaagtatcgattaggttcgtgtatatgcgcctgcgtatgtcggtgccggggagtccttttcgtatgagactttgttgtggttaataaccaagttgcgaccagatttggcgacttgtgtagtgtgcttgtcagccccgtactcgcggtactcgccaggagaaagagatcgaggtgttgtgctggttgaagagctgtacgaaccagaagaatagctgtaggaactggagattgaaggctccttggtgctctggtggatctggacggtataaggggagctcatggttgcggttgtaagagagtgggtggtagttgtttgtttgtaagagttgagatgtaaacggtnnnnnnnnnnnnnnnnnnnnnnnnntgttgataatgtttatggttgagtagaactgagttgtctgagttgtcaggtatttgtatgagagtgtttcttttttttgattcccggcccggcc

SEQ ID NO: 1085 - DNA, 1217 bp, Triticum aestivum
  unsure (1)..(1217): unsure at all n locations
  Clone ID: PAT_TA_1085
cccagtagtagcatgaattagtactacattataaaacattcttaatattgttatgttgaaaactcgagacgagcccaccaactaaccctaatgacaaactggccatgctaagtatcttacattctgtttcctgtcactggggatttattaccaaaaaaaaatgaaagtcgttattcatgagtcgttatttttctcatgggacgccgtcgctggaaaagcataaaccgggttcaaatggctacgaataatggaacaaatgaggtgtagaatagttgaaacgggcacgagatcgtgaagttagtttatgcccgaatcgtgaggaggttatctttagtcgtcaggccgttgtatcggtcgtcgtgctctcgtccgtaaacgagggggcaaatatatctctgaaccgtttggccgcctcttcactgacaaacttaatttcaaaggctccagaacggttgatccgttggttctgctgacggtattcctggcaaaagacgtagagatgaatgtcggctaagcggactctggttttgctgactctcttgatccatctcgacgaagcagattgatgtgtgacgaatgctgtccagacaggacactgccgtagatccccttcccagactgcagcgtgaagacggagacccttggagacaaagtcctcatagacaataagagaatgcataaaattgtcatccacaattcgggcttggaataacttgcgttcaccccaaagactgaggtcttcgtttgccgccattggaagagtttggctgtcacgagtcttgaatgacagaaagcagcaatataccaagaccatttcttcccatgtcaggaagcaaagggtcgcccacctcttggtgcatcggtcgctctcgctccatcgccagaattgaagacaacttccgttgcgatcgacaacaagctcatgtgccccacgaagcgagaaccaaggtgtgcccatgtggaacgttcgtaggagaaagtaggggcagttgtcctgtgcactttcatacaccaccaaagttatttggcgctcattgaaggatcgcataaatagaatttttgcatcgctaggcatctggatttgttcccagggaacnnnnnnnnnnnnnnnnnnnnnnccccaagcggaccccatgccttggacggctgctggtgtttgagtggagttcgagatggcagtggtagggagaagatcttttcaggacaacccggcccgg

SEQ ID NO: 1086 - DNA, 2411 bp, Triticum aestivum
  Clone ID: PAT_TA_1086
ccaacggctctcacaatactacagctcaaaggattttattctttaaactccaacaaaatagtacaataccactagttactttataggtttagtcagctgataggagaaatcaacaagaaaaaatacaaactccttggagctcgctgagtcggtccaacaacaaacccaaccgagtacaagtttcgccaactcgtgatgctcaccaagcttcccaacctttcttccactcacaatctgttgttcttcatcagctccacaaattcaccaaaacgccaagtctgagtcatgtggccccggggaggactcgggatggtactggaagagacataagcttcatcttggggaacacaagaccagcacagctctggtcatttaggttgatgtgtgtaacttgtactccttccgggaagcgattctgggtccacagcatagttatggttctgtgcactgatgtctacacgtccggtcctgttgtcacgaactggatggtttcctccgtgatgaccaaatttcatattaaatgtctttgcaccaagagcctgaccaatcaatttatggcccatgcaggtaccaaatactggaaccttccctactatatcttacagtgctttgatcacatgtggcactgcaattaggtcaccaagcagatttctaaaaacatccccatcaggcatgccattttgcacatccaaagcttattatgcatctagatgatcccatgcgttgcataatgttaatcttaactccaaaatcatacactacgacatgaaaagttccacttgactgattgtcgttgaactcccatcgtgaaccggtcttgtctacccattcatatggagcatcacatgtaacatcacttatcaaatcaacaccaacaattttccaatttttggccatttccaacaattcctcgtctttaagagactggtcggtacttagaacaccaatgagactgccatcttctcttaacctgcgtgttattgcacgtgtgtccacatcatatatgcccataatgttcctctttctcaaatattcatcaagtgtttctgtgcacctccagttggaagtacatatacttaggttccgtatgattaagccaccaaggaagcattttatggattcttcgtcaccagagttaacgccggtgttcccaatatgagggttggtcatcaaaacaaactgaccagcgtagctaggatcagtcaaaatctcctggtaccctgtcaatgaggtattgaaaaccacctcgccgacttgagtcccggaagcaccgaaggatttggcattccacacggagccgtcctcgagaacgaggcgagcgtcgctaagcttccaaggcctctccaccgctggcgccccctgattcgctgccgggctggcgacggagcggcataccacgggcgtcgtcgtcctcacgagggccactcggccatgctgcccaagtccgccgatagagggcggcgcgggggaggtgcgccggtggacggcgtggatggctgggcgggaagggagggggcgcatctgggggagcatgttggggaaggatgggaggggagaggctgggcctggggtgagtaggggatgcttgcgccgccgccgccgccgccgccagggttttgatatgagaggtttcttccgcgctcccgcccgcccgcggcccgcggtcccaggcccaggccctccgcgcggtctccggccccgccgtgagccgccggtggggcgtcgggcgcggcgcgacggtcgtctgcgccgtccagggccaggacaccaccatccaagttcctgatgtcacaaagacaacatggcaatcacttgttatagagagcgagattccagttcttgttggattctgggcttcatggtgtggaccttgcaaaatgattgatccagctattggtaagctgtcaaaggagtatgaagggaagctgaaatgctacaagctcaacactgatgagaatccagacatagcaagccagtatggcgtccggagcatcccaaccatgatgatcttcaagaatggcgagaaaaaggacgcggtgatcggagcagtacctgaaagcacactgatcacatgcattgagaagtttaccgagaggtaaaacgctgaacgggcctcctcgacggttactcggcattccgcatccaattgttcagtcagatcatcgaaaactcgacgtcatctgcacaatctttctatacgtgcgttcagttgtgtagatagtattggaaacttgctctctgtaccatcaataaatagaatcacagaagtgttcatgataaaaatcccaaggaagcctggtttcatggtgccattcttttgggctgtagatatgtatgacgggactgttaagagtcatattctgtattatcatatcacatattccgtcagttcatgtgatcgtttcccttgt

SEQ ID NO: 1087 - DNA, 675 bp, Triticum aestivum
  Clone ID: PAT_TA_1087
agcaaaaaataggcttctttcagcgaaaatcaaaatacgggagtagcaaatttctagccggctccaacaaaatcaaaagaagggggtagcaaaaagtatgggccggttccagcaaaagaagccacctcgctggctttccagcaaagaaaaatttggagcaccgccgcggaccgtcgatgctcccgacgacaccggtcgtagcacctcccgtcgctggctccagcaaaaaagctggccggttgcagcacgcaatcccagccccgcccgtcgccgcccgtccccgtcgcagctctgtgttgcccggttgcagcatgccgagatggcggttccagcttcgactgacgcaggttgcagcacgcctcgcctctgtgccagtctccggcgaccggtcgccactcatagcaaggcctcgtcggagcgtgcagcgcaaacgcaagaggacacggggtgtggtggcgcacggccaggccgtcgccccaggctagcggctgtccgtcgtggcgggttgcagcacgcagcctcagttgagtcgacaccgacgaccttgcctgccggctacgggtggcagagggcggtgggtacccatgccgtagagggcggtgggtagccatgccgttgctggcgatttgttagaggagaaaagatgagatgcgggatgaagaacagcaaagtaag

SEQ ID NO: 1088 - DNA, 411 bp, Triticum aestivum
  Clone ID: PAT_TA_1088
ccggggggcctttgtgggggttttttttaatgagcatctcgatggaggcgtcgggcggcaggtcggagaggtcgacgggcggcagggagagggaggagatggccggcgggagggaggcgaggaaggcccgctgcgtggcggacgccgtggaggcgaaggtgatgagcgtggcctcgacgccgtgccgcgcggccaggcgcttggccagctcggcgagcgggatgaggtggcccatcccgggcgtcaccagcatggcgacgtgcggagggcggcgagcctcggccgtgccgccgctgatgccgttcggctccatcgtttcgcccgccggtgatcccgtgtctctttctcgagagggagagattctccgggcgtgcgatgatgtgatttgatgtacgggagggcggtcgtttt

SEQ ID NO: 1089 - DNA, 624 bp, Triticum aestivum
  unsure (1)..(624): unsure at all n locations
  Clone ID: PAT_TA_1089
gcacgaggcgatcctcttcctccctccacggacatctgctccatccagcagctagcttgcaatggcacctcagcggcagcagcagcagcacaaggccgccgtggtcgcgctcttcctgctgtccgccctcgtggctgcgcccgccgttgctgcttccaggcccgaatccggcggctacgcacccgccacgccctccgaggccgcgacgccggccgagcccgccgccagcacgccctccaagaaggcggcaggctacactgactctacgccggccgagtccccagctagcacgcccgccgacacggcgacgcccgtcaagaaggcgggaggctacactgactctacgccggccgactcctcagccagcacgcccgctgagggggggacgccgacctatgaagccgccagcgcgcccgccgtggcggggacgccgatggaggccgccgccagcgcgcccgccgaggcggggacgccgaccgaggccgccgccagcacacccgctgaggggggaacgcctgacaaggccgcggcgggctacactgacactacgccggccgagcagcccgccgccgatggcactnnnnncnnnnngccgcccnnnnnnnggnnnnngactacgcccga

SEQ ID NO: 1090 - DNA, 796 bp, Triticum aestivum
  unsure (1)..(796): unsure at all n locations
  Clone ID: PAT_TA_1090
caaaaaaggattnnnnnnagtcacaaggttgtaacaaatgaatctttcctctgtccacaaaaatcttaatcaaatacagttaacagaaacaagcgcatgcctctttgcagtgaacaaaacacctcacaagcatgcacgatcgagctctaccacgtggtcatagttcacggtcaaactctacagcctacggcaaacctctgggaagcggttccggcttccagctacatctgcttataacctatatttagtgatatggtcctaatatacaagtctaaagggaaggggtagggcacaaagcaagctgccctcaagcagagatcacgcgtacgtcgtcccagcgcaagaacttcgtgattgccacataactcattgcctcttgggctcctcgccgggaacttcagcaaagcagacagggcataccttgttgatggtaagccattttgtcacgcagctggcgtggtacacatgcttgcaggggagtgccatctgcagatcccctctccgatactccatttgacagatcacacacctttcacggcgttttttcttccttgaaaataaaccacacttgaatttggtgactggaagtgctgaaatgctttcttgggagaggccccgactttgggttccaactgcctcgcccaaatccaacaattcctcatatgtcatgttgtcaggatcaatgctgtcttgccaaacaacctgaggactgcttgaattttggtgcacaggttgttggctgcggtcctcggtagtagaacttgcatttgcatgaggagcttcagcaccctgcagg

SEQ ID NO: 1091 - DNA, 884 bp, Triticum aestivum
  Clone ID: PAT_TA_1091
ctagggcctttttttttcttatattcataacggatagtactaatataagctgcttaaaggcagcaccaggtgttctcacgaatggcacgggactacaaattttaagtaaaagcacaaataatgactcggataccagcaacaggcgtagtcaaatcaaacttccaggagtgcgaagaactcagtgacaccacgaaggcaaagcaccaggtggagtccaacagtatgcgaccatcctaaagctgcttaccggcaaagatcaggcgctgctggtccgggtcaaacttccaggaatgcgaagaactcactggccaccacgaaggcgaagcaccaggtggagagtagactccttctgaatgttgtaatctgccagtgtgcgaccatcctcaagctgcttaccggcaaagatcaggcgctgctggtccggggggatgccctccttgtcctggatcttcgccttcacgttgtcgatggtgtctgaagattccaccttcagggtgatggtcttgccggtcaaggtcttgacaaagatctgcatgcccaccacggagacggagaaccaagtggagggtggactctttctggatgttgtaatcagctagtgtccgcccatcctcgagttgcttgccagcaaagatgagtcgctgctggtccggcgggataccctccttatcctggatctttgccttgacattgtcaattgtgtcagaggactcgacctcaagtgtgatggtcttgccggtgagcgtcttcacaaaaatctgcatcttgacagagagggaggttcgcgggagctaaagatcgatcgctgtgttgcggcggggattttcttgatcggagtcagcgggcgagtggattgggtggagtcagcgggcgagtggagtagt

SEQ ID NO: 1092 - DNA, 1226 bp, Triticum aestivum
  Clone ID: PAT_TA_1092
gttgtttggcgtagagaaccaatgggcgcacatcgccattttattccagcatcttaaagcatatatgtcagtactacaacagtagatgatcaacatatgatgaacattctttacatacctcaaaggctcaaatcacaactaaagagtagcttctatttccaatcaagcatgtctaagagccacaagatctcaggctcggaccttgccgcatcacaaaaatctagttcaataccaaatacctctatagagtttgttcctttatacaggaaaagcaacgacatccaagctcggatgtctgatatgaaagggtgtctgggtgaaaacctgagatattcatatgccaatgcccgtgctgcattgctgtcaatgtaatcaaaactcgacgtattgattatgcaagtcatcttgttggtgtccttgcggtgggcaagaacagacacggtgatggctggccccatagggactgtcagcttgggtttgacttccatcatcaaaatgcagtctgcggcattcagatgtgcaacaagtacatctggtatgccgccaggtgtgttctgtaaacctgctcgaagaatgcagcctgaaactgcttgagagaagattagtgatccctcaagccacatgtcaatgtaaaacaccagatcctcaaaagtgagcttaggtacaggaaggtgcaccgtcttccgtggcttggagaacgttaaatagagcttttggaagtttgtgtcagaaggaggctgcttgcagatggaaggccatttccgtgagcagatgcatttccagaagtaatcatcctttgcaatttcgcaccattggcggcatacaagcatgcaaaagactaagtctttaccatccagtagaggaaaaacagccttcagaacttcgccaggaaatccattttccattctcaatcactgaactgaaggaaatggaatgcctctaccctctaggatggagacttcagcgtggctaggaagaaccgtcggtaaggcgggccgccggcgtagatctgcagagaccagagaggatgaaggggcggtcgtcgatctggtagcgatggacgacggggtggcaacgccggaagagggacgcgcaggggaagagaggtcgccgttgccggagagattcgcccatagacaaacacccagaggaaggagcaggatcggtgcccggaggaaggagcaggatggggacccggaggtgggagaggaatgggattcgggagt

SEQ ID NO: 1093 - DNA, 423 bp, Triticum aestivum
  Clone ID: PAT_TA_1093
aaacagaggtaacagggagcctgaacatcagcacatcaagaaggaagctgatgatgatgaatacgaccatcttggcatggattgctgctgctgccatgcccatgtccagcaacatgttgttgtgccagtgctgcaatcttctactccaaacacgatcgcaggcaatgtggtcatgaacttttgggatacttaatgttccctgtatttttctagcaatgtcttaggtaggacgtagatgcaagggctcatataaatatcaatgaattgatattagttaccatgataatttggttatatatatgaccatatccgaatcattttaggcttataatggcatttgttttaatgatttatttatagagtattacaatggtgacaatggagggattcttttctttttgtaaaaaaatataaaaagggcgg

SEQ ID NO: 1094 - DNA, 690 bp, Triticum aestivum
  Clone ID: PAT_TA_1094
ccaataattatgagggctgatgcaccccgggtgcagctgccaagatggagttttagcaaataggacgccttcctcaaaggtaactacgaccaactccgctctcgttggctggcgatgcatgacgaggccaatggacaacttggtgctacacaaatgaatcaaggagaacatgctaacagaccagcaacgtgctaggaggccaacgggagcattacctggtgttgaccggcgggcaaatgacatcatatatgtttttgtccaaccaaggggtgccggtcaacctactaggagatggcatatatgggccttgaggacatggcaccgttcaggagggcggcattccgacaacactccagcatagactcatcatgtccagcaacatgttgttgtgccagtgctgcaaccttctactccaaacacgatcgcaggcaatgtggtcatgaacttttgggatacttaatgttccctgtatttttctagcaatgtcttaggtaggacgtagatgcaagggctcatataaatatcaatgaattgatattagttaccatgataatttggttatatatatgaccatatccgaatcattttaggcttataatggcatttgttttaatgatttatttatagagtattacaatggtgacaatggagggattcttctctttttgtataccatgttttttcatgttt

SEQ ID NO: 1095 - DNA, 941 bp, Triticum aestivum
  Clone ID: PAT_TA_1095
tttctcttccccaaccaaccagcaagcacccaggttaaacccgaatccccaccaacaacagcaacaagcagcgcatcaacaatgaacgcggcgatcggtccgaaacaaaaaaaatcaacacatggaacacaaacggaccaaggaaaccatcgtatgaacactgacactcgaggaaccatgatcacagcatattcaatgcaggacgcacccaggattggtcgatcagcatgcaggatgcacccaggattggtcgatcagcagaactgggccgaggctgagcaactactcactccttgaaggacatgaccgtctcgaaggcccctaccaaggccttcaccctgctctgcctctcctccaggagcttgcttttcgcctcctcgatcacgtcgttgctcttgggatcatccttcctccatgactgagcagcttcagccctgctgcttgccttcgttatagcctcttctgtctctgcctctcgatccaattcatcggcaacctttgcaatgtcaggtttgttgttctttccgccggcatcagcaccctctttctctggctgctcattcttgccttgttgctgagtgtgcggcccctgctgatcgcgtcgaggtgaagcagaagcggaagcggaagcagccatgtcgatgggtttcaggtccacagggtcaggaagctgctcctgcaactgatcttcgatggacggagtggtcaggctctcggattcctcaaactgcatcgacggctcgtcatctttctccttcctgcttgtagtagatggctccactgccttttgaggagcaccccttggccttgagattgcgttggcaccaccatttgctgctgcttctcttttcttgtccgctgtgcctggcgcgcgtgccgaggacgcgggcagaggcttcccacctctcaaagcccccggcgatggcgatggcgatgacgcc

SEQ ID NO: 1096 - DNA, 831 bp, Triticum aestivum
  Clone ID: PAT_TA_1096
tagcgtggtcgcggccgaggtactgcttccatgtcatagggaatctactttataaattttggaatacatgtcatatgaggatatgtgataaccagaaaaggggaccagcagaaaacagccagttacagaataagattcaggcggagaccaagctgctcgaaggcggcaatagatgttctaacaaatggcacataaagagtttcagacgcatgacacaaaacttgacataatcaaaaagaatacgatggaagaggccgccaggccaggtagcctggggaactcgcccggagaactcactggccaccacgtaggcggagcaccagatggagagtagactccttctgaatgttgtaatccgccagggtgcgaccatcctcaagctgcttgcccgcaaagatcaacctctgctggtccggagggatgccctccttgtcctggatcttcgccttcacattgtcaatcgtatccgaagactcgacctctagggtaatggtcttgccggtgagggttttcacgaagatctgcatgccaccccgaagcctgagcaccagatggagggtggactccttctggatattgtaatcagcaagtgtccggccatcctcgagctgtttgccagcaaagatgagacgctgctggtcgggcgggatgccctccttgtcctggatctttgccttgacattgtcaattgtgtcagaggactcgacctcaagtgtgatggtctttccggtgagagtcttcacaaagatctgcatcttgatggacgttcgcgagagctgagatcgaggcttgtatcgcggaggattttctcgatcggagtggattggggat

SEQ ID NO: 1097 - DNA, 495 bp, Triticum aestivum
  Clone ID: PAT_TA_1097
aggatgattattatgctggcatgtacccttaataaccgaatcaatagaattttacattaattggttgtacagcgcgcggaccgaccaatcatcattcagaaatcaaacgagcaaagacgtacagggacacaacgagaccgatatccgcgcgacgcacgtcgacggttaatttgacagcatagcatgcatgcatgcatggatccttttcgtccgattatcagtggcgcaggttggcgaggaggagcgcgacggccgggcagaggacggcggcgaccatcgacgacgacgacagttcggcggcgccggaggtggcgtggccgccggggcccggcgcggcggccggcgggtcgacggcgtaggcgacccccgcgagcgtggacacggcgacggcggccgcgatgaccgcggagcgcaacatcttggagtccatggaggacgtgtgcttgcttctttgaagtagcgggcacgatgaagaaacagaggtgtgtgtcgtgc

SEQ ID NO: 1098 - DNA, 609 bp, Triticum aestivum
  Clone ID: PAT_TA_1098
accagtggaaaagaaagaagaacattctttgaatagtgcatctccttttttcgattacctcggattttttaacagttcaattaggaaccttaataatgattgaaaaccagtccagcgctcctaataaacccttttttataggtctgatgctcggccgggcctagaactaatcaacgttgggaacaaagccatagtaatctggaccattctctgtcacaatcttatgacgttggaaacaaagccagaaggtacaggaacgacaaatttagttcaaatcaacactacaacctcactacttatcctcgctactcttctctcaaagcattggatccactgctgctgcttaatatccaaggtgtgtgcttccctacttttgctacttgctcagatcagatgaggagcctccttggacttggaggcgggcgcaggcggtggggtggtgcaggccgaggtcggccaaggagctccaagagaagatcccctccgtgtcgtcttccttctcctacgccgccgccgccggcggcgacctgccgagcttcctcgtggcggccatggagagagagtccgcgaggatccaagaggagagatgggatctttcacctcgtgccg

SEQ ID NO: 1099 - DNA, 794 bp, Triticum aestivum
  Clone ID: PAT_TA_1099
gccggccgggtcgtgctctctctcccaacccaaagacggcgaaacccaaccctagctcctagtctcccccatggcctcgcacctcgactttcgctacctcgacgagggcctcggcggcgagcgcggcaagcgcaagcgccgggaggaggaggcagatgccgccgattccatggagctcgacgccgacgcgccccggtcgtccaagctccgtgcagtggcctcccagtctgacccgtccaagccggcggccttcgggtcgcccacctacgacggcgtcatcgccgggcgcgtctcggggcggacatggaaggagccacgcacgcgccgctcctccgcgctgatggtgtcccggaagcccgcccctctggagcagcgcgtgagggacaagtccctgaagaaggcgtatcaggcgcgcgtggcggagctcaaggacgagatccggcagaacaaggtcgccaagcgcaagcagaaggaggagcgggagaagcgcaagaaggagaacgtgctgcgcacgggctcgaagctgcagaaggtcaccaaccccaagacgatccagaagatcgccaagtccaagaaccgaggtcagctcagggtcgtatccgacgacatcttcggcggcaagaagtccgaggccgcccgccgcatgcaggtgcccggcctggagaactgagtcgccgcatatctttgcaatctgtaactccaattttgtagtaatgcttttccattgctgtgagctgtcatggccgatcaaaatcaaacgcttgcagttactttggtatggtatatgaaactat

SEQ ID NO: 1100 - DNA, 946 bp, Triticum aestivum
  Clone ID: PAT_TA_1100
ctcgcgcctccatcgcctcctcctccctcccccccccacccaaagccggcgcaacccaaccctagctcctagccccccccccgaccctcccccatggccctcgcacctcgactttggccacctggaggagggcccctaggtccaagtctccccgatggcctcgcacctcgactttcgctacctcgacgagggcctcggcggcgagcgcggcaagcgcaagcgccgggaggaggaggcagatgccgccgattccatggacctcgacgccgacgcgccccggccgtcgaagctccgcgcagtggcctcccagtccgacccgtccaagccggcggccttcgggtcgcccacctacgaccggcgtcatcgccgggcgcgtctcggggcggacatggaaggagccacgcacgcgccgctcctccgcgctgatggtgtcccggaagcccgtccctctggagcagcgcgcgagggacaagtccctgaagaaggcgtaccaggcgcgcgtggcggagctcaaggacgagatccggcagaacaaggtcgccaagcgcaagcagaaggaggagcgggagaagcgcaagaaggagaacgtgctgcgcacgggctcgaagctgcagaaggtcaccaaccccaagacgatccagaagatcgccaagtccaagaaccgaggtcagctcagggtcgtctccgacgacatcttcggcggcaagaagtccgaggccgcccgccgcatgcaggtgcccggcctggagaactgagtcgcagcttatctttgcaatatgtaacgccaattttgtagtaatgcttttcaattgctgtgagctctgtcatggccgatcaaaaatcaaacgcatactgttactttggtatggtgtatgaaactatgtgctactgtttggttactctgtcagcggatttttaaacaaaaaaaaaaaaaaaaggcccctag

SEQ ID NO: 1101 - DNA, 714 bp, Triticum aestivum
  Clone ID: PAT_TA_1101
ggcaagtttggagctgaaatcagaccatcaatcatctcatatcatactaacatgcttgcataacagatcgggtaaggaaccaaatgctagcacaagtacatacgctcatcacatcacatgcccacttgaatgttccagttcaatcgcataactcgacaacaataggacgataatcgtcatcagcaaagagaaacaaaagggagaaaaagaaacggaaaacctcaatttgtcctagtagtagcaaaaattcggcggcgcgttggccgccaatcgccgaattaatagggtagcagccagcctctccccgcgaatcgcacgaagaagacgactggaaagagtccgcaggggggaattttcagcggtgcgccgtgacgagcgtctcgatgaagcgcagcccgtcgaaccgcggcgcgaacttgtcgtcgccgctggccccgctcgacgccgaggaatcccgctggcggaggaggaactcgtcgcatctgccgacggcggcggcgggcggctccgtcggggcgcagtcgcaggcgaggagctcggcgccggaggccacggcgacggcggccgcggaggcgacggcggctgcgacgccccacatcatcgtcgatccagcagccactttcccctcctcctcctctggctggtagggacggagcgagggggagaggtgtgaaggctgggaattctttgcttgggcagggcaggctggaatat

SEQ ID NO: 1102 - DNA, 920 bp, Triticum aestivum
  Clone ID: PAT_TA_1102
ccgcaccgccccggcgggggggcgggtcttttcaatacgaagcgctctcgcccgtgtccagctcgggcatggcgcgggtcggagcggcaccactgctctcccaacagcaggcgcaggcggtgggcgacggctgctacttctctttcatgtcctcccacttctcccacggggagctcagctccaacccctccagcccggcgtccagcttctccgccgcgctcggcgccacgccgcccgctgcaccggcgatcgccgccgacactgctggggcagtttcacatctccgagctacctcttcgacgagggcgcgttccgccgccccgagtcgcgcgccgtcgcgtccgtgccaggccgttgagcgcggtctgctgccaagttcccggcgtccgcggcggactgcgaggagcgccgacgtcgggggcatggcgcctggcgcggcagccggacggtccgcagtcgcgttccggcactaggtcgcggaacgagatcatcgacgacggcaagaagtgccgcaagtacggcaagaaggccgtcgagaacagccccaacccaaggaagtactaccggtgctcgacggaagggtgcagcgtgaagaagcgggtggagcgggaccgggacgacccggcgtacgtggtgaccacgtacgagggcacgcacagccacgtcagccccagcaccgtctactacgccagccaggacgccgcctccggccgcttcttcgtcgccggcacgcacccgccgccaggctcactcaactgtggccccgagctcgtgcttcgcaaaccccgcatcaatggtgtacgccgctccaagctcgaggacgacaaccggacaggagtttggccaagcacatactaatattcttctgcatgtgctgcccggacggtcgacatcggtcatcccaactggaaaagccggag

SEQ ID NO: 1103 - DNA, 821 bp, Triticum aestivum
  Clone ID: PAT_TA_1103
cggacagaacacatcacagacacacgcgcgtttcgataatcaagcccatcacaatcatcacactaataatactagtactagtaattatgccaattataatcactaggcaagtaggccagatgctgcgagccatgaacaagatagatgctgcgagctggcaaacttaagctaggccagaggtggctcctagcttatcttagcttatttacgctaaaggtgacgaccggcgaggttaggcgcagaggatggcagtgaggctggcgcagaagaaggagaagaaggaggcggcgatggagatatgggtccagacgtcgaggacctgcccgccggcgcttggcccgccggcgacgactgccagcatgtagacgactctgcagagaaggtaggtattggtggcggcgacgatgagcccgctggcgacgatgcaacggcccagaaatgtgagggagccccccgccagggccacgacagccgccgcggcggtcatcgcctgagccactctgaggagcaccagggtgagcgccttcgtgcgcaggcgtagcgcctccgcctccgtggccgcggccgcgtgcccgatctgcgactgggcgtggaactggaagtctcccgggttgctggtggcggcaacgagcccgatcacggccgccaacaagccgaagatgaagcaggccttggccaccatgagcacctgcctcagcgcaggttgatcgccaccagccattgatgcttgtcgctcttcctcttcctctcctcgcgcgggcggtgctttcctgatggagctagctagctatctctcacggtcacccatcctggccgctaaa

SEQ ID NO: 1104 - DNA, 1421 bp, Triticum aestivum
  Clone ID: PAT_TA_1104
agcgaatcccatttccgccggtcctcccttcgccaagccatcggcgactgctgcagcacagcctcctccccctcctcatggccgacccctccttctcctccccccggcggcctccgcaggcgacgccctccccgcgccggcggcttccgacgcgccggaggtgaccctccccgccgccgcccccgacctggacaaggagttcgggttccagcgggcggagctcggtaaggagaagctcgccgggacggtgggcttccacgagcgccacgtgttcctctgctacaagggccctgaggagtggccatcccacgtcgaggcctccgagtccgaccacctcccccgcctcctcgccgccgccatcaaggcccgcaagcccaatctgaagaagagcaccaaactgacgatttgtgaaggagaagacggcactgagtcatctcttggagacgtgttgatctttcctgatatgatccgatacagagggctgacccactttgatgttgacaactttgttgaagaagtactcgtgaaagatactgaatggcttcctggatctcctgaggctatcagaggttcctatgtttttgtctgctgccatggaagcagggataaaaggtgtggtgtttgcggtcctgctttgattacaaggttcaaggaagagattgaagcacaaggtcttgatggtcacgtggctgttagtgcatgctcacatgtgggaggtcataagtatgcaaatgtcatcatattcagtccagatgctaagggagaagtgactggtaattggtatggttatgttgcccctgatgatgtgtgagttactacacaaacaaatggggatcttaggcacgtgacacttgtgtgtgctgggcaagaatcaagcgccaaagaatcccctgaagcaaatggaactgacggggcacctgcaggtggatgctgccagggcaatggaggagcacttagctgctgccaaagtgatctgccagcaggaaaacaggataagagcattccagctgagcagaaccacaagatctccacgacagagagtgacaaagaaaacggtgctgccagcaagaaggggcgcatgaagatttgccggatgcccacctggttcgagacctgggacaagtccgacacctacaccacgcttgctgttgttgcttctgctgcaaccgtgttcgccgccttcaggtgctacaaggccatgaactgaaccctcaaaacaaggccaggttctttgcaccaaggacagtctaccgcagtaaaacaatccgatttgaaaataatatactgcctgtgcatatcaagataatatgcgttaggactttagaaagtacagtagctgatctggagatggcgatgaaaatctgttatgcgtaatgccctcatgtactaaaagtctaaaactcgtaagtttgaagttcccc

SEQ ID NO: 1105 - DNA, 2459 bp, Triticum aestivum
  unsure (1)..(2459): unsure at all n locations
  Clone ID: PAT_TA_1105
cccacgcgtccgcccttcgccaagccgtcggcgactgctgcagcacagcctcctccccctcctcatggccgacccctccccctcctcccccacggcggcctccgccggcgacgccctcctcgcgccggacgcgaccctccccgccgccgccgcccccgacctggacaaggagttcgggttccagcgggcggagctcggtaaggagaagctcgccgggacggtcggcttccacgagcgccacgtgttcctctgctacaagggccctgaggagtggccgtcccacgtcgaggcctccgagtccgaccacctcccccggcacctcgccgccgccatcaaggcccgcaagcccaatctgaagaagagcaccaaactgacaatttgtgaaggaggagatggcactgagtcatctcttggagacgtgttgatctttcctgatatgatccgatacagagagctgatccaccttgatgtcgacaactttgtggaagaagtactcgtgaaagatactgaatggcttcctggatctcctgaggctataaaaggttcctttgtttttgtctgctgccatggaagcagggataaaaggtgtggtgtttgcggtcctgctctgattacaaggttcaaggaagagacgtccgcccacgcgccggccgacccgccttgcgcaagccatcgccgccggccctcgcacagccacgccgccggcgtcagctgcaacccagcctcctccccctccacgtcgccggcctcagcccctccccccccagcgccgccaccaccagtctcgccctcggagcgccggacccgaccctccccccagccggacccggcctgcgcaaggaggccgggtgcccgcgggcggagcgcgctcggcggaaccgcgccggtacaccaggcttccgcgtgcccctgctgctacacccctgtccggcgcctgcgggggcgccatggcacggcgaggccccccagacccaccgcctgccccgctcccccccggacccgccgatcgcaggaaagcgatctgtgtccaacactaatagactgacaagtggaagaccagatgatctgcgttcttgccctcgagaacatgtgttgctctgctactaggagatcgaggagaaaacgctcaatctgcgagaaagcgactccctgtgggaaaacgccctaaaacgcgttaatctttgaagctcccaacccccacatggagcagaccgcccttctggtcttgtgtgttggcgaagaagtaatcgtgtcagctcttggatgggtgttggtctctcctgatatgataaaaggcacctgcctgaaggactaggtctttgtgatcaggggtctgttagtgcatgctcacacgttggaggtcacaagtatgcaggaaatgtcatcatattcagtccagatgccaagggagaagtgactggtcattggtatggttatgttgctcctgatgatgtgcctgtgttactgcgtcaacatatcggacaaggagagattgtgggccatctatggaggggccagttgggcttgtctgaagagcagcagaagaaagctctggagcttaggcacgcgacgaatggcctgaccgaggaagaatcaagcgccaaagaatcccctgaagcaaatgggaccaacggtgctgcttgcaaccctgcacctgcaggtggatgctgccagggcaatggaggagggttaacctgctgccaaaatgatctgccagaagcaaaacaggataagagcattccagctgagcagaaccacaagagctctacgacagagtgtgacaaagaaaacgttgctgccaccaagaaggggcgcatgaagatttgccgggcatccacctggttcgagacctgggacaggtccgacacctacaccactcttgctgttgttgcttctgctgcaaccgtgttcgccgcgttcaggtgctacaaggccatgaactgaaccctgggaagcaatcctcacaacaacgccaggttctgtgcaccaaggacagtctacccaagtaaaacaatctgatttgagaataatatactgcttgtgcatatcaagacaatatgcgttagggctttagtaggtttcagctgatccggagatggcgatgaaaatctgttatgcgtaatgtcctcatgtaccacgttttgtgcaccaaggtgagtcttacctcaagtaatatactacttgtccatagtggggaatgctagaacttaaaaagtaactgatctggagatggcgacgaaaatctgttatgcgtaatgtcctcatgcgaaactcctaggttttgaagtttttgacgccttggctatatgtgttgtagcaaggctatggccctggtgttctacatgacgatgttatgctcggttggttggaatttgggatgttctggagcatgtgggttttaaagatgtgcatttgaaaattaaaaaacttcaggttttaaaaaaccctgncattcntgg

SEQ ID NO: 1106 - DNA, 787 bp, Triticum aestivum
  Clone ID: PAT_TA_1106
tttttttaatataattgcaattctttccctaaaaaaatgctgggtgatgaactcaccactcacaggatccgaaccgagtgtttagtacatccatgaacatcccccttattctaagtatagtcaacagttgcacattttgtactatcctggcagcagcctcctatttacagataggattctcacacaatagccaatcccatcgtaaaatagaatcgcgtattagtacaacctcaatctctcaatataccaaggagggtgggtctatcatcactacaccaagcctcgtgagtatagcagtgtcatgcacaaaacttaaccacgacaagccaacaccaatactcatgcttgcatcgctggcgtttccggatgaaacgggcggtaaagacggaaatcttccatgtttcggggtactgccatcaggtgttgtcgggctgacctgttccatttccgagatgaagtagctctcctttctcttaggcttcttgccaggttcttcgtccgtcggttagtttccacgccacccttcattcgtcgcagaacgccacgccccgacctcctcccccagcacccaatggccggctctcaagcgcatacctacctcgcccgtggtggcacgcacagcgacagtgaagcgagctcgctcaactcctccatcgatcccagggacagggtaccatcccccgccccatttctcctaccctcttcccaaccgtggacgcacgacaaacccatcctatggtggtgtgcattattggtgacaacaaccatcttatgatgtctgatcgag

SEQ ID NO: 1107 - DNA, 937 bp, Triticum aestivum
  Clone ID: PAT_TA_1107
ggggcgctccgaaatctcctccttcccctgctacagttgagagtctctcgagacagttccttcccggcccgatcccggatcctctccgccggcaacgctcgtcgaagaagtgatgggggaggtgctcggcgtgttcttgtacatagtagatgtaggttcagtttccgttctggtgtgttgggcgtgatgcctaggactggcgatatgccgatgaggagcgcgccgcctgcgcgtacgagcagcgcatggtggctagcggcgatgctttggttggtggcggtggcgtggtgctactcgctgctgcgtgattcatcgtcggcgcatcctccaataagctcggttgctgccatgatttggagaaggattcgtccccttcctctgttgcttcaagctgccatggaggtggatggagcgatggtgatgctagaggatctggtttttgcaggtgggttcggagcatatcagcagcggcagatcaggtggagctacagcgcccgctggcagccggtcttccacaccatggcgttgccccttctggccgaatggcggccgtgtatttcctcccagcctaagagcgataggggaggcagatgcatcttctatctggagttcgaagcggttccaagctgctgcgatggtctcgtcgccccaagtggtgcgtccccggcgacggcgagtctacatccaggaagaagatgttctggacccgattgcaattttcagatccagtttagggtccttcttgtcaaaatcaagggcttaggtgttattttccttttatgtgagtccttgtgtgggctttgtgttgtaaccgctgaagttttaatgaagatctaggcccttcatggcctttcctgttcaaaaaaaaagagagagagctggactcacagctggaaaggtttcatacgagaattgtttggaaacaaaaaggaccgag

SEQ ID NO: 1108 - DNA, 549 bp, Triticum aestivum
  Clone ID: PAT_TA_1108
ttttttttttataaaaacccataacgcagagtattaattatcattagaactgaattacaattccatgggaacacgatcgtacatacataggagatagctgggcttcaacacatacagttttaatcactgaacttaggtagacggccaggggcaggtagagcttcgcttggccggggaattgaccacaaacggcgggtagtgcgttgctacatactgtacacctcgaccgctagtttccagggaagaccttgcgagacgcggcaccggcggcggccggccctgctacgtttgcggcggccggtatgatgggcgccatggcggcgacgaggccaggggagcagcacccgggcctaccatcacagcagttgaggcggcagcaggggaccggcatcacctggccgtcgctcggggccagcgccaggagcaccagcaagatggtcacgccgatcatcttgggagccatcgccgtggtcgtggaactggtagcccttttggctctctgtggtctcgtgtgtcggtgtgtggtagtagtatggctgtgtgagatgt

SEQ ID NO: 1109 - DNA, 613 bp, Triticum aestivum
  Clone ID: PAT_TA_1109
tgcggccgctcgttgtttttttttttaagctttttttttgtggtgaaataactaagtggtgaacttcactcaaacaggtcatgaggagtacagatcaaaatgatgactttataagctcgcacacaagaaggggtaaatcctctgaaaagtttcaagtacagaagctaactggagcagcatccgagtgctggcacaagccatacaaggtgggtttcagggcatctgcccgccgccggcgccctgctcgtcgccgccccctggccctgtggcctccctgagctccagtatctcgacgcgccggttggtccgcttcctgatcttgatggccacgtcctgcgggctgaaggcgccccagacgctcacccggccgtgcttccggtcaatcaggtggctctccagctcttgcatctggagcagcgccctcctgatcttctggtagcacccgttgcagtctatgctcatcctcagggtcatgcagtagaacctgtagtccatgaagacgacgaggctgctcttcctcggcggcggtggcggcgactgaccggagaaagcttcgggttccggggaaccaaagttgcgaggaaagcaaggaaccttaggtgcagaaaggagg

SEQ ID NO: 1110 - DNA, 390 bp, Triticum aestivum
  unsure (1)..(390): unsure at all n locations
  Clone ID: PAT_TA_1110
accccccccccatccccaccccccaccccaggtacccggccgatcaactactaccgtgcagatggccagaacacgggcaacttccttacggaccgtccttcaaccaaggttcatgctgctcctggcggtggctcctccctgggctacttgtttggcggaaagtgatgttaatgatgctgcttaatgaacgaacgatgaattggcctgtatctctgttatccatgtggtgaaaactggaagtgtttggtttcagcagtttaccacctgcgtcgatgtactctgtctgtatggttcattgtgtccaggctgacctcctgcttggaagccagcttgcctaaaacctgtcgctttcaaactaatcttgttcatctcaaaacttggtgtgcctna

SEQ ID NO: 1111 - DNA, 479 bp, Triticum aestivum
  Clone ID: PAT_TA_1111
cccacgcgtccgcggacgcgtgggcggactcgtgggcggacgcgtggggttgaccggcctagtttctcctcctgtctcgtcctcgccccccgtcccctggttggtgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcaccggcagctgccgatgtaaccaagcagattccagctggcattccaggtagccgggcgaacaactactaccgtgcagatggccagaacacgggcaacttcctttacggaccgtccttcaaccaaggttcatgctgctcccggcggtggctcgtccctgggctacttgtttggcgggaagtgatctctgttaatgatgctgacgatgaattggcctgtatctctgttatccatgtg

SEQ ID NO: 1112 - DNA, 979 bp, Triticum aestivum
  unsure (1)..(979): unsure at all n locations
  Clone ID: PAT_TA_1112
cnnnnnnnnnnnnnnnnaaaaaaaaaaaaaaaaaaaaaaaaaaaaaaaaaaaaaaaaaaaaaaaaaaaaaaaaaaaaaaaaaaaaaagcggcgctccggccccccgccgaccgctcccaccacttcgagcgcctcctccgagcgcctcctcctgtctcgtcctcgtcccccgtccccgcgcgcctcctcctgtctcgtcctcgtccgccgtcccccgtcccctcgtcggcgcccgatctaagtcaaggcatgagtcgtggcgggaagtgctggaggtggtcaaagttctctgggttacctgtttggagatggtgagcctgcaaagcctgctgcagcaccagctgcgaagccagcacctgctgagaaaccagcaactggcagctgccgatgtaaccaagcagattccagctggcattccaggtagccgggcgaacaactactaccgtgcagatggccagaacacgggccaacttccgttacggaccgtccttcaaccaaggttcatgctgctcccggcggtggctcgtcccttgggctacttgtttggcgcggaaggtgatctctgttaatgatgctgctgatgaattggcctgtatctctgttatcccatgtggttgaaaactggaagtgtttggtttcagcagtttaccacctgcgtcgatgtactactgttctgtatggtttcattgttctccagttctgacctcctgcttggaaaccagcttgcctaaaacctgtcgctttcaaactaatcggcttcatctgattgaagccaccttgcctaaaacctgtcgctttcaaactaatcttgttcatctcaaaacttggtgtgcctaattcattgtttgcgtgcaccctagctgtgtcaaacctgttttttatgtttttagcatacccaactctatgtttcgctgaactcattgataacatttgaagctgtgacttgtgagttgtgactcatgcatcatgcattggcttt

SEQ ID NO: 1113 - DNA, 834 bp, Triticum aestivum
  Clone ID: PAT_TA_1113
tgttttttttttttttttttttttttttgctcaaactttctgcttgccacttttcacctctggttgtttacttgtttcgattgttctatgcacaaacaacttgctactattctcctcaggttgtttacatgttgcaattttgactaggcagcagaaaccatcaagtttcatgcttaaggatggatacataatcatgtttgggcatgaaattgaccatatatatgtaagaacagataggaatcacattcttcacaatttgtcctccccaaccacacacacacacacatagagaacggtaaacaggcgcaacacgtatcataggtgcgaatatagtataagagtactccacaattccatataattatgcaacccgaatcctctgcctgccgacgacgattgcaaagcccgatcctagttagttcttaccggcgacgacgtcctcggcgccgtggatgatgacgtagccggccttcttggggctctcggcgccgtcgtcgtcctcgtcgtcgctgtagagctcctcgtaggggctggcggcgccggtggaggcgacgagggaccagacgaggtacatggaggcggcggtgagggcgccgcagccgaagccgaagagcaggcccgagacgacgacgaggatgtccttggcgcgctcctggaaggaggaggcggcgtcggcgtcggtctcgggggtgccgacggcggggagggactcggcggggcggcggatctggaggtggttctggtcgtgggcgtggaagcggtgcgggccgaggcggcggacgcggaggacggtgacgacggtggtggtgagcggcgaggggtcggccgggtccg

SEQ ID NO: 1114 - DNA, 499 bp, Triticum aestivum
  Clone ID: PAT_TA_1114
ggatataatactgcacttgtttataaaattcgcatcatcataacatcatcgaacaatgaggttgacaacgagaataaattattcatcccctttatatgctaaaccaagaaatcacgaactattgtctctgttttctttgaccatttgtaataatgaggcactcttcagctccgcgctaacaaactatttgtcgcagaaatagcagtagcattcgctgctccatgctggccctatacacttgtgctcctttacgtcggcgttaaacattttgcctccaatcaagcatgttgccttgcacaggaagcctacacagagtggactcccagaggtatttccccaacactttttttctgcagaaccatgattcgcgaataacacaaggatcagcacaaagcagatggtagcatttctcgcacccataatcgatggtgttgggcgaagtatcaagtatactctctcttttctgtctttctctagttagttttgatatggagcaagt

SEQ ID NO: 1115 - DNA, 670 bp, Triticum aestivum
  Clone ID: PAT_TA_1115
gccggccggtctcggaactatcaacacccgaccgcaattttgaattgtccaccgaaactacatcataagcttagaactacttctgttcatctatcaccatgtgtaaacacattctcaatgcccaagttgctgttcggtcgccatgttgcagaaaatggtttgactgcgtcgagtgccatggtgaacaggaggaccaccctttaaaagaaaactacgaaatgatctttgcctgcaagaagtgcagaaaatgctttcgaaaggatgttaccgagttcgaggaggctgatgagttctgcccccactgcgacaaccactttgttatcgatgcgaagacgcctcaggcggccctgtcagtcgagagcgaagacgtgcgaatggacaacaagatgctcagggacgacagacaaaagaccaagaccaagggcatcaggtccatctttgacccgtcagacgatgccgacaagctaggataatggaagaaaccagacagtagaggaaagatcacggcgttcagggtacaatggtacacagcgagttgtcacttacgtggggaataaatctaatagcgtgcatcccgtcattacttgtgttgttaatacaatggcactgggctctgattctagaggctcaacgcgcttgtctatggaaaaaaaaaaaaaaaaggccccta

SEQ ID NO: 1116 - DNA, 898 bp, Triticum aestivum
  Clone ID: PAT_TA_1116
ctgtgcggcgctcgaggcggccgggtcgaatctcctccgatcccccaaacaaactcccaaccaatggcggccacggcaatggagcacgacggcggcgccgaggtggtggtcaccccgggggagctcctcgggccctcctcgtccctcgaggccgggcgcggcgcctacgccgacggccgctccgtgcgcgcgtcggtcaccggccgccgccgcttcgtggcccccgcccccggctcctccgaccagaggtccacggtggaggtggtcgggcacaaggcgcacggagccgtgccgcagccggggagcgtcgtcattgcccgtgtgacgaaggttatggctaggatggcttctgcagatataatgtgtgtcgactcaaaggctgtcaaggagaagttcactggcatgataaggcaacaagatgttcgtgcaactgagattgacaaggtggatatgtaccagtcatatcgacctggcgacattgttagagctctggttctctctcttggggatgcaagggcatactacctttcgactgccaagaatgaacttggagttgtttctgcccaaagtatagccggtggtacgctggtcccaaccagttggactgagatgcaatgtgaattgactggccaaatcgagcaaagaaaagttgcaaaggtggaatagatcttgtttactttgccagatcggaaggttttggtggtgtacgatacgtttgatcaacgacgctgggtcctccagacatgatcattgccactagattaagcacattaacttcacccatgtggcattactttgagtaggctataatacaattatgcttgttgaaagaatgttatttaggcctttatggagccttcgatgttccggtgtgccctgtcgtgccagcagttgaagt

SEQ ID NO: 1117 - DNA, 577 bp, Triticum aestivum
  unsure (1)..(577): unsure at all n locations
  Clone ID: PAT_TA_1117
gtttcctcttttcttcctacaggatacatcctcaacaacaaaacaactacttctttcttcaccaaaagaacctacttagatcaaaatggctcccatcaaggtcggcatcaacggtttcggtcgtatcggccgtatcgtcttccgcaacgccgtcgagcaccccgacatcgaggttgttgctgtcaacgaccctttcattgagcctcactacgccgtctacatgctcaagtacgactcttcccacggtatcttcaagggtgaggtcggcaaccagggcaacgacctcgtcgtcaacggcaagaccatcaagttctactctgagcgtgaccccgccaacatcaagtggtccgagaccggcgccgactacgtcgttgagtccaccggtgtcttcaccaccattgacaaggccaaggcccatctccagggcggtgccaagaaggtcatcatctctgccccctccgccgacgctcccatgtacgtcgtcggtgtcaacgagaacaagtacgacggctctgccgacatcatctccaacgcttcttgcacaacaactgcctggctccctcgcaaagncataaan

SEQ ID NO: 1118 - DNA, 908 bp, Triticum aestivum
  Clone ID: PAT_TA_1118
ggcatctccgtcgccgtcgccgccgcgtcgccgccgcctccaccgtcctcgcctgcacgcctctcctcgagatccgcctccgcctgtccccgtgcgcggacacgatctcacgaccccgagccctaccctgcgcctcccgcctccggtctccgatcctcctcctagctccagaatgggtctcctcagcatcatcagaaaaatcaagcgcaaggaaaaggagatgcgtattctcatggtcggcctcgacaactcgggtaagacgacaatagtgctcaagataaatggtgaggacaccagtgtcattagccctactcttggctttaatatcaagaccatccagtaccaaaagtactcgctgaacatatgggatgttggggggcagaagaccatccgttcgtattggaggaactacttcgagcagactgacggtctagtttgggtggttgacagttccgatgtccgaaggctcgatgattgccgtgctgagctccacaatcttttgaaagaagagagactggctggatcatcgctgttagttttcgcgaataagcaggacattcagggcgctttgaagcccgacgaaatcgccaaggttctgaaccttgaagcgatgaacaaggaccggcactggaagatcgtcggctgcagcgcctacaccggcgacggcctgctccagggcttcgactggctggtccaggacatcgcctcccgcatctatgtcctcgactgaaacaacaaccaaactctggacatttagccatctgcactactgttattggttacaccggctacctcatgtaatccgatcaagtttgaaccaaaccatagatgatgaaacttttgttatgcactctcattgagctctgcgtactgcaatcgtcagttggtgcgatctgtgacttaaacag

SEQ ID NO: 1119 - DNA, 1033 bp, Triticum aestivum
  Clone ID: PAT_TA_1119
gtgcggcgctcgaggcggccggttgggctccacgctccgatggcgatctcccacctcacccgccgcctcctgagcccctcgacggccaaggccgccgccaccgccaagctctttcccggcacgagcttctcgaatccccatgcctatgcgcgaaaccccctcctcctactcgacccccaccgccgcttctccacgagcccaaacaccacccctaaccccgccgccgccgccgcccccgctccagaagccactcccctggagtcgatgaagcaccaggagatcgagggccccacggtggagcgcgacctgtcgccgctcgccgacgaggcgcgggcggagctcgacgccctccgccgcgccgcgcagcgcctcagcgcctccctcgcgatcctcggcgggacgcacctcgccgcaggagcgtggatcgcctccggggccgcgcccgtcggggtcgagtcggccgcgttggtgcagggcgtggcggcgttcgcgttccccttcacggccgccctggtgcttcgccgtgtcatcaagcccgtcgccttcttccagaagatggaggccaacgggaggctgcaggtgctcacgctttgccttcaggcctcgaagaacgttaacctcatgatgctccggacgcgggtgctcgccatctcttgcgccctcggagtgtcggtcggatcggtagctacgatcttgatgcggtaagcttgtgctaggctctgctcaggaaggatgattagtgtcagtattcgaggaataagactaaaacgagatatgagattagaccttggaactctgaaaacttggggcttttgggatgttgaagtgtgcttagttttggtatctgtatggtattacacggggtaccaaaggaatctttatagtggccgttcaaactgttgctattacagtggatgttcctcctccgttagatggatcaaccagttgctgaatcttattatcttgtatgctgaacagctccattctcaatttgataacttgtttaagaacaagtgattatacctgcattttt

SEQ ID NO: 1120 - DNA, 994 bp, Triticum aestivum
  Clone ID: PAT_TA_1120
gccggtcctcgtccgccgcctccttcttcacctcctcctctccccacccaacaacagcagaccgctaggcagcacagcagcacagtccctcaactgccgatggcgaaatgcagcaagatccgcaacatcgtctggctcaggcagacgcttcggcggtggcggtcccgcgccgcggcgcgcacggcggctggcggaggcgccggcgccgtgtcggtgccggcggggcacgtggcggtgtgcgtgggcggctcgtcccggcggttcgtggtgcgcgcggcgcacctgaaccaccccgtcttccgggagctgctccggcagggaggcggcgaagtgagatggctgaggaacctccgggcctcgtgcggccccatcgcgctcagccatccattcactcccttcgagcacgccctccgggaaatctcctcctccttgccgggcgcgcattctttcaccctcgatgacatcaagagcggcgcctactcgtgctgctgcgcggccgccggcgacgcgctcccgctcctccgcggcatctcgtccgacaagttcgtctggtgactccaatccgagctaggccagccggctagccgcgcgcgctccacgtcattgtgctggtggtggccgtcgtgttttttgtttctttttcgttttcctctccctccctccattgtcgccgggcggagcagagccgccgggacggagcgagaggtcgtgagcggccggcaggaggcggcgaagtgagatggctgagaaacctccgggtcttgagacgcccggggtctagccatccattcactcccttgtcaaatcccgggcaaggaaaattacttagtagtgccgggatttatcctttctcctcctccttctccttgattatttccttcacttactgaataattcaccctgtaaatagctagcccgtgctcccgcgattcggccgacattgcaagtgaattgaagtggaacatttctactactaaaaaaaaaaaaaaaaaaa

SEQ ID NO: 1121 - DNA, 781 bp, Triticum aestivum
  Clone ID: PAT_TA_1121
tccgccccactctttcctgacctcgtcgaacttgtcgttgaagttagccttgatagcctccaagatcttgctgaactcaagcttgtcctcgttcttcacagtggtgaggcacagaactgagccagtcttcttgtggacgatcgatccaaggcgtgattttcccttaacaatgcagtatggaacctccatcttcctgcacagggctgggagccacacaaccagctcaattgggtcaacatcatgagcgatgacgaccagctgagccttgctctgctcgatgaggtaagtgacatggttaagaccatacttgacaacaattggcttcttggcctcaacggttttcccctcagcctcagcctgggccctcttcagaagcctctccttcttagccaccttgtcctcggggcggtacttgagaagcatcttaaacaggttggtggcgaggttcttgtcgagggtgcgggtgaactggtggagcgccgggggaaccttgaggcgctgcttgaggatgcggcgctggcgctggatgcgcacgaccttgggccacttgacgaaccggtggaggtccttcttgggcggcagcgccccgccgatgccgaactgcttcggcctcttctcgaacagcgggttcaccaccttgtccgccgccttcttcttcgccggcaccggggccttgccgcctcgcttcggggccatttcgccggcggcgggggagcttggggttccgaacgggaggcgacgctggggaggaggtggaggggggcggacgcgtgggcggacg

SEQ ID NO: 1122 - DNA, 1512 bp, Triticum aestivum
  Clone ID: PAT_TA_1122
tttgtcgcctcccgttcggaaccccaagcttcccccgccgtcggcgaaatggccccgaagcgaggcggcaaggcgcccgtccgggcgaagaagaaggcggcggacaaggtggtgaacccgctgttcgagaagaggccgaagcagttcggcatcggcggggcgctgccgcccaagaaggacctccaccggttcgtcaagtggcccaaggtcgtgcggatccagcgccagcgccgcatcctccagcgcctcaagtcaaccgtccccccgacgctccaccagttcacccgcaccctcgacaagaacctcgcccaccaacctgtttaagcatgcttctccaagtaccgccccggaggacaaggtggctaagaaggagaggcttctgaagagggcccaggctgaggctgaggggaaaaccgttgaggccaagaagccaacttgttgtcaagtatggtcttaaccatgtcacttacctcatcgagcagagcaaggctcagctggtcgtcatcgctcatgatgttgacccaattgacgctggttgtgtggctcccagccctgtgcaggaagatggaggttccatactgcattgttaagggaaaatcacgccttggatcgatcgttcacaagaaggactggctgagttatgtgcgtcaccactgtgaagagcgaggaaaggcgtgacttcggcaagatccttggaggccaacaaggctaacgtcaacgacgcatttgcttaggcatgtaaggtctgggcctcgggccgtgcctgatccagggtggcagtgctcaccccgtgccctttgacccactcggggtgacgggagtggcgcggaggcgtggctacgggtacgcttgaaggccgatgcaggtcccttagtggattgtcacgccagagttcggccgtggatcgatcgagaacatcaagtcctgttcagtacccttcttgaccaccgaggaagagcgtggtctagcctgagttcttgcaggctcttgagaggactatcaaggataagcttgaacgactcagttagacgaggtcaggaaggatgttggggcggtggtcgtcatgggctccaagtcgcaggccaagaccaatggccagggaaaggctcatcgccaaggaggctgcgctagacggatgaactaagcctagccctataagtattgtcagagcatatgccatgtagtttccctttcagtgtgtcctgattttgacgaggaactcgaacccttttagcagcactgtggaatcgtattgtggttttctgattcgctgttacctgttctccagacttctgcaaagatcagatgaggtttacccatgtttggattctatatcgttttacggcgtgagcttggggttccgaacgggaggcgacgctgggggaggaggtggaggggggtttggttaacatgcaatgacgaccagctcataaaaaaagacaagggctaccgttcatggctaaaaaggagaggcttctgaagagggcccaagctgaggctgaggggaaaacc

SEQ ID NO: 1123 - DNA, 699 bp, Triticum aestivum
  unsure (1)..(699): unsure at all n locations
  Clone ID: PAT_TA_1123
ctcggctccccggcttgcaagctcagcgagtagccgtcttcataaatcggcgagctcccggccgtcgggcgacatggcgaggctcctcctcttcgctgctgaccacaccgccggagcgcccggggcggcgagtctcgccctcgttgtcctcgtcgtgctggtggtcgcggcggtcgtggtgtctctgtgcaccagcagcacgcacgagaagctgtgggggcagcagcgcgggtcctcctcgtccgcgccgctggacaaggcggacagcagcgtcaggcgcgacgcaaccggaagcgcctgctgtcggccacgctcagcgggatcggcggcaaggcggccaggatggtgtcgtcggaacaggcggtctccgtccggcagcagcgacgacgacaaggaggcgggggccgctctggggccggaggacgacgaggccgtgtggaggaaggccatcatcatgggggacaagtgccggccgctccagttctccggacacatcccctgccactccgacgccaccctcccgcccacgccgcccccgacaaccaaccccgctccccccgacgtcccagccacgtacgctgcatcgtccccctcaccgctggatccatgctcgcccgcggcgcctaatccccccgaggcgcccccgtttccgctcgatcttggtgcgcctgttcgcacgaanacagcgtatttaactat

SEQ ID NO: 1124 - DNA, 701 bp, Triticum aestivum
  unsure (1)..(701): unsure at all n locations
  Clone ID: PAT_TA_1124
ccactccaaggcccaagacaaacaccttctccggtctccacgtacggccatggacgccgacgccgacacggtggtgttcgaggcaccggcgcacttccgcttctacaagagcggcaggatagagcgccttcaccggccacccatcctgcctgccggcgacgacgaggccaccggcgtcacctccaaggacgtcgtcctcgacgcggacactggcctctccgtgcgcctctaccttcccaagctccaggaaccctccacgaagctcctggtcctcgtctacttccacggccgggctccttcctcatcgacgtcggccgactcctccacgtaccacaactaacgtgaacgccctcgccgcggcggccggcgtcctcgcggtgtccgtcgactaccgcctggccccggagcaccccgctcccccgcgggctacgacgactccctgggcggagctccagtcggcggcgttggcgcaaggacgcgtggatccgcgagcacggcgacaccggcccgcctggtcctcgccggcgacagcgccgggggccaacatcgtccacgacatgctcatgctaggtcagggccacatctgaccgtgctcggcggagcagccgtgtggggagcccggcgcacatccctcggggcgtgaccgcgcccgccgtcggggcggtcaacttccggccgtgggggngaaaccaggnaacctt

SEQ ID NO: 1125 - DNA, 741 bp, Triticum aestivum
  Clone ID: PAT_TA_1125
ctcctccctcgctctccagcaaccttcttccttcttggttgattgatccatcagcccccggtcagagctcgatcgccggccggccagagcaggcgcagcaatggggttcacggcgcgacccgcggtgtgcatcgtcggcgtcctcctcgccgccgccctcttcctggcggcgccggcggcggcggagggcgagtgggacgcgccggagtcgtgcgcgaccccggtgagcgtggaggcggcgtgccggggggcctccgacacgcaccacggcgtggactacgaccactgcgtgcgctccctgaacgcggacgcgcgcagcgccgacgcctccgcgtccgccgggatccacggcctggcggtgctggccacgaggatcgccgtcgaccacgccgccagcacggaggccaagatcgaggacctggcggagctcgaggccgaggccggcgccgaccgcgcccggttcgaccactgcctggagcagtacggcggcgccgccgacctgctccgcgacgcgctggacaacctgcaggccaacgtgtacggcctggccatgcagcagctgatggcggcgctgggcgcgtcccggagctgcgaggacgcctggaggggcgccccggcgcgcgcctgtcccgtcgccgcccacgaccgcgagtaccagcgcctcgcccacatagtcatcggctttacccacgccgccgtcaaatgattatgcattgtcgccgccatggaccggatcgtcgt

SEQ ID NO: 1126 - DNA, 707 bp, Triticum aestivum
  Clone ID: PAT_TA_1126
atgtcaatgttcctgaggatgaagaagagttcctatcagtatatgtcggtaatctttctccagctacttcagtcttcgatcttgagaaggtctttcaggcttttggaagaattaaacctgatggagttgctatacgtagtcgcaaggaggctggagttttctttggatttattgagtatgaaaacatgagtggcatccagaatgcgttggatgcatctccaatagagttgaatgggcgtctagtacatgttgaggagaggaggcctggcagtggagtctttcgcggcggcggaaggcgagggcggggaaggggtcaatatggtgggcgctacgacggggattacgctgcacggtcaaagggaaatggttaccaaaggaggggcgggcaccaatacgacggctacgactagtctcacatttgctctgctggcgaatggtcgcatcccatttggtgctcttgatctggtgcggcctggccatatttttgtcacaacaaagcgcgattacctggagaacttgcgttttgcttagctgctattgagcatgactcgtttctgatgggactctttttagtgtttttgctacatgatcgtgtcgcctatctggtactatgaactaaacatgggaaaagaatggatcagtgttagttgatccttggtcatttgagaacactgtcaaaagtattccgattgtcggaaggaggagag

SEQ ID NO: 1127 - DNA, 964 bp, Triticum aestivum
  Clone ID: PAT_TA_1127
ggggggtgggggcataaaaaaagctgaaatagttttacttggctgcaaattaaaccggcaaagtgctgggagcgataacgagcacacctgtgctccaacacataatagagggcatataacatggctttctcacgactttatgccactaataaaaagtccttttaatttaaatcatgagttgacgaaattcattccctcgcctgactccttgcgctccccaggcaagggtccgccccccgtcttccttcggcgtcgcctcgcctcgcggcgagcccccggcccgaaggacttgaaacactctggttgatacgaggtagatgattagggtgttataattttcacagcactccgactataattggaaggaattgaacatgaactttgagaagatgggatgatacttcgatgaaatcaacaacacactgcctctagacttattgaaataatgtcacaatgggtaaggaggatttcagacagcactcaggttgaaaatcgaggcaaaacttgacaagatgaaagaaggaagaattcggtcagcactccggttgaacatggaaggaatagaacatgaacttgagaagatgggatgatacttgatgaaatcaacaacatactgcctccggaactattgaaagaatggcacaatgggtaagaaagatttcagacagctctccagttgaggaaggagggaaaacttgataaaattagagaactcgaatgaaaacacgacacttcggttaaatggataagcacggaaagaccatgatctttgacaaacgagatgatgggttggaaagagcaacatcacaatgactctggaacgaagggaaacaagatcttgagagagcacggatacaacaaatgctagaatggagttgttgaaaaccaacaacgaaaagaataatcttgatatggtcttatgaaatacatcttaaattatgagatgacaacctgccactcacgg

SEQ ID NO: 1128 - DNA, 532 bp, Triticum aestivum
  unsure (1)..(532): unsure at all n locations
  Clone ID: PAT_TA_1128
aagtccggcgaggaccatgcgcagcactccccctctcaacggccgccactataggagtactaaagaaaatataccctcctctcgccctcgtttgcatctactactccaagaacacactaaatcaaggggagcgcgcagagaagccatggtgcatccggtggcgggaggccgacgagcggagccccttcggccggctcaccacgggaggcgtactgcgcgcgccacggcgtcatgcatcctcctccaccttggtcaacccgcgggggtccgcatcttcacgcaacgctgggcgcccccgtcctcnggngccatcgccgttctcnaaggttcaccggcnatccaactggtggcctgtnacgcntcaattngccaagcaggttcntcttcccgccgtnnacaacaagggaaggtttccccnagggtttcaaggccaaatccggantnggccctnttcaaaaatggaaggcggtttnccctttcgngctgantactccccggtggtctgntctctacgggatcctccggggggcat

SEQ ID NO: 1129 - DNA, 815 bp, Triticum aestivum
  Clone ID: PAT_TA_1129
gtcgccgcctactcccgggccagcatgggcggctacatatcttcgcaactgtgaggaaaatcatcgagaataatccctacatgctgggaaccatggctggaggtgctgctgattgccagttttggcatagaaacttgggggtaaagtgccggctccatgagcttgccaacaagcgaaggatctctattgctggttcttcaaagacgttagctaatatcctttactcgtaccgcgggatgggactttcaatcggtacaatgattgctggatttgatgaaactggtccgggcttgtactatgttgatagcgagggtgcaaggctcaagggaagccgattctctgttggttctggctctctatatgcttacggtatcttggatgagggttacaaattcaacatgtcagttgaggaagctgctgagttagctcggcgggctatttaccatgcaacattccgtgacggagctagtggtggctgtgttagtgtctactacgttggccctgacggctggaagaagctgtccggagatgatgttggagagctgcactaccactactacccagtccaggcggctcccgtcgagcaagagatggccgaggccccctctgcgtcaacctgattgatgtcgtacgaaattccgtgaactgtgctgaagcaccttgttttatggactgggggcttgtttgtctcctcctcgacattagagtgttctcttctgagacctgctgatgttcgacttacacatctgttatggaagtgtggttgtagactgatgaatgttatagatgtttccattgaagtttcatttgaattc

SEQ ID NO: 1130 - DNA, 1295 bp, Triticum aestivum
  Clone ID: PAT_TA_1130
ggaaaagtccgtgggtcgaaagagaggagacgcccactcgaaaaccgccgcctccgcctcgccgcacccccacacccgccgacgacgccatgattcccaacctctccgccctcgagaaccacttcggcgccgccgccgccggcagcgacgacttcgccggcctcttctccgccgacgccgccgccccgctcgccctcgagctccccacctgcaccgacttgacgctgggttccacgaaggcgacgagggcgatggtaaacaacaagcaggggaccaccacgctctccttcatcttcgacaagggcgtccatcgtcgccgccgacccgccgggccagcatgggcgcctacatatcctcgcaaactgtgaggcaaaatcatcgaaagtaaatccctacaatgctgggaaccatggctgcaggtgctgctgattgccacatggtttggcatagaaacctcgagggtcaagtgacggcgcgatgagctcgcgatccagcgaaggatatgaattgctgtttcttctaagacgttacctaatatcctttactcatatcgcgggatgggactttcattccgaaccatgattgctggatttgatgagactggtccgggcggtgctacgaatttttgaataggcgaggggtgcaagttgttggtgggtaagccacttttctgtttgttctggcttctctatacgctatgtggctttcttgggacaaagtgatacatatacatgatgaaacttttacggaagctgattatgttagctcggcgggctatttaccaacgcaacattccgtgacggagctagtggtggcttgttgttagtgtctactattgttggtccctgacggctggtcaagaaggttgtctggaagatgatgttggcagagctgcactaccacttactacccagtccacggcggctcctgtctagcaagagatggcctgaggccccttctgcgtcaacctgattgatgtcataggaaattcctgtgaactgtgttgaagcaccttgttttatggactggcgggcttgtttgtctcctcctcagacattagagggttctcctcctgagacctgctgatgtttgccttacgcatctgttatggacaatgggggttgtagactgatgaatgttatagatggtttccttgaagtttcatttgaacattagagtgttctcttcttgagacctgctgatgttcgacttacgcatctggtatggcagtgtggttgtagactgatgaatgttatagatgtttccattaagtttcattgaaaaaaaaaaaaaaa

SEQ ID NO: 1131 - DNA, 666 bp, Triticum aestivum
  Clone ID: PAT_TA_1131
gcacgaggcactggcacacatcccacagccaccaggtgccggccgccgccatggaaaaaaccagcagctcctccatggcctccccagtccgctcaccgccaccggagccggccgcggaggcacaaccacctcctccttcttcgcccccatcacagcttccggctaccgacccctttcgcctctcgccggataacccaaccccagctcatccccttcctgctgcacctacaactactgctccggcgccatctaccggcccctttcgcctctcgccggataacccaaccccagctcctccccttcctgctgcacctacaactactgctccggcgccatctaccgtcccctttcgcctctcgccggataatccaaccccagctcctccccttcctgctgcaccaacagttactgctccgccgccggatggcgccgacgattcctcttcaccgtcgcctccctcgcctccaaaggctccaacgcatccacctctttccaccaccgatccttctcctcccctccctcgtgggaaccaaacatccgcgccgcggcggacacccccttctcctcccgctcgcgctcccgctccagcagcaccacctccaccagtaccggcgtctccggaagctaaaccggagcaggaggcagatgaagcgcccggcgaatcgg

SEQ ID NO: 1132 - DNA, 464 bp, Triticum aestivum
  Clone ID: PAT_TA_1132
gttccacatcaccagccctctggaaccaaccagttgctttttcaaagcattcattagcttggccagtttccgaagtgaagaatccacgagaggtcagggcattccccaagcaccagagtgcatcagccttgttgggatcaattctcagtgcttcatccagcttagactcagcatcttcgaggcacttgaggctctcggggccgttatgcatctgcgacagctccagcagcgcgccgccccatcgcgtcaggttgtcggcgtcgagcgggttctcgtcgtaggtggacttggcggtcttgcaggcgaggtcgaagaagaagagcctctccgggtcgttcatcgctgccatgtccatggcgacggcgggcgagatcgggtgcggcggcgaggcggggcggtgccgggggcttacctagggttttaggcctcgcttccccacgcgtccgcccacgcgtccgcggacg

SEQ ID NO: 1133 - DNA, 534 bp, Triticum aestivum
  Clone ID: PAT_TA_1133
aacatgatggcatgcattttaatatagaaaaaaatgccaaacagacaccaatagagagtatgagatgagctcgtcaaaagtcaattacaaattattggcaaacaaaaagaatgatcacagaaagcaggtatatgccgcttataagcacatcagtactcaatactgtattatctagggcatgtgaaaaggccataaccacagcaatggttcccgctaacaagagaagcgcataaagtaagaagcatatccagcgtcgtatgacaagacaaacctcatcaaggcccgccgcatgtcgaaaaattccacaaaaaaccgcaacatggaaacaccatttcctctccataacttttgctaagtcctaacataggcatgccatttgcaggtttccctttttccaagtctcgtcttgaatcacatgttaggctggtgtgacatgtgaggtggttgtgcctccttggcttgactgttggccactcctagccaaacaccgatgccaacgagaagaattccccatccagccagcggacgcgtggg

SEQ ID NO: 1134 - DNA, 1284 bp, Triticum aestivum
  Clone ID: PAT_TA_1134
gggttttcttgttggcttgggggcaaagcagattcaagagtgtgagatgagcacgccaaacgtcgtttacaattattggcaaacaaaaagaatgctctcggaaagcagtatatgccgcacaaaggcacatccaaagtacccaatattatgtagacatgtgaaaagagcatacaaaaacacagtaatggttcctgctaataataagagaagcacgtaagaagccagcgcccaagtcctttgacaagacaaacctcgtcaagaccgccgcatgtcgaaaaattccacaaaaaaccgcaacatggaaacaccatttcctctccataacttttgctaagtcctaacataggcatgccatttgcaggtttccttttttccaagtctcgtcttgaatcacatgttaggctgtgacatgtgaggtggctgtgcctccttggcttgactgttggccactcctatccaaacaccgatgccaacgagaagaatcccccatccagccagatcataccagaagtcattgtccttcttctttttccttgattgccttgcatttgaggacgagggtgctccttgtgaggcttgagatgcgatttgcctatggatctccatatgcagttcaggtgcctttgatgacaaatccaatgacttcctgtacaactcatttgctggttccacatcaacagccctctggaaacaaccagttgctttttcaaagcattcattagcctggacggtttccgaagtgaagaatccacgagaggtcaaggcattccccaagcaccagagtgcatcagccttgttgggatcaattctcagtgcttcatccagcttagactccgcatcttcgaggcacttgaggctctcggggccgttatgcatctgcgacagctccagcagcgcgccgccccatcgcgtcaggttgtcggcgtcgagtgggttctcgtcgtaggtggacttggcggtcttgcaggcgaggtcgaagaagaagagcctctccgggtcgttcatcgctgccatgtccatggcgtcggcgtcggcgacggcgacggcggcgagctccggtgcgggggcgaggcggggctgtgccgggggcttacctagggttttaggtccgagaggttttaggcctcgcgccggttgcggatgggcccgaaccccccgcgccggcggcggcggcctgctggataaacgcggcggcagggagcggcgccccgcggcggtagttgggcagcggcagagccatgggcggaggcggggacggcgaagaggagggcgacctcgtgccga

SEQ ID NO: 1135 - DNA, 856 bp, Triticum aestivum
  Clone ID: PAT_TA_1135
cccacgcgtccggcaaatcatcacaaaggattttgtccagtttgccgcaaagtgtttgatgaaaaggacattgagcatgttcgtgatctgttggatgcaaacacttctcagctgatggcatgtttaacagttgaccttggagtagatgataaagagttgctccattccgaggcagagaagaagaggagagaaaaatttgggtcattgtttaatctgcaacaagaacggaatggtttaattgaaccaaagaaagaccttgccatacagcccggaatgtatgtttctcttgctgctagtgagccaaccacaagtgcaggagacagcaccaattcttgggaagcaaccgcaagctcaacttcagaaacagttcttcccggcatggcaaacatcagcggcggcggcaagaaggaaaacaattcaggtcctccaaggagaaaccgagcttatgctcccagaagacagccccatgtccaacctgttggaaaacagtggcagagaagccaacccgctaggcaacagtggcagaagaaagatgcagaaacttgacaatagcatttttgcagctctattttatcgaacatgtatattgatggagagtagggtggtgaaacaaaagggtgacaactcattagaaagcagagtgagttcatgccactgagtcgaagccacattttgatgcagaggcagaacatgtccctctcgcgacccggtagccaaccaggcccctgctgccaccgcaaatgagttcatgcgacttgttctggcccaaatttcggccggctgccgcgcagccgtttgattggcactctccaaactgtccgatgcaacccctcctttcgtcttcaaaaaaaaaaaa

SEQ ID NO: 1136 - DNA, 1213 bp, Triticum aestivum
  unsure (1)..(1213): unsure at all n locations
  Clone ID: PAT_TA_1136
attcggcacgaggcgagnagtgagggcgtggnacaaccccgggcggcaggggcggcggcgcccggggaggaggtgcggctggaggtggaggcggtggcggcggtgtacggagaagactgccgcgtgtactgcgacttccctccccaccttgtcgtccacgttcgccccaacactgccgacgactcctcgcagcagttcgtggaactctttcttggaattaaagcatcctcccagtatccaaaagaaccacctcatgtttatgctgtggaaagtaagggcctcgatgagaatagacaggcatatcttattagcagtatccaagacaaggcaaaagagcattcctactacccaatgcttgtgattctgtgtgaggaagctggagagatcctctcgaatatgaatcatccagcgggggattgtccaatgtgtctgtatcctttagtctcagagaataatcatgattctgctttgccatttatgaagttgatgtcatgctaccactgttttcacagtgactgcattatgagatggtggggctggctccagcatgatgatgccaattctaagaagatagacaacagtatctaccggagaaggattgagattgtccaactcagacaagctatataatgcaaatcatcacaaaggattttgtccagattgccgcaaagtgtttgattaaaaggacattgagcatgttcccgtcctgttggtcgctttctccgctcacctgttggcacgtttaccggcggacctcggcctgccggataatcagttcctcctttccgaggcagcggcgtggtggggtgtgtagttccggtcattgcggcctctccgtcccgtccgcctgggtttctttgacccagcgcccgccctcccctttctgcccgcccggtttgttcggcggcctgcttgtgacccgtccacgagggctgcaggcggcaccaattccggcggagcaaccgcaagctcaacttcagaaacagatccacccggcatggcaaacatcagcggcggcagcaagaaggaaaacaattcaggtcttccaaggagaaaccgagcttatgctcccagaagacagcctcatggccaacctgctggaaaacagtggcagagaagccagcccgataggcaacagtggcagaagaaagacgcagaaacttgtcaatagcatttttgcagctctattttatcgaacatgtatatgacggag

SEQ ID NO: 1137 - DNA, 525 bp, Triticum aestivum
  Clone ID: PAT_TA_1137
gccggccgggcttcgggataattccatcagccagctgttccaatctggatttttctttgaggtgcgttttttattcagcctgaatatcatgtcacgacgctcctggtgacggtcgcttcatttgcggttacatggagctcattctggaggcataacgactacgggtttcttattttaatgatcaacaaaaggcgactacgtgtcatggtggcgaacatatctgcgggaaagcctgtgcattacggctataaatatgcgattacttgggcctacggaacacggttacaatctcgcgcgttaacatcaagtgtcagcttgtgctggggatcgacttctgcatatttcatccatttcaacaagggatctgggattggagtcgttcgcctagcttgaaattacgctattcgtcaagttccagcttgtgttgccttgttccgccaggaaactaggtgtgtttcagtcagtttgtttttctgaaatggaggtaaatcgttattatcaaaaaaaaaaaaaaaaaggccccta

SEQ ID NO: 1138 - DNA, 735 bp, Triticum aestivum
  unsure (1)..(735): unsure at all n locations
  Clone ID: PAT_TA_1138
gccnnggccgggtctccgacaaacacatcaatcaagcaagcagcatattcttgagggattctgatcagtctcggcctctcagggaaagaagagactgcctactgaactcgctggtttcgtgtgatctagagctcgggagttactctagttagagcatctccaacagccgcgctaaactagcgccgcgccgcaaattagaccgtcttagcgcgcgcgcaacgcggcgggtcgcttcagcgggcgcgcaaaaccgacgcgcgcgttataacgggttgagcgcgcggtggaaaatacttacccgcgcggcgtattttgggcgccagctacagtgcgcggcacactcgagcgctcgcgccgcactctcttctcttctcgtcctacgccccgcgcgcgccggcgccggcgccctgccacccacccatggacgcgcacaccggcgccccgctcaccccgctgtaccgccgccgccgccgccggaaaccctagcgcgggaagcgctggcgtcgccaccgccggagctccgccgagcgtcggcctcgcgcgcagcctcttcttgccaccgcggatgatcacggcgccgggagtcgtcttcggaagataaggacgaagacgaagacgaggaagatgaagattgatgtgtctttcatgtcttgaactttagtttgcatttgaacttggttggataaacttgtgngcatgatttttgacttgtgngcatgaaacttttattcatca

SEQ ID NO: 1139 - DNA, 937 bp, Triticum aestivum
  Clone ID: PAT_TA_1139
atttctcatcttataccagcaaatcggatacgttgtgccgcccattacggacttttgtcttacatctccgcattgaagcgcatctctttcgcgctccttcatttcttgacctgcattcactttgttccatcacacacacaacatggctgacaacatcaaggacattcttgcagacgacagtgtaaccgtccaagatgctgcgaagaaaatcacaagctcttgcataaccgcaattgagaagaatgaagatgcttccaaaatcgagcatgatttgcatgccctctggtcgggcatcctcaccgctgccgagcagacccctcatgatcggcaagataagctagtgcaagtcatgcaggcgataaaggaacttgcaccctccggcgacaaggccaagaagtttgttgtttggggggaggagacgcgctgggatgcactgcccttgttcggttctacagcacgagatgaactcgaccgcgcgcaagaagattctgaaaatgcttgtgtcaacatcaacgcattcttcgctcgtgtcaccactgctggagttgatgactttactctctatgccatctggactttacgcgaggccattgaggatcccgccgccgatgagatcgcgcaaaagacatcacccaaactgttgaaagccgctgctgtctggttcatctatgccggcgattcattgacaaaggcgactaaggaaggaaagcagttcgatggaaagatggccaagcccggtgccagtctgcgcgatggcgctgaatggagaggcttttgcgatgacaggtggaaggcttggcaacaaaggatgtcagctctcaatgatgcggatcttcctcaagacacaaagactttgatagagaaggcatgccaaggcttgaattagatatgagacgtaactttcaggttgttaccaccaaattattgtcataaacta

SEQ ID NO: 1140 - DNA, 764 bp, Triticum aestivum
  Clone ID: PAT_TA_1140
cgcacccactttccccgtctgtctttcttctcggcggaggcggaggcgacaggaaggcgaacgacgaaccctagccgcgcgaggaacgcccagatccccaaggccggcgacgatggcgatggcggcggttcgctgcgccgcgaggaggctcggtggctccctgctccagccaacgcaggcggcggtcgcggaggagggacgccgcctcgtgccaagcaggttcatgcgctcccgccacctctccaccaagcatgctagcgagacctggatggaaaagaagatgcagaagttgagatctatgtgggcccagtacaaggcggacatagagagaaggatgagggaacctccagaagaggatgagtttaagttgcttgtcgagtcctacgcacgtacgattgatggtgtggtccatggaactgccaagatggcacttctctgcatcattccatttgccctttttgccggcgacaacaacaagggggtagaagcagagtctgttaccaaggaagaccagtgaagacaaacatccaaagacgagaaccaaagatggacccctacttgttttcagttaaattatgatgacctgcagtttcgctagcgagcactatgctatcgttgtgattttgtgtaacatggtaccatctattcgacatgaaacttgtaggttgatgagaacatgcattgcatagcttgtatggtcactggcatgcattttgctgctactggagtgcttgaatcaacttagaggtgttaatctttttttg

SEQ ID NO: 1141 - DNA, 1387 bp, Triticum aestivum
  unsure (1)..(1387): unsure at all n locations
  Clone ID: PAT_TA_1141
cgtccgcaaagatcaagcagaaggaggaggagctgtatgatgcgatatccaaagcagagcanaagaagaaggagctgtttgatgcgatttataacgcggggaagatttccaccactactggccagcatctttctgtacaagccactcaaggagcagatgaccctctgcgctggatgcggtacgcaatgagagctcggggtgtgttcgagttagctgccaagatgacattaacatttatggcctttgcttttgcgtttggttccaaagccaacaaggtggtagaagccaaggaagaccagtgaagacaagatgcaaaaaatgagtaccaaagatggccccaacttcagcttgttttatgtttaattatgacccctgcagtttgcctagctagcactatgctatcgtacgctgtgatattgtgtgacatggtatcatgttattatatctctacctatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgttttaaagaaccaaatttaactaccccgtgattgcaaagaaaaattcgtccgcccacgcgtccgtagatccccaaggccggcgacgatggcggcggttcggtgcgcggcgaggaggctcggcggctctctgctccagcggacgcaggcggcggtcgcggaggagggacgcctgctctcgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccagaagaaagaggatgactgctgggcggggttcattgagacgctaaagaggttggacgagcttgaaaaaaagaagaaacccaatgtcttcaagcagcgcatgatatccatcgaccgtgcgttgaagagtttggtctatggatctttcaaggtgacagttgtgtatgtggctgctgcttctgctttctctgatagtgggctagctagcccacgttaccaaggaaaacgtgtgaagacgaggtggaaaaatgagaaccaaagatggccgcccagcttgttttatgtttaattatgacccctgcagtttggctagctagcactatgctatcgtacgctgtgatattgtgtgacatggtatcatgttattatatctctacctatctatctattcgagtagattgcaatcacttcgatccagaagcactaaacaggagcccaacaatgcacgtcagtgaccttgcaagcatgcggacg

SEQ ID NO: 1142 - DNA, 733 bp, Triticum aestivum
  unsure (1)..(733): unsure at all n locations
  Clone ID: PAT_TA_1142
gnaaccgctctccccacccactttccccttcttctcggtggaggcgaacgacgaaccctaaccgcgcgaggaataaggaacgcccagatccgcaaggacggcgacgatggcggcggttcggtgcgcggcgaggagcttcggtggctcactgctccagcgaacgcaggcggcggtcgcggatgagggacgcccgctcgtgccaagcaggttcatgcgctcccgccagctctccaccaagcatgctggcaagatccagaaggaactggagccgtctgaagtggaagctaagttgaagctgacgagggcgaagctgggtgcaacgttagataagttggagaaggaacagccagatgagtttatgttgcgcttgaaatccatcggacgtgcggctgacggtgtggtcaatggagttgtcaagttggcagctttctgtatggttactgctgttgcttttggtggcgaaggggtagaagcacaggctgttaccaagggaagccagtgaagacaagatggaacaatgagaaccaaagatggcccagcttgttttaagttcaattatgacctctgcagtttggctatcatgttattatatctgtatctgtctatctagtcgagtactgtagcttgatccgaacatacttgcatagctggtatggtcactggcatgcatggttggtgttattggcttctgtcttgaagtgattgcaatcaacttataagtgttcactttctg

SEQ ID NO: 1143 - DNA, 786 bp, Triticum aestivum
  Clone ID: PAT_TA_1143
ttgtttggctttcttctcggcggaggcggaggcgacaggaaggcgaacgacgaaccctagccgcgcaaggaacgcccagatccccaaggccggccacgatggcggcggttcggtgcgcggcgaggaggctcggtggctccctgctccagcaaacgcaggcggtggtcgcggaggagggacgcctgctcgcgccaggcaggctcatgcgctcccgccagctctccagccaggtctccggcgagcgatcacaggtggcggagcgacgactcctcgagccaggctggctcatgcgttcccgccagctctacagcaagacccccaagaagaagaagctgtctgccttggaatctgagttcctgtggacacaggagacgcttaatgcctcgtgtgataggttggaggagcttcaaaagaaagcagcaccagatgcctttaagttgggcgtgaagacctatggacgtgtggctaagggtgtggtcagtggagctgccaagctgacattttgcttctgtatggttacttctgttatttttggtgacaagggggtacaaagccaggctgttaccaatgaaaaccattgaagacgagatggaaaaatgagaaccaaagatggcgcgtgttttaagttataaattatgacctctgcagtttggctagctagcagtctagcactatgctatgatattgtgtgacattagcatgttattatatctcttcgagtagattatgcatgaaattgtagcttgatgcgaacatacttgcaaagcttgtatcgtcattggcatg

SEQ ID NO: 1144 - DNA, 817 bp, Triticum aestivum
  Clone ID: PAT_TA_1144
acccacgccaactttccccgtctgtctttcttctcggcggaggcgaacgaggaaccctagccgcgcgaggaacgcctagatccccaaggccggcgacgatggcggcggttcggtgcgcggcgaggaggctcggcggctctctgctccagcggacgcaggcggcggtcgcggaggagggacgcctgctctcgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccagaagaaagaggatgactgctgggcggggttcattgagacgctaaagaggttggacgagcttgaaaaaaagaagaaacccaatgtcttcaagcagcgcatgatatccatcgaccgtgcgttgaagagtttggtctatggatctttcaaggtgacagttgtgtttgtggttgctgcttctgctttctctgatagtgggccgttaccaaggaaaacgtgtgaagacaaggtggaaaaatgagaaccaaagatggccgcctagcttgttttatgtttaattatgacccctgcagtttggctagctagcactatgctatcgtatgctgtgatattgtgtgacatggtatcatgttattatatctctacctatctatctattcgagtagattatgcatgaaactgtagcttgaagtgaacatgcttgcaaggtcactgacgtgcattgttgggctcctgtctagtgcttctggatcgaagtgattgcaatct

SEQ ID NO: 1145 - DNA, 820 bp, Triticum aestivum
  Clone ID: PAT_TA_1145
gccggccggttctgccacttcttcccccacccactctctccccttctttcttctcggcggaggcgacaggaagcggcgaacgcggaaccctagccgcctcccacatccgcaaggctggcggcgatggcggcgattcggtgcgcggcgaggaggatcggtggctccctgctccagcggacgcaggcggcggtcgtggaggagggaccacgccggctcgcgccaagcaggctcatgcgctcccgccagctctccagccaggtctccggcgagcgtgctggcaatatcctgaaggaggaggagttggactggaagaagatgaatgcggcgttagataagttggcggagctccaaaaggaagcagggccatccgtatttgtactgcgcatgatgtctatcggacgtgcggctaagactgtggttgttggagctgccaagttgacacttgtgtttgtggctgccgctgttgcttttggtggcgatggggtagaagccgaagctagtaccaaggaaagccagtgacttatgatgggaaagatgagaaccaaagatggccccagatgttttaagttaaattatgacctctgcagtttggctagcttgcactatatatgctatgggaccttgtggtatcatggtactatctatctatctatctatctagatctatctattccagtaggttatgcatgaaactgtagtttgatgcaaacataattgcatggcttgtatcgtactgtcatgcattgctggtgttattacaagtgcttccggctccaagtgattgcaatcaacttaaaaaaaaaaaaaaaaaaggccccta

SEQ ID NO: 1146 - DNA, 1533 bp, Triticum aestivum
  Clone ID: PAT_TA_1146
cccccgccccctgtccccgtctctctccctcctccccctaggcgcaggcgaaggcgcagcacccacaccaactttccccgtctgtctttcttctcggcggaggcgaacgacgaaccctagccgcgcgaggaacgccaagatccccaaggccggcgacgatggcggcggttcggtgcgcggcgaggaggctcggcggctctctgctccagcgaacgcaggcggcggtcgcggaggagggacgcctgctcgcgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccagaagaaagaggatgactgctgggcggggttcaatgagacgctaaagaggttggacgagcttcaaaaaaagaagaaaccaagtgtctttcagcagcgcatgatatccatcgaccgtgcgttgaagagtttggtctatggatctttcaaggtgacagttgtgtatgtggctgctgctactgctttctctggcagtgggctagaagcgtagcccaggccgttaccaaggaaaacgtgtgaagacgaggtggaaaaatgagaaccaaagatggccgcccagcttgttttatgtttaattatgacccctgcagtttggctagctagcactatgctatcgtacgctgtgatattgtgtgacatggtatcatgttattatatctctacctatctatctattcgagtagattctgcatgaaactgtagcttgaagtgaacatgcttgcaaggtcactgacgtgcattgttgggctcctgtttagtgcttctggatcgaagtgattgcaatctactcaaaagtgctcactttcacaaaaaaaaatgcaagcgcaagagatccagcagaagaaggaggcattctatgacgcggtgtctaatgtggagcttaagatgaaggagttcaatgatgccttagttaaggcgggggatcctactggccagaagcatctttctgcgccacggaccggctatgagcgccttaagatgtatggattaagagctctgggtgtgatagagttaacttccaagacggccgtcttcgtggtgtttgctctttccttcgttcctctcagcagcatgaagaccgaagagttgacctcaggggaaaccatcactgaagtgaaggccgcaaattgacaagcccaacatggatcgcgccccagcttgttcttcagtctctaatcatcacctgcagtttggctacctagcactatgctatctttctgatggtgcgtgacgtcgcatgctactatatctctatatatctgtttgttcggaccagaccgcaccggtgatgtgaacatatatgcatgcattgttgctggcgttactgccttattttagtagaggatcacattccagtcatcttagaaggttgagtatctctaagcaaaatgtatggcgcccttttgcgatccattcactttgtg

SEQ ID NO: 1147 - DNA, 3143 bp, Triticum aestivum
  Clone ID: PAT_TA_1147
cggggttcccggcatgacaatgatggccatgcccgaggcgccctgcctctgcgcgcgcccgtccctcgccgcgcgcgcgaggcggccggggccggggccggcgccgcgcctgcgacggtggcggcccaatgcgacggcggggaagggggtcggcgaggtctgcgccgcggttgtcgaggcggcgacgaaggccgaggacgagggggaggaggacgagccggtggcggaggacaggtacgcgctcggcggcgcgtgcagggtgctcgccggaatgcccgcgccgctgggcgccaccgcgctcgccggcggggtcaatttcgccgtctactccggcggagccaccgccgcggcgctctgcctcttcacgccagaagatctcaaggcggatagggtgacggaggaggttccccttgaccccctgatgaatcggaccgggaacgtgtggcatgtcttcatcgaaggcgagctgcacgacatgctttacgggtacaggttcgacggcacctttgctcctcactgcgggcactaccttgatgtttccaatgtcgtggtggatccttatgctaaggcagtgataagccgaggggagtatggtgttccggcgcgtggtaacaattgctggcctcagatggctggcatgatccctcttccatatagcacgtttgattgggaaggcgacctacctctaagatatcctcaaaaggacctggtaatatatgagatgcacttgcgtggattcacgaagcatgattcaagcaatgtagaacatccgggtactttcattggagctgtgtcgaagcttgactatttgaaggagcttggagttaattgtattgaattaatgccctgccatgagttcaacgagctggagtactcaacctcttcttccaagatgaacttttggggatattctaccataaacttcttttcaccaatgacgagatacacatcaggcgggataaaaaactgtgggcgtgatgccataaatgagttcaaaacttttgtaagagaggctcacaaacggggaattgaggtgatcctggatgttgtcttcaaccatacagctgagggtaatgagaatggtccaatattatcatttaggggggtcgataatactacatactatatgcttgcacccaagggagagttttataactattctggctgtgggaataccttcaactgtaatcatcctgtggttcgtcaattcattgtagattgtttaagatactgggtgacggaaatgcatgttgatggttttcgttttgatcttgcatccataatgaccagaggttccagtctgtgggatccagttaacgtgtatggagctccaatagaaggtgacatgatcacaacagggacacctcttgttactccaccacttattgacatgatcagcaatgacccaattcttggaggcgtcaagctcattgctgaagcatgggatgcaggaggcctctatcaagtaggtcaattccctcactggaatgtttggtctgagtggaatgggaagtaccgggacattgtgcgtcaattcattaaaggcactgatggatttgctggtggttttgccgaatgtctttgtggaagtccacacctataccaggcaggaggaaggaaaccttggcacagtatcaactttgtatgtgcacatgatggatttacactggctgatttggtaacatataataagaagtacaatttaccaaatggggagaacaacagagatggagaaaatcacaatcttagctggaattgtggggaggaaggagaattcgcaagattgtctgtcaaaagattgaggaagaggcagatgcgcaatttctttgtttgtctcatggtttctcaaggagttccaatgttctacatgggtgatgaatatggccacacaaaagggggcaacaacaatacatactgccatgattcttatgtcaattattttcgctgggataaaaaagaacaatactctgacttgcaccgattctgttgcctcatgaccaaattccgcaaggagtgcgagggtcttggccttgaggattttccaacggccgaacggcctgcagtggcatggtcatcagcctgggaagcctgattggtctgagaatagccgattcgttgccttttccatgaaagatgaaagacagggcgagatctatgtggccttcaacaccagccacttaccggccgttgttgagctcccggagcgcacagggcgccggtgggaaccggtggtggacacaggcaagccagcaccatacgacttcctcactgacgacttacctgatcgcgctctcaccatacaccagttctctcatttcctctactccaacctctaccccatgctcagctactcatcggtcatcctagtattgcgccctgatgtttgagaggcgaatatacagtaaataatatgtatatatgtagtcctttggcgtattatcagtgtgcacaattgctctattgccaatgatctattcgatccacagatacatgtgcaaacaaaaaaaaaaaaaatcttcagagcagctgttcctgtcgaccttgccccgattaccttccttgtctttggggctttctcatgctgcgcagagcatgctcggctgtcagtgacgctggtggttgtcggacggtccacactgcagtccccccggcagcaggcggcagggggaggtggcaccagcacgagcccgaggtctccagctcgaactgcttgctgtgcatgcctgtgtcgatcatgattcggtgctttcaggatatgtgatgcatctgtagaccctgcatctttggcacaagatgtacccggcggccttgcaggtcgggcagcggcgatagatcctggggttgctctcggacttgacgttgttcttcttccccttgcagaagtcgcacagcagccaccccgtgccgccgcacccttcttcgcactctacaccttcttcctccatgtccacgtccgcctcgacctccggcggggccgcctctgccgccgcggccacggcgacctccctgcggacggacacgcagccgatcctcctcggctgccgagacagcgacacggtcgacgccaatgccggggacggcagcggcggcgatgggtggcggcaccaaccgtgcaggctcgtcgcgctgcaccactgcgtccg

SEQ ID NO: 1148 - DNA, 1230 bp, Triticum aestivum
  Clone ID: PAT_TA_1148
tgttttttttttttcagtttgtccttctcttctacaagcttaatcatacttttcttattgtttgtcaatcgcaagctcgcttaaagagttatctggtaaatattattggtcaagcgtaacaagttcagggatgttcaccacacttgcaaaaaaaaactaacataacaagaactacacatgcccagctcaacacaactattttcacaatgccataactgaacaagatcatcagggaggcgctgaggatgcactctataagaccatctaatccaacttcgcgtaagcgaatccgtcggcacctttctcgccgtcgcttggcgccagatccttcaactttgctaagtaagctttgtggaatctgtaacctctgtcggtcccatataggtaatcacagtacgtgaaaacggaagcaaaattgctctggctttggcctccaacgtagtgatgataatcatggtattctgctcctccatagaatggaatatactttgtcaggctgaatgggaaatcaaaaccgctgtgtgtatcaatggcttccatctgacgaagtataatccagagccagaatgttatcatgtggcctggtgcaatggctggcccagcgaaggaggggatgccaagtatgagaacctctgcccagtgtgcgtatggcgcggcaaagccaatgggcgcggtgtactcatggtggatccggtggatcttctcatagccccactcaccgtgcagcagccgatggatccagtagttgaggtagtcctcaaccaggaagtagaccagcagctgtgcggccatctcccccagagacggcagcggcagtccggtgtggattcccaccatcttgacggcggggtaggagacgagctggagcgggccgatgacgaggaagaagatgcgcatgacgtccccgtagcacttgaggaactcggcacgcgagagccgcacccggggctgcagcttgtacggcccgacggcccgcggcgcgcggagctcgaggagcgcgacggggagcggcgcgagcgtgaagacgacgaggaggaagaggatgttgaggcagtagaggtagtagtcggacgtctccgcggtccaccggaaccacagcgcctccgcggccgtcatggcgcgccccagcgccgcctcggcctccgccgccgtcgcccacgggagcatctcgtccggccggacggacggacggacagacacaaggacccgcccgcaaaaacagactgagag

SEQ ID NO: 1149 - DNA, 770 bp, Triticum aestivum
  unsure (1)..(770): unsure at all n locations
  Clone ID: PAT_TA_1149
gccggccgggtctcgaataaaattcctagccccctgcggcggtcgtcgtcgagtcctttctttcttccccgcggaggacggagcagagcagagcgacgcagcgagcccagccgccatggaccgcgtgcagctcgtgctcctgggcctccccatcctcctcttctgctccgacgtcgtcacgctcttcgcgccgcagccgccggcggcccccaagccccaccgccacccccagcctgccgccggcgccttccagcctggtgactcctcccccgacgccgccgattccgcgcagttggcggaggcgcaggtggatggacctggctccggcaccacagtcgagttgaagttctgcgcgtcctgctcctacaagggaaatgcgatgaccatgaagcgcatgctggatacctcatttcctgggattcatgtcgtcttggaaaactaccctccacccttcccaaaacgcgccctcggcaaaatggtgccttttgttcaagttggagcaatagcaacattaatggctggtgatcagattttccctagatttgggatggtaccacctccgtggtattactcactgtgtgctaataggtttggaaccatggcatcagtctggatgtttggcaattttgctcagtctcttctacaaagttctggcgcctttgaagtttactgcaatggacaactggtcttctcaaaattatctgagcagaccagtcctccattngtcgagctgcgngagctcattggcaacagattatcagattctcaaa

SEQ ID NO: 1150 - DNA, 630 bp, Triticum aestivum
  Clone ID: PAT_TA_1150
tatcatcccaatattcatactataggagttgttgtcagggatgcgagaggggcagcagagtggccagtgagggggcaccatcacgggagatgtgttcatacaacgcaacgtcgaggagatgtcgacgacctccgtggatgagcggtggttgtgagagttttccgaggaaggcccactcgatcatggagtggctatcgctgcagaaggcgacgctagcaacagagacatccatccatttgtgccaccatcaataacaacgttgtaacaagcatggctctgcactggttgctgaagcagtagagtggcttatgtcatgtaggcaactggtggctacaaggatccgtacgtaaacatggtatgtgaaatttgtgctacacaggaatggaaatgccaatttacaaaatataatatgcatgtttggttgatgattacttggggtagccgaatagaacttggaaccattataatttaagtgtggctatgaaaattttagatggagttggtggtttggtacctattggagtaacaaattccagttacccagtagaaagcaaggtgaatcggaaatcaattattaaatctgctttataggctttgctaaagagagaaactgagagctactaatatcct

SEQ ID NO: 1151 - DNA, 719 bp, Triticum aestivum
  Clone ID: PAT_TA_1151
gccggccggtttcgacaaaatatcctttgagccgccgcacaagctcccgagctcacggtcatggcgatggcggaggcggaaagcaatggcttcgagttcctgtcggatccggtcgacaggtttccgctgatggatctatccggcggcaactgcgcgccctccaacgaagccattgaagctctgatctgcgccccgtccgattccagtatgggcgacgctggggacagagcgctgacaatggaggcggatttgaacagtacttgcgatgatgtgcccctgtcagcgccaccttcagagccgtcaacagggaaagacgatcctcaaggcacctggctggacagagaggtcaaaagagacgattgcgacagattggttccttttatgtagatcataaaccaaccatgtatgatagcttttagttatcttacctcttcttcggaaaatatatatctctaatgctaatgcagcttattgcaatcttgtattgtaatattttcagatcttattctatggcaaataatgtgtgaggtttcaaaaaaaaaaaaaaaaattagactgctgcctcagaaaattatcaacacttctcgaatgtcgttcagaagtttccttccgtacagctaacaaagagcctgaactatgcagcccgttcatggcacatgctttgtcatttgttgtgctctaaaaaatatatatatatgtgtgaaaatacaaaaaaaaaa

SEQ ID NO: 1152 - DNA, 759 bp, Triticum aestivum
  Clone ID: PAT_TA_1152
gcgtgtagattattattagaggagatgtgcccaaacatggactacaagaagccggccgcatactatgcacatatcacaaacacacatacacagatcctcatcctccattcctccggtacacacatcgatcacgcaaagcaaggcacgagtgcgtagtacgcacgcacggacgtactccgttgagagctcggaaggctaattggtgatggggcgccacagcagcagcggcaagccggaggctggcggcgagcagtaccggaaggaggagaagcatcacaagcacatggagaacctggccaagctcggcgccgtcgccgccggagcatacgctaggcacgagaagcacgaggcgaggaaggacccggagcacgcaaggtcgcacaagatcaaggagaagatcgccgccacggtcgcggccggcagcgcgggattcgccatacacgagcaccacaagaagaaagaggccaagaagaacgctcgtcatgcccaccgccactgatacactcatggatgcatatgcacacatagaccctagctagttatcttatacagtatatcttgtatgtacggccggttacattcattcattttgttgtcttgttccatagtattgaattgctgtttggtatgtgtattctcgtgacatagtcgtatagtatgttggtacattcttgtagtccatgtttgggcacatctcctctaataataatctacacgccttcttttctctctccaaaaaaaaaaaaaaaaaggccccta

SEQ ID NO: 1153 - DNA, 934 bp, Triticum aestivum
  Clone ID: PAT_TA_1153
gttggtacgagcaactgcaaagagagagtggcgatgaggaatttcgttgagaaattggtgctctctttactatggatctccctgttccaagggtgcatggtccagtctgtggaatatgatcatacagctagtattgagtgcctccgtgatccgatgaagcccctctacaagggcggcatcatccagaacagcgagttcaacaacggcctcatggggtggtcgacgtaccggaacatcaaggccggcgtcggcaagtcggcgtccggcaacaggttcgccgtggtgcaaggcgcgatcagctccctgttcagtgccgccggcgacgcagccgcctcgcagtcccacagcgtctaccagaaagtccagatgcagggcgacacccactactcgctatcagcatggctgcaagtgtcggccggcacggcccacgtgagggcggtggtcaaggcccccaacggcgagaacatcaccgccggcggcatcgacgcccagtccggctgctggaccatgctcaagggcggtatgaccgcgcacacctatcactctggacaaggagaggtcttcttccagagcgacacgcccgtggacatctgggtggatagtgtttccctgcagcccttctcctttgatgaatgggacgcccacgcccgccggtccgccgataaggctcgccggagcatggttaatgtcgtcgcgaggggccccgacgggcagccaatggcgaacacaaacgtgagcatccagctcctccgcacagggttcccgttcggcaacacgatgaccaaggagatcatcagcaacccggcctacgagaagtggttcttctcgcgcttcacggtggccaccatggagaacgagatgaagtggtacagcacggagtggaaccagaaccaagaggactacaaaatcccggacgacatgctcaagatggctc

SEQ ID NO: 1154 - DNA, 669 bp, Triticum aestivum
  Clone ID: PAT_TA_1154
gccggccggttcgggagctcatcagggcccccgatccgtcgcgtccagcaacaccaacgcagccgccgacgcctttgcttcgagttcgagatgaggttcgtcgccgcgtacctgctcgccaccctgggcggcaactcgagcccgaccaaggacgacgtccgagccatcctcggctccgtgggcgccgaggtggaggagggcaagctcgacgccctcttcaaggaggtggagggcaaggacctggccgagctcctcgccgccggcagggagaagttcgcctttgcgcccagtggccggcgccggggcggccatgggcgcgtcccccgtcgccgccggtgacgctgccgaggagaagaaggagaaggcccaggagaagaaggaagaggaggaggaggaggaggacctcgacatgttcagcctcttcgactgagcgacccaccgcgccgtgccgatcgatctgccggctctttaccgtagctagtacagtatctgtgtatccgtgatctgctgtacttttttttagggacgtaatttgctgtacttcgtttggtggtagtactttttttattaggggcgtaatatatgtattgggagattttagatgttgttgagattagaaatatatttaaccgtgtcctgatggaaaaaaaaaaaaaaaaaaggccccta

SEQ ID NO: 1155 - DNA, 577 bp, Triticum aestivum
  Clone ID: PAT_TA_1155
gccggccgggctgggcagcgaccagatgatgggttcgggctctgccggcttcgcggcgtcacggcaggaggagatgatctgtggccccaacccgttgatgaacgcggcgatgtggcagcaatacaactcgctgcttcttggccagtacccgcaggaagagatggcgggcagctcgccgatgatggccacaggaggagcgggagatgagtgcggattcttcttcgactcggggttcgaggacacggcttcccttggggccatgcggttcccccaagcgtggagctgatgccggccggtcgtgcgcgcgcgcccagtgatcgttgtgtatacgttgtgaaggaaaaactagcgattgaattatttaattccattggtactgtaggtatagtgtgtgaggtcgtttatatagatttgtgaaggatcgagtgtgtacgtgcttgcatgagatggtttcgtttgaccgtttcggccctttgaatgatgccatgtattgcaatcataaaactcatatgtaaaattgtaaattagtacaacacagttcagatttcagcaaaaaaaaaaaaaaaaaaggccccta

SEQ ID NO: 1156 - DNA, 1158 bp, Triticum aestivum
  Clone ID: PAT_TA_1156
aaaccataaactagcattgttcatggtccccaaaataacaagtgtgcccccacaaacatctcccaaccatatggcaggattcggcaacaacagaagttacaagacactctcacacaccactccatgcatgtgtacctctaaagcacccttaaataaatcaccttgcgatgttttcacaacgcaaggccacactaacaatgatcaaaatgctcaactccacaataagtaataacttatttatgtctactactgtgctactagtatgagagaagggaaggcctaagcgggtgctgatcagcagcagcctcggaatagccgaaggcctcttctttactataacgaagaggtttccttctcttgctcaagctccaaaccaatgcaatccatccgtccacggacgacctcgctagaactgggctccttcgaaggtctggccgaaggaccagccggcgggggcggcgttgttgctggtgacggtgcggccgtcgctgagggtgacccggaaggagaggctctggccgtcgaggtccgcgttgctctgccagttcatgccccagttgcgggacatggcctgccagccggtgcgcgtgcccttgatggacacggactgcgcgtcgccggcgccgcccacgttggtcaccagcaccaggttgaagtaggagtggccgttgatggtgaaccggatgccccccttcttcacgcacggcacccttctgtaggagacgggcacgatgccggcgcggtactgcgcgatgtggaggaaggccggctcggccatgtcgaagtgggggcgcggcgggttgcaccagccgccgtcgtcgctggggaggccgtagttgggcgggcagaagttggtggccgtcaccaggatggaccccggccggcacgagctgccggcgttgtcgcagcgcagctcgtagcacgtcccgcacgccgcgccgtcgttgaacagcgccgtgctcagcgccgccgtgttcgtgccgtacccggtgctgtacaggttgccgtacccgcatgccccgcccatggtgccggaggcgtcgccgccgccgtagaaggtggcgtgggcgctctgccacccgccgtacccgccggccgcggcctgccgggccaggaggcagaaggaggagaagaggaagaagagagtaccggtgcccg

SEQ ID NO: 1157 - DNA, 1241 bp, Triticum aestivum
  unsure (1)..(1241): unsure at all n locations
  Clone ID: PAT_TA_1157
tcggatctagaactagtcacagccagcagcgtgccatggagacaaagatgacacgacacgggacgggacgacaccggagaagcagcagntgcgggntacactcgccgctcccatcttcagntgcagctttgcagccacttcagccaccactccacacttcagtacncagcaaccatcacctctttaccctaatcaagactagacttttactgctactactggtatcaacctgcttgcaccttgcatatgcattcacaggccacgcaccaaggacgggaaaaacacaccaacacagaccgctcactcgctcactgtagtaattactcacccactagtatgtagtagtagtactcgtttatatataagacgatgaacctcccgcccatgccgccgaccgtcgccggagaagaggaagggaagataacggtgggctccgacanccaagttcttgccctcgaaggtctgtccgaagcgccagctctgcggcgcggcgttccaggaggtggaggtgcggcggtcgctggcggtgacgcggaaggagagggcctggccgacgaggatggcgttggactgccagttctggcccccctcccccacacgggcatccaccccgtgggcggacgctgggtcgacacggaccggatggacccgacgccnccgacgttgctgacgagcacgagctcgaagtagtcgtggccgttgacggtgaacctgacgccgcccttcttggcgcagggcacgcgctggtagagcacgggcacgatgccgccgcggtagacgccgatgttgagccatgccggctcggccatgtcgaagtgctgccgcggcgggttgcaccagccgccgtcgtcgttggggagcgcgtagttgggcgggcagaggttggtggccgtgatggtgaccgacgcgccgcggatgcagaaccgcgggtccgccgcgtagtcgcacctgatccggtagcactgcccgcaggacgcgccgtcgttgaacagcgccgtgctcagcgccgccgtgctcgtgccgtaccccgtcgagtacaggttcccgtacccgcacgccccacccatggttcccgaggcgtcgctgccgccgtagaaggtggcgaaggccctgctgacgccggacgccgagaagccggaggccgtgctccagagcaggcacgtcgcgaccgcgaacagcacgaagagccgaagagacgatccagctgacgtccccatgttacagagatcaatgaagctcgt

SEQ ID NO: 1158 - DNA, 1214 bp, Triticum aestivum
  Clone ID: PAT_TA_1158
aaatccaccaatgccgtgatatttgccttttgactttatatttcattagaaattcagttctggccaatgggaggacaacacgcgtcattttccttttcagaaaaatcctaaaacctcccaaattttgaagaaaaaaatcaaccatagcttcaaattttatgaaacttttggcatattggtcatcatgaagcctcggatgcagaggcaaatgcatggatggacacaatacctcgtcaggagaagatatcaccgcgacacaccgatgaccgaacgttacacaccgatcactgatcaaagacatacatcccccacaaaaaaaggctggagtataaattaataaaccactcgtacttatgatcgtctcttaagagaactgcttgttggtggcgaaggtctggccgaagccccagccgacgggcgcggcgttggggaaggtgagcgtctggccgtcggtgctggtgacctggaacgagaggctctggccgctgagcagcgcgttggactgccagttcacgccccagttgctggacatgggcagccagccagtccgcgtgcccttgatggacacggaccgcatgtcgccggcgccggccacgttggtcaccagcaccaggttgaagtaggagtggccgttgatggtgaaccggatgccccccttcttcacgcacggcacccttctgtaggagacgggcacgatgccggcgcggtactgcgcgatgtggaggaaggccggctcggccatgtcgaagtgggggcggggagggttgcaccagccgccgtcgtcgctggggaggccgtagttgggcgggcagaagttggtggccgtcaccaggatggacccggggcggcacgagctgccggcgttgtcgcagcgcagctcgtagcacgtcccgcacgccgcgccgtcgttgaacagcgccgtgctcagcgccgccgtgttcgtgccgtacccggtgctgtacaggttgccgtacccgcatgccccgcccatggtgccggaagcgtcgccgccgccgtagaaggtggcatgggcgctctgccacccgccgtacccgccggccgcggcctgccgggcgaggaggcagaaggagaagaggaagaagagagcaccggcgcccgccattgctgggagagagagagcttccttgtatcaccaagctagcttagctttcgaggtgatatggtgactaaggctagctagggctcgaaaggct

SEQ ID NO: 1159 - DNA, 2226 bp, Triticum aestivum
  Clone ID: PAT_TA_1159
caggtccatgattgatcgattgataaatagtactagtaacagccagcagcgtgccatggagacaaagatgacacgacacgggacgggacgacaccggagaagcagcagctgcgggctacactcgccgctcccatcttcagctgcaggtttgcagccacttcagccaccactccacacttcagtacccagcaaccatcacctctttaccctaatcaagactagacttttactgctactactggtatcaacctgcttgcaccttgcatatgcattcacaggccacgcaccaaggacgggaaaaacacaccaacacagaccgctcactcgctcactgtagtaattactcacccactagtatgtagtagtagtactcgtttatatataagacgatgaacctcccgcccatgccgccgaccgtcgccggagaagaggaagggaaggtcacggtgggatcaaaccataaactagaattgttcatggtcccaaaataacaagtgtgccaccacaaacatctcccaaccatatggcaagattcggcaacaacagaagttacaagacactctcacacaccactcaatgcatgtacttctaaagcacccttaaataaaatcaccctgcgatgttttcacaatgcaaggctacactaacaatgatcgaaatgctcaactccacaacaataataacttatttatgtctactacttgtcctactagtatgagagaaggggaggcctaagcgggtgctgatcagcagcagcctcggaatagccgaaggcctcttctttactataacgaggtttccttcctctcttgcaaggtccaaacgtccaaaccaatgcaaggaatccgtccatcgacgagagaactcgtccattttttttttttttttttttttctaatatggccttggaaatctagtactggcacaaaagggcaacgacccccgtagtacaaattaatactactacagacacgtcaaaactggtgaaacagaacctaccaaataaattaccagctactatcatacacctgtcctattgctgccattgcagccccccactccgacccttaagtaacatcgcctcgagacgtcttcacgtcgtaaggccactcgaaacatgactaatatggtcaaatcttctataagcaataagcttgtaacttccataagagttctccgaccacgcgacaaaggcgaaagtataagcgggtgctaatccgcagcctccccggcagtggcaaagacctcctccttaactataacgaagaggtttcgtctactcctcttgctcacgctcccacgcgaatgcaaacaatacgctccgtcggacgggaggggacgcccgcgctggtctcgtagaactgggcgccttccgaagggtctggccgaagggccagccggcgggggcggcgttgttgctggtgacggtgcggccgtcgctgggggtgacccggaaggagaggctctggccgtcgaggtacgcgttgctctgccagttctggccccagttgcgggccatggcctgccacccggtgctggtgcccttgatggccacggactgcacgtcgccggcgccggccacgttggtcaccagcaccaggttgaagtaggagtgcccgttgatggtgaacctgatcccccccttcttcacgcacggcaccctcctgtaggcgacggccacgatgccggcgcggtagattccgatctgggaggtaggccggctcggccatgtcgaagtgggcgcgcggcgggttgcaccagccgccgtcgtcgttgggcagcgcgtagttgggcgggccacaggttggtggcggtaatggtgatgctgcccggcaggcaggagctgctcacgtcctggcacttgagctcgtagcacgacccgcacgccgcgccgtcgttgaacagcgccgtgctcagcgccgccgtgttcgtgccgtaccccgtgctgtacaggttcccgtagccgcacgcgccgcccattgtgccggacgcgtcgccgccgccatagaaggtggcgtgggcgctctgccacgagccatagtcgccggcggcccgccgggcgaggaggcagaaggcggccgagaagagcaggagcagagcattggcggaggccattgcaaagagctcgaagctagcagctggtgcctttctagctcggtaaagcgaccgaccgacttgctgaggaaccgatggatggttgcttggctgtttttttttttttttttt

SEQ ID NO: 1160 - DNA, 1031 bp, Triticum aestivum
  Clone ID: PAT_TA_1160
ccgcgcgtagcgacagccagccggcactgaacgggagctttatgcgcattcagacatacacttcagtcccaagtttctaggtctagcacttctgttgcatcccttgcatgccaagatacatgcaggtctgaaacctctttgatgggcattcttgctcgaacctacccggcggtagacacatgcacatttgtcttcctttaaaattaaattctatgtccggacccttgagctcacggtgtatctgcagaggtcatgccactcaatcagtctcgttgaccttttatagtgttgcaagtgtgcgatatgcctggtgtcccatctgaacatgggggaaaaatgcacttggtccacaaggccaacggcaggcggatccccttctttagcttcactcgcattcagagatacattcaaggctggagcatctttgtatggtattggtgatagaactttgctgagggcagagacacacaaatttgagtcccgttatatggacaatcttgttggaagtgaaggagcttactatgaaagatcaccacatcaactttgtcaataaatttacatgcccagttattgtctttcaagggttggaggatatgctgatggcaagcggcccgggccgagcaagggccaaggccttgaaagaaagtggtctgcctgttgctttggttgaatacgaaggggagcagcatgggttccgcaaggccgaaaacatcaagttcaccttggagcagcagatggtgttttttgctcgaacggtcgggaaatttgaggtggcagatgatataactccgatcaagattgagaactttgactgatggctgcaagtaacaagcgtatcatcggttcacctttgtttctagaagttcgcctttcacagatggtgtagatgtaatggtgccgaacagcagagactgctataacaccattgatgaacgggcagatctcctataggccatcatacagtcatgatcatagtcatgaacgccaaatccatatagaccttgtaaaaaaaaaaaaaaaaaaggccccta

SEQ ID NO: 1161 - DNA, 847 bp, Triticum aestivum
  Clone ID: PAT_TA_1161
gcccgggccgcgccgcgggcgagggcggcgacgtcgcccccgcggtcggcggctacgtcgtcgtccgcttcctccccgccgccgtcgggccgcgcagctgccccggcatcatcctggcgctgcccatcctggcgctcatcgtcgggaagctcgtgaggagcttcgagatggtgcccccgccaggcgtggacaagctcgacgtgagcgagaaaggcgggcagttcagcctgcacattgccaaccattccgtcgtcgccttccaccccatcccctcaccatgaccaattacttcctcaacccaaaagcctgcccgcctcgccggctacacttcccaggggccccatggtcttcgacaactcctggtggctggccaacaaccgagagatatgggagtagccggtgtagttcgagccggagaggttcttgggcgaggagagcaacgtggacgccacggtcggcggcaaggtggacttccggttcctcccgttcggcgtggggcggcgcagctgccccggtatcatcctcgcgctgcccatcctggcgctcatcgtcgggaagctggtgaggagcttcgagatggtgccgccgccaggcgtggacaagctcgacgtgagcgagaaaggcgggcagttcagcctgcacattgccaaccattccgtcgtcgcattccaccccatctcaccctgagcaattgcatcttcaacccaatagcctgatccacaagcacaatttttcttcagattacaaatacagtagattacacgaaagtatgtcagttgatttatggggtttacattttttttctttataaaaaggaggatcacgcgtggcctctgcataaggggtt

SEQ ID NO: 1162 - DNA, 1381 bp, Triticum aestivum
  Clone ID: PAT_TA_1162
ctgccggccaggcttgcccccggacgcacgccaggctcaccacacaagcgccacccggccacccgccgatatcaccaccgctccctctccggccgccatgttgccgccggccgcccgcctcgcggcccgccgcctcctcggcctcgcctccgcctccgcctcacagtccgccgcccgacgactatccccgtctccgatctcctcccccgccgccgccgccgccacgggttacttctccaggtccttctcttcggcgcttaactaccacatcgattcgccggacaacaaccccaacatgccgtgggagttcaccaaggccaacatggacaaggtcaacgaaatcctatctcattacccaagcaactacaagcaatctggtattattccaatgcttgatcttgcacagcagcagcatggtggatgggtcccggttgcagcaatggacgctattgctaaaatagttggagttgcaccgatcagggtctatgaagttgcaacattttactcaatgttcaatcggaccaaggtgggaaaatatcaccttttggtgtgtggaactacaccttgtatgattcgtggttcacgtgatatcgaagatgccctgttaaaacaccttggagttaaacggaacgaggtgacaagcgatggtttattttctgttggggaaatggaatgcatgggttgctgtgtgaacgctcccatgattgctgtggctgactataccaaaggttcagatggttacacatacaattattatgaagacctcactcccaagcgagtcgttgagctcgttgaaatgctgagaagaggagaaacgccccctcgtggcacccagaacccagagcggaaaaactgtggtcctgctggagggatgaccaccttgctaggcgagccaaagcctcccccatgcagggacctggatgcctgctaggtttgctttgagttgcaagcacacaaataagtaggcccggttgcactgtatgttgcggaaaccgcgaaagcgatttgatctcctgttgttctcaaagctttcttgtggccaacaatggacatgcgatttgattgatcttgttgttgtcgaagctttcttttgtctgacaattggatgcgtctacctgtcacacaccatctcttcttttttccttatcatcagctagactgcccactgataagatagtgctattctgaagctgcagctttgtatccggcataagaatctggggcactggatcgattgctgttatgctactcctgcagtgttatattcctgttgttcatgcattaatgtttgaatgaacacggacctggtacattgccgattttcggggagaaactttttgatatactaattttcttattcggtcaaaagaaaaaaaaaaac

SEQ ID NO: 1163 - DNA, 707 bp, Triticum aestivum
  unsure (1)..(707): unsure at all n locations
  Clone ID: PAT_TA_1163
gccggcctggcttgctttgtcctcctatactctctagctttcgcgctctgtccggccgtcctcctcattcggctaatggggttcccggcggtgtactcggagatgcccaggctgctgctgaacctcctcttcctgctgggccacctgcgccgcctctcctcatggctgctccgcctcgtcggcgccggcgtcgacgacgacctctgcttcgattactcggacgcctccgacttcgccgaccaccaccaggagcaataccaacaccaacaccgcgaccacggcctggaggagctggaggagcactctccggccgtgcgcttcgacgcgctctccgctgcttccgacggagacgacggcacggcgctgctgccggagggctgcgcggtgtgcctcggcgacttccacggcgccgcccgggtgcgtcggccgcgcgggtgccggcacgtcttccaccgcggatgcttcggccgctgggcctcccacgtctaccacacctgcccgctctgccgggcgccgctcctgccgccggcgccggcgtctctgggtcccgtcctcctgcccatgccgctgccggcgtcgtgattggttgagagcaagctcgttcggggtgctgtttgcatatatgttcggcgactattcttgagggatcctgaggagagggttccgaattatcgcttcccggntgggnttttatgcaaaagcaagct

SEQ ID NO: 1164 - DNA, 698 bp, Triticum aestivum
  unsure (1)..(698): unsure at all n locations
  Clone ID: PAT_TA_1164
ttaagggcgaantggggtancncgggccggccccgccggccgagagaacatatctaagagacggaccaacaaacgtgaaggttagagaggttcagttccttccatatattactgctacctactactccgcccatggcagacggtaagaaatccagctccggcttctgggcgacggtggcgtcttgctttcgcccacccaaggcggtggcaagcaccgccggccggaccaccacgtatgatccagtcgcggggatggtcgcggcggccaaacatttctccggtgctcacaagataaactttggatgattcatgcctcccatctctgctgggtatacggtgattgtacatatgtgtatatatgtagttcttattgaaatctctaagaagacttatatttagaaacggaggaagtataaggtctaagctatactttcaagcctcggttacgatccctgttctgtggggatcaatattaaaaaaaaaaaaaaaaaaaaaaagagaaccaagaagaaagaaatccctgtacaaccttgtaagtgactgaaatcatgttactacttcccttccaaaaaaaaaaaaaaaaaaggcccctagtcttggttttgctgccgccgccgttcagtgactccgaataatggtccaccggaaaagaaatttgatccgaggtaacggggcaaatagagaatggattctactcc

SEQ ID NO: 1165 - DNA, 548 bp, Triticum aestivum
  unsure (1)..(548): unsure at all n locations
  Clone ID: PAT_TA_1165
acagcacctgtccgtgcttcgccaacagcgtcgcagacagcctcgccgcttccgcggccacctgcttccttggctcgcagtttctccataccctcgaacagccagagaacacccctcattacagtcaataagttgcttgaggccagaagtagcagagagagcagtgaaatttcctccccaccactcactccgttgttttcttntaccagccaacacaaaaaacaattaaaggcagcactcggagaaaagggtatgtcatagatcatgtcttcccattacacctaagctgcatccagtcttgctattgcagcggtagtcgcagatgatttaacaatagcttatctgacaaccatcatctagccggcttccacagaatccttgtgacaactacctgccaattgtgtatcgctcttagacaattttgatgtaattagtggtgtattttaggttcttgttcataatattctatcacttaagcgtttgtcttgtgaaatgaaagaaaaaaaccgtgaagcaatttacaaaaaaaaaaaaaaaaaaggccccta

SEQ ID NO: 1166 - DNA, 1188 bp, Triticum aestivum
  Clone ID: PAT_TA_1166
cacccgcgcgccccccccccgccccccgcgtgccccggcagcccccccgctcttcccggagtacccgcccggcggccagccccaccttcgtgccagccatccattccaactcccacaagaaggtggtggagatgcgccagaaggttgaacccaagggcgacgacctgctgcagttcatccgccgccgggattgagcctgctcccgcgccggccggcaccgcccgccggaccctccgtcggtctcgtcccccttagctactacatatcgacgctggctagtatgtatgcatagcttgcatcctaggggcatgacatcctgccgtccatccccgtcgtcaagtgagctccccgcaccggcatcgctcgccggacggtccatcccgcccccctccgcccttgaattcgcctgccagccagcatggcggcagtgcattcgtgcttctaacttgtctgtcagtcatctttttcgttttgtcaatgccttgcattgccttcatgtatccacccactatcatcgccatgcatcggtttcatgtcagcatccatccatccatcaaatcgccgggtatcctgggcgttagttcaatagggcttttcttttgggtttactccaactctttttcttagtctattacttaattggttccccctaagaagatttttcgtttgtataggggagggtgagtgaggagggcaggagaaatagatggatcaatcacagagtcagtgggttgttgcattgcagtggcttgcaaattaggtactaggtgagaaggagagctaaaccagcagcagcagcagcagaggcagaggcagctaggcagtcaattaggaaagttggtgtgctctaagcaagagtgaagtcaaggagatttgtaagttggtttgctaagttagagaaaactttgtgtcaagtagtagccatcaggaggttgaagtagggggatcaccaatcatagtcagcagtttatattggagcttggtgtactcaactctgaatattctttttgcagttcatctatgtttagggatttataagtggtgtctttcttgtgttttatactactagtgttacctttttttttactagtagccattaattaagattcctttttctagccaaaaaaaaaaaaaaaaaaggcccctatcctggcatcagccctagctcccgggagcataatcaaaaaa

SEQ ID NO: 1167 - DNA, 710 bp, Triticum aestivum
  Clone ID: PAT_TA_1167
gccggccgggctttcactctcaccatcttcaagactcttcacacacactcaactcaaaccacaaccaaccaatctctcttctacacatccaacatgaagttctccgctgccgtcttcaccttcatcgccgctgccggcgtctcagctgctcccgctgaggaaaaggctgtcaacatgatggccgccgccccccaatggaccatccgcgacgccaagcgctactgccgctccgacgactccatctgcaactggaagttcggcatcgacaccggcaacggcaagccctacgagtgccgccacgacgtcaagggccccggcgcctccaagaagcgctccgccggccctaccacctgcggcgacttcaccgtcacctctggctggagcgacgtctttggcgccgacaacggcttcaccactctttctgtcgtgtccaactctaagcgtcagatcatctggcctgcttacaccgacaagcagcttgctggtgccaagattgtcaagcctgatcagtcttatgctcctgcttcgctccccaaataagcgatttcatgaatgactacgacatacgataatgaggggattcgagaaaggattggggcttttagctgcatataatgggctacttggtacatatttattacaattcatgcctttcgaggccaggaaatttacatatttgagttgagaaaaaaaaaaaaaaaaggccccta

SEQ ID NO: 1168 - DNA, 1373 bp, Triticum aestivum
  Clone ID: PAT_TA_1168
ctcagccagcgggcgatccgcgcgatcagtagtcccagtcccagaactccgagctaggcaacaatggcgtcctctccgctgctcgtggcgcttgtgatggtctcggcgtgcttcctggccgtatccggccagaagttcaacgccatctacagcttcggcgactccatgtccgacaccggcaacctctgcgtcaacggcccccccgccggcctcaccctcacccagcccccctacggcgagaccttcttcggccgcgccacctgccgctgctccgacggccgcctcgtcgtcgacttcctcgccgagaagttcgggctgccgctgctgaagccgtcgaagcagggcggcgcgaacttcaagcagggcgccaacatggccatcatcggcgccaccgccatgggctccagcttcttccagtcactcggcgtcggcgacaagatctggaacaacgggcccctcgacagccagatccagtggttccagaacctcctcccctccgtctgcggctcatcgtgcaagacgtacctgtccaagtccctgttcgtgctgggcgagctgggcgggaacgactacaacgcgcagctcttcggcggctacacgccggagcaggcggccgggcagagccccaccatcgtggacgccatcggcgccggcgccgagaagctcatcgggctgggcgccatgtacgtcgttatccccggggtgctccccgtcggctgcttccccatctacctcacgctctaccagacctccaacgccggcgactacgaccagtacggctgcctcaagcggttcaacgcgctgtcggcccgacacaactcgctgctccagagcaaggtgagcagcctgcagagcaagtacccctacgccaagatcatgtacgccgacttctactcccacgtcttcgacatggtcaagagccccaccagctacgggttcagcacgaacctgagggcgtgctgcggcgccggcggcggcaagtacaactaccagaacggggccaggtgcggcatgtccggcgcgtcggcgtgcggcaacccgtcgtcgtcgctgagctgggacgggatccacctgacggaggcggcctacaagaagatcgccgacggctgggtcaacgggccctactgccacccggccatcctctcctagaggctagagcgagctcccgctagcttgtcgtttggttgttcctttccttcctcaaagctggggagggaatggattactattatttttagcagggacagaagaagaagaagatgtgttgcgagaataagcatcgatttgattaattctcgtgtaatttgcgcttgggctgaatgagattcggcggttatttatgtgctcgattgaatgtttgatgaaagatgaaa

SEQ ID NO: 1169 - DNA, 838 bp, Triticum aestivum
  unsure (1)..(838): unsure at all n locations
  Clone ID: PAT_TA_1169
gccggccgggctccgagccccaccccaaccccatctcccgctgcctcctgctcctcccgtcaagaaccctcgcagccgcagcgacgacgatggccgccaccaacggcgccaccgccgccgccgaccccgtccaggagcagcccaaggcggcggcgccgctgctgctcaaggtgaagcgcctgtcggccaacgccgtgctgccgtcgcgcggctccgcgctggcggccggctacgacctctccagcgcggtggaggccgtggtgccggcgcgcggcaaggcgctcgtcgccaccgacctcagcgtcgccgtcccggagggcacctacgcgcgcatcgcgccgcggtcggggctggcgtggaagcactcgatcgacgtgggcgcgggcgtggtggacgccgactaccggggccccgtcggcgtcgtcctcttcaaccactcggacgccgacttcgccgtcaagcccggggaccgcgtcgcgcagctggtcgtcgagaggatcgccacgccggacgtcgccgaggtggacgacctcgacgccaccgtcaggggcgagggcggcttcgggtccaccggcgtctgatgcccagcctcgacggaaggcaaggcaggcgtatctatctaggtgctgatggttcatggtgaaagagctgctggctggaggcgacctgtagctatgtgttccaatgggaagcactgtcatttctgaatttacttccatgttagccaggtagatgtagtaagtatgcagtctcttttctcttggatggcttggattatggttatggtgaaggatctcaatcgtgtaaccatgcttcgtggtcttctgaattccatgng

SEQ ID NO: 1170 - DNA, 826 bp, Triticum aestivum
  unsure (1)..(826): unsure at all n locations
  Clone ID: PAT_TA_1170
gccggccgggttccggaatgcaacaaatcatttcatcctcatcacttgcctcttactttctacaaccttcagccaacccctataacattcgcaatgcgtttccagatgatcccccttcttgctgtcgccagctgcgcgactgtcaacgcaagccccgtccagcatgagcctcgtgcagcaggatgcagctcatacaccatcatcaacaccagaggaaccggtgagatgcagggcccctcatccggtttccgaacaatgaactctcaaatcacttcccaagtctctggcggaaagatttacaacactgtgtaccctgccgacttcagccagaactcggcatcaggaacccgtgacatcgtcagaaaggtcaacagcgtcctgtcgtccaaccccagcgagtgcttcatcctcgaaggctactctcagggtgctgccgctaccgtcaatgccttgtcacagctgactggaagcgccaaggatgccgtcaaaggtgtcttccttatcggtaacccgctccacaagcgaggtcttgagtgcaatgtggacaacaagggtggcgacactaccaagaacgtgagcggaatttcagctttcggaggtggtggtattcctcaggactgggtctcaaagactctcgatgtctgtatctatggtgatggtgtttgcgataccacacatggctctggaatcaacggccctcatctgcaatatcctagggattcgtccactcaggacctcggaactanatatgttgtgaagcagctgactggctccaactagcaccattcacgatgggtggatcacgacatcgagtcccttgcaactt

SEQ ID NO: 1171 - DNA, 726 bp, Triticum aestivum
  Clone ID: PAT_TA_1171
agaaggctgaaaaacttttagcaacgaatcttcctttcccatacacctcaaatgatgtgtatgaaaatagcatgcgtatgcctcttggacctgatttcaacccagcaatatcactctctgctcttaaccgacctgcgattgtgaagaagcctggtgttgttattaagccaatacagtacggggaaattgatccgcatgagaagcctgatgaactcaagcgggtcattcagagagtaaaaccgaacccaaacataaagaaggcgtctgcgaaacaagcgaagaggacagcttcacatcggaggactggatgagacagtagtacccagttaatgtggtgagagatgcgcataacagaatgcgggcctgggttttcttgccatggctattttcaaacacttgagaagtatacaaagattcttctcatggagtcaaacgacagctttggtttggctattggaagcgggggttttggggtgccattgttcacacacctgtgctgtattgagatttgaaattttgcagctggttcctgcaccagggccgaaatatgtttgtacgcgggaagtcgcaagttagtgtagtgtttttttctatgtggtatctatatgtagcacaaaattaaagagcaccgtttgcttctcgtctcgtctgctcctagattcaacaggtctttcatagtatgtattctcaaatcttaaagttcgaataccaatattttctaccttt

SEQ ID NO: 1172 - DNA, 917 bp, Triticum aestivum
  unsure (1)..(917): unsure at all n locations
  Clone ID: PAT_TA_1172
cttccttcaggntggtgaaagacatgaagagccaaaggaagaggaagaaccttaaangtaggaaggatgcaaagctaaaacacgttattatttctgagcatgttgacaagaaggctngaaaaacttttagcaacgaatcttcctttcccgtacacctcaaatgatgtgtatgaaaatagcatgcgtatgcctcttggacctgatttcaacccagcaatatcactgtctgctcttaaccgacctgcgattgtgaagaagcctggtgttgttattaagccaatacagtacggggagattgatccgcatgagaagcctgatgagctcaagcgggtcattcagagagtaaaaccgaatccgaacataaagaaggcctctgcgaaacaagcgaagaggacagcttcacatcggaggaactgatgagacagtagtcaatacatacccagttggtgagagatgcgcataacagaatgcggacctgggttttcttgccatagctattttcaaacacttgagaagtatacaaagattcttctcatgcagtcaaacgacagctttggttttgctattggaagcggggtttttggggtgccattgttcccgcacctgggccggattgtgtttggacctggggcggcgcgtgcctgcaccggggccgtgtcttgttggtacccgggtagtcccaagttagtgtagtgttttttttctacgtggtatctatatgtagcacaaaattaaagagcaccggttgcttctcgtctcgtctgctcctagattcaacaagtcttccgtggtaggtattctcaaatcttaaaagtttgaataccgatattttctacctttaatttatcaattctgagctattcatgtataaacttcaaattagagaaatcaaagtctcacatttgttaaaaaaaaaa

SEQ ID NO: 1173 - DNA, 1249 bp, Triticum aestivum
  unsure (1)..(1249): unsure at all n locations
  Clone ID: PAT_TA_1173
ggtccggcgtcgtnnggtgaagcgnttcnccggcnacgcacacgttccccttgctgatgctcccgaagaggagcgacagcggcgggcggtaccgcagcggcgccacgagcacgtcgttcatctcgctcctctcgaccgcttccagcacctcggcgggggccttgatgctcctcagcttggccagcacgaattgcttcatctccgccgggctcgggtcgacgtcctccgtgccgtccggacaggaaggcgaccacgtcaggaaccagtacacgtccgtgtcgccgcagggcaccaggccggcacggaagccgttgccgctgaactgcatgaacttgggctggaagccgtggccgtcggggtacttggcgtgcccccgcgtggccctgcgccctgagtcgagcggcttggcgagccccagccatttcgccaccaccgagttgatcccgtcgcagccgatcagcacctttgctcggagcgtcgagccgtcggcgagatgcaggatcttggcatcgccgccggccgctttttcagttcgtgtctgctggagatggctcctggatatctcacagtttgccttgcactcggagatccagctctcgcaccgctggagcacgtgacggtgcacgcaccgggcttcgtgcgattcgggaggagaatgcacctcgtgataagcttcagaaacaagatggagattgagatcgagctgtactgtatacgtacccctgaacctgcaggtggtggctcctcatcttgtcgccgacgccgagggcgtcaagcgcgcggaaggcgttggtccatgtcatgaacgcgaagccggacgtccggagcgccggcgacgactccagcaccatgctccgcacgcccttcctgcatacatccagtgatcatcgtcaagttaagcctgtgtgccacacacaacacaaatgaagaagctggctagcgttcaccaagaattcagagagcatgtgagtcgtctctgcctctatggagatgtgactggtgtgccggcgtgtacctgtggagtcccagggcgacaccgacaccggcgaggccggcgccgacaatgaccacgtcctcggcggcgtcctgctgcggttgcatgtttgcttgcactggctccgaagacgactgatctattcggtttgttgtgtgtgctcgcgggttactttgagttggtttcaactcatctatacgtaccattcagcaagtcaatgctatacgtgaaaaaaaaaaaaaaaaaaggccccta

SEQ ID NO: 1174 - DNA, 1012 bp, Triticum aestivum
  Clone ID: PAT_TA_1174
ccacgcgtccgggatgctcatgttgcgggccgccaccgccagggcggcgtcgacggtcgtcgccggcgccaggaggagacccggcctcctgcctgtcgctgtcgccggtctctcgtcctcctcatcaggaccaccatcgggcgggaagaggaggaagggccagcggcggggcgaggccaagccccagccccagcccttgcctgggcactccgagatccccagcaacaagaaggccaacgcgaggccggccaaggacaggaggaaggttcgcccagcggaagaggcgccgcaagggccgtcgggccagggccaggagattgagttgaggaagcagccgccggagaagccgaagcgggtggtgcggtggcgctgcgcgacggggtgcggcgcgtgctgcaagctggacaagggccccgagttgccggccgccgtcgaggtcttcgccgacttccccgaccacctccagctgtacaagagcatgattggccctgacggatggtgcaacaactacgacaagtccaaccgaacctgcaacatctacgaagaccggccattcttctgcagggtcgaaccgaaggttttcgaagagttctttggcgtgccacgcagcaagttcgacagggaagcctgcagtgcttgtgtggataacatcaagattgtgtatggccaggactctcctgagcttggaaacttcaagagggccataagggaggaaagtagtaagcatgaggcaagcatgaacgaggttaaattgttggatgccacaaatactactggtacctgattaattacggagtgtagggtactcactcaccgaagcagttgaaaaccggggcacaaatactggtatctaattctcacctatgaatgagtatttaagtttcgaatcctgttctgctcagagttgagtttttttttggcactccgctgtcaaattctgatgataacagccttgtgtcactctaagttttgttctgaatgatatcaaaaaaaaaaaaaaaaaaggccccta

SEQ ID NO: 1175 - DNA, 905 bp, Triticum aestivum
  Clone ID: PAT_TA_1175
aatttaaacctgcaccgaacccgaaacaggccaggactccacgagtcaagtcagccacctgccagccagccagccttcaacgctcacccaccccgccacgaccacgaccatgtcctcctcctcctcctcgtccatgggcgcgctcgccgcggccaccgccatggcgctctccggctccctcgtcctcttctccctccgccgcttcgccaagcccagcctcgacgacgacgcccctgcctcggacgaccccgcgtcccttcgtccatgcctctccccctcctcctcctcctcctcctcctcagacaagcggccgcgcggtgggaagctgcggcggaagggggagaagcgggtgcgcttcgcggagggagtcatcgacaatgagggcgcgccccccgcgaccaggtcctcctccgcgcccccgccgtcgccggcagcggccgagccgacgtgcaggggaagcgtgacgggatcggaccaccggatgccggcgaacagggaggcgctgtaccgcggcatgctccgcgaccgctccgtgcacaggaccgcctactcctactgaccggtcaccgaccggccgacccgacgcccgctcgccgccgtgctcgattagttaccagagctagattagtccagcccgtccccgtcccctgcttttgcttggtcctgttgcttctttcttgggttgccgttggtgtctggttgctttggcaggcaggcaggctgttgactcctggtgtgcaaatggattgttagccaattaggagtagcagtagatgatttacgctttggtgtcgatctacctttgcatttcctgtgtacataaaaccacctgtcatgttccttcgtcgaagatgaaaaaaaggatgatggaagcctgggtgcaaaaaaaaaaaaaaaaggcccct

SEQ ID NO: 1176 - DNA, 763 bp, Triticum aestivum
  Clone ID: PAT_TA_1176
gccggccgccagctcgatccccccttctattgctcgcagcctccttcctctctcagacgcacaatccatcgcagcctcctccctcctccgctgaagccgtgccgcggctacgacgagctcgtccgactggccggccggagagtccctcgtcgcatagtctaaccatcggaggaagtggtccgtcagttggtctgagcttctcatacgatccctgtgcctacaaggatggagaggagagcggcgaggggcacctctgatcaccgtaggcgaatgcagatgccgccggcgccggtggggcagaagcagcagcagccgcagcgccgcggggggccgaagagctgccagagaacgccgccgccgccgggctgcttcaccatccagctgctcatggtgttcctctgggtggccgcgtcgctcgccttcctgcccctcgtgctcccgccgctgcccccgccgccgctctcgctgctgctcgtgcccgtctgcctgctcgccgtcctcgccgcgctggccttcgtcccgctcgacgcccacaacaacgtcgtcgtcggcggctcgtcttgtttgtagggaggctgcatttttttttcttttccgtgtcggtcagagctggctgttaccagatctagcctgtagtacaaactgtgaacctttttttaagattagaattattaggattaattaagagaggactactttttgactttgtaatcccttgaactccggcaatgtccatttgagacctcacgggatttatgcttac

SEQ ID NO: 1177 - DNA, 888 bp, Triticum aestivum
  Clone ID: PAT_TA_1177
agtgcccagctcgctcgctcgctcgatcgtcctctccgccgtgacgcagccagtcgccatggcctccaccgcgctctccaccgcctccaaccctacccagctctgccggacccgcgcaagctcgctgtgcaagcccgtcaagggcctgggcttcagccgggagcgcgtcccgaggaacatcacctgcatggccggcagcatctccgcggaccgcgtgccggacatgagcaagagggagctgatgaacctgctcctgctgggcgccatctcgctccccaccttcggcatgctcgtcccctacggttccttcctcgtcccggccggctccgggagcaacgccggaggggtcgccgccaaggacaagctcggcaacgacatcctcgtcgaggactggctcaagacgcacggccccaacgaccgcacgctcgcccaggggctcaagggtgatcctacctaccttgtggtggagtccgacaagaccctcgccacctacgggatcaacgccgtgtgcacgcatcttggatgcgtcgtgccgtggaacgccgccgagaacaagttcctctgcccctgccatggatcccagtacaacaaccagggcaaggttgtccgtgggcctgcacctctgtcgctggcccttgttcacgccgacgtcgacgacggcaaggtcgtcttcgtgccgtgggtggagaccgacttcaggaccggcgacaacccgtggtggaaataagcgacgcaagctccggcagcaatgctcactcgtgtgatatgttaagcctcctgccagtcctaagaacgctgctataagactactcctgctataaatgcacctgtttcttgtatccagttatatgtatacagtctatggaagaagagaaaccttttcattgc

SEQ ID NO: 1178 - DNA, 1241 bp, Triticum aestivum
  Clone ID: PAT_TA_1178
cgggcatgggctaggatagacgtcgtgccgaattcggcaccaggccaggctcgctcgctcgcttcgatcgtcctccccgccaccgcggccgccccggcgccctccaccgcttccgcgctctccccgccctgccgcccccacgcgggcgcgccgggcacgcgcaagatcgccctgcgcgcccgccaaggacctcggctccagccggcaagcgcagcccggcgggacaccacctggcgggccgccagcatgtccgcggaccgcgggccgggacatgaccaagaggtagctgatcgccatgcccctgcccggccgccggctcggctcccacccccaggatcctcgtcccctacccctccttcctgctcccgggccggcaaccgcggaagccgtgcccggcagggaccggcctcaacaaccggcatcggcgtcgacggcctggtcgaagactgggtaaagacccccagcgaccagcaacgctcaggctgccccaggggctaaagggtgaatcctccctaccttgtggtggggaccgacgacaacgctcgccacgtacgggtatccacgccttgtgcacgcatcttggatgcctcgggccgtggaacgccgccgagcacaagttcgtctgtcgctgccgtcgatccgagtaccacagccagggcaaggctttgcccggtatgccctgcacctctgtcgcaggcccagggtcacgtccgacgtgcgcctgcagccctgttcctcttcgtcgtggttgggcggcgagccgtacttccagggaccggcgcacacctccgtggtggtagataagagaacgcaagcaccggccgcagtgcaccactgcttgtgatatgctaagcctcctgccgagtccttaagaaactctgctatataagaagtcctccgcgcgtatctatgaacccttgtttactacgaatcccgctttatatggtattcagtctatggaaccaagtgtatgtatacagatctatggaaggagaaacctttttcattgcatatatagtagtatcacattttgagggctctgaatctggtagtacctacgatgtagacgactctttttctatagcagatcaaacctgaacctgaatctacacctagatagcaatctgaatagttaaagaggtagcatggcatatctgcagcattgttcaaaagggcaatgcagagtcgatatgttctgggaatgatacaagccactgtctctagaggctattctctcaagt

SEQ ID NO: 1179 - DNA, 645 bp, Triticum aestivum
  Clone ID: PAT_TA_1179
gccggccgggttcaatcatcgagaagctcgatcgagcagctacgatggtgcgggcgttgggtctcgctgctggctcggtgcactacgcgcccagcaacgttgtgggtctagctttcggctttgtggctgcggttgcaatcgtggccatcgccgtgtttggctgcgccggccacaagaagcgtcccgcggataagaagcgcaaacgtcgtcgcggaggcggagacgatggcggcggaggaggggatgacggcgacggatatggggacggtgggggcggaggcgacggtggtggtggcgggggaggcgacggcgggggcggaggaggctgctaaggaaagtcatcgttcttgaggcagagagataaacgcaattaacattgtctgccttgatatatactactccctctgtcttaagacgttttttttgacaataccataatgtcaaaaaaagtttaccttttgtcagacagagggactacttctgtgttgaattttcatgatacttgactagtcagattattttgtaatttcggctgtacctatattttttttgcgagtgaagagtttttattccgttacaacaggcttaaaaaaaagaggctgtacgcctgtacctatgttgataatcaaaaaaaaaatcccccta

SEQ ID NO: 1180 - DNA, 1418 bp, Triticum aestivum
  Clone ID: PAT_TA_1180
cgagttttttttttttttgtatcaaactgttacctcattcattccagtatcgtagagagaacggcccggttaaaacaacaccgccaaccaggcggcgtcaggttattcaggtgtccatgcagcgcgcacagatgacaaaacggaaccgaaccgaaattcttacaaaaagatgcaccatactgttctgagtttggcactaattgccgtggcgcgacaagaaaaaaaggttcagctgcggtttattttactgccatggcaggcagcgggcatgtcagcgtcccctacgtttccgtgatcgactcaaaatttgtataccatatctgccgtgtatcctaaatctttgagaaggcccgtgacctcgccctgtgaataatcctttgccttatctccagatatgtgattcatcattccaggaggaccacaaacaagaataagagaatcctcccctgggcctggcaaacctttcaaaaccatgtcctttgatatgtagccagcaccacccctccagtcacttgatggtttatcgactgtataaaataccttgaaattaggatagctgctggcaagtctatctaactcctttttcagcaagatatcatctggtgacacattggcgtagatcaaggaaacctgagtgttgtcatcagggtttttcaggatggccctaacaacttgcagcattggcgttatgccagtaccaccagcaaccatgccaatttgtcttttcatatttgggctatatctgagcttttcaatgggccctttgacttcgagaacatctcctggcttcaaattagcaaaatgctgagacattttcccttcgggataaaccttgattaataggtcgaaatatcctttagaatctgggtcagagataggtgtgtacgggcgaataacgtattttctttttccctccacttcctgacctatgggggcccttgttacgagacatgaggcaacatccagacccagcttagtagatgggtcaaacgaaaatctgaatagctctgaatcatgactaactgttgccttctcctggagcttgaattctaaccatttctcagggttaagagcaactttggcagcggcatcttcccccttctcctccatgtgcgcgatggtggggttcgacgaggcgtagaagagcgcggccccgccaacggcggcggcggccagcggcgcgcggccgcggtaggttccggcgagcctacgcatcagcagagccgccatgttcgaggcgggagggccgcgtcgcggcggagggatccgatctggcgaggggctccttcgccggcgcggcgtcggtggtggcggaaataaagcggggggcggttccgtctcgcaacggaagccgatctggggagtagatcgggagtgtggtactgtgggagggtccggccggccgcctcgagcggccg

SEQ ID NO: 1181 - DNA, 640 bp, Triticum aestivum
  unsure (1)..(640): unsure at all n locations
  Clone ID: PAT_TA_1181
nnnnnnnnnnnnnnnnnnnnnnnnnnnnnnnnnnnnnnnnngcntctccatcnccatgtgccccacccgggataaacaggctctcaagtcaaagctcagagtcttcagttcgtccccacctctacacangccgccatgagcatggaccaaagatgcagtattgctcttggccaggaccaggtcgctagttgggcaaatgagataagaaactcgtcaggaatttggttncccctttgtctccatgtccccagcatggccgtgcggcttcctcgaaggaaacgtcacccaacgagtgatctgtattggtgatttttgtagaagacgtgagacgatcgagatgttttcacaggcaaaggctgatacgatgataagggaataaagtaaaatgtagtgtgtactagaaaattcgcagtatggatgcaacattttctttttgagaatttagtagattattaatttcttggttccaaatactattagatagttttgtctgggttgctgatgtggaaaaactgaaatacaaggatgcagtccctgtttgtcatttccagtgattacgtcccccaaaaaaaaaaaaaaaaaaaaacccacaaacacacaaaaaaaaaanccccggacgcgtgggcggacgctaggtcga

SEQ ID NO: 1182 - DNA, 878 bp, Triticum aestivum
  unsure (1)..(878): unsure at all n locations
  Clone ID: PAT_TA_1182
cgtccgcccacgcgtccgggcccgaggcgtacaaaagtcttggagtagcgatgcgccccgctccgtaatgggccaataggacaccactccatcatccccgtagccgcctccgtcgtgcgcggtggccgccgcctcggccggggacaacttcttcttggggccttcgtccccggggccgcctgagccgctgccgcagcgcctccgaacaagagcgtgagatttcaagtatgtcgccaaccatggaggagccccttgttgacaagactggagggccaaaggagagcttggtggtgactgaggtcaagaagcagctgtacctggccgggcctctcatcgccggatgcctgctgcagaacgtcgtgcagatgatctcggtcatgttcgtcggccatctcggtgagctcgctctctcgagtgcctccatcgccacctcctttgccggtgtcaccggcttcagcttgttggctggcatggcgagcagcttggacacactgtgcgggcaagccttcggggcaaagcagtactacctgctcggcatctacaagcagagggccatccttgtgctcactctggtgagcgttgtggttgcggtggtctgggcctacaccgggcagatcctcctgctcttcggccaggacccggagatcgccatgggggcggggagctacatncgatggatgattccggcattgttcgtctatgggccgctgcagtgccacgttcggttcctgcagacgcagaacatcgttctaccggtgatggcgagctcggacataacggagctcagacacatgctcaagtgctggatgctggagaacaagattgggtctgatagacaagggacgctgaacctgagcaacggcgtggtgggacctggg

SEQ ID NO: 1183 - DNA, 1946 bp, Triticum aestivum
  Clone ID: PAT_TA_1183
agcgagccagcccctccgtactgcgccgagagggctccactccctccccgcagccgcctccggcgtccgcggtggccggcgcctccggcgcgcacaccctcgcccccttggggcgtccgcccccgcggccccctgaggcggtgtctgaagttccacggatgctgctagacatggaggagccccgtgtggggcgcaggatcgagaagacaggagggccaggagagagcatcctacttgagataggtcgagcaacgggtaccaactgggggtccaggggccatcaggagcaaggtgcagattgtcgtctagtcgctgcctgtcaggtttgtcgccctgctcggggaactcggtctctcgagtgcctccatcgcgacctccttcgccggtgtcaccggcttcagcttgttggctggcatggcgagcaacttggtacccactgtgtcggcaagccttcgggagcaaagcagtaccatctgctcggcatctacaagcagagggcaatctttgtgctcactcttgtgagcgttgtggttgcggtggtatgggcatacaccggccagatcctcctgctcttcggccaggaccctgagattgccatgggagcagagagctacatccgttggatgatcccgtcgctgttcgtctacgggccgctacagtgccatgtccggttcctacagacgcagaacatcgtcctcccggtgatgctgagctcaggtgtcaccgcgctgaaccatatctttgtgtgctggttgctcgtttacaagcttgggctgggcaacaagggcgctgccctggccaatggcatctcttacctgaccaatctgctcatcttggctctctacatcaggctctctccatcctgcaagagcacttggacagggttgtcaatggaggcgtttcgcgacatccttagctttttgaggcttgccgttccatctgctctcatggtttgtttggagtggtggtcatttgagctgcttgtacttttttctggatttcttccaaatcctaagctcgaggcgtcggtgttgtccatcagtttaaatactctttcactagtattcagaatcccatctgggcttggtgcagctataagcacccgagtatcaaacgagcttggcgctgggcggcctgaggctgcccgtttagcgacccatgtgatcatggctctgggtcttgtgtcgagcgtatcggtcggtcttgctatcattttggtgcgcaatttatgggggtacgcatacagcaacgaaaaggaagtggtggaatacattgccagaatgatgccaattcttgccgtgacattcttgtttgatgacctgcagtgtgtcctttcaggtatcgttaggggctgtggcttccagaagattggcgcgtatgtcaatctcagcgcgtactaccttgtcggcatccccgcggctttatattttgcctttgtgtaccatcttggtggaatggggctgtggttcggattaacctgtgggcttgtcgtgcagacagtgttgctcatgtccattaccctgcgcaccaactgggacaaagaagctttgaaggcaaaggacagggttttcagttcttccctgcctgtagacttggcaacatgagacacacaagacaagatgcacaattttctcgggaaattaggcagggagatgtgcatggagataaggaaccaatgaggaattggttgctaaaatggtgcttcactggcatgtgcaattcttcacagaaacatctggaaataggcgatccgctttggtaaaaacaatttggatacggaaaataaaatgttaggatgagtagaggcgcagtactacccttgataatgtaagcaagggaataaaatgtctcttcactagaacccatagtgtggatccaggatttcctgagaggattgatgagattattctcttcacggaaagaatatatatataatgctcaattgc

SEQ ID NO: 1184 - DNA, 601 bp, Triticum aestivum
  Clone ID: PAT_TA_1184
cccacgcgtccgtccatcgatctccgtctccacatcgtacgtttcaccggggaaccatctatggtctccatggcggcggccaagctcgccgtcctcctggccgtggcggcactcttcgccgtggcggaggcagcgaatccccaggaagctcactgctggcagtgctactactcctgcatgcagcagaagtgcggcggctaccgcaacccagccgcccacacagccgtcgacgacggtacggcggccgcctccgtccccctcaactccaccgacggcactacagccgtcgtgcaccccgccgatggtggtgcagccgcccacgtcgccggtgggtacgagagctactgcaagtgcaacaaggcgtgcatcgtggactgctacaaggccctgccgccggtatgctaccagatgtgcgtctccgagacctgcgccaagctgccgccatgtaagcaggcggaatgctacaaagcatgcggggacaaatgctaccacaagcagccgagcccgggcccgaagccaccaagcccgaagccgccaagcccgaagcccactccgccaaagtccgcaccaccgaaccacggtggttcaccgaagcccacac

SEQ ID NO: 1185 - DNA, 672 bp, Triticum aestivum
  Clone ID: PAT_TA_1185
gccggccctcatatagaggaaataaacctgtctcccgctcgtggccgatcaagctcgctcgctcgcaccgacgacgacgactaggaagaagaggaacggccgatggagcacggcgaggggaggcacgaggcggcgctgagggcggtgcagagggcgccggccaagccgtggcgcggcgccggcgccccgccgccgcccagggtgtaccgggtggagccccgggacttccgggagctcgtgcagaggctcaccggcgccggcacggccacgaccggctcgccggccgtgggagcgaggaaggcgccgggtcatgcggccgcggcgcacgggcgcagggaggccgcccccgtggagcagttcgactactcgtcgtggttctccgcgccgctgctcagccccgcgtccatgccggccggcatggacgcccaccatggcgctctgctgtaggagagttgtgctacggtcgccgctcgccgccactcggcacttgtaaaatcgagctgcatgccacagttccatcgcttcttccctcctcattatttcctttcgagggatgatgacacatgacagtgctttcgctcgtgtacgtaattgagtatagttctttttatgaataataaatgaattattagtttgctctgcaaaaaaaaaaaaaaaaaaaaaacctaaaaa

SEQ ID NO: 1186 - DNA, 722 bp, Triticum aestivum
  Clone ID: PAT_TA_1186
cccacccgtccgaataaatataccattgggggttgccgatgagctgtgggccaatgagtgagagtgctcaagacatcatgctggaatccttgataaatttcgtatagagagatcacaatctcaatagccagcagaattatgacaccccactccagaaaattcgaccgtctattttggagcacttcttgaagaaaatgaatattgtgctccacgaatttcagtttgaagtctaggcttccaaaacgttgattcagttcatattcttcccgaagatactccagaatttgtgcataatttgcatttttccaagcaatttctgacctgtcaaaaaggccgagtctaatgataacatctgcaagattagaattagccttgcccacaagttgaaagagcttctttcttttcattgtgaagtccccagtcttctccatgatacgattgatttcagtaaattcctcaaccatatcatcgacctgccgtatgtaatgatcaagagcgatactttgaccaagaacacttgaaatgatccgaattccatcagtgtctaaatatttaagaactatataatcaagacctcctttcatccatgttgtcagggatcgcttctcaactactgcataatcgtctttcctcatctccggaagccatcccgaagcatgattcctgatcatttcaagatagtgctcagcttcatgatcagcaatattgaagagcaccggacg

SEQ ID NO: 1187 - DNA, 597 bp, Triticum aestivum
  Clone ID: PAT_TA_1187
cggggtccctaaaaaaacggaaaaccaaaacgggggtcaaaaatccgtataaaatggcaagcaaccggcaatcccaaaagcaaaaaaccaaaacaaacacggcaaatcaacggaagctaaaatgcatgtaaaattaattatcccgaggtgaacatacatgttaccaaagcagggacattttaatttcaaaaaaaaccatagatcattaggacattttagtacattgactgattttctacgggtataatgtgcaaaaatcaaatttgagctacatgcacacatgacagtgcacctaaatggattgcaaaaacacatgtgtctcactgggtgcatgtttactcctcgtgcaagaaatttcaaacattgagactcttaatttttaaattctagtacatccaaaacttatctaaagttcatgaaacttatcatgttgtcatctagacaccaatacaaagtggcattgtacttttttgtcaaatttgagaccagttttggtgtaatatgtatctaattacaaacgggagattattaataatttggaaaccattatcccaaatgaattatttattcgaaccgtgagcgttagacaaacaatgg

SEQ ID NO: 1188 - DNA, 974 bp, Triticum aestivum
  Clone ID: PAT_TA_1188
cgtctgtcccatgttcggaaacttggcagcaagaactgcctttaacggcaacatcaatatctgcatcatcgaaaacaatgcaaggcgcattcccaccgagctccaaagaaacctttttcacagtgtttgctgatccagccatcagttttttgccaacagctgttgaacccgtgaacgtaatctttctgacctgtgtgctctgcattagttcatcacctatctcaggagcattacccatcacaacatttagtgcaccagctggtattccagcttgaagagcaaggtctgctgcagctaatgctgtcagaggtgtgaactctgatggcttgacaacaacagtgcatccacaagccaatgctggtccaacctttctggttatcattgctaaaggaaaattccatggtgtaatagctccaactaccccaataggctgcttcagaaccaatagtctgcggtcagctagagtagggggaataatatcaccatacacacgctttgcttcctcagcaaaaaattctatgaaacttgcaccatagttcacctccccaagggcttctttcataggcttcccctgttccagtgtcataagaagtgcaagttcttccttgtgtgacataagtaggtcatgccattttcttagtgccttgctcctttcacttgcagtgagtttgctccaagtataaaatgtagtgttagcagaagttattgcatcagctgtttctctgttgcccatgcaggccacatttgctaggacctcgccagttgctggattttgcacctcggtggtcttcccgtcgtaggcgtccacccactggccgccgatgaggccgcgcgtcctgagcagccccgccgcccggatcttatccatcgccgcgcccgcgtccacgctgcccatctgcgcacccacccagcaattaacagaagaacacgacccaccgagcaccgccgccgggggggcgcgaggggtatgaagg

SEQ ID NO: 1189 - DNA, 2526 bp, Triticum aestivum
  Clone ID: PAT_TA_1189
ccccccccccctaaaaagcaccccccaagggggggccccttatcccaccaagaaggcaaaaattttggaaagaggggccgttaccaccttttccgtaaaaacccccgcgccgaaaaggggattcttcccaaaaggattaaaataggggcccccacgggttttcccccccccccccatgaaaaacccccccccgataaaaaagataattggccccaaaaaaaaaaaatattccacgccggcgcccggggggataaaacttttaatttctcaaaaccgcgcccccttttttttttttttttttttgtaaaaaaaagtagtaattttattttttattttttttttttttttttttttttttttttttttttttttttttttttttttttttttttttttttttttttttttttttttttttttttttttttttttttttttttttttttttttttttgaacaacgtttttttttttgcgtcaagtgaacaacgtgatgattattgagtagtatcaaagttcggagacgaagccgtgcttcacgtttcattcatttacaacccatttactcggacacggcctactctctttattccaagcttcttaactgccctccctcttcattctaacttgcaccttttattcggacacggcttactctctttattccaagcttctaaaactgtcctccctcttcgttccatcttacaccttacgcctgcatagctatccacgcttatcagcacacctggccccagtaggttctcgatccttcttctccattcaggtggaagcggatgccaacttcaagcatcaacccaggttgcccatgcatacatacttaatctccaggtagtcgtccatgccgtattttgatccttctcgcccaagcccagactgcttaaccccgcggtgattattagtactgtaccaaagttcagagacgaagccgtgcttcacgtttcattcatttacaactcattacaacccatttattcggacacggcctactctctttattccaagcttctaaactgccctcactcttcactcggacttgcagcttttattcggggacacggcttactctctttattccaagcttctaaaactgtcctccctcttcgttccatcttacaccttacgcctgctgagctatccacgcttatcagcgcacctggccccagtaggttctcgatccttcttctccattcaggtggaagcgaaggccaaactcaagcatcaacccaggttgcccatgcatacatacttaatctccaggtagtcgtccatgccgtattttgatccttctcgcccaagcccagactgcttaaccccaccgaatggcgctacctctgttgaaatcaatccctcgttcacaccgacaagcccgtattcaagagcttcagaaacacgccatgaccgcgcaatgctctttgtaaacatgtatgcggctaagcctgcattggtgtcgtttgctaaatggattgcttcctcctcggttttgaatggtataagtggtgcaactggaccaaaaacttcttccctgaaaagaagcatatcattgcttacattccctaccacagttggctcataaaagctcatcccaaggctgtgccttttaccaccgagcatgatgttggctccctttgtgctagcatcacctacaaacttctctaccttttcaacagcagcttcattgattagaggaccctgtgatgtactctcttgtagcccattaccgacttgcaaacccaatgctgctccaacctttccacttatcattgctaaaggaaaattccatggtgtaatagctccaactacaccaataggctgcttcagaaccaatagtctgcggtcagctagagtagggggaataatatcaccatacacacgctttgcttcctcagcaaaaaattctatgaaacttgcaccatagttcacctccccaagggcttctttcataggcttcccctgttccagtgtcataagaagtgcaagttcttccttgtgtgacataagtaggtcatgccattttcttagtgccttgctcctttcacttgcagtgagtttgctccaagtataaaatgtagtgttagcagaagttattgcatcagctgtttctctgttgcccatgcaggccacatttgctaggacctcgccagttgctggattttgcacctcggtggtcttcccgtcgtaggcgtccacccactggccgccgatgaggccgcgcgtcctgagcagccccgccgcccggatcttatccatcgccgcgcccgcgtccacgctgcccatgtggcggcggctggcgacgcgggaggaggcggaggcggaggcggccaggatgtggcgggcgccgagcgccgccgcgcgtcgcatcgccatcgccatctgaaggaagcgacgagtgacgggcggacgcgtgggcaactctgaacaggcttgacaaatgcccttgcgaattttttatagatacctttttggcaccaatttccggtttggacatccacacgtttgtccactgttc

SEQ ID NO: 1190 - DNA, 1820 bp, Triticum aestivum
  Clone ID: PAT_TA_1190
ctcgcacgacgattttgctcccagccctagccctccgctccctcttggcaaagaccccgcccactttagcttcccgccttgtcgttgccttccgcggcttcctctgggtgcacaacccgccctccttcgcccccaccccgactgcccccgactactcccttgtgtgcctctcggcggccatgcccttcggcctcatccaggcgcccgccaacccccccgtcctgctcctccctcctaccgtccacccccccgaacatcccataggtccttccggccacctccaagcctccagcgatcgtggcggccgcggagcccgcccacgcgcaggcctccgtgagcccccggccgccctccccaagtcggcctccgcgggcgccgcggtggccacgatcccgacggcctatcctacgcctccgcccactcaggcgagcgtcgagtcccgcgccaccttctgcgacttgtactacgccgtgggcgccgccagccgctcgctcgggttcccggccggctcgtgccccaccgatgggcgtcggaggccacctcagcggccggcggcttcggctcgctggcacgcaagcacggactctcggccgacagagtcggcggctcccgtgacgaggacgccgacggatggctgctggccaggggcgccaagtatttcaaaggaaatttcaagaggttggcagctgtgaagaccatggtggatccccgatgatttcttcaggaatgagcagagcatccctcctcttccccgctgccaaaatgatgtcagattccatttgagactcttaattttggtctctattgctaaatttgtgcgtcttggtgacgtgacgtgtttataatattcatggatgaaaaagtatgtgtatcgtgtcaagtttatgaaaaataataaataaaatggaatgatattgttccttaggctaaaaaaaaaaaaactccaggagcttggaatgacgaagcaaaattgccaggaggttagctgggtccagtccacggtcttcttcggcttctccacgacgtccataccaacggagcagctcctcaacaggagcagcaatccgcgctactatctcaaggccaagtccgaccacgtgcaagagcccattccaagggacgtgtgggagagcatatggacggcgtggctcgagaagcccgaggccgcgctgctcatgctggacccttacggcggcttgatgagcagcatctcgccatcgaaaacgccgttcccgcaccggcaggggaacctttaccagctccagtactactcgttctggtacgagaacgggacggcagcagcggagaagcgaatgagctgggtcaggggactgtacaaggagatggagcttacgtgtccaagaacccaagggctgtgtatgtcaactacagggaccttgacctccgggacgaatgagttggacggcaaccgtgacgagctatgagaaggccagagtctggggagagaagtatttcaaaggaatttttaagaggttcgcagctgtgaagggcatggtggatcccgatgatttcttcaagaacgagcagagcatccctcctcttcccgctgccaaaatatagattccatttgatctggtatgggcgctttcatttctttgggagtgtgcactgctcgtgattgcctttgcatgtcttagcggtttcgtctttgagactcttattcccttcggtctctatggctaaaacgtgctgtcttggtcatgtgacgtgtttataatcatgggtggaataaaaagaaacatgtatccgtgtccagtttatgaaaaataatatcccaaaggccaatgaaaaaaaaaaaa

SEQ ID NO: 1191 - DNA, 792 bp, Triticum aestivum
  Clone ID: PAT_TA_1191
gcttgcacacagcaagttcccaacagcatcaacagccagccaccaacgggaacaaacagccaccttcgccgatcatacatttcccggccgcagtctacaccttctcgccggttggcttggctgatcagtagtcgatccatcacagctcggcggacctccatgacgaagcaccagagagcaccggcggaccagctcgtgtccctctccctctcgctctccctcggcgccgtcgccgaccgcaacagcaagaggacgcgccgcgccgccgccgccggtggggagttcatgtgcaagacgtgcgatcgctccttcccgacgttccaggcgctcggcgggcaccggaccagccatctccgcggccgccacgggctcgcgctcgctctcgccgggaccgggccggagcccaggaaggccacggaccagaagcaggggcgccagcgccacgtctgcgggcaagggttcgagatgggccaggcgctcggcggccacatgcgccggcaccgggagcaggaggccgccgccaccgcggtggcgcaggcgccgcccgttcttctcgagctgttcgtctagattgatgaatattttgttaactttagttctagtacagagttcttgatcgacccgtgtagtgcacgtacgcgatttgtttgtacgttcctacacgcagacacactcgtagctagtaattgatcattggttcattcattcgtgtactcttgtgcacgtattcggggacttggtcattcattcattcgtatcgagattatatatacacgttaactgatttgcccc

SEQ ID NO: 1192 - DNA, 718 bp, Triticum aestivum
  unsure (1)..(718): unsure at all n locations
  Clone ID: PAT_TA_1192
cgggggcatacatatantcttcctgcaacgtcacagaatactgggctttacatttgaaaacaacaaaatcatatatcagcattcaatatgacaactgaggctgctgttcggaaattctttacctcgtctgcttatgcagtggcgggcgccagttccaacccggccaaatttggacatcgtgtctttgtttggtatcttcagcatgatctaccagtcacccccataaacccgggctctcagacgatcaatgcgctcaacaaggaccatgccactgttcctaatgtgacggctcttccaaaccctaccgagacgtctctctcagttatcactccgcctgcagcaaccctccaggtgctccaagaggccaaggagaagggaatcccatctatctggctccaacctggcagttttgacgatgctgttctcaagtttgccaactctccaggaacctttgaagctgtgattgctggagatggtggacgaggtcatgagggatggtgtattctggtagacggcgagcgaggaatgaaagcagcaggaaagttgtaagatgtgaagcttagtaggtagatacatattacaggggatgaaagaagacaaccaattgatattgtggttggcttcacagttctacaagctgtagatacccgtctactctgtacataacagatagcgtactgtatgtaggtctgatcgaatcacatcatatcaattgctc

SEQ ID NO: 1193 - DNA, 1004 bp, Triticum aestivum
  Clone ID: PAT_TA_1193
cgcaaccaaaaagaactcgttccaaatctacgcacccggcgagaatccccacgccggcgacggccgcgcccgacccccgcgccgccttcctcgcggcgccgcggatccaacgaggcatttgccagtgtttgtggttgtaatttgtggtaaagtctgagtaaatcaactttataagacattcttgaatatggtatcagtgaatgttgggttagtacattatgtattggaccatatatatgggactctccttcatcgcacgaaattaggaacaccatttttcgccccgcgcggccgaggtaccaaacttgatttgttagagaggatggtgaagcagctattccctgaagcaccttgccagaactggccaccaactgctgtgcagcctaaatggaaaacagtttgggagacaaagaactcttgtctgcgagagggagttttccggacaacatgtgatgagcgactcattgatgcattgcctcctgagagtcacaatgcaagagtcgcttttcttacgcccaaggatgtctcaccagagaagatggcttgcgtggtccatctggcaggcaccggtgatcactcatttgagagaaggctccggcttggtggacctcttttgaaggacaatattgcaaccatggttcttgagagcccctattatggacaacgacgtcctagcatgcagcatggggccaagcttcaatgtgtgagtgacttgctactcttaggaaaagccactattgatgaagctcgcagtctcttatactggttgcaggctgaggctggttatggcaagatgggcatatgtgggctcagcatgggcggtgtacatgctgcaatggttggatccttgcatcctacgccaattgccacactaccatttcttgctccacattctgctgttgtacctttctgtgaaggactttacagacatgccacagcttgggaagcactgacggaagatgcagcagcattagctaaagatgcaacttctttgaccgaagatg

SEQ ID NO: 1194 - DNA, 961 bp, Triticum aestivum
  Clone ID: PAT_TA_1194
gaggaataaaacacgagaaaaaaaaaaaaaaaaaaaaaaaaaaaaataaacctcctcctatggatttagtccacacctcagcctcagctcacctgctccgtccgtcctccttgggattgggagagaagagaccacgcgaaactcctctaaaaaataaaaatgaagagcaggaggcagagcggccgcggaggagccatggtcgccgacgggggctgcaagatggagcgcaaggacgtggagaagaaccgcaggctgcacatgaagggcctctgcctcaagctctcctccctcgttccggcctcctcctcctctgaccaccacctcagacactattcttcctcgccgccgtccagcaacaaggacgcggcgacgcagctggaccagctggacagcgcggcggcctacatcaagcagctccggggccggatcgacgacctcaagcgccgcaagcaggccgccctctccggcggcaccgccggctgctcatcctccgtctccgccggcgactacaaggcacagacgacttcgctgccggtgatcgaggtgcggcaccacgacggaactctggacgtggcgctggtgagcgaggtcgggcggccgttccggctgcacgaggtgatcgccgtgttggagcaggagggcgccgaggtagtcagcgccagcttctccgtcgtcggcgacaagatcttctacacgctccactcccaggcgttctgcccacgcatcggcctcgacgcccgccgcgtcgaccaacggctccgcggcctcgccgcagcagccaccatctcgtcgtcggtcctcctcacatgatatctttctttgttgttttttcatcaatagcggcagcttagcttagcttagtactgctctactctgctagtgagtgagcttcaggtttgtctgaaatctactagtgcagccatgtacttgcatatcttctcccttttttgaatatgtgaga

SEQ ID NO: 1195 - DNA, 824 bp, Triticum aestivum
  Clone ID: PAT_TA_1195
gaaaagatatcacttcccatgcccgggtaagtaagcttggatcctttaaacgagccgccctttttaatttttaagtaattatggttgaattttattttttattaaattattgattctttataaattcattcttttttttttttagaatagaatcacaacaaatatcattcaatttgttcgaatgaaatgataacacggcgccattggccacgggttacagacgcggattgggttgagtttaccaaacgggtcgaaaagaggaattacatgtagtagtgccgataaatgtgcggcgtaatcatcatagagtggtcattcgttgatcggtggattgaattgaaattaaattaaatttaaatcaaatcaaccgacgcgtctgcgtggcgccgcgtgggagcgtgcgcgtctcagtgcaggtagtaggcgacgagggagacgaggagcgcggcggcgccgggcgcgccggcgaaggcgccgctggtggccggggcggtcgctccggccgtcgcggcggcggccccgccggtcgcgccgggggactcggccggcgcctcggtggccggggcggtcgccgcgaccagggaggcggaggccaccagggcgatcagcacggcgcaggcgatcttcttcatctccatggcttctgcctctctctcctcgcgggtacggtacggttgcacggggcctgcgcaaaagaaacaaacagcaagcggctaggcggtcgaggaggagaggtcggccggcgaggcgcggtttattccggtggtgggagcggggcggtagggggagggcggctcggtcgctctctgtaaggcccgggagcc

SEQ ID NO: 1196 - DNA, 1425 bp, Triticum aestivum
  unsure (1)..(1425): unsure at all n locations
  Clone ID: PAT_TA_1196
cgtccgcggacgcgtgggggaaaaagcacaagcgctcaaaggatcctaatattgatacaaatcccatgaatttgacaaaaggtgtcagaggaaatgttaaccacaacatgatgatgtctcttcctgaatgcactgaaactaatggcaagccaccaattttgcaaagaaacagtgctgagaaatcatctccaaaaaaggtgctccagagagagcattctgatctcgagttgggggaacttcgtgagttaccttcggaaaatgacaacgggaggacaaggaaacaacttgagagaaatagttcttctaagtcgcttgatggtaaagcaactaatgtagataatttctaccccaatatgaataccaggaaggttgccctatctgcttcccatgatcagaggaaaccatcaccgcaagaatttaattctggaggtaatataaaccaggaaggattcccaaggaagaccgccggatacgactttgataataataggtctcagcatagaggaaatgtttcacagggtcggcaattgccaaggactgatgattcagattcagagaacgtattatatccagacaggtcggtagaggaaaacaggcaaaagagaaacaaaattggcacagggntggaatgctagatcatgtagataggaaagaagactactcccaagcttcctcagaatggtaccaagaatggcatagagtgtagaacacggaaatcaatttcccctgcagaaaatgaggaaagaagtaggaataactctttgatagagactgagacaggtaggaagagaagagacagttcttcggaagaagacaatctattctttaagaagtacgataaagctaagccagaactgaaaggtccaataaaagatttttcacaatacgaagattatttgcaggagtacaatgagaaatataaggtctactcttacttgaacagtcagatagagaaaacacagtctgagttcctaaaggttcaggaggatttcaatgttgctaaagaaagagacaaggataagtactattacattgttgacagactcagagacatgtaccatgaatcgggcacaaggcataaattgatgaagaaggtcttcgtattgcttcatgaagaattgcagagtatcaagcaaagaatgaaggacttcgcaangggactattcaaaggaataatgggttcaccctcatatcaaggcattagnaaactgtttttcanatggctgttacccagcatcctactcctggaaaaaatgtcgggaaccttggcttcatgcnttggcctttcctaagaaaagcantccccgggtttgaacaatcagctcaaaggaantcaacaaggtgacagaaaagctgggaaaagctcaactgtttcaacaaattggttcctgaatnantttcccanggggtttaaagggancaagg

SEQ ID NO: 1197 - DNA, 814 bp, Triticum aestivum
  Clone ID: PAT_TA_1197
gacgccacacgcttccggattaccatggttctcgtcttcctcgtcgacatcatcccatcccctcccctccccctgccccagagaactggtataaaaaatgggcgagccaccaagatcctgtccttttgtgcgacccgactcctccaacttgtagcagctccacgcaggataaagagggttggaaagcccaagaatccccagagccccaccccgagatcccgagctttctgcgttgctccgtcgcaatccacaggaatccccatcggaggtttcgcgtcctccgtgcggttcttgatccagggtgcgcaccgaggactcgccaatgcagccggacgcgagcggcaacgctggcggtggcggcgcgaattcgaggcctaagctgccgccggtggccgctgcgccggcgccgtccgggcggccggcgtccgtgctgccgcacaagacggccaacgtgcgggaccactaccgcatcggcaagaagctggggcaggggcagttcggcaccacctacctgtgcgtggccaaggaggacggcggcgagttcgcgtgcaagtccatccccaagcgcaagctgctgtgccgcgaggactacgaggacgtctggcgcgagatccatatcatgcaccacctctcggagcaccccaacgtcgtccgcggcgcctacgaggacgcgctcttcgtgcacattgcatggagctctgcgccgggagctcttcgaccgcatcgtaagcactacacctagcgtgccgcagcgcatatcatcaggacatcggtcgccactcgctcggcgtcttgacaattcctattttaagta

SEQ ID NO: 1198 - DNA, 2422 bp, Triticum aestivum
  Clone ID: PAT_TA_1198
cgtcctcggccgcgtgggcgtatcagtgggtaaccataaattctggtcggcaatgttcttccccctagcggattagaccaaagtatgtctatccagcctcatgacgggccaaatcgattacagttgagttcaccgccgatgatgaggaaggtcaacgcgcgtaccaacagggaggcgaaccatgaggcacagcttgaatctagaatcgtcgggggacctcgatgattcccagttgcaccgacggaggcctccggaagagaaatgctatacttcgcggatgccatgttgtgcttgataagggttgcctgagcagcactcgcaaatgcagacctatctgcgatgcagcgttggaaggcggcggcaagcagaacggaggattcggggcgacggtgcggcgctcgcctgcggctgcacgccgagcagaggccgtggaactggaggtcatgatgcaaggatggggacaatggcgtatcggggttcaacagcgtcggtggccggtcaccgccacgccgctgttcgtgtctcgagggtgttctgctgacggatagtaccaatgatgccggtaagaccaatgacgggcacatggattacagtgagttcacagcgatgatgagaaagggtaatgccagcgcaacagggaggcgaaccatgaggaacagcttgaatctgaatctcggcgacatcttgaatcccagcaacagctaagccggcatggggaggagaagtgccatacctggtggatgccattttgtgaaagtttttgcatgcctgatcagctggactactaatctaagagggaaatgggagatagatggagtctcctagtagtactcagtagctagagggagggaatggcgcactcctttggttgtaaccgaatcttagacgctggatatggaggtgatgatgcgatgaactgcattgtgtattcctgtggttgaacactgttggtagccgcatcaactatttactgttcacttctgtttactgtcaactgttggtacagttgttgaaaggaattcagatgatgcctgccggtcacaaattctctgatgttgttgggagcccctactatgttgcacctgaggtgcttcagaaatgctatggtccagaagctgatgtctggagtgctggggtgattctgtacattttgctatgtggcgtcccccctttctgggcagaaactgaagcaggaatcttcagacagatccttcgaggcaaacttgattttgagtctgagccctggcctagtatctctgacagcgctaaagatctagtccgtactatgctttgcagggatcctacaaagcgactctctgctcatgaggttctctgtcacccatggattgttgatgattctgtggcgcctgataagcctatagattctgctgttctgtcaagactgaagcatttttctgcaatgaacaagctcaagaagatggcattgagggttattgctgaaagcctgtctgaggaagagattggaggtctaagggagctgttcaaaatgattgatgccgacaatagtggaactataacatttgatgagctgaaagatggcttgaaaagggtgggctcagaactaaccgaacatgaaatccaggctttaatggatgcggcggacatcgacaacagcggaacgattgattatggtgaattcatcgcagctacattgcacatgaacaaactagagagggaggagaacttggtgtcagcattctcgttttttgacaaggatggaagtggatttatcaccatcgatgagctatcacaagcatgccgtcaatttggcctggatgacgttcaccttgaggatatgatcaaagatgtcgatcagaacaatgatgggcaaatcgattacagtgagttcacagcgatgatgagaaagggcaatgcgggtgcaacagggaggcgaaccatgaggaacagcttgaatctgaatctcggtgacatcttgaatcccagcaacagctaagtcggcatggggaggagaaatgccatacctggtggatgccattttgtgaaagtttttgcatgcctgatcagctggactactaatctaagagggaaaagggagatagatggagtctcctagtagtactcggtagctagagggagggaatggcgcactcctttggttgtaaccggatcttagacgctggatatggaggtgatgatgcgatgaactgcattgtgtattcctgtggttgaacactgttggtagccggggattgcatcaactatttactgtcacttctgtttactgtcaactgttggtacagttgttgaaaggaattcagatgatgcctgctggtcaaggactatctcttgatcgcgatataatggggctaccttgtttatacagtgacgaggtactataaaattactgaacaagagaaactattttcaaacaatttgcaca

SEQ ID NO: 1199 - DNA, 470 bp, Triticum aestivum
  unsure (1)..(470): unsure at all n locations
  Clone ID: PAT_TA_1199
tattcgacaccgagacatctttacagcaagatccgactatctaataccatgatcaacgaccattatatgccaatgtacaagaaaatgatggaaatattgattgagaagtttgcaaacaacgatgacaactctggtgcagattctacagtagaatagtggttgacttatacatcaaagtatacaatagtttcttttctgtttagatgtgattagctattactactattttgcaatatatacaacatataagatgtcctgatcagtccaaatagattttagagggttgtgtgagtgcatgtataaatgtaaaggaaactagcattagtcatttaacgcccttgctgtcatgttacctgttgggtttnacaaatgtacctcctttgggaattttgaatgtttgaaaatcctaacccgctttttgggattttggaatcccaaggtgtatggggtaattggcnaaaaaaaaaaaa

SEQ ID NO: 1200 - DNA, 463 bp, Triticum aestivum
  Clone ID: PAT_TA_1200
aatcgggaggaacttgttccgaataaggacgaacttgttctgaatttaataggaggctcctattcagttcatcacaacccctgctgttttctttttcttttggagaacagcacaagaatatttacacccggcgaataaaaacgaaaactacttgcgtcatccgcatgacacgtacatgtacatttatccgaaaatacgtggattaaataaagcctttttaccactcaaaggggcgcacggaagtggcaaaagggatcctccgtatgccaccggggcgccgagaagtggcgcgtcgtcatgctcttgcccgcctgggcgagctggcgttgcgggcgggcgcgaacctggccgtgaagtccggctcgtggagctcgaggctgctgtcgtcgaagttctgcgcgtagctcatcggttcgttgtttaccccgccggcgccggggatggagcggtcgtgccgtgccct

SEQ ID NO: 1201 - DNA, 1028 bp, Triticum aestivum
  unsure (1)..(1028): unsure at all n locations
  Clone ID: PAT_TA_1201
cccacgcgtccgcccacgcgtctgctgcctcagatctcgcgggcaccaaaccaaaccaaagctctccctcccgctgactctcccttccaggaagcttggaccgaaggaaggagctgagaggaggccatgggggaattctccaaggaatcttgcccttccgtgaagaacattttgctactggattctgaggggaagcgtgttgctgtgaagtacttctccgatgattggccgaataacgcatctaggttgacctttgaaaagtccatttttactaaaactctgaagacaaatgcacgctccgaagctgagataacattgcttgatggttatattgttgtttacaaagtttgtacaagacctacactttttcgtcactgccggagatgatgagaatgagctcatcatagcaaatgtgcatacagggttttgctgattcggttggctcttctactaatgtggtgatggtgtataagaagtacttgcactttagaacttgggacttggttcttctctgcattgctgagattaatgatggaggtataattcttgtatcagatgcgaacaccaatgcaggggaaggttgcaaccaatgctgctgacggctatgttcccttgtctgatcggacaatatctcaagcactggccacagccagggaacactttggcaagatctcttctgaaatgagaagccgccgtttcttctttcacccctgtgtgttcatggtcgggctactatgccaggcctggtagcggtcacttaaccaaaagcgcaactgtgacagacagatgtgtctggattcttcttaaatgctatgtaattctatttgctcgttaaatgcttgttgagtatcttaaattttattttggtcgttaaatacaatctttgaagcttacattttactggaggtatagagaaataatttttgaagttaaaatgagaaacaagaaaaacgaaggtaataaacggccccatntatnccantnaaccnttttggggtaaataatgatcccggannncccttgagttg

SEQ ID NO: 1202 - DNA, 650 bp, Triticum aestivum
  Clone ID: PAT_TA_1202
aaccaaactactcccgcagatcaatccttgggcgagaagaaaggactactcccgcagatcaatccctggtcgatcagcaacaaagaaaggacgcgccgcgtggtggctccgccctgaggtgtacccgatccttgcggcgaccggcgtggccgtctccatctgcgccatgcagctcatccgcaacatcaccaccaacccggaagtcagggggaccaaagacgacagggcggcagggatccaggagaacttcgacgagggggaagcgctactcgcagcacggcttcaggaagttcatcgaccgccagcgccccgagatcatgccggcggaagttcatcgaccgccagcgccccgagatcatgccggcgatcaacaacttcttctccgaccctcccaagtattagttcagttcaggtttcgcaggccgcgaatgcccctctttaatgcttcgttccttcctaagattgagtcgggattttagaaactgccgacgatgttgtttgtcataattcgaatcatttacatgaatcgccatggattgatttgattgcctggctgtacgcttaagaatcatataattcgattcatttggcaatgttaatatttgatcatgtttacgagcatgtcgttttagaaaaaaaaaaaaaaaaaa

SEQ ID NO: 1203 - DNA, 798 bp, Triticum aestivum
  unsure (1)..(798): unsure at all n locations
  Clone ID: PAT_TA_1203
ccgctcaggcggcgggcgggaacctccatcgtccgcgtaaccaaccccgatcgatcgaggtgtcaccacaacgaagcaccgaaccttcctccgattcgagatcccctactcggtagtgagtgagcatggacttccacctccccatagttcacccaggcgcggcgccggcgggcaacgtcgagatggaccaccaggcacaagcagcagccgtgaacccgccgccaccagcggctcacggccgtgaaccagcagcaggtcggcgggcagggaccgaacacctgggtcggcaacgacgccaacacgctgctggtggtggccacgctgatcaccacgctcacctaccagctcggcaccaacatccccggcgggtactggcaggagacaaaatcgctggacggcagggagctttaccgcgccggcgaccccatcatgcgcgacctgcaccgcccaaggtacgcgcgcgcgtgaaaaccactccatcggtcgttcatgccagtatcggttgacatgccggatgtgcaggtactggttgttcatggcggcgagctgggttgggttcgcgagctcgatggtgatgacgctgagcctgctggtgcggatgtcggcggactcgcggcacgtgcggtggtcgttcgtggtggcctactccagcctcgtgctcanccttcgtctgggcgggcgtccgcgccttcctctggctcgtcatcagcgtccacccggagcaccgcacgcgcatcgtccaggcactctgctgcagcaccggcaactaagagttggactggcgggtgactctatcgt

SEQ ID NO: 1204 - DNA, 596 bp, Triticum aestivum
  Clone ID: PAT_TA_1204
atgcgcctgccctggtttccggcgccggtccgtggccgcccacccgcactggtgccgcactcccggtgtggacggcgtcccccattgagaacaaggtcccagcttctcccgggtctgacaagaacatctctgaagaacgctcgattcaagggaacatttctgaagaacgctgattcaaactatctgacatatttggtacgccattgacatcgaagaaggcctcctgccgcctcctcggtgtcacttgtcgccaccatcgtctgagccgtggtcggcggccgccccgcgatctgagccttgtgggagtaggttgatctcactgcgaacatggaaatatagtctagcaactgctagtgttagtaatgggtgttggaggttggctctagtcaagcggtcactcgttgtgctgggcttcctggtatttccagttgtttgtttttctctttctttcaggtggacacagtttcctttggtcgtctgttcatactcgggttgtatattgtggtatttattttcgagccgaatttgcacatatcatattttggagcctcaactaaaggctgtaaggcccaaatggtccccttaaaaaaaaaaaa

SEQ ID NO: 1205 - DNA, 630 bp, Triticum aestivum
  Clone ID: PAT_TA_1205
acgtctcagcggcaacacataatcgcgacgatgaagaacagcaaaggagctctcctcgcggccatgctgttgctggtgatctcttctgctgctgctggcagagatgctccagcagccatcgccaaggagaaccatttgggcaccacgctcgagcaaaacggcggcttctctgaatcgaaggggatcgccgtccgtgaaccgatattccgtccgcctatgaacccaccctgtgcgtccaaggtcgcacgcacaagcgggggcgccaaggaagagagactttgttaagagagcaagtggagaccagttattaatctgcaaacatgcgagctgatatcttatagtattattacagtataaataaaggaagacgggggaaatatatagacagatatatgtacgtctgtatatacacaggctctgcatttcaacgcgtggaatgatacatccatctctgagaggctgttttaacagtaattgctggtattaattcggttcagcaatatcatcggttaatcgtgctgacgacggcttctgctaatataggacagtagtagcactcggccacaggatatgcttaattcctatatatgcaaacccatggagaacagagaggaaaacatgtaaatatat

SEQ ID NO: 1206 - DNA, 855 bp, Triticum aestivum
  unsure (1)..(855): unsure at all n locations
  Clone ID: PAT_TA_1206
gatgcgtcggcccccagcgcacgcgcacgccaagttttaccaccacggccgggcggctggccacacgcgacgcgtagacatagacacgggcaggcaatcaggcgccgctcctcttctcctgcagcgcgcgcggcacagggaaaggaagggcggcgagcgatggcggggctgcagcggtccagcggcacgttccggcggtcggggtcgtcggggatggtgtgggacggcgacagccacctgtccggggagatcaagcccgtgcgggtcgagcggagccgctccacgggccacgccgggtacagggcgtccgccggccgcgtctcgccggcgctcgacccgccctcgccccgcgtcgccgtctgcggcttctgcgcctgcttccgcggcggcaagtcaaaggcggccaagaagagcaacggcggcaaggcaaaggcggccaagcccaaggctcgaacggccgccggttcaccaccgagaccgaaggcgaggcgagccagtggctgatccgtctctactctacgtccctgcagcccgtacgtacatacatattgtataaacctcggtagtttcttccctgctctcgtgttaccgatgatttgtcccatgtatacatatcgagtagtaggcgcacggatttagtacgatccatgtatagagggtagcttagaaccgtgagcggtgtgtctcaccatcactcgattgtacagagtgttctcttccattttgctatgtgaatatgtgatcagatatttgtaggacagcatatgattattagtacaacttttattacttaaaaaaaaaaaaaaaaatcacctaaaaaaaaaaaannaaaaaaaaaaaaaanaaaanaaaaac

SEQ ID NO: 1207 - DNA, 714 bp, Triticum aestivum
  Clone ID: PAT_TA_1207
actttccaaatctcattctccatccccaaaccgtagcagcagcaacccatccctccccgccaaccccgcagcagctccgatggcccgcaccaagcagacggcccgcaagtccaccggcggcaaggcgcccaggaagcagctggcgaccaaggcggcgcgcaagtccgccccggccaccggcggcgtcaagaagccgcaccgcttccgcccgggaaccgtcgcgctccgggagatccgcaagtaccagaagagcacggagctgctcatccgcaagctccccttccagcgcctcgtccgggagatcgcccaggacttcaagaccgacctccgcttccagtcatccgccgtgtccgcgctccaggaggccgccgaggcgtacctcgtcgggctgttcgaggacaccaacctgtgcgccatccacgccaagcgcgtcaccatcatgcccaaggacatccagctcgcacgccgcatccgcggggagcgcgcctaggctctgtatgcgccctgtgccagctgcacctgaatcctgctagatgtttaatactctgtagttgtctgctcctattgttgttttccgttcttgtaagtctgatggatgccatcaaatgttcaaatctctagatctgttgtgcgtgattgtctgattatgtgggttcactgtaagtaaaaatcccatttgaatctagaaaaaaagaagactcctctgtttgattg

SEQ ID NO: 1208 - DNA, 455 bp, Triticum aestivum
  Clone ID: PAT_TA_1208
cccacgcgtccgctcttgtgatccttcgcagggagccagctcgaggccaacaagaaggccatgaacatccaggtgcgccgattaatcccgcctgtccaatcgatcgaatcgatctaaccctctctagcgattggggatttttttttccgcagacgaaactgttatctgttgaatttgttgaaattacgcctttaactgggacgggatgcgtgcctcttcagttgcaacgacgattggtagcctatttctcgataggactctgggtggatggatttttcttttttgtgcggcgattatcggtaggattttgagctttttttttcaattacgcctggagaaacgaagggaatcatatacttttggcttgaaggactatagctagcgtatcgacatactagcatgctagattacaagttaattggaccaaaattgcccttcgggcatagatcttgggg

SEQ ID NO: 1209 - DNA, 1566 bp, Triticum aestivum
  Clone ID: PAT_TA_1209
aggggcccctcgaggtggaggagggggctggcgggaaggaggagaaggcggcggtgtcctgctcgatctgcctcgacgcggtcgttgccgccagcgcggagaggtccacggcgaggctgcagtgcggccacgagttccacctcgattgcattggatcggcattcaacgccaaaggagttatgcaatgcccgaactgccgcaaaattgagaaagggaattggctgtatgcaaatggttcccgcccctcacatgatattaacatggatgagtgggctcatgaagaggacctttatgatgttagttactctgagatgccgtttcgttttcattggtgtccatttggtcgcttagcacagcttccatcattctttgaggaaggagaatcaccacccccagttacttttcatgactttatgggacagcatgtgtttccagagaatctatctgtatctgctgcaccagggacacatccttgcccatatgtggcatacttgcatcctcttccatcgctggcatcatcatcaagctcccatgtccctgagagaactatggatggttccgcttatcatgatcactggaatcacctggctggcccatcagatggtaggcccttgcaaacggtgcaacccactgatttccatcataaccattgggcgcatctgccccattcctatgtgcaatccaacagcaataacggggtgacggagcagccaggggtcccttttggatcaatgagggctgcaagggtggatggtgatagccaacgtcgaggatctgttgtttctccatcgtacttcagtaatggatctggctctagatctagagctcctaatgttcctcctctggtacctcagttcatgagggcacatggcaacatcaacgaacagtacactcagagttcatcatccagcctttttgctggagctcatagatcaggaggcatgcgacctgcccctccgccacctcaaccggagaacccaacattttgcctgttcccaccgggttcatctggccatagttcaatggataccgatgaagctggaggaagccgattctatgcctgggagcgcgatcgcttcgcgccgtacccattgatgccggtcgactgcgagacgagctggtggagctcacagcagtcccacggcgcatcagaatccacacccgcacccgcgccaaggagactctttgggcagtggatcggcctcggcaggtcgtcgcccgagaatagatcgcccgagggctcatcgtatcgacaaatgcactctcctcggatgtagccagccccctgcggaggcaacctaagttaaaacttcacatttggaacctgagttgcttgtaagaaaagatgggggaaaacccatctgtaaggaattaaaccgggtttgcgcgctaaacttccggagaattctgcgagggagaaacaggaaataacccggagggaaaacgttttggtttggtttatgtgaattccgtctcgtacatatttgaaaatcaaactgggatattcgaagtttaaaactaaaaaatgatttccaaaaactcgagacaaaaaaaaaaactcgagac

SEQ ID NO: 1210 - DNA, 1557 bp, Triticum aestivum
  Clone ID: PAT_TA_1210
aacaaaatgaaaataatgaaaacgttgatattcctgcagtaaggtctgaggtggatggctctgcaagtgctggtcctgcacctcctcacagtgatgaacttcaaagagatgcatccaatgcaagtgagcatgtcgcagatatgcaatatgaacgtagtgacacggctgtccgtgatgtggaagcagtaagccaagcaagcagtggtagtggtgctactctaggggaaagcctcagaagtttagatgttgaaattggaagtgttgaaggacatgatgatggtgaccggcatggggcttcagacaggacacctctgggtgatgtacaggcagctactcgatcgcggaggccttctggaaatgcagtaccagtcagcagcagggacatatcattggagagtgttagggagatccccccaaacacagtccaggaatctgatcagaatgccagtgagggggatcaggagcctaacagggctactgggactgactcaatagatcctacatttttggaggctcttccagaggattccccgcctccggttctttcttcacgtcaaaatgcaagtgactcgagacttccagtgagcagcctcagcatgatgcggacattgatcctgaattccttgctgcactgccacctgatatacgtgaagaggttctagctcaacaacgtgcccaacggttgcaacaacagtctcaagagcttgaaggacaaccagttgaaatggacgctgtatcaattattgcaaccttcccttcggaaatacgggaggaggtgcttttgacgtctcctgatactctacttgctacattgacacctgcactagttgctgaagccaacatgttgcgtgagagatttgctcatcgatatcacagcggttcactatttggcatgaactccaggaacaggaggggagagtcctctcgtcgtggtgatatcattggttcaggccttgatagaaatactggtgattcgtcccgtcaaacggccagcaagttaattgaaactgtagggactcctcttgttgacaaggatgctctcaatgctcttatacgattacttcgagttgtccagcctatatacaagggccagctgcagaggcttctcttgaacctttgtgctcaccgggaaagcagaaagtcgctggttcaaattctgttggacatgcttatgcttgatctgcagggctcttctaagaaatcaattgatgcaacagagccgtcatttaggctatatgggtgccatgcaaatatcacatattcacgccctcaatcctcagatggtgtgccaccactggtttcccgccgtgtgctggaaactctgacatacctggcaagaaatcatccaaatgtggctaagctcttactctttcttcggttcccctgcccgcccacctgccatactgaaacacttgaccagaggcgtggaaaggctgtccttgtggaagacggggaacaacagagtgcttttgcactcgttctacttttgactctattaaatcagcctctttatatgagaagtgtagctcatcttgaacagttactcaatcttctgga

SEQ ID NO: 1211 - DNA, 2479 bp, Triticum aestivum
  Clone ID: PAT_TA_1211
ccacgccccaagagtcagcgacctcccccctcgcctcgccgccgcccccctcccccccgccgcgggccggggtcccatgcgccccgtttagcacaattagggccccgcccgcgcctgcagacctcccgcctcgcctccccgccgccgccctcccccctctcggcgagccgggattccaaggcgcgatacatctcccagggaggccgctgggcgcggaggcgatggtggccgagctgcggcgcgacgacatggcggaggaagcggggatcatccgcgacgccgtggccttccggctcgtcgagcacgtgctccagtccgtgcggaatgtgccgtttctagtggacccgcgtgatctggagcaaaatgaagaagatgattaaaaactctagacactagcaagagaaagagtgccgacgatgaggctttgtatatgacgtctttgaaggcattgacagatgcagtatccaaaatagacatcatgtaccatcattcacttttgaacaatatattcagcgtccgcatctggtacttgcaaagagatacaatggttgctttactggacctaataaccagattggctgcagtggcagatcagtttctaagagaatgtttgcaggtgcttgtgatccactttactacccctattgttggtgaacgcaaggaggtgcctccatgggcagtctcgaggaagaaggataaataatcttatgtgtatgtgggtttgaaaacgaacgctgagactgtacacttagcaccaggggcttagtttgtagtggtgtatgacagcccactcatttgcagtgtattcagcccaagtagttcgaaatttttgggttgaaagtgtgaagtacagatgttgttagaaaacgtagttgagtggttgtaagattatatatatactgcagctaggccttgtttgagtatgacgatcatgttctgatgtggaactctttgtcggcaggttctctcacgggaacatgaacggcatcgggatgatttggtacgggaacatgatggagatgactagtgaaaagcaggaataaaggactgtttgggaggaaatgcatgtgctgaaaagcttgatggtttaatggttgttgtatgtgagcacctgaagtcattagatcgtcagtgcctatataaggaatttgtcattctgaaaactatatttcgagcatctctgctgagagtccacagatcaaaatttgcccagtttatcattttctatacctgctcactggatcctaaaacccttggtgaggattttgctgtttttcttaccgacattgttacggagaagaaagaggatccaatttcaagaatgtctgcagtttcatatgttggaagctatttgtctcgggcaaggtttatttctgctgatacggttgttactatactcaaaaaattagtagattggtgcgttgactattgtgaccatcagagcaagagagaggccacaccgattccaaatcatcaattattttacgcgacctgccaggctgtgatgtatgtcctttgctttcgcttgagatctattatggattatccaaatcttaaatcagatctgtttcacatgccttttggatttctgtttcgccaccgactagaacctctaaaggtgtgcttgccttcaatagtaaacgagtttctgagacaggccaaggatgccggattggttgctgcatttgtggatccagcagctgaagatgcaattgaatctgatttgtccaggacttttggaggaatcaatagacttgacatgttcttcccatttgatccttacctgctaaaagaatctgacagatatatccgtccgaattttgagttctggtccatggtcaagacaacgtatagcgacgacaccgacgacgatgacgacgagctcgaggaccttgatgcccctgagatgaatgtgggcagcttggatgatcatgtcgagatagacatcaacagtgacgacgacgacctggagtacacgatgaacaagatgtctataaccccgcaccactctttcttacaccagatggccatggacagcgacggcggcctcagcatgccagcgaggatcagaccatcgacaagccctccgtcgcggtgggccatgtcaggagaatcaccatagatggaagaaacagctggatacttggggctgtacaaggagggtatgactgtcaaactgatacggggagcttagtttgtagtggggtcaaagaacccattcatttgcagtgtattcagcccaagtaattcgaaaattttgggttgagagtgtgaagtacagatgttgttagaaaacgtagttgagtggttgtaagattatatatatatatactgccactaggcttgtatgagtaagacgatgatattttgatgtagaacggtctgtcaacaggttgtttcactggaacagcatcggcttgagtgatatatcctgttgattcttgttgttgtttctgttgtatgtatgttttgttgatag

SEQ ID NO: 1212 - DNA, 730 bp, Triticum aestivum
  Clone ID: PAT_TA_1212
cggacgcgtgggtttgtttatcagttttagcacaaacgcaaactccgttcgttccccaccaccatctcgtcgaaaacctagaaattcggagtgagattgtgttcgtccgttcgctttcgtttcttcgagatctgtgaggaggggggagagacagatccgtcgcttgctccctgttcgaggtttgtgacgaggacgagcagcagattcgacgcgcgcctccgaggttcttcctggaactaatttgatgtgctatggaatccaagggggaaaatccctttactttatgtacctggtgaaacggggaatcgcagaaggatattagtactgctttttacctcgcaatatgttctgtacttccatcgtttctaacccaaatcaacccactccagaatttgatgtgctatggaatccaagggtggtaaaaagtccagcagtagtcgttcctccctcatgtacgaagctcccctcggctacagcatcgaggacgtccgccctgcaggcggcattgagaagttccgctccgctgcctactcaaactgctccaggaagccatcctgataatccctctcgtgccccatcctaattgcttagaattccctcccctttcaattcatcttcctaaattttctcttgctagctgcttttctctgaccagcaaagccttttctccctctaccaaccttctgaaacaatggccgtctctgcgaatgggttcgagggatatgagaaa

SEQ ID NO: 1213 - DNA, 1951 bp, Triticum aestivum
  unsure (1)..(1951): unsure at all n locations
  Clone ID: PAT_TA_1213
gcactccccacgtgtttatttagcacaaacgcaaactccgtaaatgcaaactccccccgttccccacccaccatctagtcgaaaacctagaaattcggagtgagattgtgttcgttcgtttgctttcgtttcttggagatccgtgaggagggggagagacagatccgtcgcttgctacctgttcgaggtctgtgacgaggaggagcagattcggcgcgtgcctccgaggttcttcctggaactaatttgatgtgctatggaatccaagggtggtaaaaagtccaggaaggtagtcgttcctccctcatgtacgaagctcccctcggctacacgcattgaggacgttccgccctgcaggcggccattgagaacgttgccgctccgctgcctactcaaacctgctcgatggaaagccatccgtagataatccctctcgcgtcccatcctaattgcttagaatttccctcccttttcaattcatcttcctaaaatttctctggctagctgcctttctctgaccagcaaagccttttctccctctaccaaccttctgaaacaatggccggctctgcgattgggttcgagggatatgagaagcgcctggagatcactttctctgaagcgccagtcttcactgaccccaatggcaggggattgcgtgctctctctcgtgcccagatcgactcggtccttgatcttgccaagtgcaccattgtatctgagctctccaatgagaagtttgactcgtatgtcctttctgaatcaagcctctttgtgtatccgtacaaggttgtgatcaagacctgcggtaccaccaagctcctgctggccattccaagggttcttgagcttgctgaggagctgtccctgccacttgctgctgtgaagtactcccgtgggacattcatattccctgacgcacagccttctccacacaagaacttctctgatgaggttgccttcctgaatggctactttggtggactcaagtctggcggcaatgcctatgtcattggtgatcctgcaaagccaggccagaagtggcatgtctactatgccacccacctggctgagcagcatttggtcgtctgggacaagaagaagaccttcctgctccagaagaaagcttctttcttcctccagacctcgggcgatggcgacacatcagctccctggcatctctgaaataatcccggagatggagatctgtgactttgatttcgagccatgtggctactccatgaacgccatccatggctctgctttctccaccattcatgtcactcctgaggacggcttcagctatgctagctatgaggtcatggggttggaccctgcctccatggcctatggtgacctggtcaagagggtgctgagatcctttggcccgtctgaattctctgttgctgtgaccatctttgggcggccgcaaccttgctggcacctggggcgagatggctgaatgttggggtctatgatagtaccaacatggtcgtccaacgagctgccccaggagctgcctgacgggggcgctctcatctaccagagcttcactgctgtcggcgaagacttcaccgggtcaccaagatctgtcctgaattgcaacgttgatggcaatttagttactggctgcaagatggatgctttcctttgctgggaagacgatgctgcgcaggagaaggatgagaggggggctggtaagaagatgaagagctcctgatggtgatgctagctggtctgaatgagcttgttgcgtcagtttgttcttagatttccttttcctgctcctgtcctagtactccgttctgggcaactgacgtgaaaatggttagcgttttctgccagtgtgagcgaatgtatggaaatgcctgcatctcggtccgcaggtttagaaatttaagaatacgccttgtattgagcaaatgttattattgttatttcctnaaagttt

SEQ ID NO: 1214 - DNA, 852 bp, Triticum aestivum
  unsure (1)..(852): unsure at all n locations
  Clone ID: PAT_TA_1214
ccccgcctccccccatcccccccgaaaaatcgaatcaaaccacctccacctccgcctccacgcacgctcgcacgcacgctcgccgccactgcaagtttgcaaccccctccatctctctcaacatcccgagcctgccccaaccaatggcgtccaccaacggctacggcaacgtcaccggcggcggcctccccacccacaccgccacctccaagccgcccgtcgacgacccgcgccaccagaagcagcgcctgcgccgccgccgcggctgcctctgctgcgcgtgcctcgccgtcaccctcgtcctcgtcgccgtcgtcctcctgatcctcttcctcaccgtgctccgcgtccgggacccgaccacgcggctcgtctccacgcgcctcatcggcgtcgccccgcgcctcaccttcccggcgctcaacatccagctcaacgtcaccctcctcctcacggtgtccgtgcacaaccccaacccggcctccttctccttcccctcgggcggccacaccgacctcacctaccgcggcgcccacgtcggcgacgccgagatcgaccccggccgcgtccccagcaagggggacggggacgtgcagctggcgctgacgctgcaggcggaccggttcgccggggacctggcgcagctggtcgccgacgtggaggccgggtcgctgccgctggaggccagcaccaggatccccgggcggggtggcggtgttcggcgtgttcaagcgccacgccgtcgcctactccgactgcagcttcgtcttcggcgtcgcggagatgggcgtccgcagccagnagtgccgcgaccacaccaagctctgatcctaccgaccttccttcgtccgt

SEQ ID NO: 1215 - DNA, 710 bp, Triticum aestivum
  unsure (1)..(710): unsure at all n locations
  Clone ID: PAT_TA_1215
naattactataatcttcccatcaaacaaacacgaacacgacatcaattgcatcacaccactaccactactactactactatccactcaaacactcacccccaatctccaagatgctcgcagccgctaaactgatcgactcatatgagatggaccctgatgtctcgtggctcgaggttttcgcatactcgggagttagcgctgctttatgcgctaccatatgggtcgcagccaaagcatgctgagactgcagtgccagatcagcacctctatcatctacccagcccaacagaggaagaattgcctgtcacaaatctcagcattcttccacttcggccccacgaatgaatcatttcccaactgggtttcgttgcggggatcttcacaaggaacttcgacaaatcccctcgcttgaaatcaacactccttcactatgatcaatatcgtttgtcgtacgggctaaacaatgtcaagccatgtcgagacaatcaagggacacagcactgattcgcccaccatggttccagactgctttcagcacgattggttggatagatggagaagatgcggttcacggttaaaaaagtatactagaaatatatattgaaagtccatcattcaagttacatgggaaacgttttccgctcttctaaaaagaaagagagaaatgaaaaaccttcaaaagaccgaaagaactgcggagatggcgaac

SEQ ID NO: 1216 - DNA, 532 bp, Triticum aestivum
  Clone ID: PAT_TA_1216
atctaccgttctgtcgtcgcggcctacaaccggggaaagcacaaacaagccgagcgccaacaccatgaggacacaagctgtcgtgctcgcctactcgctgttggcatccgcgctgctgtgcaggtgcgccgcggcctcgccggcgttcatcgtcgggaagctcgtcatgggcggggtggagttacgccgtcccatgatcgacaccatgacggcgaatcagtctgcaccactgcaactttcgatggcggcgagcgatgggcatgtgaatggactccagctgaactggttctccttgctcccggaaataacctcacagctgggccggagccatcctcttgcggaacaagggatagtgctcgatcacctgctcgtgtttttggtgctcttcgttgtgtacattttccgctgatttcgaggcagttccaaatcttctccggtttatactcagatgtattatatgtgctgtgtactatatttaatgtcctgcgcaagcagtagaactaataataatctgatactcccgttttttaag

SEQ ID NO: 1217 - DNA, 636 bp, Triticum aestivum
  unsure (1)..(636): unsure at all n locations
  Clone ID: PAT_TA_1217
cggncgcgtgggccacgacatcaccacggtgcacctcgacgaccagcccccctcgccgtcccagtcatccatgatcacccagtccagcgcaccggctccgagcgcgacaacagggcagttctctctgccagctgacaccaagcaacatggcggagcgaatgcgccatacaattcgccgccgagctacggcatgggtttgcaagatcaaggcctgcagtgtggccctctgcatgatcagctggccgcgaaccggagcatgctgtattagaagatgcaaccgttcgatccatttcgacgccatccgatcagatgtctagtgtaatatggcccttgctgtagcttcactgcctgtattattattgaagtaagtaattgattatggggatttttcagaacatagcagagagagagagagagagagagagagagagagagagagaggggtatgatgctggtgatgctttggtagtagtccataatttctggtgtggatactgagaatgtaagggaagagaatggcaagaacttgatgctgtagtatcttgagacagacagggaatactagtgctcagtactgatcatgtacattgtcaagtggacttaattttcaatcttcatgaatcctgctttctggtc

SEQ ID NO: 1218 - DNA, 742 bp, Triticum aestivum
  Clone ID: PAT_TA_1218
gaaggggggtcccgtggcccgccgacgagcacaggtttttcttttagccctgaagacgtacggaaaaggggattggaggaaaatatcacgcaacttcgtacggacgaggacgcagacgcaggtggccagccacgcgcagaagtactttatcaggctcagctcaggggcggcaaggaggtcgagcatccacgacatcaccacagttcacctgacagacgaccagcctccctcgccgtcccagtgattgatgatcaaccagtccagcgcaccggctcagcgcggcaacggggcagttctcgctgccagccgaccccaagcagcatggcgcggcgagcgcgcccttcagttcgccgaaccgggctctcgggatgccgaactacggcagggtttgcaagatcaaggcctgcagtgtggtcctctacatgatcagctggccgcgaaccggagtaccgagtacgctgtattagaagatgcaagcgcatcagatgtctagtgtaatatggcccttgctgtagtttcactgcctgtattattattgaagtaagtaattgatcatggggatttttcagaacatagcagagagaggaggtgtgctggtgagtggtgatgcttggtagtagtccataagtgttggtgttgatactgagaatgtcaggggaaaaggatgcaggggatgtctagaacttgatgctgtagtatgttcggacagacagggaatgctagtgctcagtactggtcatgc

SEQ ID NO: 1219 - DNA, 916 bp, Triticum aestivum
  Clone ID: PAT_TA_1219
ggggcgcccgccacggcgcccccgccggcggccccgcagccgtgcggcggcacggcggccgcccccccgcggaggagccgaaggaggtcgtaccatcccacgacatcacccacagttcgctcgtcccgaggccgagcaagtacggcaatggggactggaggaacatttcgcgcaacttcgtgcagacgaggacgccgacgcaggtggccagccacgcgcagaagtacttcatcaggctcagctccggcggcggcaaggacaagaggaggtcgagcatccacgacatcaccacggtgcacctggacgaccagcccccctcgccgtccctgtcatccatgatcacccagtccagcgcaccggctccgagctcggcaacggggcagttctcgctgccggccgacaccaagcagcacggcggagcgaatgcgccatacaattcgccgccgagctacggcatgggtttgcaagatgaaggcctgcagtgtggccctctgcatgatcagctggccgcgaaccggagcatgttgtattagaagatccacccgttcgatccatttcgacgccatccgatcagatgtctagtgtaatatggcccttgctgtagcttcactgcctgtattattattgaagtaagtaattgattatggggatttttcagaacatagcagagagagagagagagaggggcttggtaggtatgatgctggtgatgctttggtagtagtccataatttctggtgtggatactgaagaatgtaagggaagagaatggcaagaacttgatgctgtagtatcttgagacagacagggaatactagtgctcagtactgatcatgtccattgtcaagtggacttaattttcaatcttcatgaatcctgctttctggtcaaaaaaaaaaaaaaaaaaaaactcgag

SEQ ID NO: 1220 - DNA, 555 bp, Triticum aestivum
  Clone ID: PAT_TA_1220
gaggctggttttgtttttgtgttagtgggattgaggtcgcttatcaagaagctgtctctttgaagaggcaagaagagcttattcgtgaagaggaagaagctgggctccttgaaagtgagatgaaggggaagcgcaacaataccactgaaaaggagaagcgtgcaaagaaaaaacaggccaaacaaaaaaagaacaatcggaaggttaaagacaaggatagagaggaaaaatctgattcaaattttgcagagaaggatcaagatgaaagcacaattcatgatagtgaggattctaagcaggcaggacaagtagccatgaaagttgatacctccgaagaaggtgcttcagacatctcagacaatttagatgggtcagctgaggtatgtcaaactgatgcaggtgacaaaatttcacaacctgtgaatggggtgaatgatgttggtgttgagatgaaaaatgtgcatactgggaagaactctaccgtggagcacaagccactgccgtgtttatcagaatctgctactatgaacattatgcaaggcaaaaaaaataact

SEQ ID NO: 1221 - DNA, 706 bp, Triticum aestivum
  Clone ID: PAT_TA_1221
gccggccaggccggccgggctttacatccaattcactcttctttcgagatatcaactctttaaaccaccaacaatctcaaacatcaacttttacaacactctcatccgtcaaaatggctgtcaacactccttctacctgctgccgctccagcgacggtgccagtgaatgcgcctgtgcccaaaaggccacttgctcatgcggtcaaaagtctgctcttcagtgcacatgcgccaaggctcccgtcgaaaacaccgtcaacggccctcgatgctcatgccgtgctcgtcccgctggcgaatgcacctgtgaccgtgctgcttctgagaacgtcactcccagcggcgccacatgcgcttgcggatctcgtcctgctggtggctgcacttgtgagaaggctgccgatggtggcttcaaccctgccaacgagatcgactttaccaccaagaaataaatgtctgactctgatgggaattaacgaaaacaacatgcattaataaattactggacggcgttggggatcatgactaggtactttgggttggggtggggagacaatcgataccagatacacaagaattgaacaacattcattcatgacaactgaaaaaccgtgttggagagtgtgcgttgtttgccaagaacatgtttatgccgaattcgtgtgtaaacaacattagctcacgcgattagcaaacggttgtgggc

SEQ ID NO: 1222 - DNA, 1372 bp, Triticum aestivum
  Clone ID: PAT_TA_1222
cggcactcgcgccgctccgcgcctcctcctcctccgtcctcccccctccgccccactcgcggtcgcctctcccgatagatctggtgccagggttcgcggcgccggcggacgcgcggggggagcggacgacgcgtgcctggtgggcggaggggaggatggggaatccgcgtggcggcctcgacgagcagatcgagcagctcctgcagtgcaagcccctcgtcgagcccgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatccgcatcgacttacaattcttagaggaaaccacgagagccggcagatcactcaagtttatggattttatgatgagtgcctacggaagtatgggagtgctaatgtatggaaaaccttcacggatctttttgactatttaccgttgacagcattggttgagtccgaaattattttgcctgcatggcggcacgtatcaccatcccatcagagcacacttgataatgtgccgcggcttccaccgcacaggggaaggaacttgcatggatccagcgtgtgaccttctagggtctgatcctgatgatcgatgtggttggggcatttcaccacgtggtgccggatacacatttggccaggatatttcagaacagtttaaccataccaatagccttaagctaatagcaagagctcatcagttagttatggagggattcaactgggcacatgagcaaaaggtcgtgacaatttttagtgcacctaactactgctaccggtgcggtaacatggcctcgatcttggaggtcgatgactgcaaggagcatactttcatccagtttgagcctgccccgaggagaggggagcctgacgtgacccgaaggacgcccgactatttcttgtaaatgtagcctaggccattcgtttttgttttattttacgggatagcttaggttattccgacagcaaacaaaaaaagaagatagcttagatgcgttgtgtcgtgtcgtgtggtcataatttttgttgtttgggtcctgctccgttttgcttcactccttttgttgtaatctgtctgcctcatgccaggctcgggggtgtgaatgtgatggatgatgctggtaaatcaaaggcctcgcgtagtagtaatttttgtgctttcaaaaaaaaaaaaaaaaaactcgagattag

SEQ ID NO: 1223 - DNA, 1015 bp, Triticum aestivum
  Clone ID: PAT_TA_1223
actccatcgtggctgccttggcgaacgacgaactccttgctgtcatcattgttgccatcattgttggatatctcattgagtcccctcattcacccatcattcgtgtcgccgaagagattgagcgcatgatcctcaaagtcatcaacttcctcatcgcagcagctcccattggtgtcttcttcctcattctgcccaacttgatgcggctcgacattggcgagatcggctcaaacttgggtattctcattggcgccaccttgtccaccatggtcctccacatcttggtcgttgtccccatcatcttcttcatcttcacccgaatgaacgcatattcctactggatcaagatatccccagcttggatcacggcttggggttctgcttcctctgctgccactctttcggtcacccttcgatgcgccaaggagcgtggtgtccccgccatcatctccaagtttgcttgtccccttggttgtctgattaacatggatggtaccgccatctacctccctgctgcggttgttttcctggcttccacccaaggcatcaccctggaccctacctcatatgtcattgttgcacttctgtcgaccttggcttcgattggtgtctcccccatcccctcggcctcgcttgtcctcctgctcatgattgcccgctcggtcaacgttgagatcactggaatgtacgccgtaatcgtagccatcgactggctcctcgaccgcttccgtacagcgatcaacgtttctggcgatctgtttgctgtcatgatcatttacaagcagaccggaatggaggatcccgaagaggttatcgaggagaccgcccgggagactgatgcgcacgaaaaggatgcgaccaaccgggtctagatacagaccaaataggcttgctgaatgaaggatgaacaatttatagccggcgttgttgcttttgagaataccatatcataaatagttgaagagttgaattgattactgtcttcaagacaaaaaaaaaaaaaaaaaggccccta

SEQ ID NO: 1224 - DNA, 704 bp, Triticum aestivum
  Clone ID: PAT_TA_1224
tctctgactagaggaaaagcccagcaatgtcggggcggcgcgggcgcgggcgcgggccgccgacgcaggcggaccgcctgatgcgcggggccatcgaccacttcggacggatgggctacgccgaggccgacatccgcagcaccgtcgggcaactcatcgaggtctatggtgaggatgcttcgtcgttcctgaaggaagatgactaccgggtcgtgcaggacgcactatttgagaagcaggagcaggaagagcagcagcaggagcctaaacaaaaggaagcagcaatctctgaggcaccaacagcaagtgacatgccaattgtggacatgcacaatgagatgccacctggggctgagttatcagttgagggagcagaccctatgcccatcgacccgcctgctcctgaggctacaatggcacatcctgcagctacaggaactagtagagcagggcgtccctgctatggatggattagcgaatctgagagtgattcggactatgaagaatacctcgccagtcgacgacaggcgacacatgctccaatcccaggaagcggctgagtggatagaatgtgaaatgaagccccacttaactggcaggcacatagctcgctttgctgggtgggtgttgaggtcgtctgaagtattggcaatgatgtattagtaattgaagtactatatatagtaagcactaagttaacacag

SEQ ID NO: 1225 - DNA, 768 bp, Triticum aestivum
  Clone ID: PAT_TA_1225
ctcatatcctccgttgcgccggaagccttggggctctacactccggggatttctcggcatcgaaggagcacagtttcatttgcatcgtctcatcgcccgcggatccttgccatgaacttctggggcgccaaccataacctgccgatcaggagagcaacacaaatccctgcagctgttccaggcccagaaagtttgccaagagtaaatctccctatgtccaacatgccttcatggatgaccttggtcgttggtgcagtccttgttgcgatacctatttacagaaagataagagcattggaagataaggtggagaagacggcagaggtggcggtcgaggtaatggacacggtggccgaagctgccgagaaagtcgccggcgaggtggccgaggcgttccccgaaaatgaaggcctcaaggaggcagcgtccaggatcaagaccgtcgccgatgcgatcgaggaggatgccgagttagccgaggccctaatccataaggttgatgagttaacgaaagagatggattccgtggtcggtcctatcatcgacgtggtcataaaggagagtggagaaagaggagtcgtagatgaagaacccaagagtaaagaatcggacaacatataagaaacatgtcttaccggcaaacaaatataactagtcgtcaaccgtgcatccgcatgggtgtatataactatatatacaatgtcgataaataaccagtaacagctcaagttcatcattatctaaaaaaaaaaaaaaaaaggcccctaa

SEQ ID NO: 1226 - DNA, 674 bp, Triticum aestivum
  Clone ID: PAT_TA_1226
gtacgatcgccctgtaatcctgctgtagctacatttgcgatcggcgggtgcgcatcgtgtggtgaagcgccagagggtgtaatgacagctcagacgcgctactcttcgcttccgctgctggctcccccgccgatcctggcgtcatccgtgcaggcggccacgacgccacggccaggccataaagagggttttgtgccgcgctgcgcgggatgtctgagcgataggttttgtgttacatgcaacaaatggtggtgcgaagcgtgttaccagccttttggagggaattgcgcccccgtggctaagagacatgtttcgcggagttgttgggagtgtgggatgaattgtgatgagtgtattgagaagacgcaaaaggtgtgcaagaagtgctgtggtgggtattgtcttgttcacaatgagggttcgtctacgtctttttgcgattggtgtttttcatctggtcgtgggttgcgacgtgtgtgatggccaccatgacggtggtgcttggaagggtttctttacattctgtttctttgcgaggcgtcacagtgtttattttcttatgatcttctatgatgggtttgggagtcaaggtgtatgtaacaaggatcaaactcgactctgctcttgagatacctacctagaaaaaagaaaaaaaaaaaaaaaaaaggccccta

SEQ ID NO: 1227 - DNA, 781 bp, Triticum aestivum
  unsure (1)..(781): unsure at all n locations
  Clone ID: PAT_TA_1227
gccggccgggttcgaagacatcgagttggagcagcagagcagaggtaataatcacagaagaatctgctgcccgtacgtgcttgtttggagcttggtgcttggaggcgaggctaggaagaagatgacgaggcggttcttgcctctttgcgcgctcctcctcgtgctgctctgcatggcggcgagcctcgcggaggggaggcgcggcgggggacgccccatcatcggcggcggcagcggcggggccagagggaggggctccggcagcccgcgcggcctcagcggcggcacctgggcggcgtgcgtcggctcctcgctgctggtcgcggcggccatgctcttctagcttgcagcggcgggaagagctcaagaaggatggttgggcaacgtaaatgttctgtgcattcgttggttctttgttactactgtcgatttgattgttgttgtatatacatacgtgagcggattggctaattcattcgatatgtttatcttgattattaagtggatgcagccgttcatattgagacactgtatatgaggatgtgcatgatctgttctcgtcaaagtatggtagagacagctcatgtgattgcgcagtgtgtttagcatcaaatcatatactactaccacgccaacatagtttattttcataacatttcacagaactacatcctagaaaatgttaaatgcatattccctccgtaaagaaatatacttttatattgagggagtacnaaaaaaaaaaaaaaaaaaaaggaaaaaaaaaaaaaaaggcccctaa

SEQ ID NO: 1228 - DNA, 896 bp, Triticum aestivum
  Clone ID: PAT_TA_1228
caatcacagccgccgccgccgccgaggaagaagaagaagaagaagagaggaagcgaccggaccaagcccggcggccgaagatgaagacgatcctggcgtcggagacgatggagatcccggaggaggtgacggtgaaggtgtcggcgaagatgatctcggtgacggggccgcggggcacgctgacccgcaacttcaagcacctcaacctcgacttccagctgcaggagggcgggcggaagctcaaggtggacgcctggttcggcacccgcaagaccatggccgccatccgcaccgccatctcccacgtccagaacctcatcacgggggtcaccaaggcttccgctacaagatgcgcttcgtgtatgctcacttccccatcaacgcctccatcaccgccgccaaccgggggagggagatcaggaacttcctcggcgagaagaaggtgaggaaggttgacatgctcgacggggtcaccatcctgcggtccgagaaggtcaaggacgagatcgtcctcgacggcaacgacatcgagctcgtctcccgctccgccgccctcatcaaccagaaatgccatgtcaagaacaaggatatcaggaagttcttggacggcatctacgtcagcgacaagggcgccatcaaggaggagtagagagccggaaaccgtcccgcccaccagaagccgtgtttctgcctgccgtgtttgtttcatcgtgtttgtgtctgtctgtcgtcgtcgtcttcgtgattttgaactttctctagactgaattttgtagcggagttaaatttttagggatgtgccgtggaacatgctatctttattgttatcctgcatatcgtcgccgccgcgagaaccggtgcgacgcttatctagccctaaaggctgaagacatgga

SEQ ID NO: 1229 - DNA, 877 bp, Triticum aestivum
  Clone ID: PAT_TA_1229
cgcacagcacagcccagcaccgccgccgcaccaccgtgagaggaggaggaggaagaagcagcgtcggccgaagatgaagacgatcttggcgtcggagacgatggagatcccggaggaggtgacggtgaaggtgtcggcgaagatgatctcggtgacggggccgcgggggacgctgacccgcaacttcaagcacctcaacctcgacttccagctgcaggagggcgggcggaagctcaaggtggacgcctggttcggcacccgcaagaccatggccgccatccgcaccgccatctcccacgtccagaacctcatcaccggcgtcaccaagggcttccgctacaagatgcgcttcgtctacgcccacttccccatcaacgcctccatcaccgccgccaacaagggcatcgagatcaggaacttcctcggcgagaagaaggtaaggaaagttgacatgcttgatggtgtgacgatcctgcggtctgagaaggtcaaggatgagatcgtcctggatggcaacgacatcgagctcgtctctcgctctgctgccctgatcaaccagaaatgccacgtgaagaacaaggacatcaggaagttcctggacggcatctacgtcagcgacaagggcgccatcaaggaagagtagtgttgttgcgacctatccatccgcagcccctttgtagctggtagcagaaactgtcctagagttcttggagcttgtcgaaaccaagatcagaagctgtttcttttttgtttttttggctcgagtgaatcaacaaaagtttgctgtagttttgtaccggatcaatgtatcagggatgtcatgtaattggagcttggagatgctttctttaccagcctataagacctcttgttatct

SEQ ID NO: 1230 - DNA, 969 bp, Triticum aestivum
  Clone ID: PAT_TA_1230
cggacgcgtgggcggacgcgtgggctcccctcctcccccgccgccgccgccgccgccacacccccacccctcccccaacccccatcaccggcgcgaagatgaagacgatcctggcgtcggagacgatggagatcccggaggaggtgacggtgaaggtgtcggcgaagatgatctcggtgacggggccccggggcacgctgacccgcaacttcaagcacctcaacctcgacttccagctgcaggagggcgggcgcaagctcaaggtggacgcctggttcggcacccgcaagaccatggccgccatccgcaccgccatctcccacgtccagaacctcatcacgggggtcaccaagggcttccgctacaagatgcgcttcgtgtacgcccacttccccatcaacgcctccatcaccgccgccaaccgcggcatcgagatcaggaacttcctcggcgagaagaaggtgaggaaggtggacatgctcgacggggtcaccatcctgcggtccgagaaggtcaaggatgagatcgtcctcgacggcaacgacatcgagctcgtctcccgctccgccgccctcatcaaccagaaatgccacgtcaagaacaaggatatcaggaagttcttggacggtatctacgtcagcgacaagggcgccatcaaggaggagtagagtgcgaaaaaccgtcccaccagaagccgtgtttctgcctgccgtgtttcatcgtctttgtgtcgtcgttgtcgtgattttgaactttctctagactgaattttgtagtggagttaattattagggatgtgccatggaacatgttatctttattatcctgcatattgtcgccgcgagaatcggtacgatgcttatctacccctacaaaggctgaagacttgaagtatttgaggttaaaacaggacatgaatgtgctctaccgttaaatgatttggttatgcatctacattgcatgcctcgg

SEQ ID NO: 1231 - DNA, 933 bp, Triticum aestivum
  Clone ID: PAT_TA_1231
tataagatctcacttcttccttcgcctcgccgccgccgccgcccgcagagcccagcacagccgccgccgccgccgccgaagaagaagaagagcaaacccggcgtgcgaagatgaagacgatcctggcgtcggagacgatggagatcccggaggaggtgacggtgaaggtgtcggcgaagatgatctcggtgacggggccgcgcgggacgctgacccgcaacttcaagcacctcaacctcgacttccagctgcaggagggcgggcggaagctcaaggtggacgcctggttcggcacccgcaagaccatggccgccatccgcaccgccatctcccatgtccagaacctcatcacgggggtcaccaagggcttccgctacaagatgcgcttcgtctacgcccacttccccatcaacgcctccatcaccgccgccaaccgcggcatcgagatcaggaacttcctcggcgaaaagaaggtgaggaaagtcgacatgcttgacggtgtcacgatcctgcggtctgagaaggtcaaggatgagatcgtccttgatggcaacgacatcgagctcgtctctcgctctgctgccttgatcaaccagaaatgccacgtgaagaacaaggacatcaggaagttcttggacggtatctacgtcagcgacaagggcgccatcaaggaagagtaggggtgtgacctttctgccgcaatccctttgtagctgtttatggaaactgtcctagagggtgggtgttttttgagtgaagaatcacattagttggctgcaacttgtactggataggtcaagaatccctttgtagcatttgtcggagaattgattgtagctcctacgacatcacccggctacaactccggggaactcgggttgcaactcatgaatgtggttgtagcttttttggtgaacgcttgtagcatttgtc

SEQ ID NO: 1232 - DNA, 1052 bp, Triticum aestivum
  Clone ID: PAT_TA_1232
gccggccgggctgcgagaaaccctagcgacgccagctataatagatctcaccttgccggacgcgtggggccgccgccgtccgcacagcacagcacagcaccgccgccgcaccaccacgtcagaggaggaggaggaagaagcagcgtcgggcgaagatgaagacgatcctggcgtcggagacgatggagatcccggaggaggtgacggtgaaggtgtcggcgaagatgatctcggtgacggggccgcgggggacgctgacccgcaacttcaagcacctcaacctcgacttccagctgcaggagggcgggcggaagctcaaggtggacgcctggttcggcacccgcaagaccatggccgccatccgcaccgccatctcccacgtccagaacctcatcaccggggtcaccaagggcttccgctacaagatgcgcttcgtctacgcccacttccccatcaacgcctccatcaccgccgccaaccgcggcatcgagatcaggaacttcctcggcgagaagaaggtaaggaaagtcgacatgcttgacggtgtcacgatcctgcggtccgagaaggtcaaggatgagatcgtccttgatggcaacgacatcgagctcgtctctcgctctgctgccctgatcaaccagaaatgccatgtgaagaacaaggacatcaggaagttcttggacggtatctacgtcagcgacaagggcgccatcaaggaagagtagtgttgtagcgacctatctgccgcaacccctttgtagcttttagcagaaactgctgtttttttgagtcacatatgtttgctgcatcttcgatcaatccggaaaccgtcccgcccaccagaagccgtgtttctgcctgccgtgtttgtttcatcgtgtttgtgtctgtctgtcgtcgtcgtcttcgtgattttgaactttctctagactgaattttgtagcggagttaaatttttaaggatgtgccgtggaacatgctatctttaatgttatcctgcatatcgtcgccgccgcgagaaccggtgccacgcttatctacccctaaaggct

SEQ ID NO: 1233 - DNA, 1293 bp, Triticum aestivum
  Clone ID: PAT_TA_1233
cgtacgcacagtcattcacagccgccgccgccgtcgaggaagatgatgaggactacgggggggagcgaccggatcaagccggccgggcaatgaagaatccggccgacatcgtctcgcccccaccctcgcccctgccctcctccctcctccgccgccgccgccgccgccacctcggccccagccccagcccccatcaccggcgaagatgaagaccatcctggcgtcggagacgatggagatcccggaggaggtgacggtgaaggtgtcggcgaagctgatctcgctgacggggccgcgggggacgctgacccgcaacttcaagcacctcacacctcgactatccagctggagggagggcgggcggaagctcaaggtggacgcctggttcggcacccgcacgaccatcgccgccatccgcaccgccatctcccacgttcccagaaccttcaagcaccgcggtcgccaaaggcttgcgctacgccgctacccgcgcttcgtgtacaccctcccccccaacgaccccgtcaccgcccaccaaccggcgccaccgaggtccagggactgccaccgcgggcaagaaggtaaggcaaggtggccatgctcggtggtggtcaccatcttccccgatcaagagacggtcaaggaagagccgtccctccgcggacaccgactgacatggaactcctctccgcgctacaccaacctcagcaagcaaaagtgccacgtcaatcaacaaggggatcagcgaaccttttgggcagtatagacatgagcgacaagggcacaatcaagcaacaatcgaggacgaacaccgtgctagtctcctggtccgggcctgtcacgtgccagaaatgccacgtcaggaacttggtgatcttgatcttttcctgggatgaattttctagtagagtgacgtagggatgagcaaggcaggagtttatcttgaatatcctacatattgtgacacggtatttttgcttgccgggttttattccctttgagttttagtagtcgtgatttttaactctctctagactgaattttgtagtggaagttatttgttagggatgtgccatggaacatgttatcctgttattatcctgcatattgtcgccgcgagaatcggtacgacgcttatctacccctataaaggctgaagactcggaagtatttgaggttaaaacaggacatgaatgggctctaccgttaaatgatttggttatgcatctaaaaaaaaaaaaaaaaaaggcccctatgataaaagagttgtttgctgcccaggcaggaatcagc

SEQ ID NO: 1234 - DNA, 2059 bp, Triticum aestivum
  Clone ID: PAT_TA_1234
gctccccgcccctgccccgccgccccccgctggccatcgtgcccggcgccggctaggccggtgccggacgcgccacctcactactcttgcgcgtgggcggggaggtggccgcccactgagggaacttgcaaacttagttctgatcatggggaaccacacatgccatcgaggagatgcctcccggcaatgcaaatgtcctcaccactgtcttgaagctggttgacaagtatgatctgtacggaagtgtggccttccccaagcatcactaccaggcctaggtacagtgcttttatgccctcacagccatcacgaagggcgtatacaacaatcctgctctcgtcgagcctttcggccttacactaatcgaggctgcagcgcacggtctcccaatcgtcgccaccaagaacggcggtccggtcgacattacaaatacactgaacagtgggctgctagtggatccgcacgaccagaacgccatcgccgacgcgctgctgaagctggtggccgacaagaacctgtggcatgagtgccggaagaacgggctgcgcaacatccacctctactcgtggccggagcactgccggacgtacctcgccagggtggccgggtgccggatcaggaacccacgctggctcaaggacacgcctgcggacgctggcgctgacgatgaggccgaggactcgctcatggaattccaggacctatcgctccgcctgtccatcgacggcgagcgaggctccactaacgagcccgcctcgtcggacccgcaggaccaggtgcagaagatcatgaacaagctccaccagtcgtcttctgccgctccagatgctgccacggacaagaatccggccaacgttcaagccgctggcaccgtcaacaagtacccgctcctgcgccgccgccgccggctgttcatcgtggccgtggactgctatggtgacgacggacgtgccagcaagaagatgctgcaggtgatccaggaggtgttcagggcggtccggtctgacacccaattgtccaagatctccgggttcgcgctgtcgacggcgatgccgctgtccgagacgctccagctcctgcagatggggaaggttcccccaaccgacttcgacgcgctcatctgcggtagtggcagcgaggtgtactaccctggctccgcgcagtgcttggatgcccaggggaagctccggcccgaccaggactacctgcagcacatcaaccatcggtggtctcacgacggcgccaggcagaccatagggaagctcatggcctcacaggacggctccggcagtgtcgtcgagcctgacgtggagtcctgcaatgcgcactgcgtctccttcttcgtcagggaccccaagaaggtgagaactatcgatgagatgcgggagaggctgaggatgcgtggcctccggtgccacctcatgtactgtcggaagtcaacgaggatgcaggttgtccctctcatggcatcaaggtcacaagcactcaggtacctctttgtgcgttggggcctgcccgtgggcaacatgtacattgtcctcggggaacatggcgacaccgaccgtgaggagatgctttcaggactacacaagacggtgattgttaaaggcgtcaccgagaaaggctcagaggacctgctgaggagctcagggagttaccacaaggaagacgttgtcccgtccgatagcccattggctaccaccacgcgcggtgatctgaagtcggatgagatcctgcgggctctcaaggaggtctccaaggcttccagcggctgatcggttgcccggaagctcgatgatgccgaacatcttcactcatgctatttaatatcttctgcttgttcataaccagagattcgaaccatttctcttttcttcactacatatataatcttgtgagcactagcacgactacatcttgcagtgagaaataattaagacactgctgatgatgccactgtctggcttgaatgtttgtgaactaattcagcatatacgtttgcaatatatattgtgcttattcaacagctttgtttttttaagtcataaaaaattctttt

SEQ ID NO: 1235 - DNA, 538 bp, Triticum aestivum
  unsure (1)..(538): unsure at all n locations
  Clone ID: PAT_TA_1235
gacacagcaaaatggcggtccataagcatacaagtatcttacaaccgatctatattacagaagcgcagatacattcaacgagacgaaggaattctaaagagaagctgaagcagagtaagccgagtcgtccgtcagggtcaggtaaacaggatgcagcaaccgcgtcgcttgacgcgctccgctcctcaaccgccgcccccaccgcccccgtggccgcctccaccaccgcagccgccgccgccggcgccatcacctccgtagccggcgccgctgccgctgccccagcgctcgcggcggcgtcgcttggccctcccgtcgtcggcgcagccgaacgccgcgatggccacgacggcgaccgcgcccacgaggacgaagagcagacccactacggcgccgggcgcgcgctgcacggagccnnnnnnnnnnnnnnnnnnnnnnnnncggctgcggcggcggcgaagcctctcgccgcggcgagatccaacgccgtcaccatttcagctgctggagcctactcttgaaatcccggcccggccgc

SEQ ID NO: 1236 - DNA, 1055 bp, Triticum aestivum
  Clone ID: PAT_TA_1236
ctgcgccgaagacgccgcgctggacaaccccgccatcgtcgaggacctgaccatgttctttgccaggtcagtggtcgacgaggttatagcgccgtcggacttggaggcgatggaggaagaggccggccgccgaaaagccgcaggctccccagggatgttggctctgcgcaacgcccacgccatgctcggagcaaagctctccgcggagcggatcctgcggtgctggggcggcggtggcaccggcaaggccggctgggagctgagcgaggtgaaggacaagatcgggaagctgctgcaggagtacgacagcggcggcggcgtccgggaggcgtgccggtgcatcaaggagctcgggatgccattcttccaccacgaggtggtgaagaaggcgctggtggcgatcatcgagaagcggggcaaggacgagcgcctctgggggctgctcagcgagtgctacggccgcggcctgatcacgccgaaccagatgaccaagggcttccagagggtcgccgactgcgtcgacgacctcgcgctcgacgtgccggacgccgggaagcagctcggctgctacgtcgagcgcgccaagaaggggggatggctggacgcgtccttctccgttgccaagccggggccagatgtcattgccgtttgctcgtgagcaccggttacatgcaaacacactactgacattccgggggagttcgttgggtttgcaacaactttacgccattatattacgtgtatgtatgatctgcaggtatgactggtctcgggcgtttaggagtatataatgctcgcacaggaaatgtgctataggatagggagtatgatcttccaaagtaggaggttttcatggcgtttagcgcggaggatttgtgcattgaagagtttgtttttgccattgtttttctcctacactgtcctgtggtgtttttatctggtcaactgctcgttgaggaaattacaatgttactccttattaatgtatcacacatttctctagtatattttattttctttcttttctttatcattaaattttcaaaaaaaaaaaa

SEQ ID NO: 1237 - DNA, 563 bp, Triticum aestivum
  Clone ID: PAT_TA_1237
cctgaccaagatgctttaactcagctccaaagacaaagaccaaggatctctctattgatacaccataatgattaaggatcaagcttagtccggcacgggactactaccatttttaaaaataaaacaaacgctcgtattaatcatgcaatactcctgccaacgccataaaaccaaaccaaaggaatgaacaaaaaatgtacaccacccctgggagaaaaagtcagctcagctcagctccacgcacgcacgctcctcatctccacgtggatttgtcggcgtcgtcgggtccggccttctcggccagaagcgacgtccgggcgttggtcgacggccggtgagccgcccgcggcgatcggtgctccgtgcggaaggggaactcgtcgccctcgagcatgtgcacgatctgccccatcttgggccgcttgtgcgcatcggagtcgatgcagcggaggcacaccagcagcacccggttgagcaccctgggcgccggcaccggcacgatgcgcgggtccgccaggtcctccacgcgccggctccccaccatccccctgaaccactccacc

SEQ ID NO: 1238 - DNA, 695 bp, Triticum aestivum
  Clone ID: PAT_TA_1238
tttttttttttttttttttttttttttgttggacataatcttctgaaaaattcatcatcttatgaggagtacacatatactcaagtctcggttcacctcagcgccggtttgatccgttttagaccaacagatctcagatcggttctgctctgttctcggcggaaaaactatttacagggctcctcggtctgtctcggacaactaaacaaaaatacaagaggaccagaacagaagaaggaaaaaaagcgttccctgcaggaaaaatgagaaactacagtcatcatctaaaatttgtcctttgtctagtcctcggaaggcggcggccggttgagatccagatcaaacgcgaccgccttatgcgctgtcaccgcggggggcgacggggacagatcaacgaccgacgaggagtcggagtcgctctgcgcaacggccgccacggtgaccggctgcgccaccttcagcgcgcggtaccccgacgccgacgccgccgcggcggccgcggcctgttcgtagaagaagtacgggtgcaggggctggcgcggcgccaccgggtaaccgttgaatgggaagcgcatgccgccgccggcgacggccgtgacgaccgccgcgcggtggaagaggtccaggtcgagggcgggcggcagcgggatggcctgcatgggcgcctgggcgcagccgccgctccctccgccctc

SEQ ID NO: 1239 - DNA, 1510 bp, Triticum aestivum
  Clone ID: PAT_TA_1239
cccacgcgtccgcccacgcgtgcgacggtgtgtaagttggataaaaaatacccaccttatgagctaatatgggaggattctaatcagctcgcaggaaagtcgttctatttgcctgcatcgtttgatgctgatcataatcagatggatcagtggaatctatcacctcctcctgtttctctggggagccgcagcgattttgctcagaaacataatgagattgctaaatcaaaggggcacctctgcagcagaagaccgtgctataatgattcacaaagggacaacgcaggcaatgcatatatgagcaccagtggcgatttggaaatgggcagtgagggtgaggcgtgcatccctgacgaagaaatgcaaggagagcgacaagcagaagcctccgtgatagaccagttgttggctgacacataccatgataccactagttctccaggtgactactggactgataccaacggccgatcagggcaacctcgcaactatgatactccaggtggaaatgaccctccaacccatgagtattttgcagtcagggcagctgaatctgacatgagcatttcgttgtccggcagaagtgcttctcggaatcaaaaccaaactgtgtcaacctctgatcatgagcctaccaacgatcatattgcaagcgtatctgccaagcaaccaaccgatcctgctgattgtgacgacgtaacatcagctgatgcccagcatgggctgggagacccaccgtctgcaccagaaaatgcagctggagttcaataccgaatcctggaagactccccacctgaggaaggacagctgggagacccaccgtctgcaccagaaaatgcagctggagttcaataccgaatcctggaagactccccacctgaggaaggacagctgacacctgaggaagcacagccgaatgatttgtcgtctacagatggaaatgcagctggtgtgccgatgctggaggagtcgccacttgaaacagatgctccagtgggtgcagcgaatctgccactagcgcataccttcccggggctgcagtttgcaagcgctcccacgtggcctggatgctacgctgctcgtgaagttctgtcgcgaggcatgggctacccgaccttccatcaggaagcctcctacaacttgcttgggaagtaacattcgccaagcaagcaaagttggtgccatcttttgttagcaatgactggttgactgtcttgctttaacctggccaggacgtcgagaaagaaaggaaaaccagcgcctcttgtcatatgtgtaagtggaagaagacaccaagtagctgctgatgtgcctcggcttatcttacaggtgtgagcttgtttatcttctacggccagctttaaagtgttgggttgtgtgtgcacctgcactaattttgaactgaaactgtatcaagagtcattgtgatgatgcttgttcaaatcatgtttgtttggcaaaaaaaaaaaaaaaaggggccgctggactgaaccccacgcgtccgcggacg

SEQ ID NO: 1240 - DNA, 1740 bp, Triticum aestivum
  Clone ID: PAT_TA_1240
gtcccactgcccgccccccacccgcgcgccgccgcggcgatggactcgctccgcctccggccgtcctcgctccgctccgcgcccggcgccgccgccgcccgccggcgagatcatattctaccatcattttgttcgatccaacgaaatggtaaagggcgagttactttgtccatccaagcatccaaaggccctaccattaatcactgtaaaaagttcttggattggaaatattccaaccataggatatcacatcaatcaataaatacttctgcaaaagctgggcaatcgctacagcctgaaactgaagcacacgatcctgcaagcttctggaagccaatatcatcttctctggacgcgttctacaggttttctcggccatataccatcataggaacagcactaagcatagtctcagtttcccttctagctgtcgagagctgatctgatatttcgcccttgttcctcactggtttgctggaggcagtggtggctgctctttttatgaacatctatattgttggattgaatcagttgttcgacattgaaattgacaaggttaacaagccaactcttccactagcatctggggaatactctcctgcaactggagttgcaatagtgtcagtatttgcagccatgagctttggccttggatgggttgttggatcaccacctctgttttgggctctttttatcagctttgttcttggaactgcttattcagtcaatctgccgtactttcgatggaagagatctgctgttgttgcagcactctgcatattagcagtgcgtgcggtgattgttcaactggcattttttctccacattcagacatttgttttcagaaggccggcagtcttttcaaagccattgatatttgcaactgccttcatgacattcttctcagttgtaatagcattattcaaggatatacccgatattgaaggggaccgcatctttggaattcaatcttttagtgttagattaggtcaaagcaaggttttctggacttgtgttggtctacttgaggttgcctacggtgttgcgatactgatgggggtaacttcttccagtttgtggagcaaatctctaactgttgtgggccatgcaatcctcgccagcatcttgtggagcagcgcacggtccatcgacttgacaagcaaagctgcgataacatccttctacatgctcatctggaggctgttctacgcggagtacctgctcatccctctggtgagatgaggaccgacaagcagcccacggaagaacttcagtgccggagtacagctgtgcgaatccatttgaatttcggatggtcacggaccgcgcccaataaaactcccagagccttgccccggtacatcgttgattttccagccatgaatggtgagatcaccacctaaagatggataacctccccatgtacccaagctgggccaggtgagctgtagtttagttgatgctagcgagcaacaactcctgcagcaggcacgcggctgcctggaaaataaggctccccactcccaattacattctgttgtacggttttagtacttgtgaattttgctctggtccgttgttgtctaggatgtttggaacattgcgcagactttcttatatcttaccgggaggggtgaattggccttaccgggcccggtgctgtggcttcatccctcccccttctgtcgtttcaacccgcccctaatctctctgctcgggaatataatcattctgttctgt

SEQ ID NO: 1241 - DNA, 690 bp, Triticum aestivum
  unsure (1)..(690): unsure at all n locations
  Clone ID: PAT_TA_1241
ttcccaagcccagaactcgcntcaggactacctctcacctcacaacgccgcccgcnccncngtcggtgtgggcgcggtgagctggagcacgaagctgcaggggttcgcccagagctacgccaaccagaggatcaacgactgcaagctccagcactccggcgggccctacggggagaacatcttctgggggtcggccggcgcggactggaaggcggcggacgcggtgaagctgtgggtggacgagaagaaggactacgactacgggtccaacacctgcgcgggcgggaaggtgtgcgggcactacacgcaggtggtgtggcgcgcctcgaccagcatcggctgcgctcgcgtcgtctgcaacaacaaccgcggcgtcttcatcacctgcaactacgagcccgccgggaatgtcgttggacagaaaccatactaactgtgatcgcttcgcagtacatacatagtccaatagtccctcgttccttgcatggcagcacccatgcaaggattcatgcacgttcctatgatcctatctactgtataactagctagaggggctgggcgagtagataaaaggaatgccgtaacaagctatgtatgtattctccgtcatggactacaataaataatgagcctttttacggtaccttggatttacctaaagagtatcttaaatgtatctattaattcaat

SEQ ID NO: 1242 - DNA, 568 bp, Triticum aestivum
  Clone ID: PAT_TA_1242
cgcgcagaactacgcggagcagcgccgcggcgactgccagctgatacatacttcccgatggccggccctacggggagaacctcttcggaggcggtgggacccagtggacggcggcggacgccgtgaactcgtgggtgtcggagaagcagtactacgaccacggcagcaacagctgctccgccccggagggcgactcgtgcgggcactacacgcaggtggtgtggcgtgactcgacggccatcggctgcgcccgcgtcgtctgcgacagcggcgacggcgtgttcatcatctgcagctacaacccgccgggcaactacgtggggcagagcccatactaggctatgcatgcatgcattcgtgcgtgcatgtacgtagcagcgcgtatattgcataaagaataaagctgagatcacagtcgtgataagatgtgagactttagcaggagagattcaaggtaagtgtagtttagactggctatggatattgtgttacgattcatgtgagttgtacgatcattaattgtaggtgcctgctatgcagtgcttatgaatgaaaataaagttttatt

SEQ ID NO: 1243 - DNA, 732 bp, Triticum aestivum
  unsure (1)..(732): unsure at all n locations
  Clone ID: PAT_TA_1243
atttagnaacaaccgaacccanaatgcagacgcccaagctagccatcttgctcgccctagccatggcagccgccatggttaatccttccgaggcgcagaatacgccgcaggactacgtttcaccgcacaacgcagcccgcgccaccgtcggcgtgggcgcggtgagctggagcacgaagctgcaggggttcgcccagagctacgccaaccagaggatcaacgactgcaagctccagcactcgggcgggccgtacggggagaacatcttctgggggtcggccggcgcggactggaaggcggcggacgcggtgaacgcgtgggtgggcgagaagcaggactacgactatggctccaacacctgcgcggcggggaaggtgtgcgggcactacacgcaggtggtatggcgcgcgtccaccagcatcggctgcgctcgcgtcgtctgcaacaacaacctcggcgtcttcatcacctgcaactacgagccccgcgggaatatcattggacagaaaccatactagtagctgtgatgcatgtcttcgcagtacatacatgcatacatagtctctcgtcccttacaaacatgcattcgtatacacacatgcaacggttcatgcaccttcctattcctaactagctagagggaccgagcgagtaaatataaggaatgccgtagtgagccatgtaattccgtcctggactgtaataaataatgagcttctctatggcagtctt

SEQ ID NO: 1244 - DNA, 816 bp, Triticum aestivum
  Clone ID: PAT_TA_1244
gccggccgggccgggttaggtgacactatagaaggccggccgggctggatctcatcgttacagatacatcttccttgattagttttgctaggcttaatcagcgatggaatactcgccgaaactagcagtactggtgctcttagctctcgcgtccgccatggcggtcacggcccagaactcggagcaggacttcgtggacgcccacaacgcggcgcgcgccgacgtgggccttggtgaggtgacatgggacgctaccgtggcagccttcgcgcaggactacgccgatcagcgccgcggcgactgccagctgatccatactcctgatggccggccgtacgggaaaaaaaactaaaaaaaaggcggcggtgggaccgagtggacggcgacggacgccgtgaattcgtgggtgtcggagaagcagtactacgaccacgacagcaacacctgctcggcgccggagggtgagtcgtgcgggcactacacgcaggtggtgtggcgcgactcgacgggtatcggctgcgcccgcgtcgtctgcgacagcggcgacggtgtgttcatcatctgcagctacaacccgccaggcaacttccccggggtgagcccgtactaggctatatgcatcatgcatgcatgcatgcgagcgtgcatgtacgtacggcgtattgcataaataaagtgattaagctgtgataactacagtgtgatcagattttttttttttgcgggtacagtgtgatcagatgtgatatataattaaccagcccgggccgatatatatatgtactgttatgattccaggtaataagttgtggtata

SEQ ID NO: 1245 - DNA, 816 bp, Triticum aestivum
  Clone ID: PAT_TA_1245
atactacaggtgatacttcacggatagtagcggatagtacacctttccttagcttcgtaaggcttaactagcgatggagtactcgccgaagctagcagctgtgctgctcttagctctcgcgtccgccatggtggtcgtcacggcgcagaactcgccgcaggacttcgtggacccccacaacgctgcgcgcgccgacatgggcgtcgggccggtgacctgggacgacaacgtggctgcgtacgcgcagaactacgcggagcagcgccgcggcgactgccagctggtacattcgggcgggcagtacggggagaacatctacggaggccgcggcggcggggccgactggacggcggcggacgccgtgcaagcgtgggtctcggagaagcagtactacgaccacggcagcaacagctgctcggcgccggcggacaagtcgtgcttgcactacacgcaggtggtgtggcgcgactcgacggccatcggctgcgcccgcgtcgtctgcgacggcggcgacggcctgttcatcatctgcagctacaacccgccgggcaactacgagggggtgagcccatactaggctatgcatgcgtgcgtgcgtgcgtgcatgtacgtagcagcgcatatattgcataaagaataaagttgagatcacaatcgtggtaagattgtgacactttagaccggctagattcacgctatagtttagaccggctaatgggataatgtgttacgattcatgtaagctgtatgcttgcacgtgcttgatatgcagtgcttaattgtatgaatggaaatacagttttattatcaggggtg

SEQ ID NO: 1246 - DNA, 1557 bp, Triticum aestivum
  Clone ID: PAT_TA_1246
gccgctcgaggcggccgggcggggtactaagcaaggcaaagccagctagccacggcctacacatacgcagctagctatagtgcaggcacatacatagtagaaaccatttggacagcgagccagggagtaatggagacgcccaagctggccgttttgctcgccctagccatggcggccgccatggttaacctttcccaagcccagaactcgcctcaggactacctctcgcctcacaacgccgcccgcgccgccgtcggcgtgggcgcggtgagctggagcacgaagctgcaggggttcgcccagagctacgccaaccagaggatcaacgactgcaagctccagcactcgggcgggccctacggggagaacatcttctgggggtcggccggcgcggactggaaggcggcggacgcggtgaagctgtgggtggacgagaagaaggactacgactacgggtccaacacctgcgcgggcgggaaggtgtgtgggcactacacgcaggtggtgtggcgcgcgtcgaccagcatcggctgcgctcgcgtcgtctgcaacaacaaccgcggcgtcttcatcacctgcaactacgagcccgccgggaatgtcattggacagaaaccatactaactgtgattgctccgcagtacatatatatatatatatatatagtcgccagtagtccctcgttccttgcatggcaacaacccatgggccggatacaagctacagaagcaaagctagctagtgcaggcacagataaatcatttagacaccgcgaaacgagaatgcagacgcccaagctagccatcttgctcgccctagccatgtcagccgccatggctaatctttcccaggcgcagaactcgcctcaggactacctctcaccgcacaacgctgcccgtgccgccgtcggggtgggcgcggtgacctggagcacgaagctgcaggggttcgcccagagctacgccaaccagaggatcaacgactgcaagctccagcactcgggcgggccgtacggggagaacatcttctgggggtcggccggcgcggactggaaggcggcggacgcggtgaacgcgtgggtgggcgaaaagaaggactacgactacggctccaacacctgcgcggcggggaaggtgtgcgggcactacacgcaggtggtgtggcgcgcgtcaaccagcatcggctgcgcccgcgtcgtctgcaacaataacctcggcgtcttcatcacctgcaactacgagccccgcgggaatatcattggacagaaaccatactaactgtgatgcacgtcttcgcagtacatacatgcatacatacatctagtctttcgtccctaatcgcatgcaccttcgtatgcctaactagccagagggaccgagcgagtaaataaaaggaatgccgtaataagccatgtattccatcctggactgtaataaataatgagcctttctatggcacacttaaataaatgtgagtctttcaaaaaaaaaaaaaaaaaaaaaaaaaaaaaaaaaaaaaaaaaaaaaaaaaaccaaaaaaaaaaaaaaaaaaaaaaaa

SEQ ID NO: 1247 - DNA, 880 bp, Triticum aestivum
  Clone ID: PAT_TA_1247
cggccgctcaggcggcgggcgggatctctccttccgcattcacggatagtagcggataccacaccttccttgtagcttcgtaaggcttaactagcgatggagtactcgccgaagctagcagtagtgctgctcttagctctcgcgtccgccatggtggtcacggcccagaactcgccgcaggacttcgtggacccccacaacgcggcgcgcgccgacgtgggcgtcgggccggtgacctgggacgacaacgtggctgcctacgcgcagaactacgcggagcagcgccgcggcgactgccagctggtccattcgggcgggcagtacggggagaacatctacggaggcggcggcggcggggccgagtggacggcggcggacgccgtgaattcgtgggtgtcggagaagcagtactacgaccacgacagcaacacctgctcggcgccggagggtgagtcgtgcgggcactacacgcaggtggtgtggcgcgactcgacggccatcggctgcgcccgcgtcgtctgcgacagcggcgacggtgtgttcatcatctgcagctacaacccgccaggcaacttccccggggtgagcccgtactaggctatatgcatcatgcatgcatgcgagcgtgcatgtacgtacggcgtattgcataaataaaatgattaagctgtgataaccacagtgtgatcagatgtgatatataattaaccagccggccggatttgaggccatatattgtttagaccggctgtatatatgtaccgttatgattcaggtattaagttgtgttattgtataagcagtgtttatggatgaatatatggttctactattataaaaaaaaaaaaaaaaagaaaaaaaaaaaaaaaaaaggccccta

SEQ ID NO: 1248 - DNA, 865 bp, Triticum aestivum
  Clone ID: PAT_TA_1248
gcggcggccggccggccacaaaagcaaggcaaagccagctagccacggcctacacatacgcagctagctatagtgcaggcacatacatagtagaaaccatttggacagcgagccagggagtaatggagacgcccaagctggccgttttgctcgccctagccatggcggccgccatggttaacctttcccaagcccagaactcgcctcaggactacctctcgcctcacaacgccgcccgcgccgccgtcggcgtgggcgcggtgagctggagcacgaagctgcaggggttcgcccagagctacgccaaccagaggatcaacgactgcaagctccagcactcgggcgggccctacggggagaacatcttctgggggtcggccggcgcggactggaaggcggcggacgcggtgaagctgtgggtggacgagaagaaggactacgactacgggtccaacacctgcgcgggcgggaaggtgtgtgggcactacacgcaggtggtgtggcgcgcgtcgaccagcatcggctgcgctcgcgtcgtctgcaacaacaaccgcggcgtcttcatcacctgcaactacgagcccgccgggaatgtcattggacagaaaccatactaactgtgattgctccgcagtacatatatatatatatatatatagtccagtagtccctcgttccttgcatggcaacacccatgcaaggattcatgcacgttcctatctataactagctagaggggctgggcgagtaaataaaaggaatgccgtaataagctatgtattctccatcatggactataataaataatgagcctttttacggtaccttgaaaccaaaaaaaaaaaaaaaaaaaaaaaaggcccta

SEQ ID NO: 1249 - DNA, 1537 bp, Triticum aestivum
  Clone ID: PAT_TA_1249
ctcgtgccgacttcggcacaaggcaaagctagctagctacagcctacacatacgcagccagctatagtgcaggcacatagtagaaaccatctagacaccgaaccagggagtaatggagacgcccaagctggccatttctgctcgccctagccatggcggctgccatggttaacctttcccaagcccagaactcgcctcaggactacctctcacctcacaacgccgcccgcgccgccgtcggtgtgggcgcggtgagctggcagcgacgaacgctgcaggggttcgcccatgagctacgccaacgacgatggatcgacgactgcaatgccgccaggcagctccaggcgggccctacggggcgaagaacatcttcttgggggtcggccggcgcgggaactggaaggcggaccgggacgcggacagaagctgtgggggctggggagtgaggaacgaagggggtaatccacgtagggggttccaaccaccctcgccgccgggcggggaagcgcgtgcgggctaccgtgacacgccaggtgggtgggttgcgccgcctccaaccaaaacactccggcgcgcgcctccgcgtgcgtctagccaccaacaagggcatgggcgtcttgcaatcacccgagcaaccaagcgaaggccccggcggggtaactgtacgttaggacaagaaaccatactaactgtgattgcatcgcagatacatacatagttcaatagtccctcgttccttgcatggcagcagccatgcaaggttcatgcacgttcctatgatcctatctactgtataactagctagaggggctgggcgagtagataaaaggaatgccgtaacaagctatgtatgtattctccgtcatggactacaataaatatgagtttttgaactcgcctcaggactacctctcacctcacaacgccgcccgcgccgccgtcggcgtgagcgcggtgagctggagcacgaagctgcaggggttcgcccagagctacgccaaccagaggatcaacgactgcaagctccagcactcgggcgggccctacggggagaacatcttctgggggccggccggcgcggactggaaggcggcggacgcggtgaagctgtgggtggacgagaagaaggactacaactacgggtccaacacctgcgcgtcggggaaggtgtgcgggcactacacgcaggtggtgtggcgcgcgtcgaccagcatcggctgcgctcgcgtcgtctgcaacaacaaccgcggcgtcttcatcacctgcaactacgagcccgccgggaatgttgttggacagaaaccatactaactgcgattgcttcgcagtacatatagtccagtagtccctcgttccttgcatggcagcacccatgcaaggattcatgcacgttcctatctactgtaactagctagaggggctataataaaaggaatgccgtaacaagcatgtattgtccatcatggactataataaataatgtgcatttttacggtacaaagaaaagagcaaaaaaaaaaaaaagggcccttgggcc

SEQ ID NO: 1250 - DNA, 903 bp, Triticum aestivum
  Clone ID: PAT_TA_1250
agatacaaaacggggtccggccgcgcgaggcggggatctcatcatctaagatagattcacagatagtacatatttcctttccctcaaaaaagaagaaagattatacatattccctcacttttgtaagccatagcgatggagtactcgctgaagctggcagtagtactgctcttagctctcgcgtccgccatggcggtcacggcccagaactcgccgcaggacttcgtggacccccacaacgcggcgcgcgccgacgtcggcgtcgggccggtgacctgggacgacaacgtggccgcgtacgcgcagaactacgcggagcagcgccgcggcgactgccagctgatacatactcccgatggccggccgtacggggagaacctcttcggaggcggtgggacccagtggacggcggcggacgccgtgaactcgtgggtgtcggagaagcagtactacgaccacggcagcaatagctgctccgccccggagggcgactcgtgcgggcactacacacaggtggtgtggcgtgactcgacggccatcggctgcgcccgcgtcgtctgcgacagcggcgacggcgtgttcatcatctgcagctacaacccgccgggcaactacgtggggcagagcccatactaggatatgcatgcattcgtgcatgtacgtagcagagcgtatatttgcataaagaataaagccgagatcacagtcgtgataagatgtgaaactttagcaggagatattcaaggtatgtgtagttacccttcatgtaagttgtactatcattgtaggtccctgctatgcagggcttatgaatggaaataaagttttattatcaggggtgaagctaaaaaaaaatactaaaaaattcaaaaattctaaattttttgtgatatataaattaac

SEQ ID NO: 1251 - DNA, 1174 bp, Triticum aestivum
  Clone ID: PAT_TA_1251
cccccgtggctgcccttcaaacctctcaagtccagcgccctcccacaagcgtcctccgcggccgaggtcttcaaggacatgcctgacgccgacatcgatgtccttcctgctggctcggcgatgaccctcgacttcaggaccaaccctgtccgcgtcgtcgttgctagctgtcccgaccgccccttccgtatgtgagcaaaacctggcgcgcccgagacacattcgacggagagaagaatacgacgtcatgagcagaggtagtgggtaagtcaaacaaggaggccaaggagatcatcgttaaggacatgcctgacgccgacatcgatgtccttcctggctggctcgggcgatgaccctcggacttcacggaccaaccgtgtccgacatcatcggttgacactgtcagcagaccaccccttccattggtttacgcaagctttgcgaagctgacgagacaaactggatgcacttgatgctatgcgggatgaataagtagtttcaagtaatcgatgaatgaataaatacacgcatgacctaatgggcgtgtgtcggatagtgagtcgtgggtggccaatggacttgctccgtgtttatttgtaatttaggaggcggaggcgggtaagctcgaggtccatttagctgctcaccgaatcaaggatgagctgcgccgccccaaaagcccccgccggagaggagaagaagacgtcatggccggaggtagtgggaaagtccatcgaggaggccaaggagatcatccttaaggacatgcctaacgccgacatcgatgtccttcctgctggctcggcgatgaccctcgacttcaggaccaaccgtgtccgcatcatcgttgacactgtcgcgatcaccccttccattggttagcaagctttgcgagcgagatacaaaatggatgcacttatgcattctgatgaataagtagtttcaataatcatggatgaataaatacacgctgatcaatggcgtgtgtcgatgtacttatggttcaatggacttgaccagttatttttaatttatgagaaaaaaaaaaaaaaaaaaaaaaaaaaaaaattttttccccccccccggccccccctcggtatctttcttgaattcttccaaaaaaaaaaaaaaactcgagacctcggccgcgaccacgctaatcactagtgaattc

SEQ ID NO: 1252 - DNA, 751 bp, Triticum aestivum
  unsure (1)..(751): unsure at all n locations
  Clone ID: PAT_TA_1252
cgccatgaagtggcacccggntcggtgggcgagcgaccccggcgcgacgggcgaggcgaagcggcggttccagcggatccaggaggcctactccgttttgtccgacaaggggaagagggccatgtacgacgccgggctctttgatcccctcgacgacgacgaccaggatttctcggacttcatgcaggagatgctggtgatgatggatagcgtgaaaaacgagaagccggacacgctcgaagacctgcagaagatgctggatgacatagtcaacggcgacggcggtagccgcgccactgctggtgctggtggtagcggcggcggtggtggtggctgcggtggtcgcgttccaccggaggccaaccgcagaactcgtgtcgccccttacccgcagccttcgcgaaggtgatggacgcgccggtgctcgtgacgtgcacgcaccgctgcgcttgtaggagagagatcagagcaagaagagagcaaccagcgtgaaaaaaaacattagcaaatcagaattgttgctcgatccccttgttggggtggttacaacttagtgtttagatcatctttgatgacaattgacgccgtcgatctgtttaattgtgttcctttagctggttggtgcttcggtcgcggccaagaattggcgtggatgcgcgacagcccaaagattccatcatctttccggacatttcgatcctcagttaaatttgttctcccaattgttgctcgaatatacctcatctccatt

SEQ ID NO: 1253 - DNA, 615 bp, Triticum aestivum
  Clone ID: PAT_TA_1253
gctttcctcttctagcagtctcacaccgcccaaggctgctctgctccatctctcccacaggctagctgcagacctacagactacagtgtaccaccaccgcctgccctgccgtgcctcacacctctatccccccctcccccaacccctctctccctccaccccatccgcctctcacgcgggacgccgccattgccgttccctttcgtcctcgtcgccacatcgcgtccctcccgcctccaccccgtccgcagtctttggccattgagtttgaggttgatgatccgtcggaaaggatgaacgggagtcgacagatggaactccactacataaacactggatatccatacaccatcaccgagagcttcatggatttttttgaaggcctcacatatgctcaagctgattttgctcttgccgatgccttccaggatcaggctaatccatactggacgatgatgcagacaaactcgtataaatatggatattctggtgcaggaaattactatagctatggacatgtgtatgacatgaatgactacatgcatagagcagatagtggacgcagaatttgggataaccccatgcctgtaaacagtaccgactcccccaacatag

SEQ ID NO: 1254 - DNA, 504 bp, Triticum aestivum
  Clone ID: PAT_TA_1254
gtgccgcttcgagccggccgggccgaaaaaaaaaaaaaaaaaaaaaaaaaaaaaaaaaaaacccccccttcccctaccccaggaggggggccccctaactcggaactaaatccccaggtgaacgggctccggttcattggccaaaaagaaaagaattgcggggggggccatggtggtccgggccttccccggggctggacacccggaacaagggggctcccaaggcgggggggggaacgggcccaactggccctggtggaagaaggtcgggttctgggggtccgggtccgaataatggggggaagggtggcaaagccaggggaaagggtgggggaccccgggaacgggaccgacccccaccgggggggggggggcccccattaacccccaagcggtcttccaacaaaaggtggtggaccggaaagaaggggcggggcaaggcaagggggtccacaactaagggggctttggcggcggcggcaacttggtcccggggttccggaa

SEQ ID NO: 1255 - DNA, 1285 bp, Triticum aestivum
  Clone ID: PAT_TA_1255
ggcagtttcaaccccacagtaccctcccccgacgaggagcgccgcccctatgaggctatcgcccggttcgagtgtgagtgtgacggcctcgaccgcctggccgggcctcccctcccccgcgttggattctgatttccttgtcagtttgacgatgcttgcgatttgcaagggcatcggagctctgcaggttcctcgacaaaggcaaatcaggtgaccgttgtttctttgttctgaaaaaatgtagctcaattcacatacgtgggatgatcggttcggttcagttagttgtacaatctattttttgatgagctcgatgcactttgtgttttaaggattttatttgagatagtgcagtcatattagcttctgcacctggagtgtccatggagcattgagtgagaaaattccattttttctttaaaaaaactcgtgccgaaatagagctccaacgaccaccagcgcctcctacagtcctactgtcagcctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggcggcccgctgggcgagatcgtggacccgctctaccccggcggcagcttcgaccccctgggcctcgccgaggaccccgaggccttcgcggagctcaaggtgaagcagatcaagaacggccgcctcgccatgttctccatgttcggcttcttcgtccaggccatcgtcaccggcaagggccccctcgaggacctcgccgaccaccttgccgaccccgtcaacaaaacg

SEQ ID NO: 1256 - DNA, 1039 bp, Triticum aestivum
  Clone ID: PAT_TA_1256
cccacgcgtccgcccacgcgtccgcattaggtggtcttccagcaacaaggatgatgacaagaccgaattgacaagagctgaagtagaatcattacgaagcgaaattgccgatgccgatgaaagggtgtcccagctaaaagcccggttagaaaatattgacgaagccttgagatatgcactcctttccgggtacctccatatcagaagtagatggactcaacttcctggggagccacctatcatagacgacgccgatgtcgatgactggcttcctcgctttgttgtcctacaaggacagtgtttatactactatctgaagtgtagtggctactgccgctgataatgacgatgacaacaatgttgacctttttggaaccaaagaagagaagaaggcagttggagagcatgctgccaaagtgaagggttcttgcaagaagaaagaatatgactgcataattttaccatgtaatttcttctcttttatcgatggaggaggtggtcagaagattcaattattcttaaactcctccacttcttctgcaaaagtttggtgatttttccaagggggccgatcagaggatctactcaactgaggccctcgggagtttattgcaagcccggttccaccatactataatgcaaggctggtttttatttcttcatttattctttttgagactccctgcgccaccatggttttatgtgtactacctctgcagtggaaacttctgctacaatgtgcatcgacaccagagccatgttccctatcatgctatggtgcttagcatcatcatgtatttccattcggtgtagttgagggctcccaaagtttgtgtttccaaaatgatacctcatttttctcttatttgtattgtttcacatagttttccactacagggataaagagctatagaaatttatgtaatttagctccggtaaatgatgctaaactgtaatgtcttaaaaatatgcttcctagccactcacatggctacgtggtatttactttcaggaatctggatagactaagactgatggt

SEQ ID NO: 1257 - DNA, 1018 bp, Triticum aestivum
  Clone ID: PAT_TA_1257
attgaattgacaagagctgaagtagaatcattacgaagcgaaattgccgatgccgatgaaagggagtcccagctaaaagcccggttagaaaatattgacgaagtcttgagatatgcattcctttccgggtacctccatatcagaagtagatggactcaacttcctggggagccacctatcatagacgacaccgatgtcgatgactggcttcctcgctttgttgtcctacaagcacagtgtttatactactatctgaagtctacagacctgagcccgcaggaatctctgctgctgcgcgacgtggaacccacgtcctaccccgacgacggcggtcgaccacaacctccctctcaggggcttacaccgttgcggttcctcaggactcggaaggaggagcgcgggccgtagagacggaagaggaggctgagacagccgcggtgcctgctgcagcgaccatggccactacatcgaaaagaaagacaacaaaatgtattaggcccccttgtgctggattgggctcaacccaattataaaagagtagcaaatgagaggaatacaagaagtcaagaagacacctttctctccatgtctaagtttcacggtacctcgcctggatccggaagtgcggctacggcgacctcgacatagtcaaggagattctaaaaaacttagcaatggcagggctcctggagctcaatcctcaccaccaccagcagatgatgatgatgcacaagtggatggtccatctgaagatggcgcagcagagcaccggcagcaaccacatcatgaaagggtcgagggaagattatctgatatgtgtcactgaaagcgaaggttgaatgtcaagacgatcaagaagatcaggtggatctatccaaaaatatgcttccgtggaactacataggttatttgtctcgcattgctcctgtgccttgattttgctgtatgagaagtacattgtatcaaacttgatgtggattgttcatctggtctcgcttttggaaaagtatatatttac

SEQ ID NO: 1258 - DNA, 1347 bp, Triticum aestivum
  Clone ID: PAT_TA_1258
tccccgccctcggttttcccgtcgaccaaccgatccagttcttataaatacctttccgtccagtcacctttccaccaccacacgccagttcagcgcacgaggcagcggaactggatttgtcttcgtccagggaagtgaaggctgctgctcctgtgcggtgctgggccatccaccttcggttcactacagtcaacgacggagcgccagaggcagaacccattgaaagcaggagccggaaggggaccatatagtgcaggctggtcaagcgtgagagttcaggttatcacaccatatgaagtgaaagcgccgttgggactattcgcgttgcatagaactcccatgacagctcgggcgattccaaggcccacttgagctcctcctgcttatgacagacggtgaggtttctcaacctccactctattagccatggtcacaaagtctttgtgccaggattcttccctttgtaaatgtgaaagcggtttgtcaacgtgcgtgtcgcagcggccctccactatctgcaccatctgtaccaagtttcctagggacccaactatacgcgccgacgccgctgtcgtcttttggccagctggctttctcgtcaactaaggcatttctactcggtccttttcttttagcctgctgcagggaccaaagactataccttcttcttcggtcttcaatccgttttcttcttcaatgaagctaaccacgacatcctgcacgtactgcaccgctcccagagtttccacggtgcggcggctcgaactgacgctctcagccacggcgcgcctggatcagtcaggttgatcgagggacaatactggcaaccgctcgtccgtgctgatcttcgaccgagatagagttcaggttatcacaccatatgaagtgaaagcgccgttgggactctgctcgcagtgcatagaacttccatggcagcacgggcgattccaaggcccacttgagctcctcctgctgatgtcagacggtccacaaagtctttgtgccaggattcttccctttgtaaatgtgaaagcggcttgtacgatctattcacagacttgctctgctgctttgtagcccaactgattatgtactcttgatcgtcctcgtggcatcctgtcaactccattgtgaaccctctctttatccttaaggctgtacgctgctatgcatatgaatggatagatgatatagtaaatcgaacttttctttttaaaaggctcatatcagaaggaatgtcgtgtactgtgaaccaagttcagtatgttgtctattaaatatattcccgtttctccttcaaaaaaagaggggcccggaccagtcgcccctgcccgggcggccgctcga

SEQ ID NO: 1259 - DNA, 1447 bp, Triticum aestivum
  Clone ID: PAT_TA_1259
cccacgtcttccggacgacacctcgcggcgcgagcacggaggaggaggaggagtggtgcggggagacgaagacgatctgctgacatggcgacggcgatggacacgacggtgccgaggagcggggtgggggaaggcggcggcggcggtgggctgaagaaggggccgtggacgcaggcggaggaccgggtgctgctcgaccacgtgcggcggcacggcgagggcaactggaacgcggtgcgccgggagaccgggctgcagcgctgcggcaagagctgccggctccggtgggccaaccatctccgccccaacctccgcagggccccttctctcccgaggaggagcgcctcatcctccgccttcacggcctcatcggcaacaagtgggcgcgcatctcaacacacctgcccgggaggacggacaacgaggtcaagaacttctggaacacgcgcctcaagcgccggcagcgcgccggccagtcgctctacccgccggacgtcgagcgggagatcgccctcatgcgcgcccagaacatcaacccgttcgccgacgcggacggcaacaccgtggcgtcgccgttcttgggcccgttcgcgctgcctcccaggccgccgtcgtccaccaaacaggcctctcactctcattctcactcctcgccgctgatcaaccagcactaccagctcctcaaccagatgcaggggatgcagatgcgccaccacgccgtccagcaccaccaccagcagccggcgttccactaccacggtggcatcaggtcgccggggctcccgccgttgccgaccaggccgcgggagctcccttcgaaccaaatcgagatggcgagctgcagcggcggcggcgacggcctgctggaggctctgctgctcggcgtcgacgaacatcaactcccccgtccaaaccatgccgtgtgcagggcgggctccatgcccgatctcatgtacggcggcgtcgcgagcgggagcgacagcgacgtcacctcgcagttccctcccgctcccggaggccaggacccgcaccatggcgggaaatgggacttcctcgtcgatgacatgaagccaacaatgaggagggcgacgagcgcggcggagaacgagacttccggtatgtttggtgtggcccatgggtcaatatccggggagtggtttggcaccggtgttggctcaccagggccgtcgtccgtcgtcaccacggatgatgagttcggccttgagatgcagcagctcatgtcgtcgttgccactgtcggccgacgagcttaactggaacgcttaattggcaaaagaaaaaaaaagggaaattaaagacatagggatggtgtttgtttgctatgggagcagaagatgccttcgttttgtatcgagtgagtcatattgtcggatgtggcttattgtcgggtacttgctaatgatgctataagaagcgtttcgacccca

SEQ ID NO: 1260 - DNA, 704 bp, Triticum aestivum
  unsure (1)..(704): unsure at all n locations
  Clone ID: PAT_TA_1260
agaaagcgagataagccacagatctagttgtctggtttttggatcttcaacaaatcaaacacaatttacctcgtatatatataacatttgttgttgcttgacccaacaataattcctaaccatgataatgaccgtaccacgaggatacagaaacttttgacacaattatcaacacttccatgtcaagagcaggaagagagaaccggcacatttgaggagcagaatatctaactctatcatgtggcacactccagaaaaaacatcaaaacttctggaatttcttgtttccaaattagaaaccgagcccaattactcggcatcagcatcatcaaaaccatcgtcttcaccgtcgtcgaacgcttgaggccctacactgtcttcacctattgtagtatcgtcatctccagacttttcagggcctggtcctgcagacaccttgaccatcgccggacgtagtaatctctcgccaagcttgaaacccttgcggaattcctggaggacgaccccatcttcatattccaccgattcttcccgcacactccactcacggagcttaggaggttggccttgcctccagttcccacatcctcagctccaatgcctcctgggtgcgtcatctcccttgataaggccctgcgggctggtcttcagtccagcgtaggcnccgtccactttaccgtgttttgccccttcaaagttgtaag

SEQ ID NO: 1261 - DNA, 1002 bp, Triticum aestivum
  Clone ID: PAT_TA_1261
ccacaacagcgcgatactggctgaaggcttctaggcgggcgggccgcagcccaagcctgaactgcgcggggctctcaacacggctggggcggatcactccatgccgggcacagatcgagtggtacaaggcatcattcgacgccgacatagggtactacgacgcattcaagcaacagaggtcaccaaagaagttcggcaaggccaacatttatcgcctcaagctgggccagttttgggatggggtcctcacaatgcttgacaacagccagctgccgcacgacttccatcgccgggccaagtgggtgaacgccgcccggttctaccagctcctcgtcgagccactggacatagcagactatcaccgcaacaacctccacaggctgactcacggctacatcacccatggtcgtgacagaaagtatgaggctgttagacaagtggtggaaggagaagggcgccttcagtggcactagcaccggcgacacgtcggtcacagcgacagcaaggagcaagtacgctgggctgactcaggatccatgcttctgggcgagggtggaggaggcgtgggatcaggactgaaagcgcccaggccgagtacgacgtggcgatgctggcgatgaagcttgggaggctgcgggagttcgagcggtacgccagggagctggtggagagcaaggaggtgtccatcgacgtccttgcgccgcagtcgagctacacccgctgggtggaggagtggaagaagctcttgctcagagacgaagccagaacagcgtcgttgttttagttctcatgatgaattagctggagcagctcaagatttttatttttattttttgccactagttttaggtaacttagtatagccctggtataggcggttgtaaatacgcataggcttgcagaccgcagaggcactgcattatgttgttgtatcagttcatcatcttgcatcttgatgctgatttattcagttgtttcttcctcaaaaaaaaaaaaaaaaaa

SEQ ID NO: 1262 - DNA, 938 bp, Triticum aestivum
  Clone ID: PAT_TA_1262
cccacgcgtccgcccttcgcctggagccaccagctcagacaccaccagcaacggcgaaactagtcctggcaatgcagatgagcccgccctctcttccctccttaccgttggcatgcaggcgctggccagcgccgtgccttcagtcaagctcaacctctcaagcgtgactgcaatcaacagccacatatgcaccaccattcaccagattacaacagcactcaagtgtgccggaaatggcaacactgtgcgcccaccgccaggttctcatgcggtgcaagaggcgccgggtgggagcggagggaagcacacggtcaaagactgtgtccaattattttgccacctgctaacacctgagagtactttgttagcatcacagttgcaagcgaggatttgacaggagcccaacttgttaaagcagactgtaatgcgaaagggaagatgaaggtgagagaggaggagtcaagagcgaaccattcagtgatccttcccactagcaacggtaagggtctcttggattcgggaattgacttgtttcctctctccgccgtgtctgtaaaacattcgcctcccgtctccaacagaatcagctcccagggcattttggtcatgcggttcttgctgctactcttcctcctcccccctgctcagaaagtcaaagactgtgaaggtatcttcttttgattttgtaataatgagagtacttaattagtttgagcgtgcgactttgttccaagacttgtttaaagcagactgtaatgcgaaagggaagatgaaggtgagagaggaggagtcaagagcgaaccattcgtgatccttcccacttgcaacggaagggtctcttggttcgggaattgacttgtttcctctctccgccttgtctgtaaaacatttggatcatgttttgttattactgtgttcctggtaaaaaaaaaaaaaag

SEQ ID NO: 1263 - DNA, 1063 bp, Triticum aestivum
  Clone ID: PAT_TA_1263
ggctcacgctcccaatcccgccgatctgctgccattggcatacgctcccaatccccccaactgacctattgcaattggcacgttgctattgcagctcctccgccgcttcatgtcgcccttcgtaacttcatgccatcatccactttgaagatccgcatggtgctgcaattcgtccaaggagtagggaagcttggatccagcaaaaaaacttaattagtaattaggcaatggagtgaaggaagggtgatctcatcccaacgcccaaaccttgttcgattccatctatggccgattcgtacccacgcgtccgggaaaaaactgctctgtatatgtgtttcacatcacaacgcttacgagattaagaaatataggaagctatgaagaatgggccagttacagtattcagatatcatatatagctgccacttacagaaaatatgattacaagtaggatttacaatcgtttcctcaaatcattaaatgggtagctattgtgagttccagtatggtcgtttattgatcacaaaggaattgcttctgccattggaagtatgacatgagtcctgacttctgcagggacattatggaggcatcagatgatcggggggatcgacaatgggaggctaccacgacaagcaactagcaaagaaagaggagctatggactaggcattacatgctggacaccatggactgaaaacatgagacatggattgacacgggaacgatgtattacaattccgtttcccatataatctaaaaggatgagttgggcttcccttcatgagcttcttttctgtaaggttcatgtatagagaaagaagaaacaaatataaacattatagccaagatgaggaattgaggataacggtggtttatctcaatgccacatgtttagttggtggagcatgctcttggagtacgcacggaaattaacttgatggaagtaaataacatggcaataaggtggctagatttttctgttctattacacagtacatttatgtttatttaaaatcaattgccagaaaatttcatgttccaataaggggattttttcccca

SEQ ID NO: 1264 - DNA, 1210 bp, Triticum aestivum
  Clone ID: PAT_TA_1264
gcagccatggcggatttgaaggctccggccaaggcgaggaggctggcaccgcccatgtcgtggcggacgcgcctgtcaatcttcgccgccggttacctcaccgacgccacctgccgcgctgacggcacaatcaaccgccgcctgctcacctacctcgaccccggcgtcccgccctccgccgccccgcgcaacggcgtgtcctcccgcgacatcgacgtcgacgccgcgatcccgctccgggcccgcctcttccaccccgtgggcctgcccggcccgctcccggttgtcctgttcttccacggcggcgggttcgcctacctctccgcggcctccctcgcctacgatgccgcgtgccgccgcatcgccaggtactgcggcgcggccgtgctgtcggtcgactaccgccgctctccggagcaccggttcccggcggcgtacgacgacgggttctccgcgctccgcttcctcgacgaccccaacaagcaccccgccgacgtcgcgcccctcgacgtctcccgctgcttcgtcgccggggacagcgcaggcgccaacatcgcccaccacgtcgcccgccgctacgccatgtcctccccgtccttcgccaacgtccggatctccggcctcatcgccatccagcccttcttcggcggcgaggagcggaccccctccgagctccagctggagggcgcgcccatcgtgtccatctcccgctgcgactggatgtggcgcgccttcctcccgcccggtgccgaccggacgcacgaggccgcgcacgcggcgtcccctgcggccgcggccggcatcgactccccggcgttcccgccggcggtggtggttgtcggcgggtacgacccgctccaggattggcagcggcggtactgcgagatgctgacctccaagggaaaggaggtgcgggtgctggagtaccccgaagccatccacgccttttatgtcttcccggagttcgccgagtccaaggacctcatgctgaggatcaaggagttcgtcgccgggagcgacggcagcaagtgagcagctcgcgccagtatcttcagtgtcagtgtttgcgtgtgtggtcggaattaggagaagaggattgggtgtgctggcatgacgtatctggacgagagtactcgtagtgaactactgtagtagggaagtacggatgacgacgtgtaagaagtgttattcttactaaatgaccctcgag

SEQ ID NO: 1265 - DNA, 741 bp, Triticum aestivum
  Clone ID: PAT_TA_1265
gcggagcgtgtcacggcacacacatcgcggtcgcgggactcatcagggacggcacagacctcgcggccgcggacggcggcagcggcgatgggaagcccgctgggcggctggccgagccacaacccgcagaacttcagccagctcgtcccggccgacccctccgcccagcccacgaatgtcacaccaacaacttacattgcagcacataggacagatccacctccatatcaagtgatcacgacagagcccaggaacatcctgttgaggcatttctaccagaactcggagaacaagccgaggccgaagagggccgcaccggagagtgccgccctgcgcaacggcaagcaggcgaggagccccgcggatggcggaagccagtcgagcacgagaagctaaaccagggctggtgttcttgtcttgcgccgccaccgcggcatctctgaatctttgctggtgatggtcggtcggtcggtcggttatacaactcctcatttgtttgattttgagaaaggtgtttgcacgcgtgtacgcatgcactgcacgtacatgttggccaggcctagtgcgggtgacacccggcatgggaccactgcagtctctttctcctttgaatttagataataatgtcccctggccgcaccagcacaccaactttgtactgctactactgtagtagcgcttttgtatatttggatggatgtttcccgcttttggcgaatgatattgatgtgatgtgattta

SEQ ID NO: 1266 - DNA, 419 bp, Triticum aestivum
  Clone ID: PAT_TA_1266
ctgacctcccacggcgtgttcgtcgtcgagggcgacatcaacgacggccgcctcctcgccaagctcttcgacgtcgtgcccttcacgcacgtgctccacctggcggcccaggccggcgtgcgctacgccatggagaacccggcctcgtacgtgcactccaacgtggcggggctcgtcaccctcctggaggcctgcaagaacgccgacccgcagccggccatcgtctgggcctcctcctcctcggtctacggcctcaacgacaaggtgcccttctccgagtcgcaccgcacggaccagccggcgtcgctctacgcggccaccaagaaggccggcgaggagatcacgcactcgtacaaccacatctacgggctgtccatcaccggcctgcgctttttcacggtgtacgggccctgggggcg

SEQ ID NO: 1267 - DNA, 1093 bp, Triticum aestivum
  Clone ID: PAT_TA_1267
tgcatgtgcgtgcccgtcccgctcgggcctctcctgcccccgctggcccgcgtgcgctgcgccagggtgttcccggcctcgtgcgtccccgccaaccgggcggggcccggcgccctcccgggcgcctgcccccgccccctcccgcggccgcccttcgtcggggcctccccctccccggccctccgccccgaccccatggtgcccgtctccgcgtcccaccgcacggaccagccggcgtcgctctacgcggcgaccaagaaggccggcgaggagatcacccactcgtacaaccacatctacgggctgtccatcaccggcctgcgcttcttcacggtgtacggtccgtgggggcggccggacatggcctacttctccttcacccgcaacatcctgcaggggaagcccatcacggtgtaccggggtaagaaccacgtggacctcgcccgcgacttcacctacatcgacgacatcgtcaagggctgcctggggtcgctggacacggcgggcaggagcacaggcaccggcggcaagaagcgcgggccggcgccgtaccggatcttcaacctgggcaacacgtccccggtgacggtgcccaccctggtggccatcctggagaagcacctccgcgtgaaggcgaggaagcacgtggtggagatgcccggcaacggcgacgtgcccttcacccacgccaacatctcgctcgcccggcagcagctcgggtacaagcccgccaccaacctcgacgccggcctcaagaagttcgtcaagtggtacctctcctactacggctacacccggggatccaagaacttgtgaccgctccgccgcgccgccggaattcttccccaacccccctccccatcccccccccccgactctcctatttcactatttggatccccggctccgaccacgcccggtgccaacctttttcggcccctggtccatgcttgggtggatcgtcgccgttcagggtcaccattcttgtctcgattctttttggggaaatgctacgttttatggtgttctccgatcaagaaaaagaaaatcaatcccggatcgaaaaaaaaaaaaaaaaaaaaaaaaaactgag

SEQ ID NO: 1268 - DNA, 846 bp, Triticum aestivum
  Clone ID: PAT_TA_1268
aagaggccagccggagatcactccctgttccccatctcaggcacacaagccctaaacccgtgcatggcattcgccgcctctcgccgtctctccgccgccgccgccgccgccgccgctccgaaactctcctccctcttcacgccccgacccattcctaatcctaagcctcgcccgctgtcgccggagtccggcgatgatcctaggcggcggaaggcgaggccgagatcaaggcacccgtggggggaggatgcggcagcgctgctccggcggcttcacgaggggcgatacctgccgggaccctacatcccggatgcgccgcatgtagtatcccccgacgctgtcaaggccgccgccgagcggttcggcaacgatcaccaggtcgtcgccaaatggttgtcgggaagtgacttgaagaaggtagcattgtttggctgcccatctgtcgagcgaagaacagtttttgcatcaaaaagattacgagctttcttcaacttgccagaagagaaagtatgcagctcttgcaagataagaagttcatgccagtttattaaccaggaggtgcctaggtatgataaagtgatcttgtcagatactatgaggatccttgctttgtttgtactggatgcatatcctgagccactacaggttactgctgaagtaaaagctagtgttcgcaaacttctcaaggacaccataaatctaagcatttaagttctttgagggataatttttaatcagttgaggtactgtgtatatgtcaggtatacttaggttcattttcccactcttcttttttcttttgtacctcgagcaaccattgtaacatgttcaatcaaataatagagt

SEQ ID NO: 1269 - DNA, 1021 bp, Triticum aestivum
  Clone ID: PAT_TA_1269
ccgccattcggacgcgggtcgcaacccgctttccccaccttcagctcctgaatctagggacaataaggtttcccgagcgccgccacacgatccaccctctccctctcatgtcgccacccaaggtggtcgccgggccagcctgtgtggttggcgatgaaggtcgtggtgagatttttgctgattcgttcgctggcggaggaccttggacgccaaggcggcggcctcggacggcgaggaagcgttcgtcagatgtgctagccggcttccttggctacacgggtggagaagattcggctgattgtggtcgcaacccggattccccaccttctgctccagatctgaagactaagaaaggtttggaggactccatcggcatgcacacggtccaatgctacaaatgggagaaatggcgccaggtcccaacggagtatggggccgacctgacggcctcgaggttcgccttcgccacgcccatgtttgttccggcgcctattggagggcgctcactatggagggttgcccaggccgaggggggatagtttgagcagatggacgtgttcggattctgattactactgctatccgaccggcaccaactaggtactatgcaagtatcgtctttttgatgcctctgtgtcatgcatggtgctgcccaacgggatgcgcccgcggcccggcggcgacgtggagaagttcctccaggagaacccagagtatagggcgaacctgccggcatcaaagttctccttcgccacgcccaagatcgttccggcgacttgtggtagagagctcactatgggagggttgccaaggccgagggaaaagtgtgaggagacggacgtgttcagattctgattaatgctaccatccgagcggcagcggcagcggcggcaactaggtactatggaagtatgaactttatggatgcctctgtgtcatgcatggtgcttaataatgtgatagttctacatcacaatgttttatccttgtttgttttgagtgtgggttgttaatcactctc

SEQ ID NO: 1270 - DNA, 791 bp, Triticum aestivum
  unsure (1)..(791): unsure at all n locations
  Clone ID: PAT_TA_1270
ggaagaataccatcttcttggatcatccctcaccacttgttaggacaacttacaatggccatggtcaagaacattgcatgcacattgttccttgctgccattgtggtggcagccacattggtaccggcggcaagcggcgccggcgacaaatccattgaagagatggattcatccatcaagaaggcctttgacgcggtcatcgccgccgccccagcatccaaaaggtctgcagtagaatctttcgtgctcaagcagaaagtcgctgccaccgcctcgctcaatgaggccgctggagataagaagaaacttgatgaaattgtcactgcctataagatggcctccgatgcggtccttgccgctaaacccgccgacaaatatgccgtatttgacaaaaccttcagcgaggctggtcatcctcccaccgtgaaggccgtcgacgcattggagaattccttcaaggaggccattggtgatgtcgtcgctgctgccccagcaccacaacaggacgaaatgaaagccctcgtcttccagcagaccgtcgtcgctgccaacatgcttgcccagtctgcaaaggacaagaagctatttgctgcggttaccactgcctacaaggtggcttctgatgcagtccttgccgctgcgcccgccgacaagtattccgtaatgggaaaaaccttcgcggaggctgctgatgtcaaagcagcatgagtggcaccttgatcgtccggccttcgatgcancagaccaccagcagatggatccctggagggttattgattttggtccatgca

SEQ ID NO: 1271 - DNA, 822 bp, Triticum aestivum
  Clone ID: PAT_TA_1271
cccgcgccgccgccccgcagccctcccccgacgccgaaccgaatcgcagcagcggcagccggagaagaagagatcgagcgccagcagccatgtccggcatggaggaggaggagaacgccgccgagctcaagatcggcgaagagttcctgaaggccaagtgcctgatgaactgcgaggtggcgataatcctggagcacaagtgggagcagctgcagcacatgtcggacggcggcgccgaccaggtctcgcaggtcttcgagaagtcgcaggcctacgtcaagcgcttcagccgctacaagaaccccgacgcggtccgccaggtccgcgagacgctctcccgctacagcctcgtcgagttcgagctctgcaccctcgggaacctctgccccgacaccgccgacgaggccaaggcgctcgtcccctccctcgtccccggcggcaggttcgacagcgacgaccgggtcgacaagatgctcaacgacctctccctcatcaagaagttcgagtagtagcccccataatatgctcttcttgtcttcctccagtgatatgtttaagcttcagattatctccttttattgcgctatgatcataagacatcagtgtcagtctcaaatgaatggagttaattaaaccttgttgctatgatgtcatagaaaataatcatgttgcttcagctgcgtcaatttcaaatgtatggagttcattaaacccacttcctatgctgtcttggagaaatggggagtagctgctcttgtggcttgcaagcagcttgccctcctgtttgctagaactataagacggactgtctgatcttctaaa

SEQ ID NO: 1272 - DNA, 987 bp, Triticum aestivum
  Clone ID: PAT_TA_1272
gcctgaaatcacaaagtacaaagctgtggtttctgcccaaccgcccaggcaggagattattcaagatctctattgcacaggcatagaccctgagaagggcacccctgtacacagtggaatgatgcgggagttgctagtgtcattctttcagaagaccaaacataaacccagcaggatcatattctacagggacggtgtgcccacgcgtccgcggacgcgtgggttctgatgtatgaaatggatgccatcaggaaggcttgtgcatctttgcaggaggattatcagccccctgtgacatttgtggttgtccagaaaaggcatcacacaaggctcttccctgaggtgcacggaaaagagaccgacaaaagtggaaacatccttcctggaaccgtggtcgacaccaacatatgccatcccaccgagtttgatttctacctgtgtagccatgccgggattcagggcacaagcagaccaactcactaccatgtcctcttcgatgaaaaccgtttcactgccgatgggctgcagctgctcaccaacaacctgtgctacacatacgctcgatgtactcgctctgtctctgttgttcctcctgcctactacgctcacctggctgcgttccgcgcacggtattacgacgagccatcggagggctcggacagcgcctcgatcgtcagcggtggcacccgggagtcagctgccaccggcgcaggagctgctggtcctcctgggacataccgtcgcctccccaggatcagggataacgtcaaggacgtgatgttctattgttgaatcggcccattgacaagttcatgggagtcgtgtgttttgttggcttgctgcttaattaggcggtacatttgctgggtacttgtgatggttaaacatggtgttggtaaaacatgggagatgtgatgcatctgttggattttctgcgcagagcatgaagggaatcaaacaggcttttcaatatgatgaaaaaaaaaa

SEQ ID NO: 1273 - DNA, 713 bp, Triticum aestivum
  Clone ID: PAT_TA_1273
aaaacaaaatactagcatacagcaccaccacaaagaaagccagcaaggcctagccatcctacctagtgtagagtacgtgcttgtgcaccggcaatgtgcagagggacggtggacgacctccgcccgctcgggccccggcggctcgacgtccgcgccttctacctccgcctctcctcctcctcccactcatccgcgtcgccgccgcccgcggagctcacgctcgtctaccgcccggccatcggcggcgccgcgctggagctggccggccgcgcgctcccgccgccgtgccccgccgaggccaccctcctgcgcgtccgcggcgcggccgacggtgcggacgacgcgccggcgtacgcgagcgccgaccgcgtctcggccgccgagggcgcgcgcttcgaggtgtacgccgggcaggagctcgcggcggagggcgccttcttcccgcggcgccggctcgacggaggcgggtggcacgtcgagtgccgccggccggtcgggtcgcgctcgcactcgcgggtggcggaggtgctggtcctcgcggagggcggcgtgctcataagggccagggccagggcggcgaggcgggccgggtgcgcgacgccgctcgaggggataccggaggaggaggatgcgtcctcctgggggtcgtgcaagtgcggtggggcttggggacgggtggcaaatggtcggagacaagaggagggatgatgacg

SEQ ID NO: 1274 - DNA, 332 bp, Triticum aestivum
  Clone ID: PAT_TA_1274
gagacaaaatgttcatgcagacgcaccgttcccacacacttgtattacagagataatgtcattgagagcacaagaaaacctatgcagcagtagagagagatatgtatacacagacaggtataccggcatagctgtagtactcttcccgctgaaacccacgcaacacatggacggaccctttccggccgccccaccggagcagcaatcgatgagatcagacggtgtagttctgcggaatggcgtcgatgtcgatgcccttctgcttgacgaccgactcgacgtggcccttgagcgtgtgcagctccctgagcctggcgatctcggcgcgcttg

SEQ ID NO: 1275 - DNA, 265 bp, Triticum aestivum
  Clone ID: PAT_TA_1275
agtagtgatcgaaacgctcttatatttgtttagggagggagtagcagggagagaagcaagaggtttgtgacaagagagacaaaatgttgatgcagacgcaccgttcccacacacttgtattacagatagtgtcagatggagagcacaagaaaaactatgcagcagtagtaagagagatgtatacacacagagaggtataccggcatagttgtacaagcattgctcttctcgctcaaaaccacgcaacacaagccggacgcgtggg

SEQ ID NO: 1276 - DNA, 1577 bp, Triticum aestivum
  Clone ID: PAT_TA_1276
ttttttttttgtgactagagagacaaaatgttgatgcagacgcaccgttcccacacacttgtattacagatagtgtcagatagagagcacaagaaaacctatgcagcagtagtaagagagatgtatacacacagagaggtataccggcatagttgtagtacaagcattgctcttctcgctcaaaaccacgcaacacaagcgaccctctccggccgccccaccggagcagcaatcggtcagatcagacggtgtagttctgcggaatggcgtcgatgtcgatgcccttctgcttgacgaccgactcgacgtggcccttgagcgtgtgcagctccctgagcctggcgatctcggcgcgcttggcggcctccgcggcgatgtcggagagctcctccttgttgctgaggaggtcggagccggccggctggctgaggccgttgagcgtcctctgctccctggcccacagcgcctcccgctcgcccctgccgtagtccttcttgttggtaaacgccgtcttgttctgtacgttgttccaccccttgccgctgatcgagtagcggatgatgaacttgagcacgtccagcgggatgtaggtgacgagggtgaagacccagatggcgccgccccacgcccacccgatcccctccatgtcgcagaagtcccagtcggcgtacacggcgatcgccgtcgccaccagctgcgccgcgaagaaggcgaacagcagcaggaaccccggccgctccacgaaggaccagctccgcgaccgcgtcacgaagatgagcgcctggctgatgatgctcacctgcaggtacagcgccgccatcagctgccggtcgttgtcccggatcgggtgcaccccgaacgtctccgtgaagaagtccgtgtcgtgcgccaggtagaagaagaccacggtgaccagcgccatgtacgtgcccagcaccacccccgtcgcgaagatctcgtcgagtttccatgagtccggcttcggcgacggcttcacccggtccttggagatggtcatgatggtgccgtcgttgaggatggcgatgatgagcaccatgaagggcgcgaagtcgaacttccagatcagcgccaccagcatgaacccgagcacgatccggatcgtgatggacaccgcgtagatggtgtagttcttcatccgctggaagatggcgcggctcgtcagcaccgcgctcacgatcacgctcagcccgggctccgtcagcacgatgtccgacgccgaccgggccgcgtccgtcgcgtcgtccacggcgatgccgatgtcggccttcttcagcgccggcgcgtcgttcacgccgtcgcccgtcatccccacgatgtgcttcttgtcctgcagccgcttcacgatctcgtacttgtgctccgggaacaccccggcgaacccgtcggccttctcgatgagctcgtcgatggggaggccgtccacggccgtgttcttgtcgcccaggagggccgtggacgggtacatgttggtgcccatgccgagccgccgcccggtctccttcccgatggccagctggtcgccggtgatcatcttgacgttgacgccgaggtggagc

SEQ ID NO: 1277 - DNA, 599 bp, Triticum aestivum
  Clone ID: PAT_TA_1277
gacaagacaaattttggcaccaaattttatggtgaacctgcagaaatgttggtttcaacaacctttaaaaattccaaacaggaaaaaggagagaacagtggtggatacatcattcggataccatttggaccaagagatatgtacctaactaaagaacgtctatggcctttcattcaagaatttgttgatgccgcactcagccatattgtgcggatgtcaaaaacaattggtgaagaaatcggctgtgggcatccagtctggcctgctgtgattcatgggcattacgccagcgcgggaatagctgctaccctgttatcaggagcacttaacctgcctatggcatttacaggacatttccttgggaaagataaactggaagggcttctcaagcaagggcgacaatcaagggaagaaataaatatgacatacaaaataatgcgccgaatcgaggcggaggaattgtctcttgatgcatctgaaattgttattgctagtactaggcaagagatagaagagcagtggaacttgtatgatggttttgaggtcatacttgcaaggaagcttcgagcaagagtcaagcgtggtgctaactgctatgg

SEQ ID NO: 1278 - DNA, 1027 bp, Triticum aestivum
  unsure (1)..(1027): unsure at all n locations
  Clone ID: PAT_TA_1278
ggccgggccgggatctcttcatcaactcatctctactctccaagtctcaatatcgcaacaatggtttccaagctcgctctcgctcttttctttggcaatgcccttgctggtcttgccggccgagctcttcctcctcgttgcgccgtcgccgaccctaccgctgagcaggttcagcacgcccagaacttgaagaagattgagtctgtctccaaggttgctgctgcttccatcaccgttgacacctacttccacgttgtgtcctcttcttcgtccaagtacatctcaaaggccaagctcacggctcagctgaaggctctgaacgacgcctatggccccaatgacattaccttcaagctcatcgacacaacctttaccaccaacaccaactgggctgctggtaatggcgagcttgctatgaagcgacagctccgccagggagactacaagaccctcaacctttacttcactgatgtcgccaagcttggaggcactgaagctctcggttactgttacttccctgagcccaacgtctcaactggctctcagaagttcatccttgacggttgcgtcatcgtcgctgagaccgttcccggaggcactgctgccccctacaacctgggtggaactgccgtccacgaagttggtcactggttcaacctcttccataccttccaggatggatgcaacggtggagatcttgttgccgatacccctgcccaggcccgtcagacaagtggatgccctgctcgcatggacacttgccccaaccaggctggtgatgaccctatccacaactacatggattattccgatgacgtttgctacgaggagttcacccccggacagcagacccgcatgcactctgcttggaccgcttaccgaaagtaaatggacgatgatgaaacgatatttcttgtatatagttttgacgagtagttttatgaagaatatatgacagtttctgcgagaannnnnnnnnnnnnnnnnnnnnnnnnnnnnnnnnnnnnnnnnnnnnnnnnnnnnngaa

SEQ ID NO: 1279 - DNA, 1345 bp, Triticum aestivum
  Clone ID: PAT_TA_1279
ccgcggccgcgtcgaccgccccgagggccaggacgcggtgggcggccgccgtcgctgcagcacgcgctgccgcagccgctgccgcgggcggcgccgccggcggcgtccgccgcccccgcacgcccgggcggcggcggcgccgagagccgacaacatggacgaggacgacgaggacgaggacgactacgaggacgaggacgcggcggccgcccccgccgccggctcgtccctgggcatggtccagttcctccgcccgccaccccggcggcttccgctccctccccacccccacaacgttgtcaggccgaacgccacctcgtccggcggcggcaacccgccgggccctttctctctccctgcctctggcaccgcaaagacccctgcctgttcctcccgcgcctccgtcccgtaggcccatccagcccccccctcccccgccctcgctccccccccccccctatccactccctcggtggctttccacctacgctcttgcccgcccgcgtaccatttgtatctacctacctcgcccatcttccttccccgtccttctccctccctctccatgtcccgttcaatcgatacaagctactggccgcctgcatccgtttcttgattcgttgctgtgtttaattacagtgttacagtaaaaaatgggtggtctggttagcctgcgtgctggcgtgggcgtgcgcatcgtcccttccggcccgacgccgtcactcagccgtcccttactactaccccggcgtggtacaagctacccacggctgcagcccgttcctgctcccgcgcggtgttaatgacggggtgaccgtgtgcttgtggcggtcggctttttggtgctgacggctcctggccttcagtatgggcccgtccggccggcgggcgtcccggggagaatgattacggctccaccgggctggcctgcagccccggtggtaggagcgacccggcccgctcccggtttatttgctgtcgagtccctgtgtttttttcttccatctttccggtgctgtccgctacggccctccggggttgtcctcttctggccaactgtttttactgaaatattacagtgtatacttgtgacatgcctgttccccatgaggaagaaaggtgctggagcatatgcggtttttttttccttttgatctttctatatttttttcttcaaaattaccgaaattgtccattatgtattacggagtttttcttcttcttaccaactgtttttactgaactattacaatgtatacttgtgacatactatatcctatattcttgctgttcttgcaccggctttcttcggtgtctatatgaactccatcactgccaaaaaaaa

SEQ ID NO: 1280 - DNA, 616 bp, Triticum aestivum
  Clone ID: PAT_TA_1280
ggtcaccgtgctcaaggacggcttgccgtaccccaacggcatcgcggtgagccacgacaggacgtacgtcgtcgtcgcgcacacggtgccgtgccaggcacacaggtactatctccagggaccaaaggctggccactacgagctgctcgccgacctgccgggctacccggataacgtgcggcgggacgggaagggcggctactgggtggcgctgaaccaggagaaggggcgcccgggcgcgaccacagccccagtgaagcacttggtcggtgtccggctcgatggcggtggcgttgaggtcgaggagctgacggcggccaagggcgtgacgctcagcgaggtgaccgagaggaaaggacagctgtggctcggctccgtcgagctcgattatatcggccttgttgcctagtttgtttacattatattactactactagctagtctttttcttatgtactagatacattactagtagtttttattagaagatttgtcataatatggtcagttatgtaggttaatttgttggtggacgtaattgatctcgtttttaatctaacataaattcaaagacatatttcgctttttgaaaataaaaaaaaaaaaaaaaaaaaaa

SEQ ID NO: 1281 - DNA, 476 bp, Triticum aestivum
  unsure (1)..(476): unsure at all n locations
  Clone ID: PAT_TA_1281
agaagacaccaagaagaagccctccgcggccgcctcgccctcggacgacgacgacgacgatgactccgccgcagactcgcccgacgactcctcgtccgatgacgccaccgcagacaaggacggcgccgcgccgtccgcggtcgccgggtgggtgaccgccgccgtggccgtggcctcggcgctggcattggcagcttgataaaggtgtgtgaactagtgtgtttttgtgctgagttctccgaaaattcgtggtccttgttatttatcgcgaaaaataagaagggccatttcattcatatttattaccacgtgtcctgaagaaaaaaaaggaaaaagacaggaatttccgggtttttgttgtgatgatcattttgtaatgatagtggtcaatggtactggaatgtgtgtttgtgtttataatactactcctatatatgaaagacatcctggagttaacanaaaanaaaaaaaaaaaa

SEQ ID NO: 1282 - DNA, 1149 bp, Triticum aestivum
  Clone ID: PAT_TA_1282
gtcaacaggtaaacgcttttccgataaaatacatcacagtgaagtttctgtgaacaaaatcacataaacatatttggacattcctgccgtattcttatctgtagcatctggcttccattcctcaggtaaaacagtggtctcttgctacaaaatcatcctagtagtattcgttctaggtgggataatcaagaactgaataactcgagcatagatagcaaaacaagtttattctgttgcaaatagttaacacagcggagcgagttattttgatttctctttcttctggtcgggggctcttgaccctataatgctacagatgggttgatctggcgactgaagcaatttcagcgccgggtggactatcagatcgcgcatcagcagtttctgcccgacgtccaactcgcttaggtccacttcaatgtatggtgggactatgtcagcagggcagagaaacttgacagttcgttttatggtgttgaagtaagctcctttcctgaggccaggtgaggcgtcctccccaatgtacattaaaggaacatctattttgagcagtgccgaagaaggtgctctcatgaatgtcacattcagaggttcatcagtgcctgcgtgcaagtgcaccttgcgcggcaggacgcggacgctctcgatgaggtccccctgcccggcctgctcggaccaaacctggagacggaagaggcgggagaggaagaaggaccgtccgaggtggtcgacgagcttgcggatctgcttggacggcaccgagacgaggcgcttgttgccgccctcctggccattctcctgctcgaagacgatggccggcacacgcccagccttgcgttccttggcggcgaagtgccggccagaggagtccctcgggacggcgaagatcacctcgtcgtgcttcgcgtccggccgcgggtgaccagggaggtagtcgaacggcggcgacaggagttcgtcgatgttgtgatctggggcggaaaccgctgcggcggaggcggagaggtgccggcggaggagggggagggtgagcgtctgaagtggtcgccggaggagcatggcggccgccggttggtcgtcgcggggtgtagggttttcgggaggtgggatgaagaacgcaacgcgacggcgatgatggccgactttggc

SEQ ID NO: 1283 - DNA, 1454 bp, Triticum aestivum
  unsure (1)..(1454): unsure at all n locations
  Clone ID: PAT_TA_1283
ggtcgcccccgtggtggctctccggacggttccagcacggtcggcagaccctggcctagccgcctctctctcctgcgcctgctccccccctccccacatcccctcccaccctggccggcagctcctcctgccgagcccccatggaatcaaaccctcgcctacccgcctctatctcctgctcccgctcctgccctccccagatctcctaccacgatggcctcgtgcttcctccgacccccgtgcgaccttccccgccgtcccggatcttgccggcccggatcaggcccctggccggaggtcagcaacgttcctcggttcggtcgcgaccggaccgctcccgggtaccgccgacgtgtgagaccgcccgttcgtccgatggtgtggtcccactgctccgcagagatggatttccttcagcttttgcgcccgtatgctactgcgtccatctccctatcttgaacatctcgtgaggagaatgctgcccaggcctacgaatcctccagcaactccgccttcgtttgatgaagaaactttggtgcgcatcaagtaaccacattggttattaatgactaccttatctttgttccgcaggtaggatccaaatattccaagctcagagattgaaagttcctcaaagcagacaccgccctggacaagctgagtaagagaagctctcggaaaaatccgctgcatcaaaatgtaggccgcaagcgcctctccctgttcgttctttagtctgatcagtgtttctcgcaaatcatgaccatacaaattgttccctccaccttctcgttgaggtttcaggacaaacaagtcaggtttttctattgctgatttcactatttcttcattgtccaagctccataaccctgcgaagcatttacgtagcttggcaatgtcttcctcgttgtcaaggaacctttcaagaacactaggttttgctagctcttgctggatctttttggttccgactaaatggtaggatattgaagggcacttaatagcagatgattgttcaatcaaaagccttgcactccattccacttctgaagggtagtcagtcggtgcatacccagctctgaaatacacaacagcaacaggtcgtccatctaccacaagtgttccattcggcctcgcgcctaattccggctccacctgtgccaaagttttcctaatggtcatcacaccatgcgttatagacagttaagaaaagtctcatcttgatgcagtttattgtggtatcaatcagatgacttgttgataattaaagtgaacaagcaattcaacagcacaataggaagtttgtattgtttacgtgaactataattcatgagaaactaaacaagcgtcaatagattagaaaactgtatgagcgaaaacgttaacatgaaaggttaataaaatctttcgtcgtttcngnggtttgcnnctttaaaagaaagacgcgtgggacg

SEQ ID NO: 1284 - DNA, 1485 bp, Triticum aestivum
  Clone ID: PAT_TA_1284
caatgcagctctcgttgtggtgcttgtagaactagaaccttcaatacaatttatctggtaccatgtcatacagacgcaaggaacaaaaataatagtcactcagcgaccatctttcgccggcctctacatgagtcacaagctcaaactttcatgagtgacgacttcaaagcacaacccagcgtgatgaatacaaggtaacacgtatttttcaattcccggaagttcacgaagttttgtgtgtctatcagcatcgaataaactaagacagcaaaacatggatagccatgaaaaggcaggatcgacttcattgaagatggatgtcaaagatgctttttcagaccccaaaaccgaacactgcacgtatcctctggaagatgagctctttccagcctctctcggtgttctccaccacggttgagttcccatacctgtcttcctctggcacatcagtttgtttgagctttattattgtcactcctgactcaggctcatcaaacaccaacctgactgtagaatggacgccatcagcccagctcccaaaccgccatttctgcacgatcagcttcccttcctgcagctcctcattaacacctgtgatggacccatcaaagaggctaaactgcccaccaacatccttgctgatcctcgcattgctctgtgtgaaacccttccacctgttgtcatccatcaagatctcatagatgtccttggagcggcagttgaacttctctgtcatctcgatagtcttgaatccttccttatccttgccattcgccttcttctccttagctgctggcgcctgcactggcgctgctgtcaccttcactgaaggagcaggagcaacagctgcgccaccggccgccggggcggccttggtggaaatcttcttagaatctatctcgtccttggcggggccaccattcgccatggcggcgacataatcccggatcttcgcaatgaccagaggcttgccatgggcgatgaaggcatccttggcccggcgcgcgagggggccgtcgtcaccgcgaacagtgatgcggagttcggggtcctcgtcggcgttctcgtcagcgaggtagggtacctcagcggtgccggtgaccttgacgacccccgactcggttgtggcatcggcctcccaggcgagcgtgagggaaagctcgtaccctgggatgaccttgcccttgcggatgttgacgtaggcctcgccatcaagcttgtcgagggtggtggtgcggagggtgaggccgccctctccggagaggacggggaggcccgcgaggagcttggagagaagcgcgcgagaccagtcgagacagtcgcgctccgcccagtgccagttgtggacgttggcaccgtcggcgcgctcctgcacgatccaccgtgcgtcgccctcgccgaacttcgccatgggctggggagggggctagggtttggttgggcacgatttgcttttctttcctcggatctgcgcggacgccggac

SEQ ID NO: 1285 - DNA, 968 bp, Triticum aestivum
  Clone ID: PAT_TA_1285
catgaacgcaacgatccactgcctcgctcccggccccgcgcctccgccgtcctcgctcgccccgccgactccggccggatacgccggcccgctcccggatcggacaggcttgcaagcatgtatattcgagtcaagcggaacaagaccacctacttcatacagtgtgatccaacagagacaattttgaatatcaagcagaagctgcagtcaataacagaccacactcctaataaccagaggttgatcttgttggctaccaacaatatattggatgactccaagacgcttgctgatcaaaaggtggagaatgacgccgtcgttgcattggcattgagaaaagacaacgagttcgaggaggtgtccatcgccgacccaagcgattacatggcgtcctcatgaggccggccggtccgtcgccgtccctcctacccaatccatgcaaggacactggtggcttccgtgaagcagatcatgttacttgcttgctctagcctctagcctataggatgttgctcacttgtgtgattgtgtccttgctattaaagaccctaaacaaccgttgcggatggcatttagtttggatttggaccctccagccgatacgtgtgatgtgtgatctcaccacccaccggggcgtgtcctggtgctccgacctacccgtcttttgtaccggcgcgtgaatgagcacggacatgggtggcgagatccgttggtggtgaccggtgattgggatcccttcccaccacctaatgctgcgtgtcatgcaggtcctgttgtgtttgccagttggtgtgtgctgctagggactatattgtcggtctgcttgtgggaattccagctggttcgtgtcgaaggttattcttattcttgccgttgctgtttatgcggatctgtggactctgtggagcgtgcattttctgggttcggcgcccgcactagtatcccattaaaaaaaaaaaaaaaaaaaa

SEQ ID NO: 1286 - DNA, 645 bp, Triticum aestivum
  Clone ID: PAT_TA_1286
actccccactccatccctgccgaatcccagtagctctgcgcggcgctacgccagaggctcgccgcaatgtcgtccagcgcctccgagatcgtcgccgacacgacgcacgggcgccaccacctgaagatcgacggctactcgatcaccaaggccaccctgcccacgggggagttcctcaagtcccagcctttctccgtcggcggccgccgctgggccatccagtactaccccaacggcgacccgtcctcgcacaagggccacatctccctccacctcgtcctcgacgacgccgtcgccggagaggtgcgcgcgcaggtccagttccgctttaaggccgaaaagaagcacgcgctctcctttctccagagctggggccgtaagcccgcgccgctgaagctcggcagggtggaggccggcgaagatggcgtctgggagtgcccgaatttcgtcaagaggaagaccctggaggaatcggaccatctcaaggacgattccttcaccatccgctgcgacatcatcgtcgtcaacgagttccgcgccgatgggggcccgccgcgggccgccgcgccaagatccatccctgtgcccccgtccgacctcgggaagcagctcggcgactcctcgcggcgacaagggcgccgacgt

SEQ ID NO: 1287 - DNA, 762 bp, Triticum aestivum
  Clone ID: PAT_TA_1287
ccctattcactcgctcccgagagagagctcgactgcggcggcgacggcgaggcgtgcccgcagataagacacggcggcgcggcggagcagcgtgcacaaggacttcgtcccgcccgctcctccgtcgagcgtagctccggtgacgcggcgacgcagttgtggggcatttcgccggcggctgccggcgcaagcttttggcggcggcgacatccgaggcgcggaggccaggcgatgcgcacgtgcatgagaatggcagcggcggctgctgcttcattccacgagccaccgcgaagggcggcggcgtcctggccatggcgtgcgcgcacgacagtggccgtgcggaccccgaaggccggcatcatcttgctttggcggccgcttagccggcccagggagagagacgccatcacctccatcatcacccagctaatggccctccgattgacaccgccgcttcccccacctcctccggaaccagattagatcgtcatgtcgtccactccgccgccatcgtctcagattgtgtcttcgtccttttgtgttgggcgtgatgtgccgtgcccacaacggaacttgggtattgtgtgtgtgtccgtgcttgttggtgtggttcatgacttgcggtggcgttgcgtttgtgtgtgcgctgtgttctgttgttaccttgatactttgtgcttggtgggtgctttatttataaagcggggcgaaagcctttttcggtacaaaaaaaaaaagcgggccggtcccctcgccgggata

SEQ ID NO: 1288 - DNA, 645 bp, Triticum aestivum
  unsure (1)..(645): unsure at all n locations
  Clone ID: PAT_TA_1288
cttctcccccacgcacgtactcaatctcatcatctccacagcaacaatggtgcagcgcagctccaacgccgaggtgatgtgcatggacctgtcgcccaagaagccggccaaggcctacggcagcgacggcggcgcctactacgactggtcgccggccgacctgcccatgctcggcgcagcctccatcggcgccgccaagctgcacctctccgccggcggcctcgccctccccagctactctgactccgccaaggtcgcctacgtgctccagggcgccggcgcctgcggcctcgtcctccctgaggcggccaaggagaaggtgatccccgtcaaggaaggcgacgcgctcgcgctccccttcggcgccgtcacctggtggcacaacgccgagggctcctccgctgagctcgtcgtgctcttcctcggcgacacctccaagggccacacccccggccgcttcaccaacttccagctcaccggcgcctccggcatcttcaccggattctccaccgagttcgtcgcgcgcgcgtgggacctcgaccaggacgccgccgccaagatcgtctccacccagcctggnatccggcgttgtcaagatcgnncgcggggcacaagatgcccgagccgagcgccgnnnancgggan

SEQ ID NO: 1289 - DNA, 578 bp, Triticum aestivum
  unsure (1)..(578): unsure at all n locations
  Clone ID: PAT_TA_1289
aaatcttgatcactctcctctaagctccagcccttccctcgccgccggcgccgccgcgacctcgcgccgccatgctccgcctccgaagctgcctcctcgcccaactcctctcgccgcgctccgcctccccctctcccctctccaccgactcctctccgcggccgcggccgcgcccgccttttccccagaccctagcatcttcgccgtggaggagtacctcgtctccacctgcggcctcacccgcccgcaggccctcaaggccacccccaagctctcccacctcaagtcccccgctaaccccgacgccgtccgcaccttcctcgccggcctcggcctctccggcgccgatgtcgccgccctcgtcgcgagcgacccgcagctcctctgtgccaagcgtgggagaaaancctgggcccgtaacgttnaagaactaaacgggctccgggtctctccgcgtcccgaaggtcgtgggggttaatctcgcttaaaattcggccggccggggcaatttcgcttgttaaagcaatcngtctncaaagcttggaataataacttggcccctncctggggggctccca

SEQ ID NO: 1290 - DNA, 680 bp, Triticum aestivum
  Clone ID: PAT_TA_1290
ggacaattccaagcacaaatattggaattatttgagtacatgtcaagctagaccatcagttgcacaaatattcgagtacacgtcaaactagacccttcctgagcacacatatttgtcaatctggcgcatccacaagagacataggcatacatatgaagtgacacataagatgacatgatcatttctagtgcgtgaccagtaagaatgagtgtgaaggacttaaggatcacaactgaacaaacattgctttaaaaaattgtatcagctttgctatcctgatggtatatgacaggaagttcttctcttgcctccagttatactgtttcttgctcttggaacttcatatgcctgggaaagattacacaaaacaaatactgtttttatttgcttacaaccaggtgagacagcaacaactaagattctctagaagctgtaaataattcttcaaaatgacccaagagcaacggcaggggcagagcttaatactagtcaatgagctctaaactactcatcatacccagagcataacaagtgttctacaccaaaatccagatgtctgacttctcaatctccttgctccggccaccgcatcaacgccgcgacccttcgtccaaccgccgtctgcacgatctgtcgttgccgttccagccgaggggagagagaagatttgttctgcggag

SEQ ID NO: 1291 - DNA, 750 bp, Triticum aestivum
  Clone ID: PAT_TA_1291
gctagtccccagttgcacaaattgtcaagctcgccccccagttgcaactagacccgcgtacacgtcaatctagacccttcccgggcacacatatttgtcaatctggcgcatccacgagagaacatacatacatatgaagtgatacataagatggcatgatcatttctagtgcatgaccagtaagaatgagtgtgaaggacttaaggatcacaactgaacaagcattgctttaaaaaattgtatcagctttgctaccctgatggtatataacagaaagttcttctcttgcctccagttatactgtttcttgctcttggaacttcatatgccttgatactgagccagtgaggggatggagtcaggaagaagagctggcgcgtgtagccgtcggggctgcgtattctctaacaactctgtgccgcgggttttcggaactgttgcgaacccgtcggagtccggcatggtggaggccagatggtgacctaggcagctgtgcccgaggcgcccgcggccatcggcgaggacgactagcgacggtcgacgaatccctgcgatgatgcgccgcgcggcgttgggcctggccggaaggcggatccacgcgaccttgaagccggagtggaagataggaggcagggagaagaagctgtggaggggagccaacaccggatctggcctggaccgccgacagcgtcgctcgccggctggagaggtcgagagggccgatgaaggattggggatctgagaaggatc

SEQ ID NO: 1292 - DNA, 814 bp, Triticum aestivum
  unsure (1)..(814): unsure at all n locations
  Clone ID: PAT_TA_1292
atctgattcgcggagtctctctatccagcaggcggccgccgcaccgcaccgcctcgtctctccccgtcccgccgtccgccgccgttctcttctcccctcgtctcctcgcacgtcggagccgctcagggcacacacaggtgccaaattccccaaatcagagacagtgagccgccgccgatgcacggatgcattcatcagacaattgcgggaaacagacatcgggccctgctcatgcaaccaatttcgaacgagttgtgatgacctatcaggacagggccgtagaaccgagccactcaggagaagggctgcgagtggaaaaggaacacgctggcaaacaagcaaacccggaaggaagtcaacagccgattggtgaaattaatcattcaattcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggctgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcnagcaagggtgcgtgtgcgtgtgatttgcttgctcgctc

SEQ ID NO: 1293 - DNA, 877 bp, Triticum aestivum
  Clone ID: PAT_TA_1293
gcgcacgcaacacctcgacccaggccaatccgtctcctctcctccactctcggctgcgaattaaacccacccgcgaatcctccgattcatctacttcctcttgcggcgcggcgcgaatcagtgatcaatggtgttagcatcgggacccgcggccacgttctccgcccggcccgcggcgccgggcgccggccggccctgctcgtgcgccgccgcggccaccggaggtgccaggttccgcggcgccgacgggaagtggtgggcgccgctcctcgggtggtcgggccagcccgactacatcgacgcccagccggcgcctgcaccggcgacggaggaggagcgggctgctgctggtgctgcgggggcgaggcggttcggggtgctgacggaggagaaggcgcgtcagctgcggctgcggatgatggagacggagagcttccacgacgccatgtaccactccgccatcgcatcccgcctcgcctccgccgcgcgcgacagcgacgccaagccatagagcgcggagccgagcagctcagctcgccggccggagccatgggagacgcgctgtctgtgtacagctgtacatacgctttcgtttgttctgtctgtcctgttgatcgttactgtaccccattagacaagaagaagccggtaatacttaggacagggccccttcagaccctcctgaacttgattattccatggagatgggactgcttagttaatctcactagttctggagcaaaactggctagcagtagagcgtgatgaatgatgaatgcggttgcttaaaaaaaaaaaactgatgatttaagttcggttttcttatcagtgtttttaaaaaaaaaaaaaaaaacccctcttttttccctccttctcc

SEQ ID NO: 1294 - DNA, 1531 bp, Triticum aestivum
  Clone ID: PAT_TA_1294
ttttttttttgcgatcaaaaccttgctcatttattttcgatcgatcgatttctcactcaggggcatgcaggggctaattaactaagggattaatctgaggctaatgctatggaaaaagatgaaatccaaactcgatccgatgaggggctagctaagctagctagctgcgatcagccggcttggtggtgagtccgaatccgaaggggaagagcgggtcgtagagcttgtcgccgtagttcatgggcagctggtcgacggacctgacccacgtcctgggcagcttgccggagaatccgtggtccccgaagagcacatcagcgacgccgtggccctcggtgcccggcagccaggcagcgacgagcgcgtcaatggtgtccaggtatggctcgacgacgagcggacggcccgagacgaggacgacgacgcactcgacgagctcgcacaccttcctgatgacctccggcccgggtcccgggatggtgaggttcaggttgtcgccggccgtggcggcgtacgggttctcgcccaccaccaccacagcgtagtcgtactcgtcctcgttcttggagacggagcccttgtccgggtgctccgtgtagtcgatgaccgtcttcttgtccacggccgacttgatggcctcaggatggtggtgccttggccggtgatgccgttgccggactgaccctgccacgacttggtccagccgccgcactggaggccgaggtcgtgggcgtgggtgccgaccacgaggatcttcttggccttcttggagagcgggaggacgggcttgccgtctttcctgcctttgccgttcttgagcagcacgagggacttcctgacggcctccctggcgagcccccgggcctccttggtgccgagctgggcggtgaggctgtgttcggggaaggggttctcgaagaggcccatggtgaacttgaccctgaggatgcgggcctccccgtccgtgatcccgtccccctgctcggccccgcccaggacctgggccgggacggccgcggcgacctcggcgttgtcgtacgccgtccggaccgtgtcgttgccgccgtgggtgctctcctggctggagcggtagtagtgcttgtgcggcggggtggtgatcttgtccaccgcctgccagtccgtgatcacaaaacccctgaagtgcatcttctccttgaggatttgggtgatgaggtacttgttctcgtgcatcttgacgccgttccagcttgagtaggagatcatgacggaggcgacgcccttgatgacggcgtcgtagtagggcggcatgtggatccgcatcaggtcgtggaagctgagcaccgtgttgttgccgctgatcccgtggtgcgtcccgccgtcgccgacgaagtgcttggcgcaggcggccacgtgcttgggcccgcccacgaaggggacgcccctggggtgcttggtggagacgtcgccctgcaggccggggatgatggccgacgtcatcagctgcaccagcttcgtgtcctcgctgaagctctcggtctgtcaatccatg

SEQ ID NO: 1295 - DNA, 775 bp, Triticum aestivum
  Clone ID: PAT_TA_1295
aatcacaacttgacaagaagcagatccccatcgccacaacccttctcccccaatccgctcgtcgtcgtttccccgcaccgtcttcgacagcaatcgtcgccccgcgaagatgcagatctttgtcaagaccctcacaggcaagactatcactcttgaggtcgagagttcagataccattgacaatgttaaagccaagattcaggacaaggagggcattcctccggaccaacagaggctcatatttgctggcaagcagctagaggatggccgaacattggctgattacaacatccaaaaggagtctaccctccaccttgttctccgcctgagaggtgggatgcagatctttgtgaaaactcttaccgggaagaccataactctagaggttgagagttcggacactatcgacaatgtcaaggcaaagatccaggacaaggagggcatcccaccagaccaacagaggctcatcttcgctggcaagcagcttgaggatgggcgcacattggctgattacaacattcagaaggagtctacccttcacctagtcctccgcctccgtggtggcatgcagatatttgtcaagacactaactggaaagaccatcactcttgaagtggagagctccgacaccattgataatgtgaaggccaagatccaggataaggaaggtatcccgcctgaccagcagaggctcatctttgctggaaagcagctcgaggatgggcgtacattggcggattacaatatccagaaggagtctactcttcacttgggt

SEQ ID NO: 1296 - DNA, 858 bp, Triticum aestivum
  Clone ID: PAT_TA_1296
ccggggagcagcagcagccaacaaacaaacatacctccactagcaggagcgcagcagcagacatacctccactcattggagagccgctgctgctcgccggccctccctcggttccccatttctccacctcggagcagccgagccgacgcctccctcgccgccagcgtctccgtgaccgtaacccaccatgtcggggatgaaggacgccaatgctgctgggcatgataatgttggaaattctgaacctatggaccaaagtggagataatgccatgccatcggctcagcaacaggaacaagtaatcaagaagaagtttggaggactaattcctaaaaagccaccgctcatctcaaaggatcacgagcgggcctattttgactctgctgattgggctctcggaaagtctggacagcaaggtgttgcaaaacccaaaggaccgctcgaggcactcaggccaaagttgcagcccacacgacaacagcaacagcgttcaaggagctctatctacagttcatccgaaaacgaggatggagatggcgctgggtcggaggacatgaatatcaactgatcaacagcgtggaatctcgtgttgtcggtgagaaggggcctcgtcgtctaaagaagcagcttgctttcattgtctgtggaccgcagggaagggatgtatgcttgcgtccatagataagaaaagagacggttgtaatttcaaggactgcggctgcgggtttgtacttcatcgaacagctaccttgctatgtgcccattatagactggaccattgtcctatttgtgaatggatatctctgtttttgaatatccaaaaagcgatcacgcgtactactacttacctctgaattc

SEQ ID NO: 1297 - DNA, 1611 bp, Triticum aestivum
  unsure (1)..(1611): unsure at all n locations
  Clone ID: PAT_TA_1297
ctgatgtgtatgctataaacgttagacatctgaactatctgaataaaaaagaatggacacgcactaggtgctcgctctcggctccccccctcgcccccttctcttctctcttccaccggtgcggnnnntaacccctcctcctttctctcccccagatgcgaacaccccgccgcctcctcctcataacccgcccgaccgccgtgccgcctcttctcgccttccttccgggtccctccccccttcaaccaagcctgatttctccggtgttggtcggcctggggaggagactccgccgaggttgggtgggatttctcggtttgtatttgagccggcggtgcgttgatgtttgatgctgctgcccgatggagggggtagggagagagcacgatagctccgtggcgctgcccgtggaggatttcggcgccgccaaggatacaaccagcgtgagcacaaagcctacaagaaggtatccgctcgcgtcatgggttgccatattggccctggccacccttgtaggtgtatacatattctccttatcttctgaagcaaaatgggatgcttttcgggctcaggcagaccaacatgatagagaaagaacgggagcagccttgccaccaccccggagttccggagaccgagatccctttcgtgcacttccccacacccaatacttatagtaggaaagaatgtgcatgcacaccagttagattctttgctatcttgtcgatgcagaggtcgggaagtggatggtttgaaaccttgttgaatagccacgagaatattagctccaatggagagattttctctgtcaaagacaggcgtagcaatgtcacggccatcacacaaacactcgataaattgtacaatctcgactgggtcagcagtgccgctaaaaatgagtgcacggctgctgtggggttgaaatgggatgctcaatcagggtcctgatgacacatcatcaagagatagctgaatatttcaaccgaaggggtgtgtctttaattttccttttaagaagaaaccttctgcagcgatatgtctctatattggccaaatgattatgatagaaatacgaagcaactaaatggaactcacaaagctcatgtgcatcacagaggccaggctgatgttcttgctcagtataagccaacaatagacacaaaatcgttgattgctgaactgaagaggtctgataagttggcagctgatggtttagtgagtttcaagaagatccggagtattgtcctgtactacgaggatgtggtcagcaatcgcactaagctcacagatgtgctggattttctgaaattgccaaagatgaagctatccagtcggcatgtgaaaatccatactaaacggttgcgtgatcatattgataattggactgatgtttctaatactttgaatgggactcaataccagagcttncttgaacggccgaagatgaccagattagctaggtgtaaataatgttgtagtgagtttcattcttttggccccttctttcgcccctgccatagctagcagagtaagccaaagttggcacttgtgtccattcatgtgctaatccaaagggnctncatttggtttnccattgacgtccctaacata

SEQ ID NO: 1298 - DNA, 588 bp, Triticum aestivum
  Clone ID: PAT_TA_1298
cgcgcctgcaacaactgccgccagcccggccacatagcccgcgagtgcaagaatgaccccatctgcaacctctgcaacgtgtcgggccacctggcccgcgcctgcccgaagacgacgaccctggcctcggagatccatggtgggcccttccgcgacatatcgtgccgcatgtgcggccagccaggccacatcagccgcaactgcatggccactgtcatctgcgacacctgcggcggcaggggccacatgtcatacgagtgcccctcggccagggtcttcgaccgcggagtccgccggttctgatggattcagggggtggccccggcgcctgaagcaccccgcccttgttccgttcgttggttggttcatgttttagatagctttggcgtacgacgccgaaaccgtttttcgcttggtcggtgcacgctcttcttgctccctgggtgttggttgttgtggaatgagtgtttatggtgtagctttgtaactctgctgaactgggccgagaaagagtcgtttatatgaactgccatggttagaccagattattatatcaatgtgacacgctttcgagttcaaaaaaaaaaa

SEQ ID NO: 1299 - DNA, 698 bp, Triticum aestivum
  Clone ID: PAT_TA_1299
ctgggctcacctcatgggtactcctgggcatgctgatatatgacctggcccgggttatggctagtgcctcgccgttgcatcgtcacgggcggctctgttccccactcctatccctatccgatccagtgggaggcactggagcggtgggaagcaccaccgcggccactcttgcactgcagcgtcgatctctacaccgaccgtcgctgcccgtgcgcaggccttcatcgatcaaccagctatggccggaacgctaagatgtgagggggcatatccatgctgcgataacaggatgagctctcgcgcgatcactaacgttttccctggcacgctcgatggttacaacatcgcaactcctggcttccttggtgctgctaacgcatgctacccgccactccagtccggccctcgtgccatcttggcccctcagggtagagaggtcatgaatggtttgctcgaccactagagtggttcgctaggggatagggcgtctaggccggtcgcgcgcctgcaccctccggtccacagcttcttctgctgtggcgctatggcgtgctcccccctctgaggtcgtcgtatgttcacgagttgttctagtattagctggaaataaacatttaaatttctgctgcagcaccagcagcatctcacggacgcctcgttctctcgctctctcctccagtccaggatcttggccactc

SEQ ID NO: 1300 - DNA, 1228 bp, Triticum aestivum
  unsure (1)..(1228): unsure at all n locations
  Clone ID: PAT_TA_1300
gtccgatggcacgccacaccccaagcctcgaacccacctaaccctagagaagccctcggcctcgggtcgccgccgccgtcggcgactccgagggagctctcctcttcccttgccggtgagaacggaacacctctctgccagccgtttctcgttttgaagcctttaggtaagaaatctgaggtagggttgctatggagtcgtcagatgacgagcatgccatggagagtgatactgtgactgaaagtgatctgatcagcgagctgcctgaagacatcctccagaaaatcctgtcatgcgtgtggattagaactgttgtgcgcatgcgcagggtgtctaggaagtggatggaactgtgtgaaagcctgcagttcatacgccttgattacagagatttcgaacattggaaggtcgagaagtttactcgtttcgttaacaacctattgcttgtccgtcggaaagtagacttgcacacattccagctgcattggaatcctcatggtcccctgaactgcaatgatgtcagaatgtggattggctatgcggtgaagcataatgttaaagtgcttgacgtgaaactttgtctatatgataagactgttttacctcctgccattttcacctgccgctcgcttcaggagctaaatttgcagtggggtaatgctccctaccgagattatgaccacacgggacttgtactgcctgacataatcaatcttccttctctcaagaaacttactctgcgcgacgtggaagtggatgagctttctctgaacagattcattgcccggagccctggcctagaagacttgaatttgatagactctgcgatgcgtcttgatctcatagcctcaaaagcattaaaaaggctaacccttgatggcttcctaggtgagtgcgatggattcacaattgctgcccctcatctcattagctttgagtgcacggggatgttcactggaagctatttcctggagagaccaaccatctctagagagcgcacgcatagatacttgtgggtatacatttgattgtgaatcaaaagttcactggagttcttaaagtatgccaaagaagcttgcattatttggttctgacataaagggtatgttgggaaaaaggngctgccaacaangtttaacgnttgnaaaactcacaactcctggagaattggggaaagggtatttaactgaaggacttgtttcgttgtgcttcgcttcctccaactttn

SEQ ID NO: 1301 - DNA, 1612 bp, Triticum aestivum
  Clone ID: PAT_TA_1301
ccgcacaacccctcgtgccctcctctccctctctctctctctcaggaaccctagcactccactcctcccttgccgccgccacctccggcgctcggtcctggcgacctcaggcgggaatcgaagaccgctgtccggcgagatccggcccgcgcggcgagatccatctctctctcacacatgagaaggaaaatcccccgccccattctcacgactcatctgcccctccctcgatccccttccttcctgaggacgcacgcgccgccccctccccgatccacatctcccctcgccctcccacatcgtgccgccatccacctcgtcgcctcccagatggttgcaggcgattgaatccggtccgggtccatggcatccacgaccgtggcggtgctcgcggtgacggacgagctggacctgccgctccacacggtgggggacctggcggccgtcaccggcgtcttgcaggaggaggtcgtcgtcatcacgtactgcacctcgctcgggggctggcgttatggcggctgtgtacagcgatgaccacaagttctcccgtgatttgcctccatctcctactcctagctccctcttttttgctcctatagcagtagaaggctttaaatttggtgcatgcgtgaggatcaatcatgttgactgcgtgacaatcatgtttctcatcattgtaatttttggtaatgaaaagaatacatgttttcttgatcttctgttaagtctatttatttataaatccaactttcatgttttttagaggcaaacttgaagactaacccctaatgtttccgtgcaggtagtaactctgataggccactacactttccaaattccatgcttgcctgttggtcgtccccaagttttcactaccctgagccttcgagtacaagaggctgctgcttgactataacagcaaaaatgtgcaatattggattaatgattgaagtgcattagcggtttatcttcttcttcacaagtctgtttgcaatggatgtacataactgtcatttttacctcttgctatttaacatacatgacaatagctgtaggtattgaaatatatgtgaaggtagaagctatcgttgctgccttgtgggtcgtaattctttctctctagacgcgtatactgtgtgatgtattgctcatgctcatattctgtaccaagatagtcctaatatccgtagggttgtagactgatttccccttgaaaaagctatgcttctttctttggatgataagcatgttcggcagctatgtggaatccttaagataaatggtctttagtttcttttggtgcatctgcgtgcacataacagtttgttagtttcactttatataatgaagaaaatatgctgctgtcatttgtttattattatctatcatctgtagattgatttttaggccatcaatacttgtatgtatgatttctagtcttgaatgaattatttttctttaggtgacatgcgtcttgtgttactacatacatctatcgtgaagtacatggttccagaactatggtaacccgcagtttgctctactggtgatagtaggatgatggaaacatcactactaaatgtagtccctggttcttcactaatcatcatgt

SEQ ID NO: 1302 - DNA, 688 bp, Triticum aestivum
  Clone ID: PAT_TA_1302
ccgcagcttcactttccccattctcctccgctagggtttttaggttttatcccacagcagcagcggccgtcggcggcgacaacctaaccctccgcggcaactcgagcgagagagatgaggctactcacgcacaacttcctggcgtcgaacgtgaagggcgtgagcacgggctacccgctcgcgctggaggtcgccaagacgtccatcaaggaggtggagctcaacgtcgacttcctccgcgggatccttcccaagatcgactggcgggcgctcttcgccgccatgccagccgcggggttcccggagctcctcgccgcagagcagccgccggaggccgagctcttcgccgagggcgccgcggacgtcgaaggcagcgcgatccgccgcctccaccacgcgctcctcgagatccacgtccaagagggcaccctcgtctgccccgatagcggccgctccttccccatcctgaagggcgtccccaatatgcttctccatgaggacgaggtgcggcactgactcgcgtgcagcaccagccgtctgccttgctttcttgtttgctcgtgccacatatggttatgcacttccagggcttggactcctaagattgtgtgtatgaactatcctagcatgaattgtggatcttgaagtcgtaccttgataaatactacttacctgtgacgttttgctc

SEQ ID NO: 1303 - DNA, 815 bp, Triticum aestivum
  unsure (1)..(815): unsure at all n locations
  Clone ID: PAT_TA_1303
cnntcggggcatcggntnctataantcantnttagtgtattgaaagtcaccnatttgtgtatcttgaccatcgtgacaagnagcantccntacacgggcacatgaagcacacgaggagatgacggangagggcgangaaaggagtcttttcgaaaattgttttagaagtgggggaggggaaaatgagaggcgaatggcgaataatgtaatgcgagagatgagagtttatgatgggtacttggtatgtctcggcttggcgtagatctccccggcaacggcgccagaaattcttcctgctacttcttgaacttgcgttgatttttcctttgaagaggaaagggtgatacagcaaagtagagtaagtatttccctcagcttttgagaaccaaggtatcaatccagtaggagacaacgcgcaagtcaccgaatacctgcacaaacaaacaccaacttgcacccaacgcgataaaggggttgtcaatcccttcatggttatttgcaaagtgagatctgatagagatggataaacggtaaagtaatatttttggtatttttgggtttatggatacggaaagtaaaagattgcaaagtaggtgattcggaaactgatatggtggatcagaaaccttatatgatggaaaagagacccggggaacataaggttcactaagggctccccccaagatacaaatattaccgggggtgaacaaattactgtcnnagcaattnatagaagaaccataatnttacatatctnaggnatgatcatgaatatagcatcagttactgtcaaaatagaccgaatgatccncanc

SEQ ID NO: 1304 - DNA, 954 bp, Triticum aestivum
  Clone ID: PAT_TA_1304
tcggcacgaggcctacggaattggaagcccgccgccggctgccgctccgcccctttcgctcgcgcgcttccaccggcgcgggcgaggccgaagcaggggcatcggcggcggcgtcggcggcggcgccgaagcaagccggccgtgctcaagtgctggaccaagatggaggcggcaggggatggctccatgggcatgttcggaggaacgccggatgccgccgccgccatcggcagatctgccgaggttgctggtctcctgaacaagttggtgaatggtctgggagcagcagttatggacatccccagcgacgaattcacaatccatccatcaactgaccttttaatacaagccctgcagaattactcttgcaacacatatttggtggagccagtgcatcacaccactgatccttgctctcacatggtcgattgctgggcagccaagctcaagaaagatgcagaaatgatacgccgaggtgaaaagggtgggaaatacatattcctcctgaataacacatatgatgttttgcaaatgctgcagcctccaagtgcctctttcgccggtgctcaagaaatggcgagtaggctcacatcaatggtggagctgtacaacaagtgctacttggacgagtgttgggctcctctgcatcgcttaaacttggacatgtttgctgctgaatttcgtgccatctgtgactgccagtcgacatggaaggtcggagctgagctcaggtacaacctgcggcaggagattgtggattccgttgttccaccgtatgaggcgctcttgtctgaccgaagcgcatgttcagggccgtccttttcgttgaaacgaatggtgttcggagggaagaaacaaaagaggtatgatactggtgcccaactggaagggaagataagaggattgtttgagggatgagcgatctcctctcctgtcatcatctcgattgttgca

SEQ ID NO: 1305 - DNA, 695 bp, Triticum aestivum
  Clone ID: PAT_TA_1305
cccatcttcctcctcatgctacttcatcgcccaaagtagctcgtccttctcttctccatccactaacaccagccaagcgctgctctcctcttctcgcccacggtggctaggcagccacttcctggctggcagcgccgacgtgtttgctgcaacagctggggcggtgacagcgtgctcgtcggtgcaccgggacaagggcggagtccccgtgccgtggtggtgtagctcaccccgattgtggctgcaggcaacggagccggtgtgcagtggctcggttgctcgccagatctggcggccgaccatatgccatgccagcgcgcgggggctgtggcggaggcgcggtaggcagggtggtgttgctcgtctgccggtaggcgcggatgtgggagtgtcgaagttgcctccggtgaaagctcccacatgactgtaccatagacatccaaggctctctctccttctttaggattattagctcaaatggcaatttaactgagacctttctttccattatgcgcctctcctctttttgttcatttcgattggtgacgcataatacatgcgacaggcacctctcatcctctctttgttggcttgttgatcttgcaacgcatgaacgtatataagtttgtaagatttcatgtaaaagagcagggtgggactattaatagagatttgaaattttagcaaaaaaaaaa

SEQ ID NO: 1306 - DNA, 570 bp, Triticum aestivum
  Clone ID: PAT_TA_1306
gctcgacttagagatcagaaatggcaatgcagacgggctgctgctcggcggcggcggtcctcctcctcctcgtggttgccgcggccggtgcgtcggtcgccggggcgtcgtatgtcaggtacaaagaccccaagcagccgatccaggcgcgcgtggaggatctcctcggccggatgaggatcgaggagaagatcgggcagatgacgcagatcgagcgccacaacgcctcctccgccgtcatcgagaagtacttcgtcgggagcgtgctgagcggtggcggcagcgtgccgtcggagaaggcgtcggcagcgacgtggcaggagatgatcaccaagatgcagaaggcggcgctcagcacccgcctcggcatccccatcatctacggcatcgacgccgtgcatggcaacaacaacgcctacaatgccaccatcttcccccacaacgtcggccttggcgccaccagggaccccgaccttgtcaagcgcatcggccgcgccacggcgctcgaggccagggccaccggcatcccctacaccttcgcgccatgcgtcgcggtttgccgtgatccga

SEQ ID NO: 1307 - DNA, 514 bp, Triticum aestivum
  unsure (1)..(514): unsure at all n locations
  Clone ID: PAT_TA_1307
cccactcgtttacctgatggagaacgggggtgcgaatccggagattggtcaggcagattctgggatggctgagatggtgtgcgacggtgtactgactgacgctcaaggaggtgcccggcgtcgccgtgatgaatctcatacgaggtctgctcaatcgattgacagagttaatccagaggcccccggctggactaaaaggcatcggctggggagcgcgccaccgggccgtgtgccctgtccatcaagaatgagcgccctcgagctgtcgattcgcaaatatgcaaagcaccatgacaagagcgtggtgcgacctgagctaagtttaagttttgattcgctgggtgaagcgtatgatttctacaacttatatccttgaaaaatcgggtttgggataagatacgggaaaanagatccaacgccaanaggacaaagacatcatttgtggttctccgtgaatggcattactngcagataaaggaaataacatattnctgatgctnttaaaaaaaaaaaa

SEQ ID NO: 1308 - DNA, 692 bp, Triticum aestivum
  unsure (1)..(692): unsure at all n locations
  Clone ID: PAT_TA_1308
aatttaagcttagcattctctctccatccacatacaaccagcaagatccatgaggccaccggcggctcttgtggtcgtagccgccgtccttctcgtgttgtctggtgtcgatgcgaccgtggaaacaacttgcaaggcggcggccgacgaggacgcgcatgtcaactacgacttctgcgtgtcggagttgagaaagcactaccagagctccgacgcagacacatggggcctggccaagatagcagccaacatgggcgtcaacaacgcctatggcgccatccatgacatcgagcgcctactagcgaggccgggcacggatgccaagacgaaggtggcccttgggcaatgccaggggctgtacgacaacatgaagtttgcgtttgccggagcctacgacgagatcaacggtcggaattacgccgcagggaaggaggaggtcgcaaaggccgtctccctggcgcaccagtgcgacgatgcctttgttaaggccgccgtcccgtcgcctctcaagcaacgtagcctctactccgtgcagacagcgatagtctgcagggccatcactaaccttatcaagtgatgaatagcatcatggatccaaatcgtgggagagtttagaggtcggatcaaacttgtagcgattactactccgaacctttgtaggtacatgcaaggaatanaacatgttttttggt

SEQ ID NO: 1309 - DNA, 896 bp, Triticum aestivum
  Clone ID: PAT_TA_1309
gattcggcacgagccaaatccgtgaacgacggggaacgctgcctggcgctcaccccccccctctcgcacgaaccctctcgcgtctccctctctcgcacaaaccctatcggtggcggctgctgctcctccccctggatccgcgcccccggctgctcctctccttcatcctcgccgccggctgctcccccccttcatcctcgccgccggctgctcctctcctcccatccacgccgccggatgctcctctccctcgtctcctcctcaatcggctgcgcggcggcggtcttgaagctgggcggcgagcgaggggctactccggcggcggccctgaagatcagcagatgtgaagcagcaccaccagaacacagaaagcagttcatcttataaaacgtaaaaggacttctttggaggtttctatgcagagatctctcgctgttggcattaagtctgagaacaatggcaagcgggattacactggaactggtactgttccatccttgcataagcaagatagcaagatactgaccaaaaagaccataaagttgttggatgcaccaccttgtccaaaaaggccaaagctagagccaactcaaaccactagaggtgctgaagctaagggccatgaatcgctgccacataagattgttcctgaaatggtacgatgcacagcatctgaaaaatctgggttgctaaagcagaggcgcatttctgatgcaaagagaattgacaagaagaatgctaggtctggtgtcagatctaaatatgattgtttcacattaaagtctggtttaggaaatcatgattccagtttcctgggaaatggcatgcttggggcacatggcctgaaatctgatatccgtgacatcacgaatcacattgagaacctgacattgagc

SEQ ID NO: 1310 - DNA, 540 bp, Triticum aestivum
  Clone ID: PAT_TA_1310
acttccagcacgaggcatctaccagtgacactggaacgaaagcactagctaactacagtacttatcaccaagaaaagaagaaaaagcaatagcttgctgctagcttctcatggctcctatcggaagtaacactcgggccttgtgtttggtggttctcctgctcatgtctaccaccttcttgtcctgtcatgcatcaggtacagcaggtgggtggacgaagttctgcgtagccgagaaagcctgcgcgccaacggcaggacccaaggacgatcatgtgtgcaaggctgattgcggacgccaaggttacgacaaggataaaagctattgcgcaccagaccctagtggcatttgctgctgccaaaagtaatacaagccgtcagtctgaaggatccatttaatttggatggagatgatatgttttgtcctgtgctagaaagttttgggcagtgaaaggggaataattttctatgcatgctgggatttagctcatgcagaaacaatcaataaactataatggttgtatccgaggaaaaaaaaaaa

SEQ ID NO: 1311 - DNA, 448 bp, Triticum aestivum
  Clone ID: PAT_TA_1311
aggcacatgggggtgggcggggacgacagctggacgccatgcgtgcacgaggaatacctgctgtcgccggcggcgagctacaggttctcgctgcggctgcgccccctgctgccgtcgtcgtcctcgtgccacgacatctacctttcccagctcccgcactgatcgtctcgtctgtctgatgcgcccgtccgaggtacgtccgagagagagaaagcattcgagagactgaaacgatagacaggtacgtacctgtcatgaataaagaagcgagcgtgacttgtttggtcgttggtgtgggtggcatcaatgacttgtttcgaacgcatgaatttcagatgagagatgcttttcttagtgtatttcggatgagatgctgggggctgtcctggttgctcatgtggtgcagagtcgatggcgccgtaagaccacagtgcgcacatttaggctc

SEQ ID NO: 1312 - DNA, 689 bp, Triticum aestivum
  unsure (1)..(689): unsure at all n locations
  Clone ID: PAT_TA_1312
cgctggaaaaactgccaagggagggacttcactattaatggattaatgttcaatccatattcagaaaagatctacgactacctgggaggcattgaagatattaagaaagctaaggttcgtactgttatnnnnnncgccacttcgttccatgaggattgtgctcgtattctacgtgcaatcagaattgcagctcgattaggattcagctttcccaaagaaacagcttattatgtgagaaatcttgcctgttctgtggcaagacttgacaagggaagattactcatggaggttaactatatgcttgcttatggttcagctgaagcttctttaaggttgctttggagatttggtcttcttgaacatttattgccctttcaggctgcatatttttcttcaactctttttaagaggaaggataatgggactaacatgttgctggtcctattttctaagctggatagttttcttgcacctaacaggccatgccataatagtttatggataagcattttagcgttccatgaggcattggtacgcaaaccacgggatcctttggtggtggctacttttgcactcgctgtataccttggaggtgatctgccactggcagtggatattggacaatcaatcaaccgtcaacatgatgctgggtttgcagagctcttggaaccacggatgtggggcaaaaa

SEQ ID NO: 1313 - DNA, 2543 bp, Triticum aestivum
  Clone ID: PAT_TA_1313
gcattcgccgccactatatgcttgtctgcctcccacgaggcctctccctcctccggcagcgccagccccggctcccgccccgcctcctcctccacctctccgccggcccgatctgggacccgcccgtcgcgcctaacagcccctgcagggagtcggtgcagaaagcattgctgacgtcatcgcacgttttaacggtgaagttgcggctttacagtgtcttcaacgtcgcagcatccttttttgtttagacacctgatggacaaaccacagtgggctatggtgaaatatgaactgagtgagatatcgtgatattggagttcaagttgtcacatgtacatcagctggaaattcgccatggggagagcaacttggttggcgacgagctgcctgatagctcaggtgaacggcgtgctctgggacatcgacagcaacgaggaacgtgacacgttctggcactcgagtgctcatattcttggagaggccattgacacgttgtatggctgcaaggcgtgcattcttggagaatctaccgagagggtgtatttctgctacgtgtccattggaccttgtactacaataggagagggtttttactacgacgcccactacaaggacttgacactgaatgatacacactttggcctcattgacaagcaagctaaaaaggctgttgcggagaagcaaccatttgaacgcattgaagtctccagagcagaagctcttgaagtttttgcggaaaatgaatttaaggttgaaataattaatgaattgcccgaggacaagaccattacagtatacagatgtggtcctttggtcgacctttgccgtggcccgcacatcccaaatacttcctttgttaaagctttcgcttgcctcaaggcttcagcatcatactggagaggaaaagcagaccgtgagagcctgcagagagtatatggaatctctttccctgattctaaacgtctcaaggaatatcaacatatgatagaggaagctaagaaacgcgatcataggttattagggcagtcccagaaactcttctttttccatccacttagcccaggtagctgcttcttccttccaaatggcgctataatatataacaaattgatggattttttgcgcaaggagtatagagagagaggctaccaagaggttctgagtccaaatatttacaacatgcaactttgggaaacctctggacatgctgcaaactacaaggacaacatgtttgtttttgagatcgagaaacaagaatttggccttaagccaatgaattgtcctggccattgcctaatgtttggacacgaggttcgatcgtatagagagttgcctctccgcatggctgattttggagttctgcacagaaatgaacttagtggtgcacttacaggtttgacacgtgtcagaagattccaacaggacgatgcccatattttttgcacggagagccaaatcaaggatgaagttcggtcttgcttggagttcattgattatgtttataaaatatttgggtttgaatacgagctggagttatcaacgagaccagagaagtatttaggtgacattgagacctggaacaaagcagagcaacaactgacagaagcattgaatgagtttgggaagccatggaagataaatgaagcagatggtgctttctatggcccgaaaatagatattggtgtgtttgatgccctcaagaggaaatttcagtgtgcaactctacagctcgattttcagctgccacttcgcttcaagttgacttattctgcagaggacgaagccaagcttgagaggcctgtaatgatacacagggcaatactaggatcagttgaaaggatgtttgccattcttttggagcactataacggtaaatggccgttgtggttaagcccccgacaagccattgtttgctgtgtatctgccaattcactaacatatgcaaaagaggttcatgctcagatacgtgcagctggttttcatgttgacattgacatgactgatagaacaattcaaaagaaggtgcgggaggctcagttagcccaattcaactatattctagtcgtcggcgcaaaagaggcagagtctggaaaggtctctctgagggtaagagacagggcagacctatccacagagagcattgctgacgtcatcgcacgttttaacgatgaagttgcgtctttccagtgatttttaagtcgcatcatctttttttgttaagacatctactgcacaacccacattgtaatttggtgaagtgaggtgaatgaaaaatcatgatattcttgttcatgttgtcacatgtacattaactgccatgatgtatcaattctataagggcctctttgattcgaaaaaaaaaaaaaaaaaaggcacctagtatggtctgggaaatagggctgtcagtcagacaagctcaaagctcgctagcctttgaactatgaggcccttttaattatgatgaagttttagacccctgttgtattgtagtgtgttttgaacgtttgagccttgacgtactacatgacttgagggtcctttcc

SEQ ID NO: 1314 - DNA, 412 bp, Triticum aestivum
  Clone ID: PAT_TA_1314
cgtccgcggacgcgtgggcggacgcgtgggggattacgtaaaatggagaggagtgcttttccttcggtttctgccatctttagttgacgaatcggataagataaggcatttggctgactacctatttggaagcatcttaaaagccaaagcgccacttcttgcatataacagtttcatagaagctatctacgtcctaaacaattgcacaggacatggtggatatagtgagtctcagtctcagagttctcaagggtcccaaagttcagacagaggacaagccctttttgcgatatggggaactgacgaaaggtcaaggtcaaaacgaatgcacatatatgtgtccttgttgaaacaaatggccccggagcaccttctagctacatcagccaagttatgtgctgagatcttagca

SEQ ID NO: 1315 - DNA, 658 bp, Triticum aestivum
  Clone ID: PAT_TA_1315
cggccgctcgaggcggcgggcgggacacagtgagaatgttcttggccgatcccctttctcctctcctcttatttttcttctcagttaaaatttgctgatgttggataccacccatcaggttgctctcttgattccctgcattcaggatgctcgtcctaacctgaagccacccccgcacctggtgcttcgacggggtgaccatcgacgacgattgagggttagcagggcccaaggatctactacaccagagtctaggcgaggtcatcgatctggacgctgccgttgatgctgtcgtccgtgcagttgatttggtcttggatatcatctcccgcaggtctgcaacggcagcattgttccaagttgagctgcaggtgatatcatatttgtgacatgaagagtaagaaagccacatgtcaatcttaaggaggtgttttttgggaatgtttatatgctccattcatgctatgtgtcttcatctccagttggatggagctgctggaattacgacaggaaccccatagcatctgaggttgaccaaatacccaaaccaactatatggagctgctgttgttatgaaaggaaaccactatagcatctgaggttgatcaaacatggacaccatcatatctgtttgtaaataatgaaacttagctatcct

SEQ ID NO: 1316 - DNA, 867 bp, Triticum aestivum
  Clone ID: PAT_TA_1316
actgggtttgctaggtgctcaagttgatttgctggaaacctttgtttttctgttggaaccaatttttggttttgctgcaactacccaccggagttcttttttgggctgagatgtgttttttggtggaatcaggtggtgcaggtcgactgcggcgtcgatgttgtgctgtgatgggcggagccagtgcgagttgctgcgtccgacgtttggcaaagatgcatccgtcggggggtggtgctgaaacgacgggggatgaggagggtgtgcaccgacgccggggtggagctgcggagagaggcggcgagcggtggagatccgacgggtcaagtagctcgtccatggcactcgcgtgatttgcagagtaaagaacggcgtggtggggacgaaagaatctgacggttaaaagagttttaatcagacgtacaggatacgaccggcccaaatttgggccggcgcaccggcgcttagtactggccaaaaacaaatcacacgagacaaaccggtgcctcccaatctcatcccgagttctgttcggcatggcggccagccagaccgccgtcgcctgatcgcacagcggcacgggcaggccgacgacgcgacgcaggcatccggcgacatccatctctcggtccaccagcctcgcttcatctttactccatctcggtagtgggcagcagacaatatcggaggatcactcagattccagttccaaactatgttatcccacacattcaaccggcaaccagattagtatttattaaagactctactcgggtcgatcgggacagatccacatgtgattggcttcagttcaagaatccaaaatcagaggacggggcttcagcgtggtttcaaagacacgcacgg

SEQ ID NO: 1317 - DNA, 438 bp, Triticum aestivum
  Clone ID: PAT_TA_1317
gacgtctcctctcctcctccaaatcgagaggccatagagagagagggtcagagagagaaacctagccccttgaatggaggactcgaacggcgccgagatcaaggccccgccgccagtccaccggcgcccgccgcgcccgcgtggaggcggcttcacccccgagggcttcgtggccgcgcttcgccgccggctgagctccggtgccgcggtggccgcgcgtgccagcttcgcggcggactctggggacgagtccggcccccccgagccctcctcgtcgcaccgccgccgcgactcaagcggggacacctcgtccgccggcggccccggggacttcaccgcggtcagcttccgcgcggctgccccagtccactggaaggcgaaggagagtcccctgagctccgacgccatcttcaagcaggtgggctcctcccgaactga

SEQ ID NO: 1318 - DNA, 666 bp, Triticum aestivum
  Clone ID: PAT_TA_1318
ctacgtggccatagagagggcctccaactgcgctacctccccccccaagccgaggcgactgctggatcgaagaccgcgagaagatgacgcagaagcaggccatgttcaaggggcagaccaagaagaagtatatccctcccaagcaccatggcaacgcgccccacatccgcaaagggaagagggccgtgaagcagaccaagtggaccaaggagctggccaacgacaaggacctcacaaagttcatcaaccacgcgaacgaaataaaagctgcaaataaggctagtaaagaagctagcgagctcagcaaagataaggccgacgtggagaattccaactcaaagcagtaggctgggaggcttatgttgcttactgcgatgcctaatacaagacctgtgtgtgaaatgatcatgttttcaggaagagattatgtttagttcacgctacatgttgtaatctgtaactagttttgtgaaatccaagttttatcctgtgaatcgctttgcgggatgctaaatgttctcgtgtatctgtagtttcaaggtcttctcagatgtcatacttttgcgattttaccacaactctctagcccgtctctcaaaactgtataacttccaaatcttgaaattatctgtagcctcagtaaacttcctttcataaactgccgcc

SEQ ID NO: 1319 - DNA, 403 bp, Triticum aestivum
  Clone ID: PAT_TA_1319
ttttttttttttggactaacacgcctgtcaaattagcagatggaaactgcaagttgtttttccccctacctcactggttcatgaagaccgatgaaaattgaataaatgtaatgtacaggtacatgatcgtgtagaaaaaaaatgattactatgtatgtgtggatctatttaggacgtggagcctctgtttgttagcctcatttacagcgtcttgtctctaatccatttcgtggcgacccatttctctcctctcaccactgggcagcttccatgaagtgaagtcggatcaatggtaccatttaccataagggagtaaaacaagaggccgtcgcccttcctcggttttacctttaagccgatgcactgctcgtagtcgtagcctatgttcatattatccccattc

SEQ ID NO: 1320 - DNA, 800 bp, Triticum aestivum
  unsure (1)..(800): unsure at all n locations
  Clone ID: PAT_TA_1320
ggcccgctccgagccggccgggccgggaataaaaaaccatccaccattggtctcccggcattgtcactcacctgctctaccgctcttgcgtatagcctagaagctatagctagccatggcgtccatgaccagggagacacctgttgcccgtttcgttgacgaggaggaggatgaccttgtcggcgatgatagtggcgacgacggtgacgaggtgctggaggtgaggaggcgcgtgtcccgcttcgccgtcgggggagacgacggtgccggcggggcgggggagttgaggaggcgggtatcccgcttcgccgtcgacgggggcagcggttcgggcggcagccgtggggtcttgtcaaggagacaggaggtcgtcgacgcgggcgtgcaggaccgacgtcaccgcgacggcggctgcgagggggcccggaccctgccgccgccgcacgcgtggctggcggtggaggagacgaagaagaacttcgggagcgacaacgaggagcagtgggcgcggcttctgcagcgcgggtcggcgcaggcggaggtggcacagccgcggcggagcagcttcagcgtggtccggcgggagcgggcggcgcgggaggcctggctggaccgcgcgtgggagatcaagaagagctggcacgagcgcaacggcggcgcccccgacgccgacaccccggtggtagtcgtggtggggaagcaggccggcgggtcctcgtccccgtgcgccttctcctcccgnnacaccaccactcngtcgccagcgtcgcgatggacatgggagnangtgcgtgcgtgca

SEQ ID NO: 1321 - DNA, 1395 bp, Triticum aestivum
  Clone ID: PAT_TA_1321
ggccgcgcgcgccgcacacgtacgtacagacccaccaccccctctcttctccgctccgccacgcagccgcgctccccgcattgcattgacatggtctcgtcttgcctcgcctcgccggccaccgcgcgcggtggctctgctctacgtctgcagtttcagccgagagggtgccgcgtgacgtgcttgcccgacgctgggggagccgggagcggcggccgcgccaaggccgtgggagggttcgcgtgcggcttgctcgcagcctgggccgtcgcgtcagcccccagcccggtcatcgccgccggccagaggttgcctccactatcaacagacccaaagagatgcgaggctgcatttgttgggaacacaattggtcaggcaaatggggtgtatgacaaggtgcttgatctccggttctgtgatttcacaaatgataaaagtaatcttaaaggcaagactctgtcggcggcattgatgtcaggcgcaaagtttgatggtgctgacttgacagaagttgtcatgtccaaggcctatgctgttggtgcaagtttcaaaggcacgaacttcacgaacgcagtgatagaccgtgccaattttggaaaagccgacctcgaaggtgcagtcttcaagaacaccgtcctgtcgggatcaaccttcgacgaggctaatatgaaggacgtcgatttcgaggacacactcataggctacattgaccttcagaagctttgcagaaacaccagcatcaacgaagatacaagattggagctgggatgcaggtgattcaatcacagctgcacttatggcagcatcgacgtacattgtccggtaaagattagtaagtcaggtctgttatagagcaccagcaggatgaaaatatgtataccgtaaatatcataccacagctgcacttgatctgtgcaaacacaagttacagcaaaggaagaaccttatgcatttcatatttttgtttacatatagatattgttcacaattcagcaacagcatgccatcactgatgatgcatgcatgctttattccaaatccacacatgtattgatgaggccctactgtactttatatgtgcgcttgcttgacaacatcaacattattcgccttcccttgggtttggctcctgcatgccatgctcgcacgcgcaccctagtataacttggcccctacaagggccgatgctgctcaccgacagtgcgcaatatatacctagatgcaccatctaaaatggccggcagcctcgccggccaggcacctgccggcgaggtcggtctttaattgtctttagctcgagattgcgcgggtggcccttgctccggcgattggcttcattcagtgtcgttgttgttgccggagtcgatgacgcaggtctccacaccgccggtcatc

SEQ ID NO: 1322 - DNA, 589 bp, Triticum aestivum
  Clone ID: PAT_TA_1322
tgatcaggcagcaggctgttgaaagagccacagacactgtatcaggtgtacatagatcaaagagactagccagatcatcaaagatgtggatttttgctgtttgggcaacatctgtagtagttttcttactggtaatctcgatgtttttctcggaacgaaggagaagtatttcaagatctagggcttccagaagccagaaggcccacagtttgactataaaacaaacagtatgatcataagtttattcctttgccatacagacataaagggggtacagtacaaggagtctagaggctaacaacacctatatgagctatccgaagaagccggagctgattaaccatgtgaattccttattttttgacaagttttcttagtgctattagcagattttgttgcaactactgtacctaacgttgttatgttcaattcctataggtgtttgtttagcttggtgtaattgatatgcttttgtattgttttccctagtccattaaggtgtctatgtgtagaaagttgtatgtgattaactagcatacagatagaataaacattttggtcacaatccctctggactgctatacaaaat

SEQ ID NO: 1323 - DNA, 1611 bp, Triticum aestivum
  Clone ID: PAT_TA_1323
ggcaggcggggcgcggtttgactttctgacctcggcaaccgatcgaaggcgccttaccgtggggagtaattcccggtacgattcttggacggaaggaaccgccgccttcaggtccggcgggggggagcgcccctctcagttccgaggattttgactgcgcctctcgctccgaacgaggagagccttatcaactactgaaaacaacgggtacaaggacggcagaatggagcccccctcgctgtttccacggattttcgcccccgccctccctccgatggaggcgaattttattaactactgatcagaactggtaatcggaatgaagtcaccatcactgtttattcagtgcttccctggcttgcttcccagcagagcaactacgtggtgtaggccgtttatattacaagggggtattctgtatccaagctatcaaagacgcttttagcaagataatgctttgccatttcccctttctgatataaaatcatcaaagagtgatggtagtctcaagtatttgatagagttccatcactgttgtgagtagtagaaagaatgggatccgtgattggcagctgagcttcaggggcaagcgagttctagagcttggatgtggatctggccttgctgggatttttgcctgcttgaagggtgcatctatagttcacttccaggacacaaatgcagagagcttaagatgcagaacaatgcccaatgtgcttgcgaatcttgagcaggctcgggacaggcagaacagaccatcagagagcccggttacaccatccagacagttgttagctcccgttgtccatttctatgccggggagtgggatgagctccccacaattctctcagttgtgcatccacctgcacaaccaacaaaccttagcttctctgaggatgattttatggatggctgcagtagccatgacggaagcagtatagttggtcaggaccccaggcgatcgaggaagctttctggcagccgtgcatgggagagggccagcgagaccgacccagcagatggagggtacgatgtaattttgatttctgagatccctaatgcggtgaactctctaaggaagctctatgcccttatcactaagtgcctacgccctccttatggagtcttgtatgtggcttcaaagaagaacttggttggttcaagcggcggcgcaaggcagcttaaaagtttgatggaggaggaaggtgtccttggtggtcacttcttgactgagatatctgaccgggagatatggaagttctttttcaagtaaaccggcaaatgttggaactgaaaaagatgatcctggccatagtgtcgtatacaagaaaaattcatttgtctactcgcagcgctgtacataccgcgaagcttagttcgattaattctttggtgataggttcaagtatgcgtcccagttgttaaacctgcaaatgtgttggcattttaacccttttgtagatctcctatctcctaggtgactgttgagcttttgcataccgaatctatggtgctggcatatcacagcacgctatcagcaatatgtacaaatcgtgccggccactcgagaaaatggggttaatggtaccttgccttagtccgggacttaa

SEQ ID NO: 1324 - DNA, 868 bp, Triticum aestivum
  unsure (1)..(868): unsure at all n locations
  Clone ID: PAT_TA_1324
gcacgaggccaccgttaacctctcctcaccgccctctgcgcccattgcctccctctgccatcgatcccgagaccggaagaggcgcgcggcctggagctagcgaagcctcggtggccagggaggaggcggccacaaaatcaacatggttctggagctggatagagtcctgatgctgcgcgccgccgttctcgccgtcgtcaccggcttcgccgccgccggattcatctcaaatgacgcgctccagtcgcactcgcacggcggcgccggccggagcttgctgcaggccaagaaggaatgcccggtgaccttcgagggggccaactacaccctcatcacgagcaagtgtaaagggcccctgtaccagccggcgctgtgctgcgcggcgctcacggagttcgcgtgcccctacgacacctacatcaacgacgtcgccaccaactgcgccgccaccatgttcagcctcatccacctctacggcaagtacccggcggggctcttcgccaatacatgcaagggggacaacctggggctcaaatgccctgaggacgtcccgcaggtccagccgggcgaggagggcaagagctccgccgccgttgctactgccgcacaggcggcactcgccgcggccagcgcggctgtcatgtccctgctcattgtaatgtcttgatcagagccggacggtagctgtgtgcgtgtgctcgtgcgctggtttctattgcatgcatgagtttgtggtcatatgtaattctggatcctgcacagggtgataattcaccgattaacattttaacttgttcttttaaccgttgtacattgttaccagaagggctaggaatttgggatcgtgttaacaacaaaggccccttng

SEQ ID NO: 1325 - DNA, 450 bp, Triticum aestivum
  Clone ID: PAT_TA_1325
cgtcatgttctcccagtcagtctcatcggcttgtgatcctggcatggttagcagcaatagaaacacacaagaatatgatcctacagactactaccaaatggcggtggtggggtgtcacaaatccgtcaagcaaatctcaaattcttaccagttcttacccagcagcaggcggtgatcggcaatcgttgtagtcaaaactctcaaagcttggatagagcgattaccagggagagtcaaccgcacgacgtagatgtatgtggagcgaggaaggcttataatatggtagcaaaaatggtcagcaataatcaattcagagatgcaaagttgaataaacgctcaacgacggtactgtgctggtcctaggctagactgtgctagagacgcgagcctagaacactaacaaaatcacggcgcggcacgttaacaagggaaaagcacactctgcccgtc

SEQ ID NO: 1326 - DNA, 586 bp, Triticum aestivum
  Clone ID: PAT_TA_1326
cgtgcttggggttccagaggatggagtaggtgtggaagtcggcggtggggtcgaaccagaggcggaactgctgctcccgctgcccctgcccccgcgtgaacacgttggtgtgcagcgtgtagggctcgccggacacgttgcccaggaactcgaagtcgatctcgtcgtgcgcgccgccctgcgacgacaggtagtaggcggtgacggtgccggcggagttgcccggcaccagccgcagctgcatgtcgatcttgccgaacaggtactcgtgccgggactggaacccggagccggacgtgcggtccagcgacagcgtcagcagccgcccgttgtcaaggaccttgccccgcccgtcgccccacgtgatgtccagctcctggtccaagctgcccgccgcgaaggagcaggacaccagcacgcccaggcacagcagcagcaagggcacccgacgagacgacgtcgccatgaccgttgcaaccagccaccaagagagacagacacctaccgacactctacactgatgatcgagcaggtcgctactaggtgctcgacctgatcagctgggacgagcgagctggcgcggtgg

SEQ ID NO: 1327 - DNA, 1452 bp, Triticum aestivum
  Clone ID: PAT_TA_1327
acctgttgttgcttgggttagtgggacatgtgcacgcctattcaaatctgaggtccagtttggccatgctggtgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcctgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttattgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgatgccgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagaaattgatgagattgtagagattggatatcttaatggactctttgtgcttgcacgttcaattggcctaattggccacacctttgatcagaagaggctcaagcaaccactctaccgtcacccttgggaggatgtcctgtacaccaagtgaggccgactcagcacggcatcatatggatcttccacttgtgtgtacaccataaaatcgagcataattgcatagaattcaaagttctgattgtcaactaggcgaggagggagagaagaccgttacagatgagcattggctgtgtgtatgtcttgtgggactggtgtgttttttataagctccaacgtaagtaattttttttgttcaagcatgaaagctttagggcatcaaatatttgaaaggatacttgataattgtttcatgttatcatcaattaagtgaccgccaaattttccagacattcagacatttggggagtgttgtaatgtttgtgatgctagttccccatcacaaaaaatgtactgtcatctgaattctgt

SEQ ID NO: 1328 - DNA, 1661 bp, Triticum aestivum
  Clone ID: PAT_TA_1328
gttggttttgtgtctaaatcgggtggcatgtcaaatgagctgtacaacacgattgcaagagtgactgatggtattcgtcagggaattgcaattggtggggatgttttccctggctcaactctttcagatcacattctgcgttttaacaacataccccaggttaaaatgatggttgttcttggggagcttggaggaagcgatgagtattcactcgtcgaagccttgaaacaaggaaaggttcagaaacctgttgttgcctgggttagtgggacatgtgcacgcctattcaaatctgaggtccagtttggccatgctggcgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcttgtccctgaggttacacctccccccattcctgaggatcttaaaactgccattaaaagtgggaaggtccgagctcccacacacattatctccactatctctgatgatagaggtgaggaaccttgctacgctggtgtgcccatgtctacaattattgaaaggggttatggagttggtgatgttatttctcttttgtggttcaagcgtagccttcctcgttattgtactcaatttattgagatatgcgtcatgctttgtgctgatcatggtccttgtgtatccggtgctcacaattctatagttactgctagggctggaaaggaccttgtttccagcttggtatctggattgctgacaattggcccccgatttggtggtgcaattgatgacgccgctcggtacttcaaagatgcatatgataggggtcttacgccttatgaatttgttgagggcatgaaaaagaagggaatccgtgtccctgggattggtcacaggatcaaaagcagagacaacagggataagcgagtgcagcttttacagaaatatgctcatgcacacttcccttcagtcaagtacatggagtacgctgttcaggttgagacctacaccctgtcaaaggccaacaatttggttatgaatgttgatggcgcgatcggttctcttttcttggatcttctttctgggagtggaatgttcagcaagcaagagactgacgagattatagagattgggtatcttaatggactctttgtgcttgcacgttcaattggcctaattgggcacaccttcgaccagaagaggctcaagcaaccactgtaccgtcacccttgggaggatgtcctctacaccaaatgaggcaccgtattggtcttccacctgtgtgtgcggcgatgaaaataaaaaagagcataactacaccaaatgagtagaattcaaaattcttactgttgatggaactaggcgaggagggatacaagaccgttacagatgaaagtttgtttcattttttcttcattcaagcatgaaagcattagggcatcagatatttgaaaggatacttgatagttgtttcatgttatcatcaattaagtggctgtcaaatttagttcagacatttggggaatattgtaatggttgtgattctagttccccatcacaaaactctgaaatatctacattgtcaattttatggtgat

SEQ ID NO: 1329 - DNA, 1201 bp, Triticum aestivum
  Clone ID: PAT_TA_1329
agggctaaaaggaactggctaattatagaacttgcataagtacatggatcgaccccgtgtgacaacgaaacaaatgaaagaatgcgatatgcatactacggtactacatttacaccatccgacagagctctgatgcgcgcacttccttccttcgttcgttcccagggatcgaaagccgaaaccaaacacatctcagacgacgggttcatgcgtggttcttgtaagctgcagcaggatctcatcagcggagcttgcactcggcgggcaggccctgcgccacccgcttggggtcggtgcagtagttgtagatcatgaacttcctctgcacccaccgcatgcggcggtaccccatgccgctgagctcctggttccaccagctgccgctgccgccgtttgcgccggccgcggaggcctccatggtgcccgcggggcagcgctgcgcgccgcccgacatgacgcacgcgtcggcgttgaagttgcggaaggaggcgacgaacggcgccttgctccagtcggtcttgacccggccgccctgcgtggcccagtcgtcggcgttccagaggctcgcgtacagccgcatcggctggctcttggggaacgacacgccgcgcgcctcgtggttcttgaagtccctgatcgccgtgccgtccaccgcgaatatgacgtgctgcgggttccagatgatggagtaggtgtggaagtcgttggtgggatcgaaccagaggcggaactgctgctcccgctgcccctgcccctgcgtgaacacgttggtgtgcagagtgtacggctcgccggtgacattgcccaggaactcaaagtcgatctcgtcgtgcgtcggcccctgcgacgacaggtagtatgcggtgacggtgccggcggagttgccggggacgagcttgagctgcatgtcgatcttgccgtagaggtactcgtgcttggactggaatccggagccggagaccttgtccagccccagcgtgaggagctggccattgttcatgatcttccctcggccgtcaccccaggtgatgtcgaactccttgtcgaaggtcgccgacgcaagggcacacgaggcgtcgagcaggatcgccagcaccgaggacaccgccatgcgtttcttgctcccgaaagcaagctcactcaaccagctagctaggaacaactagtagtagaagaaggttgatgaggaggagcgaacgcg

SEQ ID NO: 1330 - DNA, 1012 bp, Triticum aestivum
  Clone ID: PAT_TA_1330
aagctaattaacgatatgtagtatacgctgaatttattgtatcatttacatacttgcacagttacatttacatccatacgagtaggtgtgcacaaattctatacccaatctataaaatactccgaccttgtagacagaacaccctacttggtagcgcactcgggcggggcgccgtccttgaacctccaggtgtccgtgcagtagttgtagatcatgtagttcttctgcacccactggagtcggtccagcgccgtggcgtccagctcctggtacatccacgcgccattggacctggcgcacgccgccgcgtcctgcgacgcgcacccgctcgcggcgaagcccttgtacgacgccacgaagggcgcccgcgaccagtccgtcctcacccgcccgccctgcgtcgcccactcctccgcgtcccacacgctggcgtacacccgcatcgcctggctccgcgggtacgccacccccgtcgccgccaccggttctctgagtcgttcatagtaggtgtgaagtcgtttgatcgaaccagacaactgctgctcccgctggccctgcccctgcgtgaacacgttggtgtgcagcgtgtagggctcgccggtgacgttccccaggaactcgaagtcgatctcgtcgtgcgtcggcccctgcgacgacaggtagtatgcggtgacggtgccggcggagttgccggggacgagcttgagctgcatgtcgatcttgccgaagaggtactcgtgcttggactggaacccggagccggagaccttgtccagccccagcgtgaggagctggccgttgttgaggatcttgccgcgcccgtcaccccaagtgacgtcgaactccttgtcgaagctcgccgccgccagggcacaagaggcgagcaggatcgccagcaccgaaaccgccatgcgagccatgcgtttcgtgattccaaaagtacgctcactcaactagaagaacgttgatgatgaggaggagaaagctgcggtggttcccgcggacgcgtggg

SEQ ID NO: 1331 - DNA, 532 bp, Triticum aestivum
  Clone ID: PAT_TA_1331
ggaacaactttttttttgatggggaggacgagtataatacagacacgagacacgacgaacacgaacagcgcgcggcggcagactacgtacaccgtacacgtaccaacagggtgggcgaggacgaggaggctacaagaacacaggcagcagaagaatttcttaccaccacaccacgcacgcaccagctactgcgttacaaatcgtcaagtcctttatttatctaccatgtttcgatgcctttcgtcttgccttgatccggtgatcgacaccgatcgtcgtagcggtagcagtagagcggaccacatgcacacacacgcgcgcgcgcgccattgttggacgggcgaggaataaccgggcgctactgcatggagcactcggcggggaggccctgctggtagcgcttggggtcggtgcagtagttgtagatcatgtacttgcgctgcacccagcgcatccgctgctgcagggtgaggtccagctcctggttgtaccagtccccggcgccggcggcggaggcggtggcgccggtgcc

SEQ ID NO: 1332 - DNA, 1650 bp, Triticum aestivum
  unsure (1)..(1650): unsure at all n locations
  Clone ID: PAT_TA_1332
ttaaaaacgggccccccctttttttttttttttttttttttttttttttttttttttttttttttttttttttttttttttttttttttttttttttttttttttnnncaaggctaaacggaacaggctaattatagaacttgcataagtacatggatcgaccccgtgtgacaacgaaacaaatgaaagaatgcgatatgcatactacggtactacatttacaccatcccacagagcttcgatgcgcgcgcactttcccttccttccttcgttcgttctcacggatcgaaagccgaaaccagacacatctcagacggccgacgggttcctgggttgttgttcttatgagctgcgggagctgggatctcatcagcggagcttgcactcggcgggcacgccctgcgccacccgcttggggtcggtgcagtagttgtagatcatgaacttcctctgcacccaccgcatgcgccggtaccccatgccgctcagctcctggttccaccagctgccgctgccgttggcgccggcggccgaggcctccatggtgcccgcggggcagcgctgcgcgccgcccgacatgacgcaggcgtcggcgttgaagttgcggaaggaggcgacgaacggcgccttgctccagtcggtcttgacccggccgccctgcgtggcccagtcgtcggcgttccagaggctggagtagagccgcatcggctggttcttggggaaggcgatcccctttccctcaaggttcttgaagtctctgatcggcatgtcgtccaccattaagatgatgtgcttggggttccagaggatggagtaggtgtggaagtcgttggtgggatcgaaccagaggcggaactgctgctcccgctggccctgcccctgcgtgaacacgttggtgtgcagcgtgtagggctcgccggtgacgttgcccaggaactcgaagtcgatctcgtcgtgcgtcggaccctgcgacgacaggtagtaggcggtgacggtgccggcggagttgccggggacgagcttgagctgcatgtcgatcttgccgaagaggtactcgtgcctggactggaacccggagccggagaccttgtccagccccagcgtcaggagctggccgttgttgaggatcttccctcgcccgtcaccccaggtgacgtcgaactccttgtcgaagctcgccgccgccagggcacaagaggcggcaagcaggatcgccagcaccgacaccgccatgcgagccatgcgttccgtgctaccaaaagtacgctcactcaactagggactagctagctgaagaaggtaggtaaggaggagaaagcttgatggaagagttgtgttagtctgacttgagctgcacggcgatcttgccgtagaggtactcgtgcttggactggaacccggagccggagatcttatcgagccccagcgtgaggagctggccgttgttgaggatcttgccgcgcccgtcaccccaggtgacgtcgaactccttgtcgaagctcgccgccgccagggcacacgaggcgagcaggatcgccagcaccgacaccgccatgcgtttcgtgctccagaaagtaagctcactcaactggagtagctagctagctagaagaaggttgatgaggaggagaaagctggatctaagctttg

SEQ ID NO: 1333 - DNA, 1375 bp, Triticum aestivum
  Clone ID: PAT_TA_1333
cacctaggggccgtattattgttttttttcgttgtttttttttttatttttttttgttttttttacgctgaatttattgtatcatttacatagttgcacagttacatttacatccatacgtaggtgtgacagattctatacccaatctataaaaatactccgaccccggcaacgtcgccaccagacagaacactcgatctacttggtggcgcactcgggcggggcgccgtccttgaacctccaggtgtccgcgcagtagttgtagatcatgtagttcttctgcacccactggaggcggtccagcgccgtggcgtccagctcctggtacatccacgcgccgttggacctggcgcacgccgccgcgtcctgcgacgcgcacccgctcgcggcgaagcccttgtacgacgccacgaacggcgcccgcgaccagtccgtcctcacccgcccgccctgcgtcgcccactcctccgcgtcccacacgctggcgtacacccgcatcgcctggctccgcgggtacgccacccccgtcgccgcctcccggttccggtgctcccggatcggcgtcccgtccacgtagaacaggatgtgcgtggggttccagacgacggagtaggtgtggaagtcggcggtggggtcgaaccacatgcggaactgctgctcccggccgcccttgccctggctgtacacgttggtgtgcaccgtgtagggctgcccgctcgcgttccccaggaactcgaagtcgatctcgtcgtgcgccgaaccctgcgacgacaggtagaaagtggcgacggtgccggcggagtcgccggggacgagcttgatctgcatgtcgaaccggccgtacaggtactggttcttggactggaacccggagccggaggcccggtcgagggacagcgtcaggacgtcgccgccgccgaggatcttgccgcgcccgtcgccccacgtgatgtccacgtcctggtagaagttgcccgccgcgcgggccgcgccggcaagcagcagcagcagtggcagcacagagcacacgactgttctcctgggactcgacgccatcgttgggatctgaattcttctgcactcggtattatattccggtgtgttgtgtccggactccggccggctcgagcggagcacagctagccccagcgtgaggagctggccgttgttgaggatcgtgccgcgcccgtcaccccaggtgacgtcgaactccgtgtctaagctcgccgccgccagggcacacgaggcgagcaggatcgccagcgccgacaccgccatgcgtttcgtgctccagaaagtaagctcgctcacctggagtagctagctagctagaacaaggttgatgagcaggagaaagctgcccacgcgtcaacga

SEQ ID NO: 1334 - DNA, 2882 bp, Triticum aestivum
  Clone ID: PAT_TA_1334
cccagtcaccaatccttattgatatcggattatacagacaccccatcttccctatctccggccgtgtttctccggcgatcgacaggcatggactacatggagcactcggcgggaaccccctgggcgaagcgcttggggtcggtgcagtagttgtagatcatgtagttgctctgcacccaccgcatccgctgctgccgcgtcaggtcgagctcctggttgtaccactcgcccgccgcgcccgtgccgggggcgacctccgtgcccacgctggcgccgcagcgcggccggccggccgcggtcaccacgcacgcgtcggccttgaagccgcggtaggaggcagagaacggcgcgtgggaccagtccgtcttgacgcggcctccttgcgtggcccagtcgtcggcgttccaaaggctggagtagaggcgcatcggctggttcttggggaaggcgatcccctttccctccaggttcctgaagtccctgtcgcatgtttgccgccgggttcgggcgtgacccagagcaatctccgtcctagagcaattctgcctccgctctcgtcttgccctgcctcgcatcggaaggggaaagtaaatcatggcgacgggtcaaaattttcctcgaaaaccacccaagcattattctataattataagcaactccctatacaacggatgcttgattttgacttcctctgtgggagagaaacaccttctgttgctggaataatcaatcctggttctgatgggttccagaaacttttctttggacaagaagaaattgctatgccggttcatcctacaattgaagctgcttgcaatgcacacccaactgcggatgtagtttatcaactttgcatctttccggagtgcggctgcttcttccatgtcagctttgaagcagccaactgtccgagttgtagccattattgcagagggtgttcctgaatcagacgcaaagcagctaattagctatgcgcgtgctaacaacaaggtcatcattggacctgcaaccgtcggaggagttcaagctggtgctttcaagattggtgatactgctggaacacttgatcacataattcaccgcaagctgtacagccccggctgcagattggtctttgctccaactcgggtggcatgccaactgagctgtatgaccatcgggcctgagtgacgcactcgggtggtgcggcagttgcgaggtgttgggggaggggtgcaagggttatagatcttggagcaagtccggcccctccgcatcctcccccgcggcgtcatgtcgggctcctggttggtgccacggcgtggcagggcttggccccggggaggctggcccaggaactgcgagggtcgatctcgtcgtgcggcgtccgctcgcgacggacaggtagacggtggtgacggttgccggcgggagttgccggggacggagcttgatctagcatgtcgagcttgccgcaaggggtactcgggctgggacttggaaggcggagccggaggtcgtgtcggagccgcatgtgctggttgtgggcgcaggcgatcacctttcccccgcagtttccctgaagtctctcgatcggcatgtcgtccaccatgaagatgatgtgcttggggttccagaggatggagtaggtgtggaagtcgttggtgggatcgaaccagaggcggaactgctgctcccgttggccctgcccctgcgtgaacacgttggtgtgcagcgtgtagggctcgccggtgacgttgcccaggaactcgaagtcgatctcgtcgtgcgtcggcccctgcgacgacaggtagtaggcggtgacggtgccggcggagttgccggggacgagcttgagctgcatgtcgatcttgccgtagaggtactcgtgcttggactggaacccggagccggagaccttgtcgagccccagcgtgaggagctggccgttgttgaggatcttgccgcgcccgtcaccccaggtgacgtcgaactccttgtcgaagctcgccgccgccagggcacaagaggcgagcaggatggccagcaccgacaccgccatgcgagccgggcttaatgtgctccaacaaaaactcaaccgactagagctagcaggaaaaagcaaatacaaaaggaagaacagtcaggtaaatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcaattggcctaattggccacacctttgatcagaagaggctcaagcaaccactctaccgtcacccttgggaggatgtcctctacaccaagtgaggccgactcagcatggcatcatatggatcttccagttgtgtgtacaccataaaatcaagcataattgcatagaattcgaagttctgattgtcaactaggcgaggagggagagaggaccgttacagatgagcactggctgtgtgtcttgtgggactgttttttttataagctccaaagtaagtcttttttttttgttcaagcatgaaagctttagggcatcagatatttgagaggatacttgataattgtttcatgttatcatcaattaagtgaccgccaaatttggggagtgttgtaatgtttgtgatgctagttccccatcacaaaaaatccgaattctgtaatgtcaaattatgtggtacgagtaataaaatagaatatgcacgtctgaattgcttccacctcgagactagttctcccccgcccgggcgcatgatcaatcgtgtttacatggtacctgcccgggcggccgc

SEQ ID NO: 1335 - DNA, 679 bp, Triticum aestivum
  Clone ID: PAT_TA_1335
attattccagtccactagcacagctcgtcttgtccatcggccgcttgcaggtttcacctgctttgccaagaagactctgcgcctgctcatcgccttcttcttccccgtcgtcttccagccaagacaagattcgagccgtccgtggtgaccgatcgtcagtccagagacgccgccgggaacggaacaccgtcgcgacgccgccagattaaatcgccgcctccagagatatgtgcgagccaaggagcctgggaaccactttatgctaactatgcagcgcctccaagagagcatgatttcagtcccattgtttgaggcgcaggaagaagatgctgtgaacaaggagtctccattcgtcatggtgctataagatgccaggctccatcttaatgatttcgactagctgtttgttgtgcccttgggagtatctatcctgtatgaaccttgctttctgttctgtcttcttactttttagtactagtagaaccgaacactttgtatgtctgaagtagcgcctcatcacttggtgcttgttatgctatcttgagcatcatgttgatgttgtaaaaaattgtgtgtctatgctattgctatgtagaactgctataatgttcatgttcacccctgttgactttcagtttgcgttgttattaaggcatggttgcagtttgaaatgctgaaa

SEQ ID NO: 1336 - DNA, 1023 bp, Triticum aestivum
  Clone ID: PAT_TA_1336
actctccactcccgcccgcttcactcttatgtccgcgccccccatggctgccagcgcccaggagcttcccccggcgcagcagcagccagcggcggagcaggctccctccttggcgctggcgctggtgcctcagccgcaggcgcaggcgcagattaagccgaccagggtgtcgctatcctacgaggagatctccaagctcttctccctccccatcgcggaggccgcctccatcctaggggtttgcaccagcgtcctcaagcggatatgccgcacccacggtattgtcagatggccgtatcgaaagattgtttctgggaagggtgatgacgcaaaaaatgctgaaagagagaaagccatgcagcttcttgagttgtcaaaaattgcaaaacaaaaggctataagctcttctggttcattagcgacgtcatcatcaggtgctttccagggagtgccaaaagctcaacaaggcagtgcgaaggcaggaacagctataggtcgacaaaatgcgccaagcctgtcccagtttagccaagccaaagacatccccacctacatggatgatttcaagtacggatttccatcatctggcctgtctactgaaacaatgaaatggtgggggactgacagccacacagagaccgctcccgcgaaagacgataaccgggaaggctccgaatcaacaaatgaggcatcgaaaggaacagacgacgagttagactggggagcagacgaacccgaagctgatgccgacggagtggctgctgcaactgacccgtcggcccagctctgctccctcaggagaaaggccgcgggcgatgggcgcaggctgctgaacggtgacaccggcagggtccagcagttgtgccgactgaacaagaggcagaagatagtgctggcccaggtgttcggagcttcactgccagagcagcggaggagcaagctagcctgaatgtttttttgcctgctgttgtaccatgtgtaactctagggattgtagcaaccgatgggtctgccctcttcctg

SEQ ID NO: 1337 - DNA, 958 bp, Triticum aestivum
  Clone ID: PAT_TA_1337
ccgcccacgcgtccggacggagaaccaaacaatggcagccgaaggaggtctgaagctgctcggcttgacggtgagcccgttcgtcatccgcgtacgcatggcgctgcagatgaaaggcatcggctacgagtacatggagcaggacctgttcaccaagggcgagctcctccgcaagtccaacccggtgcacatgaaggtcccggtgctcatccgcgacggcagacccatctgcgagtcgctggccatcgtgcagtacgtcgacgaggcctgggcggccacgggcccctcgatcctccccgccgacccctacgaccgcgccgccgctcgcttctgggccgcctacgccgacagcaagctcttgcctgcgtgggtaggcatcatgtgggcggcgacggaggaggagagggcggagaaggtcggcgacacgctcgcggctatcggccaattggaggaggcgttcggcaagtgctcgaagggaaaggccttcttcgccggcgattccgtcgggtacctcgacctcgtcgtcggctcgcagttgctctggttcgaagcgctgcagaagatgttcggcgtcgtggtcgttgaggtgggtagggctccgctcttggccgcgtgggtgaagcagtttggggagactgatacggccaaggaggtggtgccggacgttgacacggcggtggagtacctgacgaagcttcagtctcgtcgggctggttccacggttgcccagttgctgtcgtgacaaaagtagagtggaatttgtcgacccagctagcaagtacagcgaattttctctttaggccagctttatagtcatgtcttgtaaggatgcaaagaatggactggtttccctcctgacaccacgtagctacttctccaaagaggataacaaatcgtttgtaagaaatcataagtatatctttttttttgcgggtgaaatcataagtatttctttgtc

SEQ ID NO: 1338 - DNA, 3385 bp, Triticum aestivum
  Clone ID: PAT_TA_1338
gtcatactcgccaccaaaccccccaaaagtatctttccacgccacatatccgggctccggcacggcagatacccaaatctaccccggcatcccctccccccttctcttcccccatcgccgccccgtcccgtctcgtcgccaaccaccaaatcccccgccccgcctcgccaccaaccccacgccaccacccctcgccggccgcctggtatataaaccccgactgccacccccatttcccccagaccacacgactcgccctccgcacagcagccccgaacccatcagggcggctgcggatctgcccgtagggcgactgacgccgtcccacccgtcgcgtccgctcccggggcgcgccagctcgacgtccgcctcccccgggccgccatggggcgggccgtcgtgctccagggcggtcgctccgccgaccgcagcggggggtgcaacgccagcaacagccgcggcacgttgcgcgccccgccccgggcggcaggggccgccccttcgtcctgcaggggcgccgactgcgccgagggcctcaaggctgtccacgccaccaacatccgtgacaccttccgcgtgctgatccacgtgggccccctccccattttcggcggccaggtccccgtcgtcaaggtgggccggctggctggccgcatggccaagcccaggtctgacaacttcgaagacgaggagggcgtcaagctgccgggtcacagtggccacaatgtcaacggcgacgccctcgacctcaagagccgcacgcctgaccccgacaggatgatcagggcctacgcccagtcggtggcgaccctgaacctgctccgcgcgttcgcgaccggaggctacgcacctatgcagcgggtcatccagtggaacgtggatttcatggatcacaacgagcagggagacaggcaccgtgagttggcgcataggatgggcgcggctcttggcttcatgacaccagccgggccgcgtgttggaccatccgataatgacgactactgacttctggacatcccacgagtgtctcctcttgccatatgagcaggctcttacttgagaggactcaacatgtcgtcattccttcgactggctggaccaaatgggctgggtttgtaaagcggactgacatattcaacccgtcaaacaaggagggaaggctcgccattgctacaaggctgggggttaagaacatgaagatgaagttgcctcatctcatccgtgctgtccgcaattctggacagattgtcacatcgatgaccgaaccgatgcacggaaacaccatcaaggccccatgtggactgaagactgggtgcattttgactctatctcgacctgagctgcccgcattcttcgacggtgtacgaccaagaaggaagccacccaggaggtatccaccttgaaatgactggtcagaatgtgaccgagtgcatcgggtggatcgcggtctgtggaccttcgcatgagctgggtgacgaatacaacacccgactacgaccccaagtgcttgaacgcgtcccaatctctggcgcttgcttccatcatcgcagggacatacccatggaagagcaggatgaaggctatggaaccgccacacaacccatgccgcttgcggccatggggcttgcaaagcacaaaagcaccaggctgaaggggttatgatagttggcatttgcaagcggtaaccaaatacgcattgcaacgagtttgtacctggggctgctgtgaacatgattgacgttttgaagaggtgttagaaagtcgggaaggacaaccagggttacaagtacgcgtggctgtgaacatgtgtgtgatgttgcctcatttcatccgtgctgtccgcaattcttgtcagattgtcacatggattaccgaccccatgcacggaaacaccatcaaggccccatgtggtctgaagactcgtccatttgactctattatgaatgaggtgcgtgcattcttcgacgtgcacgaccaagaaggcagccacccaggaggtatccaccttgaaatgactggacagaatgtcactgagtgcattggtggatcgcggactgtgaccttcgatgacctgggtgaccgctaccacacccactgcgacccaaggctgaacgcgtcgcagtctctggagctcgctttcatcatcgccgagagactcaggaagaggcggatgaagtcaggactcaccaacaacctgccactgcccccattggctttctaagcaggaagcaccagggaggaggggttagatagttggcatttgcaagcggtaaccaaatgcgcattccattgagtttgtatggtggggtgctctttgcacaagctgtgtgcttatgaggtgttggtacttgtcgaggacagcaggggggtagcttactcgtggtgttgcactatgttttgtttctttgttttatttttgagtgtttgatctgtttgagcctttgtgattcgagaaaataaaaataatatgagttacctttattaatttatttaaatctcaaaatttcatctaaaaaaaacccacgcgccagcccctcccctcccctcccccaggcgagctcctccgcaagtccaacccggtgtacatgaaggtcccggtgctcatccacgacggcaaacccatctgcgagtcgctggccatcgtgcagtacgtcgacgaggtctgggcggccacgggcccctcgatcctccccgccgacccctacgatcgcgccgccgctcgcatctgggccgcctacgccgacagcaagctcttgccggcctgggtaggcatcatgtgggcggcgacggaggaggagagagcggagaaggtcgaggacacgctagcggctatcggccaattggaggaggcgttcggcaagtgctcgaagggaaaggccttcttcgccggcgattccgtcgggtacctcgacctcgtcgtcggctcgcagttgctctggttcgaagcgctgcggaagatgttcggcgtcgtggtcatcgaggtcggtagagctccgctcttggccgcgtgggtggagcagtttggggagactgatacggccaaggaggtggtgccggacgttgacacggcggtggagtacctgaagaagcttcagtctcgtcgggctggtgccactgttgcccagttgctgtcgtgacaaaagtacatttcgtccggttagcaagaacagcgatttttctgtttaggccagctctatagtcatgtcttgcaaggatgcaaagaatgaactggtttccatcctgacaccacgtagctacttctccaaagaggacgacaaatcgtttgtaagaaatcataagtgtattctttgtcgtggatataatcctgacaatactacaggggtgtgaatgtagatacaatcatatctaccgatcagtgtgggat

SEQ ID NO: 1339 - DNA, 802 bp, Triticum aestivum
  unsure (1)..(802): unsure at all n locations
  Clone ID: PAT_TA_1339
gtttcacatccaacggccgccgctgcgtcgttgcatctggtggctacactctcgcctggcctgccttctctgaattgggggaggggaggtcaccaccgcatcgccatggctcccgccgccgcccgactcctcccagccgccatgcctattacccctcaccgtcccctgaactggtgcaggtcagccgccgcacgccgcccttcccctagcatgcggcttctccgctcaaactcgcggctcctggtcgtcgcctccgcgcagtccaacctctccaaagctgttcaaaaaacatggagggtcagtaaggaagctgtggatgctggaagtgctcttgtcccaggttcagttccacgcccaattgctaggataggcgtgacatttgttgccgtgtctgtcgccctttttctgctcaagtccgtcatttccaccgcattgtttgtactggcgatgatggggcttatatacttcgccttcctggcgatgaacccaaaagagggctccaggagcatggatgaaggagacagtccttcgtcggacgaccccgccgaagaagcccgtcgcataatggagaaatacaagtgaagaagagccttattttggtgagcctactctgaagtctgaataggtatacagagaaatacctgctgtggccttggatggatctggctttaggttaacagaagtgaattattccgtatggctacatacggggttgggttttcaacaanataagtgttgtcaatacggtatatatacgtanatggcaatgatctgatataatggactggatcanagaaaaaaa

SEQ ID NO: 1340 - DNA, 792 bp, Triticum aestivum
  unsure (1)..(792): unsure at all n locations
  Clone ID: PAT_TA_1340
aaaaaaggaccgtgggagcgcctcaaaagccactgtagcgatccccaactcagctctcacacaggcgacagcgcggcggggcacgcccgctacgtccgtacttcgccggccgctgtccacagttgcccacccagcgaggcagcgagcctcctccttctccggcctctctctgccgtcgacgcctcggcctcgcccgtcccccgcccgccatctctcatctgctgagccgtcaatcttacggaacgagcggtcgcagctgctccggtcgccggctagatctgcagcgccatccctccacccgctcaccaccgtgatctacctgccgtcaccggtcctctccctctgccgcacctccgactgaggtggagttcaacagaatgagagaattttcacccgtgttcagttgaagttcgagatttcatgatgtattagtacttactaatctggcaaagatcataaaatgtatacctggccaaacctcgggtcgggccgggcctagccaagcccgaggcaaaaaacccaggcccgagcccggcccggccatcaggcctggtttttaggcccaatcccggccaggacacataaaagcccggcgggcctcgggccgggccccttcaggaaatcacaaaaacgacgggcccggcagtctccctgcgtcgcccctgggtcagaagaactagtgcggattgtactccttttgctgaactcagcgttgtaataactggacttgatattttgctgaacctgttctgagaggcttcttttaattaaaanaaggatattatagaactg

SEQ ID NO: 1341 - DNA, 648 bp, Triticum aestivum
  Clone ID: PAT_TA_1341
ccccgcccccgatgcccggctcctcccacgcgtccggttgtcttggccgacggcgttcagtcgctggtgagtgggccgaggctgtgtggtgcgagtgggctcagggctcgtgctctttggtgggtggtcagcccgtcaggttgccggagctgtccgttgacaggacgcaccatcgggttaattgttccgttggatgcccttgcaagaaggattgctgcggtggttcagcgtcactgcccctcctgcatcaacaatctggtgatccatatgcaaaggttcagaagagctattttgtgtacatgagttgctactggcagtggacagattgtctatgcagagtgcgtagagaaaaaaatgctcacatacaaacacaaacgacatccagtaggcgcttggaacacccgacagattgaaagcacagaagcaaagatttccaatacgaggccacgatgcccgacagagatgtagccaatatgtgcccaatccttatttcttgatgttggaacaacaactactgcggctccgaccagtccgccgtgggcccgcggccgccgccgccgtgccgcgcgcgcggggccggtgggcgcccgccgggggcttccacgtccccccgcctaggcggggcagtggtggtggcgtgtgcggcgg

SEQ ID NO: 1342 - DNA, 541 bp, Triticum aestivum
  Clone ID: PAT_TA_1342
accataagatccccaatcccaaatcctccacctccaagcagctcaacctcttcgttccgttgggagctcagcaatgtcggggcgcggcaagggaggcaaggggctgggcaagggcggcgccaagcgccaccggaaggtgctccgcgacaacatccagggcatcaccaagccggcgatccggcgtctcgccgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctaggccgcgctctcgcgtgttagtccggtgccggtgttagccattgttagggttaccgatgtgatgtctcgtggtgtggagtgggatgtgatgcatatggtttcagattgatcaatggattcactgttgctgttcagtaaaaaaaaaaaaaaaaaactcg

SEQ ID NO: 1343 - DNA, 862 bp, Triticum aestivum
  Clone ID: PAT_TA_1343
gctgtctcaaaagatggcaaacttataataagcaccagtagagattccgcaattctgttattcaatagggacacaaaacaggagaggctgattgaagaggagcatacagtcacttcattttctctttcggaagatggcgatttcttgcttgtaaatcttataaatgagcagattcatttgtggaacataaggaatgatcccattcaagttaaacagtacactggccataagcgcagccggtttgtgataaggtcatgtttcggtggatctgagcaggcctttattgccagtggaagcgaagacgcaaaggtctatatatggcacagagctagtggagatgttatcgagaccctgtctggccactcgggtgcggtcaactgcgtaagctggaaccctacaaatccacatatgcttgcatctgcgagtgatgatcataccattcgcatatgggggctaaagaaagccaccgtgaagcgaagggacgcaggcagcagcagcggcagtaatgggatccacatgaacggcagcgccaacggcaacggtttcgttcaccagtgcaacgggagccgcagcaagtgacaatgacatgcagcgctttgctttccttcctccaggaagaacaccctagtccagcaccggtgtagcgggggagcggaaaacctgcttggttttatgcaccgcctcccttgttccatcgtgtgtcacaattgtcacatttatttctcaattcaaagatggacacaaattcaaatattgtttggcgcttaaattagctttctttcctctaattttgtgatggtcgtgatggccccgtagtgatgaatccatttcatattttccctgatttcctcaattcaatgtc

SEQ ID NO: 1344 - DNA, 2573 bp, Triticum aestivum
  Clone ID: PAT_TA_1344
atcatattattccaggagcaccgaagaagccagcggcattgccaaacgaacaagacgaggcagcgagcggcggatttgcgtccccagcggtgaagatccccgcgggcaccggcggcctcgtcaccccacgcagcgtcgcgccgacggcctccggtagcgccatcatcaggttcgattcgctgtccccaccggcgcctggcctgatttggtgcgacggcggcggcggctcgattcggtgcggcggcagcttgattcgcggagactgcggcccgattgcgacggcgtgcagagtccccgctcagcgtcggccgtgcgagggagcggcgaggtgacgtgcagcggccgtctgctcctcgtcgcgcacgtgcagtcacgcggggatcaggaaccggattgcagactgcagtaaccgacagttttctgtggtggcatgttctcgttgcttgtgtaactttgttctctacagaagtaaagaatatatgggctgactttggcatttcatgggatggttttgaagatgctgaaccgccctcaatacgcgcaagagcatcctcagtagagtcggcaaatttgccagaaactacctgttattcgatacccactcaccctttgggaggtacaatggctagacctttggcttccccgcggaaagatgttatggttggctctaaaggcgtgattaagcgggacggatgtggggcgttcagctcacttcctctgtatactcttggatatgaaaaaagtggagctgttcttgaggaagaatcaggtattacattgcattctccgtcggtgaatctattcagaaagcaggtgcttgatggtaattgggacaatgcagtagctaccttgaataaacttggccttctggatgaaaacattgctgaagtctgctgcatttttgttattggagcagaaattctttgaccttttgagaaatgacaacttaatgggtgccataaagacgttgcaaaatgaaatctccccccttggtgttaacagaaaacgagttcatgaaatgtcaagttgcataatttcttctcacgcagaacttcttgcttgcatttccaaagcttggaaccgaagcttctgactcacgccttaagctcctagaggaattgcaaaaggtgctcccacctgccgttatggtaccagagaggaggttagagaatatagttgaacaggcacttactgtacaacgtgaagcttgttatctccataattctattgatggcttgtcaccctatgttgatcatcactgtgggagggatcagataccatctcgaacactgcaggttctgcgtgcacacggtgacgaagtatggtttcttcaattttcaaacaatgggaaatatttagcctcatcatcaaatgataaatctgcaattatatggaaggtcgatgaagatggagaactattgctgaagcacagattgactggtcatgagaaaccagtgatgatggttgcatggagtcctgatgatagccagcttcttacatgtggaatggaagaagccatccggcgttggaatattgaatctggtgaatgtattcatgtctacgaaaagcctggccttggtttgacgtcatgtggttggtttccagacggaaagcaaatattgtgtggtctatctgatcaaagcctttgcttgtgggatttagatggtaaagaggcagattgctggaaagggcagcggtcatcaaaaacatctgattttgctgtaacaaaagatggcaaatttataataattatgaacagagattccacaattcttttattcaatagggacacgaaacaggagaggctgattgaagaggataatacaatcacttcattttctctttctgatgatggagatttcttgcttgtaaatcttataagtgagaagatccatttgtggaacataaggaatgaccccagtagagtgaaacagtacattggccataaacgcagccggtttgttataagatcgtgctttggtggatcggatcaggcctttattgccagtgggagtgaagattcaaaggtctatatatggcacagagctacggaagatgttatcgagactctttctggtcactccggcgcagtcaactgtgtaagctggaaccctacaaatccacatatgctcgcttctgcgagtgatgatcacacaatacgtatatggggggtgaagaaggccagcacaaagcggaaggacataggcagcagcagtagcagcaatgggactcacatgaacggcagtgccaacggcaacggtttcgttcaccagtgcaacggtagccgcagcaaatgatgatggcttgatccttggtagcccccatgcaagcgatgatagcttgatccttggtagcccccatgcaagcgtcatttgtaaatcctcctttgctttgctttcctttcgccaggaagaacaccatagtttaaaacgaagctacagtaacaggtgtgagtgggtgaaaaacctgtttggttttatgcaccatctcccttgttccatcatcatcatcatcatcactgtggtcacattaatttatcaattcaagctggatacaaattccggtgttatttc

SEQ ID NO: 1345 - DNA, 538 bp, Triticum aestivum
  Clone ID: PAT_TA_1345
gaagctgaaaaaggactgatcaacggcttcctcgtaagctctcatctcctccacgttcataccgcttgcagccgtcggcttcgcgtgccctcgggccttggcagggcggtccccaccggtccctccggtgcctctcccatgggcatcccctggcgagtaaaacatggtatcggcaggagcgggaacaggggcatggggtggcagcgctccagctgccggagcctacaaccccctgtcccccgggcgcgctccgccccgcctcccgccgtcccgcgaaaacctgctcaaggctacaccaaaaagcgtccactacagtgaaggaccaaccaagaaagattgacacaataggtggtgatcaaataagatgtatcgatttagtcgttgtggtgtaccagttgtggttctcctgcatgtatgccactatgggaagcatcgtctgtttgaattcactgatatgttttgacgtatatgttttaacagcaactcgatcgctgaaatgttagatcgggtttattaattggcagaacgtttttatgcg

SEQ ID NO: 1346 - DNA, 1607 bp, Triticum aestivum
  Clone ID: PAT_TA_1346
tttttttttttttttggccccacaaaaaatggatggctaatctctacatcgtcagcttagaaacagcattgtaccacagcatcaaatgacgatgctgctttattatcaaagcataaggaaatcttcagggtcagcaccaccaagtcaaaaaaaaagacaacagagcaaacgggaacatgtttcaacaaagaacaaattaaaaacagttcatcttcatcacatttcacaggaaacgaacaaggcagacgcaactcagcgccctaccaacagcaaatcctctccggagttcaggtccactgcaaaaactccaagcctttcttttcatctccgcctcactgcagctgttcacgaaacaccctgaggatgtcggcgaaggtgacgatcccggcgagacggcagtcgtcctcctcgtcgagaacccacaggtagctcacgcggtgggcgagggcctgcaccatgacggccaccagcgagctcgcgggactgcacaccacgggctcctcggtcgaccggcgcccaaagctccccgacgacgggcgcctcaggtgcggccggccggtgtcgtcatctgacgacgaggaagagagggagaacgacgtcatcgtctcgtcctccatcagctcaagcatggcgtcaaggcccttggccttgagcccggtcttgatggcgcgcaggatgtgctctggcggcgagccgaagtagtcgatgtatgccatgaggtcggccgccgagagcgtggcgatggccgcggctgccgtctcgtcgcaggcagcgaggtgcgcggtggagatctcgccgacgaggtggccgtcggcgctgaccacggcgaccgcggtctctgcggcgatggcccggcggatgagggggacggcggacagggctgcctcgtcgggacgcgccgacaggaagtcggggcgcacgaggccgagggaggagacggagcgggcggcgacatggtagaagagggaaatggagttgaggaagtagcggacgaggtcctcctgcgtgagccagcagaagtcgccggtcacgccagcgacgccgcccagctgcttcttgcggccgcccgagcggagcgggacggcgagcacctgcgcgccgctcaagatctcatcaagagcttccaagacactggaacggggatctacgcggcggacctcgccggcgccgtccttgggcaggagcgcggagacgggccggtcgagcgcggcggtggggcgcgcgagcgcgtcgggggaggagcagaggaggcagaggacgtcggcgaggccggcgcgtcccaccacggcgccgcgcgccgggccgacggctatgcaggcggcggcggcggcgcggggccccttgcggaccgtggcggcgaggtcgccggcggccgcggagagcgggagcgacctcacggccggcttgccgatgcagaggtccgacacgtcattggccaggaggctcactgccatgcactcgcgggcggaccctgggccggtttcgaggacgaaaccctcacgcggcgtgggaaggggaaatttttccgacgggaggacgaggagagagagaggccgggaggaggacgagaggcgaggggggatctggtttttttgagcccggccggc

SEQ ID NO: 1347 - DNA, 1457 bp, Triticum aestivum
  Clone ID: PAT_TA_1347
cgtccgcttgcagagtctgctaagttgcagttctcatgccgtgactatagtgaccaccttgcgattgttcgtgcttatgatggatggagagatgctgaaagagatcgcaatggctatgactactgctggagaaattttctgtcagcgcaaaccttgaaagccctagattctctccggaggcagttcctctttcttttaaaggacactggcttgattgatgaaaacatgactatgtgcaataaatggagtcgcgatgaaaatcttgttcgggcaatcatttgtgcgggtttatacccaggtgtttcgtctgttgtgaacaaggagaaatcagtttctctcaagacaatggaggatgggcaggttatgctttactcgagctcagtgaatgggaaagaagccaagattccattcccctggctagtgttcaatgagaaagtgaaggtgaattcaatgtttctccctgatccaacagcgatgtctgattctatatggctgctctttggaggaaacatacaacaaggaggctcggacggacacttgaaaatgctcgggggatatctggagttcttcatgagtcgcgatcttgcatcgacttacttgaatctcaagggtgaacttgaaaatttaatccactgcaagcttcaaaacccaaggattgacatccaaaccagcgaggagctgctgtcagccgtacggctgctggtcacggaggacccatgcagcggccggttcgtctacggccggcaagaaccaaggtcaaagaaagcaaagacgatgatctcttccgcctcggtggcctccatggaccgcggaggcggaggcgggcacggaggggacaaccccaagaaccagctgcagaccctcctgacgagggcggggcacgacaacccgtcctacaagacgaagcagatcaagaacaccctcttcaggtcgaccgtggagttcaacggcatgcagtttgtggggcagccgtgcgccaacaagaagctggcggagaaggacgcggcgggggaggcgatcagctggctcacgggcggggaggctcctccggtgacggccaacgcgagaggccggcaggacgccgaccacatgtcgatgctgacgaagccggcaacacgcaggaggcggcaccaccataggaggagctgattagcgcagaaaggttttgttcgttgcactcagtcaggcgaagagcgataaaacggaatacatacggtagattagcttgagaagaagaaacacagcgatttttcgtacgatgcccgagttgttgaaactggctgcgatcgcccaagatggggttgtcctggtcttcattcttagatcataggacctgttcgtacggtgacctcgatgctcattgtgcagtgctgtgataagactatctagtataatggaagagcattggatggtaccaatgcaacagagggactactctccgtcctgaattatttgtc

SEQ ID NO: 1348 - DNA, 796 bp, Triticum aestivum
  Clone ID: PAT_TA_1348
gcttcccccgcccgtccccgtccgtccccttcgcctcgacgaccggatcgatccgcctccgccttttccgcgagcctcttcttccccgatcatggagcagactttcatcatgatcaagcccgacggcgtccagagaggcctgattggggatatcatcagccgatttgagaagaaagggtactacttgaaggcgatgaagtttatgaatgtggagaaatccttcgcgcagcagcactatgccgatctctctgcccagcccttctttgccaagttggtggattacatcatttccggccctgttgtggccatggtgtgggaggggaaggatgttgtcttgactggccgaaggatcatcggggccaccaggccctgggaggcagctcctggcaccatccgtggtgaccatgctgtggaggttagcaggaatgtaattcatggaagtgattctgtggagaacggaaagaaggagatcgctctgtggttcccaggaggcttggccgaatggaagagcaacctccacccttggatctacgagaactgaactcacacgatcatctacttctacttgttgatgatgcctcgtttcttcagaattcgagcttgtcccggtctggctatccgagtcgatgattagatttcgtgctgtgtgatgatgttaataaccgaactgaatgtgttgcctgaacctatatggcttttgcgtttcctttgatgtaactgtaactgctgccacctcactacctcagtgcagttttcggaaataagataaacctagcaggggagtttaacaaaaaaa

SEQ ID NO: 1349 - DNA, 715 bp, Triticum aestivum
  Clone ID: PAT_TA_1349
gtcgacccacgcgtccgggacccacgcggcagcggacgcgtggggagcaagaagggttggaaggcggcggcaggatagaggagaggagtcagaagatggctccggtgaagaagcccaaaaaggccaagcggaagatcagtgactccggcgagaccaagatcgatgactccagcgaggcgaagaccaaggacgccagcaaggtcaagagaaccaagtccggcggctcgttggcgttgcttccggcggaccttcgtggccccgatacggaatggtggtatgtcttcctcagcaagcacggggaactccacaaggaagccgaatcaggtggtcgtgctccagtgccttcagatgatgaggaagcgttcaggtacttcttcaggacatcgaggaggacttttgagtacatctgctcgattgtacgggaggatttgatatcgaggccgccttctgggctgatcaacattgaggggagactgcttagtgtggagaagcaagtagcaattgccatgaggaggctggcatctggggattcgcaggtgtccgttggagctgcttttggtgtggggcagtctactgtttcccaagtcacatggaggtttatcgagtcgatggaagagagggctcggcatcatttggtgtggcccgggccaggagaggatggaggagatcaaagctaggttggaggctgtctctggtctaccaaattgctgcggtg

SEQ ID NO: 1350 - DNA, 998 bp, Triticum aestivum
  Clone ID: PAT_TA_1350
gtcgccgcgccaccatcgtcgcaccccgccagaccgtcgcgctgccgctggcagcgccgaccaccacatgacacagcctccgcgacgacccaccgcgaccgccgagccagtcttcctcggcgccacatccatcccaagtccatggcccgagccggccaccaacatccccgtctttcggcacccgcctcccccgccgccgccgcagaagcacccgcacgggaagcaccggtcccgccccgcccgcctcatgcgttcggtgcgcgccgcattccgttcgttcccaattctcccggcaccgtcctgccgtgggatgccgtcgctgccccacctcccgagcctcaacggtgccagcctcgtcaggaaccagttccatggctctacgcgcaccacggggacgctgtacggccgccggcggtcgcgcatcaccagcgccttccacgacaacccgggaagcccgccgggattgctgttggagatgtgcgtgccgacggccaagtttatccaggacgtcagcgcggccggcatggtgcgcgtcacgctcgagtgcgacaagcagcagcagtaccagcatcagcacgcgggcgaagcgtcgccggcgcaacggcagcttatggacgagccgacctggtcggcggaggtgaacggcgagagcgtggggcacgcgtctcggcgggaggcgacggaggaggacgagctggtgatgcggctgctgtacgccacgtccatgggcgccggcgtgctgccggacgacgtggccgagcatgccaacggcgagctcacgtacatgcgcgggcacttcgaccgcgtcgtgggatcccaggactctgagacgtactacatgtacaatcccgagggcaccgccaccgggccggagctcaccatcttcttcgttaggaattgattagttaatcttattctcctccacccttatttttctcttcgatttgttttaacattccccagccttctctgtttattttacgtatatgtgcatagat

SEQ ID NO: 1351 - DNA, 492 bp, Triticum aestivum
  unsure (1)..(492): unsure at all n locations
  Clone ID: PAT_TA_1351
gcacgaggcaccggaagcccgtctcaagggaccaccagaagctgctcgacgacagctcccccctcatagtcgtgtacagccttgagaaccaggggaaggcgaacctcgacggcaatgacgattatcggcgcaggcaggctgatgatgcccaggctctggccttcgcctctggtggtgaagccgctagcagcgcctggataatcgactccgttgcggcttgcaagctgcagcctctgtgacagagctcaaagaaggcttctcatgtcagtgggtttagtagtaaacaggaaaatccagggtggcactgaatacaagtgcatactttatatcgtgtcatgtagaaattataagacaacatnnnttgtgtttttctttcagaaagaggttgaaaccccctgtgttgatgaagagtaacttgatcgttccaatgtaaagagatttcacgctctactagtgctggcattccatataaagagattgacccttttcctg

SEQ ID NO: 1352 - DNA, 941 bp, Triticum aestivum
  Clone ID: PAT_TA_1352
gggagaggagagctcccatggcgacgccggacgcccccacctcgtcgtcgctttgaagcggaagaacaacggtgaccgccgtctgctgtatctccgccgcagcaggtctgtctcagcatcaaaagtcgaccgccgcgagcttcatcgcagcactccgccgttgtcgtagcattaggcgtcgctgccgcatgcgcgtggcggtgttgcagcggagtgctcgccggtggttcctgtgctgcggcatagtgcccgcacggaggcctggagctcggtgttgcaaggaagcttttcacccgcggcgcccgaagctgcgatgagcacgcggagctgcaacgaagcttcacccacgctgcactggagcctcaccagcgagccccaggctgtgatgcggcgggtggtgttgcaatgaagcttcaccgacggccttgagcttcgatgcagcggggaggcgatgcagtgtagcatcgccggcatcgccggtgatggctacaatgaaacttcaccggcgctgcattggaccttcacccgcgatcccggagctgtgatgcagcggggtggtgctgcaatggagcttcatcggtggctgcaaatggagttcatcggcaggcctgaggtgccatgcaacggggtaggcggctgcaatggagcttcaccggcggccttgtggtgagatgcagcggggtagacgatgcagtgtaccatcgccggcgccggcaatggctgcaatgaaacttcaccggagctgcagtgtagcttcatatcgccagccgcggaaggggggcccctgccttgagcatgcggcgttgcgtccctacttcgacgatgtgtccctgctgcgacgctaccgttgctcgcgttgacctgatccaagggctgtcagaggatgaatacaatggcttgtgacccgactgatttccgcaggaaatcagccggatgatttg

SEQ ID NO: 1353 - DNA, 513 bp, Triticum aestivum
  Clone ID: PAT_TA_1353
aagaaatttcaccaataacaagttcttgcttcctgtatacagatagagttttattggcagtgagatagctctgttatgttgaacattttgtactagccatgcaagaaatcaaccaacatttgttcagacacaaaatactttatcctaggcaatgtaggcaagaactacattggaaggcagagccagccatcttcattcgagattgacaggcactccatttatgaatataagtgatcgatgagatcagatcgtctgcatccaagctgattggtgattggtccggggccactgcaagcaggcaaccagccaccgttcttcttccacgtcgtcgtcgtcgagcctgcatcccttgtgctccaacagagggtttggggagaacatcttgggctgcttcacctcctctggcacctcccttgtgccgagacgcccctcgtcggcaccacggatgatggcttgcagcagcagcaggagggaagccatctatagatcgatgaggactgctgctggctggtt

SEQ ID NO: 1354 - DNA, 1132 bp, Triticum aestivum
  Clone ID: PAT_TA_1354
cccccctcccccgccgccgccgccgccgccatatacctcatctccgtcccagtttctcctccccgccccactgctcacacatctcgtcgcctctccctaatccgcgtgccactaacacccaaaccgcgcgtcgccgagcgctagcttccgccctctctcgccgaacctcgtcctcctcgccgcgggctactaatttctgttggattccgtggttgggtttggatttggaggcatgggggaagtggaggacatgctcaaggactatgagatcaagaaggaaggcgaggccgagatcctcatgctcgcgagtaacgccgtgttcttcaatcccgtccaggtgcacaacagagatatgtccattgctgtgttaaggacatttgttgccaagcgcaaggaagaatacgaggaactgatgaataaaaggaataataagtctcataaaaaaggcaatcaggttgaaacacctgttgtaaatggagacactgctttaactagccagcatgatgaaatcggtgttgttcatgaaaaggagacaaatcaggctacaaatgaaatagaagatctgtcaaaagaagaaacaaagacaccttccaggaaagtaaccagagagcttaagccaccaattgttcttgaggctttagctgcttctgggttgaggtctctccgttatgctcgtgaagttgatggattaggaaaggtagttgctctggacaatgataaagcttctgttgaagcttgcaagaggaacatcaagttcaatggggcttctgctattagcaaggttgaagctcacttggctgatgctcgagtttacatgctcacacatccaaaagaatttgatgtggttgatcttgacccctatgggtcaccatctgtattcctggactcagctgtacaggctgttgctgatggtgggctattgatgtgcacagccactgatctggcagtactttgtggaactaatggagaagtttgctactccaagtatggttcctacccagtcaaaggcaagtattgccatgaaatggctttgagaatcctccttgcctgtatcgagagccatgcaaatcggcaccagagatatattgtgcctgttctctctgtgtatatggaatttctatgtccgtgtttt

SEQ ID NO: 1355 - DNA, 1133 bp, Triticum aestivum
  unsure (1)..(1133): unsure at all n locations
  Clone ID: PAT_TA_1355
cctccgcccgccctttcctccgcccgctctagcccgcacacgcgacgccacacccacacgtgagccaagcaaaagcaaggcggacagacgttcacaccaccatcaaagaaagatcggccatggggagatcgccgtgctgcgagaaggcgcacaccaacaagggcgcgtggacgagggaggaggacgagcggctggtggcccacgtccgggcgcacggggagggctgctggcgctcgctgcccagcgccgccggcctgctgcgctgcggcaagagctgccgcctcaggtggatcaactacctccgccccgacctcaagcgcgacaacttcagccgcgacgaggacgagctcatcgtcaagctccatagcctcctcggcaacaagtggtcgctcatcgccgcgcgcctgcccgggaggacggacaacgagatcaagaactactggaacacgcacatccggaggaagctgctgggcagggggatcgacccggtcacgcaccgccccctcaccgacgccgccaccgtctccttcgtccatcctgcagaggcgaccaagcaacaggcgacggaggagaggaagccgcccagatgcccggacctcaacctggacctctgcatcagcctgccgttctaacaggaggaggaacggccgccggcgagagcgtgcgccaagccggtgatctgcgagcagctgcagcagggcggcatctgcttccgctgcagcatcctcagagtgagaggagcgccgacggagtgcagctgcggcagcaacttcctgggcctcagggccggcatgctcgacttcagaggcctcgagatgaaatagaaatttgggaataattattccgatcaaactttctgctgtaaattgttgctccctcctaccaatttttatttagctcttaggaaaagaaatactcctacagtactagtagatggtgaggaggagactggtatggtattattaggtgaggatttggtagcgatatcctccctgccctcctcgatttgctcagttccttggtaattattactgctccactggatgaaatggaacggaatgaaataatacagtacgatacttaaaaaaaaaaaaccgtaccattcccctaagnatcctatacncccncacngg

SEQ ID NO: 1356 - DNA, 618 bp, Triticum aestivum
  Clone ID: PAT_TA_1356
gatgggataaaccaattctattatacagtatttcacaaacatgtcacacagcatgtatatgcatgcataataacaagcactggtctgttcatgcatccatcacacataatctacgccaataaatccatcattacaagttcattaatatatataactgctcaaacaaaacagaaacaccactcacatcggcgccatcctttttattccagaaacattcagtacttgcttagcatatgcatcgttcaccaggcaacgatcttccagcgctggttgtcgccctcagtccactcccacagaatgagggtggttccatcacgcacaccgccatggtccttgtcgccatggagcgcgtcaaagttcaagtagatgttgttcaccatcctgatgcagcggtagcctgccccgacgtccctgctctcggtccaaaggaccgattcgtccagggtgtctggattgtacctggtcagacgaacagggtgggattggccaagggagtgcttgagcgcctctccgctggccttgttgacgagtgccatggcagggtagccttcctcatccttcaccctcgtgctgtacttcatgtccttgatccagtgctgcgtgtcgtcgtcgcggtcg

SEQ ID NO: 1357 - DNA, 1621 bp, Triticum aestivum
  Clone ID: PAT_TA_1357
ccccggcgctccgtaccgcccgaagtgggccccgccttcgcccgccccgggttttttttcccctttctgactatttgaatatccgccacacctatatagatagatctcccttacagcaatatgatgggataaaccaattctattatacagtatttcacaaacatgtcacacagcatgtatatgcatgcataataacaagcactggtctgttcatgcatccatcacacataatctaacgccaatgtattccgattattacaaattatcagcataggatttatcatggatccatcccacatagtctcggccaaataaattccatcattacaagttcatccaatatacataactccccaaacaaaacagacataccgctcacattggcgccatcctttttattccagaaacatacagtacttgcttattattaagatcgcgcgctgtttgaaccaacaaactgtagcatgtgcatcattcaccaggcaacgatcttccagcgctggttgtcgccctcagtccactcccacagaatgagggtggttccatcgcgcacaccgccatggtccttgtcgccatggagtgcatcaaagttcaagtagatgttgttcaccatcctgatgcagcggtagcctgccccgacgtccctgctctcggtccaaaggaccgactcgtccagggtgtctggattgtacctggtcagacgaacagggtgagattggccgagggagtgcttgagagcctctccgctggccttgttgacgagtgccatggcagggtagccttcctcatccttgacccttgtgctgtacttcatgtccttgatccagtgctgcgtgtcgtcgtcgcgatcggtgcggacgaggcagaccttgccgtccctggcggcgaggctgaagctgtcctcgccggccttgcagaggatcctgtacgtcggctgcctggtcgccggggccgccccgccgccgtggtgggggcgcgtctcgtggccgtagcccccggatccgccgcccccgtactgcggcctctcgtcgccggactcgtgggagacgtgcaccacgttgccgtacgcgggtgcgccgtagccctcgtcgcggccgcctccgtaggccggagcaggggcgtggcgcccgtagtcaccaccgccgtagcccgccggggcgggcgcgtggcgtccgtagtcgtcctcgcggcctccaccgtaggccggggccggggcgccataggccggagcgcgtcctccgtactcatcctcgcggccgcccccgtaggcgggaggcggggcaccgtaggccgggggaggagcgccgtaggcggcgggagggtggcggccgtaggcatcaccagcgtcgtcgtcggggcggcggccgtaggacgggggaggggcgccgtaggcatcaggctcgtggcggccgtagggggcgggggcgcggcggtcttcgtcgtcgtcgtcgcggcggccgtggccgtggccgtggccgtgcgggaactccatgattgactagcctgtcggtggtcggaaaatgggaacgcgcgcgggggagtggaggtggatcctatccgggccaagctcagcctatatacgtcgcgtcgccggagcacatgtcgacggatggtgagtgcg

SEQ ID NO: 1358 - DNA, 960 bp, Triticum aestivum
  Clone ID: PAT_TA_1358
gtctcgcatcccacctattcccaccgccaccgcgcccccaccggccgcctccagggacagcgagcgagagaggagggagggggctcgtcggagaagatggtggacgtgtcgcgcgtgcagaaggagctgacggagtgcaaccgggactcggacatctccggcgtctccatcgcgctccacgacgggggctccagcatcacccacctcaccggcaccatcgccgggccccgcgacagcccctacgagggcggcaccttccgcatcgacatccgcctaccaggtggctatccctttgagcctcctaagatgcagttcatcaccaaagtatggcacccgaatattagcagccagaatggagcaatttgcttggacatactgaaagatcagtggagcccagcccttaccttgaagacggcattgctatcccttcaagctcttctttctgctcctgcccctgatgatcctcaggatgctgttgttgcacaacagtatctgcgtgacaaggccacatttgttagtactgctcgttactggaccgaggcattcgcaaagagcgactccactggcatggaagaaaaggtgcagaagctggtcgagatgggcttccccgaggacatggtgagaagcgccctgctgagtgtgaatggcgacgagaacatggctctcgagaagctctgctctggctgaaggccctatgtggcctataagaagtgtaaattgcgagcccattcattatggaacaacgatcctagctaatgctcctgttatgccattccggtttggcctataggaacaatatatatatagtggactgaaccatggggctgaactgaaaagggcctatcataactagacggtttgtctagcttgttttctccaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1359 - DNA, 1279 bp, Triticum aestivum
  Clone ID: PAT_TA_1359
cccacgcgtccgcccacgcgtcccaccgcttgccaccgccaccgcgccaccaccggccgcctccagggacagcgagcgagagaggagggagggggctcgccggagaagatggtggacgtgtcgcgcgtgcagaaggagctgacggagtgcaaccgggactcggacatctccggcgtctccatcgcgctccacgacgggggctccagcatcacccacctcaccggcaccatcgccgggccccgcgacagcccctacgagggcggcaccttccgcatcgacatccgcctaccaggtggctatccctttgagcctcctaagatgcagttcatcaccaaagtatggcacccggaatattagcagccagaatggagcaatttgcttggacatactgaaaggatcaagtggagcccagcccttaccttgaagacggcattgctatcccttcaagctcttctttctgctcctgcccctgatgatcctcccggatgctgttgttgcacaacagtatctgcgtgacaaggccatatttataagtactgctcactactgcaccgacgcattcgccaagattgacatccctgccatggacgacatgctgctgacgcccctggtgatgggcatcgacgccggctttgctgagcagcgtccggcggagcagggctacatgacttaatactggtccctatggggcccggcgtcgccctcgacgtcacgtagaggccttccagacattgcttgtttacccatttagatgggaacgcccgacgcaactttgaggactgccctgttgagtgtgaacggcgacgagaacatggctctcgagaagctctgctctggctgaaggccctatgtggcctataagaagtgtaaattgcttgcccattcattacggaacaacgatcctagctaatgctcctgttatgccattccggtttggcctataggagcgatatatatatatatatagtggactgaaccatgggactgaactgaagagtgcctatcataactagacagattgtctaccttatcttctcattctcatggttcctcccctgtcaaccatgaccctgaattagtagcagggtcatgtcggatttcgccccatttgtgtctgattcaaagcgtctgtttggcaaataacctgatgaatccggacgtgatgggtcatatatcgggtagagttgtgatcttggctgttcctgtgtcctggaaagcctgtgtgtccggtgactgtgacacgagtttcttggttcagtgtgcactcttgacgcttctt

SEQ ID NO: 1360 - DNA, 898 bp, Triticum aestivum
  Clone ID: PAT_TA_1360
gattaaggaggaaattcattcattcattcattcaccatccaaacaaacaaacaaacaaacaaacaaacaaacaacgcgctacaatcgatgcggcagtaattaaaactaaaattaaaattaagcaagcagatcctcctgctgctgaccaccaatgctcggctccatgaaaatatacacatgaatgggatggggtgggggttgggttggtgtcagcaacaagaatcaggtctggataaataggacctactagttattagcaaggatgcattgcatccagctcgctccgccggcagccatggctatggctatgctacccctaggccaccgttcgcccgtagcagatcccggcgaggtagaggttcttggcccacttgtccttgacatgcgcgctggggaactgcgacgtccgcagggtctcctgcgtctcgtcccgaggccggcgcctcggcatgctcaggatcagggccgactggtccatggtcgccgccatcgccgtgatccggtacccgttgtcccaccgccggtggacgccctcgctcgggtacagaaagtccagctccaccacctggtcggtgaacccagcgttgcgtgacatgactatggcccatcggctgcctgatgtcgccatcgacgtcacgtagaagccttccttccacttcttgtttatccatttaaacgggaaggaatcgctcaccttgtaggactgctgcgtgtatggtgtgcctttggacatcactacaagagagcttccaatattcgcgccagcaacagaactgatgtagaaatttttctcccattgttccataatccagtccttgtgaaggaaatgtggagacagctcatagacttgatccgtgaagccagttccagcatccataatgattgcccaaagatcaac

SEQ ID NO: 1361 - DNA, 1209 bp, Triticum aestivum
  Clone ID: PAT_TA_1361
tgaggtacaagtgcttctcttcaaacgaaggatggtaacagttacacactcagcaaagtatctcatgcaccactttttccctcaagaggcaggcagttcgagacaagtcgcatcagaaaatgtttccacctagctggaaacaggagcgcaaactaaacacaatccgacatgattgatgatacaattataaagcatgaagagcgaaaaggctgaaactggaacgagacgcagcagctgttctcacacccaggcctcagcgtctggcagggcaccgctcactgcctgcctcgcggcttcgccctgctcgcctcctccggggtcgacgggaacagctccacgtacctcgtcccgatggtcatcttatccttgcacatggcagtcttggcaacctcggccgtcgggaactccacaaaggcttcgccagtggccctgccgtccccgcggtaagcgatgtgcacgttctcctccgtcagctcgtactccacaaagaacttgatgatgtcctcgatggtggcggagtaggggagcccgcgcagcttcagcacctcagtgtactccatgctgctcttgtcttcagacagcctcctggaccgcagaggaggcgacgagtgccggtgctcttggctcaaggagaggaccgccctggttcacctcggcggctatcgcgctgtagtaatcctgcttcttgcatcttgaaaacctccacatacctcctgcccatgttctgcctgttgcggtgcagcgcaaactctgcttgcatggatgaagggaagacaacaaaggcctcgccagagaagcgcccattcttgtggaccaggaggcagtccactatgtccagcccagcaaaaaacttgctgatgtcaacatcctcgcagtcaaaagggagccctcgcagacggaccgctggaaagttttggatgccactgttaacccctgcagcaccagccatgttgccgccataggttgggtagaagccgctgccgctgccaccagcgctgcttcccatgcctgcaaaatatggggggcctggctccatcatcctggcccgctttgagacgtccaacgggctccctgcgttcaccgcggtgcccgtacatggcggcggcggcggcggcggccggcgcttcgcgggggaggtggggaggagaactggccggcgggggagacgggcggcgcggcggcggcggaaaccctaatcgcgagcggacg

SEQ ID NO: 1362 - DNA, 2093 bp, Triticum aestivum
  Clone ID: PAT_TA_1362
cgtccgattcactacatgggctatacgcctggccttcttattgtaggactgtttggaataatgattatgtggatgtatggctacttttggattaccggcatgcttctggttgctggaggttgtatgtgttctttgaaacatgcacgatttgtcatacctgtcttggctatgtatgctgtttattgtgtggctgttcgtgtcgggtggcttggagttttcttcacgctgaatctctcttttctgacaaatgatcttctgaacaagctgctgcaaggatatgagggaagcacggaagagagaccatttgaagaaatgaaggattctgatccagccacggatgccttctttcgtggctgtgaatatccccctgctcctgaaagtgaaccagagaccgtgtcgtctgcaaagcccttttgcgcagcacctacccaagacgtgttacatgtacagaaggagccatctcctagtcaaatagtgaattcaaatgctccgtcgtgggtcggggggaagtggatattcggcggcgcggccgattgtgatgttttgggcatccctcggagcaaaagcatcaatcagatcgaattgaaaaaggaatacagaaaactggtaatagacaacaacactttaagctgaacgatcatccatatttctgttccttattgtcctggtgcattttgtctgtctaggcagttcttgtccatcctgataaaaacatggggaatccattggcgtgcgagtcattcaagaagcttcagtcagcttttgaggtactctcagatttaacgaagagaaatggctatgatgaacagctgaggaaagaagaatcgcggcaaatgactcagagatcacgtgttgtctctcaaccgagtggggtagagtttctctctgaggagtccaggcgtcccacgcgtccgcccacgcgtccgtttcatttatggatatgtaccaagagaagcaaagcaaaagcaagatggtgccaggattgttcccaataccatgttgccaaggacggagatgggtgggtggaaaatagatattctgcatccttgaagatagaaataccaagagcttttgtctgtgcggagagtaaaatatttgatgtatctgagtgggctacttgccagggaatggagtgcaaaccaaacactcatggtccaacttttatggtgaacatggttggtgcggataggatgcctcagcgatctcacagttctcggtatccctttagcctggacgccgagatgatccctgaagacgaatttgagctgtggcttcagcaggcattggcgacgggcgtcttctctgacagcccgaaacgaaggaaaagctggagccccttcaaactgcctcagaaagggatcagaagttggcggcgatcgtcatgagggtgtgacgttaaatagcatggctacatggggcctcagatggtagcaacattgggaaaaaggcaataatacaagggtttgtatttgtaaatagactgaccaaaaaaatttgcctggatgagcaactaattttgtccgaaaagagaaacaacaagtaaaaggaactcttaaatgaaaagacacagtgaacctgactgttgaaattagttctctctgctgggttcccacaagttgtttcaaagaaaagaccaggcatggggtcgaaacacgagtagctgttcggcgtgcgaactccatcagtgcagggatcgacgacgaaaagagtgctgacctgggttacaggagcaaattctgcgggtgttgcgctgctctttccgaagcatcgctgaagggaagatgctctgttcatggaagcagcaagttctgtgaagctcattctggagaagagaagggggaaaaggaagaaacctgaaaagagatggtagaaactggctgctgtgtaaccatgggaaaccctgcatgagaaatgcactcgctcactgctctgtaacattataccctgatactactaacatcctgtggaaaaaactaccataatccaggtttgtcctgtgacacgccatgtgccgcgctctgtaacattttcgagcgggtaaatagtgatcttgtcctggattgtcccctaaaaaaaaaaaaaaaaaaaaaaaa

SEQ ID NO: 1363 - DNA, 800 bp, Triticum aestivum
  Clone ID: PAT_TA_1363
aaaaaggaatccactggcaactcagcattcataactcggataaaaactcggtgggagaaactaaaagtttccaactgcagcaaatacagaaggcctaggagagggagcaaaacagagccgtcatagaaaaccatgaccacgtagcagttcgggtcaagtaatgcttcgctattggcggggcgagtctataagatcaggcttttgtctcctgggctacctcctcaaaggtctctccgggaacgagctccggaacatcgtcgtcgttctcctccttgggctggatggcgcccgcagcagccacctgcttctgcatctcctcagcaatcctctgcaggtgctccatgttgtcagggcccaattggttaatgatcgaaggaagaacattttgtagctttttggtttggggagtcccactgaccacccatgtgtttgcgccgatgaaggcttgcactttggggttgaggaactggatgacgaggtcgtccttgaagatgttgacctcctcgatggccgggatggtgttgacgcccaccctcttgagcgtgctctgcagccgcttgtcgtccgtggtcgccgtcttgtgcaccgccttcttcttccggcgcacggtgcccttgccgccggtgcggacggcgccggccatcttcatgagcctctccttgttcatcttgccggagcgggtgggtcgcggcgtcggcgccggcgggcggtggggcttgagcgggcggcgggggtgggggggaaggagcggccccacgcgtccgcccacgcgtccgcccacgcgtccgcccacgcgtccg

SEQ ID NO: 1364 - DNA, 1001 bp, Triticum aestivum
  Clone ID: PAT_TA_1364
gaccagggcgggcgaaactttaggtctccagctgcagcaaatacacaaagcctgggagacggtcctcatcagaaagcagctaaaaagtaatccactggcaactcagcatttataactcggttaaaaactcggtgggagaaagtaaaaagatcctaactgtttccaaattacaagaaggccaaaggagagagagcaaaacagagccgtacataggacaaacataaccacgtagccgttgacggggagcaagaaatgctgcctcgctattggcggggcggaatctatgaaatgatcaggcattttgtctccgggctacctcctcctgattttatcagctccggcgttagcgagcctcgtgcaatcactgaatcgtcgctccgggaacgaggggctcggaacgccgtcgtcagcatctccttgcctttggcttcgcatggcgcccgtcagcaggcacctcattttttgaagctcctcagggaaaatcttctacagggtgctctcttgttggtccagggcccaattgggtggatgagcgcaaggaagaacatcttgtagcttcttggtctgggtgagtcccgagtgaccacccatgtgtttgcggcgatggacgcttgcactttggggttgaggaactggatgacgaggtcgtccttgaagatgttgacctcctcgatggcggggatggtgttgacgcccaccctcttgagcgtgctctgcagccgcttgtcgtccgtggtcgccgtcttgtgcaccgccttcttcttccggcgcacggtgcccttgccgccggtgcggacggcgccggccatcttcatgagcctctcccttgttcatcttgccggagggggtaggtcgcggcgtcggcgccggcgggcggtggggcttgggcgagcagcggggagggaaggggggaggagcggctggggcggcggcgggggggactcccgtaggttttgtgggtggatataggtttcccccgaccggccggctcgagcgccgca

SEQ ID NO: 1365 - DNA, 917 bp, Triticum aestivum
  unsure (1)..(917): unsure at all n locations
  Clone ID: PAT_TA_1365
gctcgcccccacgcgtccgcccacgcgtccgcgcaaagcgaggcaatccatccctccctcctctccggcggccgcgcgagagagagcgatctccggccacgagaggcgggcgggaccacgagagcctccgccgcccaccaaagccgcggagaaccgcaccggacgccttgtatctccgcccatcttctcaaaggtcttgaaacatggtggccatgtcaacgcttgccgctggatcgttgccgggaactgtggtccccaatggtcttctaacaaggaggtttcaaggctcacaatttcagacaactcaagttaaccacatctcatttgaacgggaagtttctactaaagcaacactgaggagtgtaaaatgcagtgctcaaacccaaagtgttcagcgcaaatcttcaaccgcgactgtcaaacgatctgaccccaaaggaaaggttcaaggacctaagttggacgatggaagcggtgggttccctccgttccgtttcggcaaaggaggcggcggaggtggaggcggtgggggtggtaacagctactttggcgggttcctcctcttcactatcgtgctgctcctggactacctcaaggagtttgagaagtacctgctcgctcgaaagcatcgtgccggagacgacgatgacgcgggctacgacacgagcggtgggatgctaggacaatcaccatgatgagtcttgttagcagtagtcgtctctagctactagaagtgcatcagtcagttaactggctttggttatgttacatatccttatcttggaaaattcatgcctatgcagagctcaaaatatttataggattgtgtggtgagatgcttaaacttgatgccatnctggctgttgtgccgaagtatgaagaaattccatctatgtacaacaaaggttttgctacta

SEQ ID NO: 1366 - DNA, 802 bp, Triticum aestivum
  unsure (1)..(802): unsure at all n locations
  Clone ID: PAT_TA_1366
gaccccgggagcgcgctggacctcctcaggccgctcgcgctcgcggcgctgtgcgtcgtactgctcgccgccgtcgccggcgccgcggcgacggccacggatgtggaggcccagtcctcctacatcgtgcacgtcgcggaagcgcacgcgccacggctgccacgccgcggcctgctgacaacccgcgggtacggctcgttcctgcgggaccgcatccccgtcgagatgtccagcccggcgccgagcgtgctctactcctacgagcacgccgccacgggcttcgcggcgcggctcacggagcgccaggccgcgcagctggcgtcgtcgggctcggtgcacgccgtcgtgcccgacacgatgcaggagctgcacaccaccctcactccgtccttcctcggcctctcgccgtcctccgggctgctcaaggcgtccaacggggccacggacgtcgtcatcggggtcatcgacaccggcgtctacccggaaggccgcccgtccttcgccgccgacccgtcgctgccgcccccaccgagcaagttccgtggcaggtgcgtctcgggtccgtcgttcaacggctccgcgctctgcaataacaagctcgtcggcgccaagttcttccagcggnggcaggaggctctacgcggccgtgcgctcggcgcggacttcaagtcgccgctagacaccaacggccatggnacccacacctcctccaccgncggtggntcctgctgtcgcgggcgccggcttcttcgactatgccagaggaaaagccgtcggcatgggcccgggcgcgcgcatgcgc

SEQ ID NO: 1367 - DNA, 813 bp, Triticum aestivum
  Clone ID: PAT_TA_1367
cggcacgagccaaccttatccaccgcgcttcctctcttgtcttcctccctccccatttctatcttctcctctctcaaatccgacgactcccagcgattccatggcgaggtgatggcgttttgcaaggaggagtctgggggcatgacggagagacgcgagaggtggcgtggagctgggcggggacgtggcatgaagaggaggaactcggcggcatcggcgcctcagggagctcgatccgagctgccgcggagctccaggcggcacgccttccttcctgttgcggcggagctccagggagccacgtcgtgcaaccccgccgccgcgcaagctctatgtccctgcgcgcggtaccccgatggcgcctcctcctcgatctcaacgacggcatcggcgacgcacgaggtggagaggtggtggccgcacctcctcatcacaacagccgccgccatggctcctcgtgcgggtatctggccgccggcgccgtccaggataggagctcctccgcggggccgtggcgggcttcagggagaggggcgccgtccgagacaggagcggtggtggccactgtcgacgagttgctccacggcctccaccaacccatgcccgcaccctcctccccctgttacagctgagttcgtccctgtatctttttagttcgttttgtttcctcaccggtacgtactgaattcccagcagtgtttccactgaattccctagctgtgtcgatgattcatgtgtagaacgaaacagttcgaatttgcaagatcattttgattggcattcgactatacattttgggggtgtccatgaact

SEQ ID NO: 1368 - DNA, 648 bp, Triticum aestivum
  Clone ID: PAT_TA_1368
cgcctccctccctcctatccccaccgcccgcctccctccttcatatctctccctctaccccaagctcgggccttgctagctagctatccgccgtagagagagaggagaaggaaggaggcccgggcgctccggttggttccgtcggatctcgcctccaggtcacccgtctgctgggatctcgcccgccccatggccgtcgtcgcgccgacccccgccccgcccgccgcgccggcgcccgccgccgcggctgctgctccagccccggccctcgcccccgcccctgccgcggatcaagccacagatctgttgcagaagatgtcgctggaatcgcaagccaaaggcgggggaggatggaaccgagcttgccggtgccatcaagcaggggcctgtggccagccagccgctcagcgtgtcgatcccacaggaccggtccatcactccggtggttcaagattttacggatcccaacatgttctatctgccaacatattactatggagggttatgacgggaaccaatgaagcgagtggggattgaattatactcagaaattggtaaaatcaagaatgggaaggggaagggttacccccccaacaagtaatattgggagaaaaatttatggggatattgggcgtatggcttcccttg

SEQ ID NO: 1369 - DNA, 682 bp, Triticum aestivum
  Clone ID: PAT_TA_1369
aattcacctttcacaaaattccatctcaccagaacgtgataccatggatcacccatacagcttgctaccgacgattctacatgactaatattgcaaacgcacatctaccatccgtctcttctgacctattcctgttctgcaaacaacaggatttgaggtttaagaacacgcttgacacaaatatcttttacgttttcccagagccctgcaacctctttgttcgcagcatcatagaacatccaggacccattctccaaggtaaagcatgtgaaatgacttccctcactgtggcacagcattgaaaccaaaacatgatttgtattctggtgaagagcaccgtaaatgacactcaagtctatgctgctagatatggcacccaaagttaaacctatatcaccagccgcctcctcgtggcaccattctaggcaacaacaaatgcatgtggacagcgtcccaaacactctttcaaacaggttgtttcacaacaactgaggcatagcttcgatatttccatctccctttttagtaaaacatcgaaggaatcttctggatatttgcttttaatgcatctggtagaagcagctgtcaactgatgagtaaattgggtttgcctttcaactctagaactgcggccacattttcgacactcacaaagaacaaagttttcgatcactctcgtgcc

SEQ ID NO: 1370 - DNA, 600 bp, Triticum aestivum
  Clone ID: PAT_TA_1370
ggcacgaggcaagaagcacacaggaagctcctagccaacaccaatcaaagcctccatccaatcccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgtacgtcccttctgtttcctcatacatcatgcgcccgctataatatgactatatatgttgatcttgctatgggactaaggattgatggatgggtgcaggagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacct

SEQ ID NO: 1371 - DNA, 826 bp, Triticum aestivum
  unsure (1)..(826): unsure at all n locations
  Clone ID: PAT_TA_1371
aatgggaacaagaagcttgatgcttgcttatcaagaagctcaggcaaagggctctagcttgcctatattcttggttttctcggtgaatacaagtggacagtttgttggtgttgctgaaatgactggtcctgttgattttgaaaaaactctagagtactggcaacaagacaagtggaatggttcattctctgtcaagtggcacattgtcaaggatgttcccaacaacattctcaagcacatcgtccttgagaacaacgagggcaagccagtcacaaacagccgtgacacacaggatatcaaccttgagcaaggtatccagatgcttaagatattcaaagagcatgtcagcaagacctctattctggaagactttgccttctatgagaaccgncagaagttgatgccggagaagagaataaaacaacagcagatccaaaagcaggtgtgggacagcagggctccgaaccctgttgctggagagaaacaacaggaagtcgccaacgggaagccaagggtatctgtaccgaacggtgtcaatggagagaaacccgaggatgccctccatggggaaccacaatccgcctggggcgaatggtggtaccggggatcccaaagtttccgcaagaaaaaagccgtgccccccgttgtttctttccgccggttacctaccgggggaaaagggggcccaaaccagccacggcccgaaaaaaatacctgtgggcgaaccgcaaaaaaaccttgtgtgtccccaaccggggctgtcaaaaaaccgaggaaaattgtgttaattcgcttttcccccgcctcctccccntattcccgggcc

SEQ ID NO: 1372 - DNA, 1153 bp, Triticum aestivum
  unsure (1)..(1153): unsure at all n locations
  Clone ID: PAT_TA_1372
cagctcgaaattaaccctcactaaagggaacaaaagctggagctccaccgcggtggcggccgctctagaactagtggatcccccgggctgcaggaattcggcacgagcagagcggagcggataaactcgagttcgatcatcaccaaccatgtcgtgctgcggaggcaactgcgggtgcggatccggctgcaagtgcggcaacggctgcggagggtaaaccatcacctcctgatttctctgcgttcgatctctcccatcttcgcgccttctttctcaatcttttctttcgtttctcctcgatccatcttgtccgacgaggccatgcgtgtccatcgaccccctctgctcctcaagcacgagagggggatgatctgtttatcgccccctttgagatggggccatgcacgctgtctgtctgtttatcgatttctcagagagatatacaaggatcgatgatacttcttgtgattgatgatggtttctgacacggatcgatgtatgcatgcaggtgcaagatgtaccctgagatggacgagggggtgaacaccacctccgagaccctcatcatgggcgtcgccccctccaagggcaccccgtccttcgaggccgccgccgagaccggggccgagaacggagggtgcaagtgcggccccaactgcacctgcaacccgtgcacctgcaagtgatccatcaaatcgtggcaaggagacggcatggacggacctgatgaaggagcactagtagttggtatgcatggtgtgtgcgtgtgtgtttcctttttaattgccaccgagaataagacgaagatcgatcgtaccgtgctaagttaatggcttatgtgtgccccttgnggcctgtaccgtntggtgtggaaaggcgtcctcntgnggtggnganggcgcccttttcctactggtctaagttncccgtccctganggngcccttccttcggcntaatcttanaaattagaaatctccaaantttttcngggcctaatggnaatttnggaannctgggaatnaacttcttattggggnnggtggccccancttctttgggatnaaaaaaannanntaannanaaaaccttcngnnnaaggacttttttaaaanccggncccgnggggcccccattcgaattttttcnncccg

SEQ ID NO: 1373 - DNA, 622 bp, Triticum aestivum
  unsure (1)..(622): unsure at all n locations
  Clone ID: PAT_TA_1373
gcaagatcagatcagagaacagagcggagcggataaactcgagttcgatcatcaccaaccatgtcgtgctgcggaggcaactgcgggtgcggatccggctgcgagtgcggcaacggctgcggagggtgcaagatgtaccctgagatggacgacggagtgaacaccgcctcccagaccctcatcatgggcgttgccccctccaagggcaccccgtcgctcgaggccgacgacgagaacggagggtgcaagtgcggccccaactgcacctgcaacccgtgcacctgcaagtgatccatgagggctcaatcaaatcagatcaaggagatggcatggatggacctgatgaaggagcgagtcgtagttatgcatgaatcgcaagcgtgtgtttcgctttaaattgccacccagaataagacgagatctatcgtatcgcatcgagctagctaatggattatccgtgccccttgaggcttgtaccgtgtgctgtgtaaggcgtcttgtgctgtgatgcgccttttcctacctgttctagttccgtcctgatgtgtaaacgataataatttggagtttctgcctntaaaattccncgttaaatttttgtaaatcaacttctttttttacc

SEQ ID NO: 1374 - DNA, 761 bp, Triticum aestivum
  Clone ID: PAT_TA_1374
gccggccggtccgggatcaactccacagtctcaacgctacaacactcaagaacacttacctctctcatcaacaactttataaacaaccgccatcatgcgtttctccgtcgccgccgcttccgccgctctcctcgccctcgctgaggcccgcatcaccggtatccaggtccccaaggagatcaaggctggtgaggctttcgaggccatcgttgttcgtgagaactacatccagagcgtcttcgactcttccatcgtcttcggctactctgccaacccttaccccggcaccatcggccaggtcctcgactctactcctctcggaaaggccgagtccaacaagattgacaacctcaaggtcaagctgaccatccccgagtccacccagaagggcaagggtgtcgtctctgctgctctcctcagcgtctacggtgcttctggaagccctactctcagcgagtacaacgtcactgtcaccatcggtgacaagaccagcaccgagtacggttccagcagctaaatttccggctggtcttagactttgattgcacaactcacgagcctcatgtcattaaaccttgaacgtagtgttggaaatggagcccgaaaatggagattccatggacacggcctccctgcaatcaccaccagatttgcatatttcgagtacatatctagttagcctgttacaacatagacttgatcttttatgagcaattgacaatagcttttacaccaaaaaaaaaaaaaaaaaaggcccccta

SEQ ID NO: 1375 - DNA, 644 bp, Triticum aestivum
  Clone ID: PAT_TA_1375
tttgttcgtctcttgattgagatcgttcttgatggagcgcaagaactcgttcggctcgtcgtgggcggaccagtgggactacggcagcgacccggccccgcgggccggcggcaagaagcagggcggcgtcggcggcggcgtggagaagaccaaggcggccgcggccacggggctgaagaaggtgaaggagggcaccgcgcacggcttccagtggatcaagggcaaggtccagaagaagaagcagggcgccaccgccgccggcgacgacgtggccgccgggtattaggcagccaggcccggctgatccctggaggatggaacgccgatcgatcgattggccgatctgttggtttcttgcgtccttcaattggttgtgtacatatagttttaacgtctgattcagggttggcaccgccatgtagaccatcgatcgttttagatctctacttattgattgattctttcttcaaaaaaaaaaaaaaaaaaaaaaaaaaaaaaaaaaaaaaaaaaaaaaaaaaaaaaaaaaaaaaaaaataaataaaaaaaaaaaaaaaaaaaaaaaaaaaaaaaaaaaaaaaaaaaaaaacaataaaaaaaaaaaaaaaaaaaaaaaaaatgggccccccaaaaggttccaggcctaa

SEQ ID NO: 1376 - DNA, 990 bp, Triticum aestivum
  Clone ID: PAT_TA_1376
agaattcggttgatatcaggtgcggcaattcagtttgaagagcattcctcactctcttcctatgcgcttcaaagcagcaagccgccctcttatgtcctgctgcagaagctccaaccattgagatgcaacactggcagcctttactgatagcacagtcatgtaatcatgttgagattcatgatctaatgtactacatgtcctgtccgaagccatagtgactgttgatgagagttgcaatttcagattgtcgccatcctctgcaaggaatcttgatgcagtaggcagaccatgttgaaacattgcattattaccttccatcatgaagtggcacttcatcaaactatccccatacttctggtcctgaattctctctataacttctttacctctttcacctgtttggccagcaagaccaggctggcttgcgttctcaagctcctcagagcgtaccattgcctttattatggagtatacttgcttgctatttcttacatgatttatgattcctggattcagcccagataataggccactaggagcagcaacctttgtgaacttagtctgttcattctgggtagaagtgctcctcttgagctcatcatcccttttccgcttgggcggtcgaccacgtggcttaggtaccactgcagttccatgggttgaagaaaggaacccattctgcttcatttctctccactttctatgtgactcactttctcctgtagcaccagttgtactaccacattctgatggatcactaactttggactgacccagcttcttgtaaggaaagaacggatttacctctgccacatcagaagaacccactctattaagatccaacccaaggggtgcatcactcatcctattttcactgtgttttgcatcagccttaagttgcaactctgcccggatgttctctttgccacgtgccaaaggattggcatcatgcaaactttcagccaaaactgcatccgaagcacggcccct

SEQ ID NO: 1377 - DNA, 652 bp, Triticum aestivum
  Clone ID: PAT_TA_1377
gtttttttatgagaatattaaatgtattattaacatgattaatattgaactcttaaagttaatgtggccccgttgcaacgcacgggcgttcttctagtattactaagatgacagtacataagtatttcaggtgcatggtagagagcagtcaggatacagggtaaatatgctagctgcttgtatagattactcatggttcgataacaggatcatgagtaggttgctttccatgtgcaggtgttctttcgatgccctcccactccgcagattgagcattttgattctttccttttcttttgaggagtgtcccctcttagcggacacgttgtgctcttgtgaatagggccacgacatatagtgcagaaccgtgttcgtttgcttgtactgcatccaatacctgtatcaacttgtgatgtgaccttaatttttttgctctttgcagactggtcatcatatggaggcttgtctctgctgtttgttggttgaccggccttgcgtttctgttctggagctgataatccaatgaaatttttgacggcgctaccttcatcatcgctcatgtatccatgttgtgctccttggaagagagtcagttatgtaccttttgtcttcttcatttcaatcttgtgttgcaaacccaaaccatcatgct

SEQ ID NO: 1378 - DNA, 489 bp, Triticum aestivum
  unsure (1)..(489): unsure at all n locations
  Clone ID: PAT_TA_1378
cacagaagaagctcctagccaacaccaatcaaagcttccatccaatcccaagcaacctcgacgatgtcttgctgcggaggaaactgcggctgcggtagcgcctgcaagtgcggcaacggctgcggcggctgcaacatgtacccggaggccgaaggccgccggcgccaccctcctccgtctccgctaccgccacccacaaaggcgagtcccggcggcatggagatggcggcgggagaacggcggctgccgctgcacccaatgcaagtggcggaccaactgccggtgtcctgctgcaattgctaaattcaacatccgncatgcatcaacgcgttgnacanactttgattgatcaatcatctacttacaagttagctacctgatncangcctttgagttgtttnncaacctgcctgaataanaancaagtgcaatgcaagcatgttaaccccnaataanccccctnggttaaccnaaaaaagcttttgtttt

SEQ ID NO: 1379 - DNA, 555 bp, Triticum aestivum
  Clone ID: PAT_TA_1379
ttcggcacgaggtgttcgtctcttgattgagatcgttcttgatggagcgcaagaactcgtttggctcgtcgtgggcggaccagtgggactacggcagcgacccggccccgcgggccggcggcaagaagcagggcggcgtggagaagaccaaggcggccgcggccacggggctgaagaaggtgaaggagggcaccgcgcacggcttccagtggatcaagggcaaggtgcagaagaagaagcagggcggcgccgccggcgacgacgcgactgccgggtattgattagccaggccccgttcccggcgggcggatggaaatggatgcatggatgtccggtcgattgactgggcgatctcttgtttcctgtcgtttaaatggttctgtacatacaggtttgccgtttgattcagggttgacaccaccacgtagatcatctagcgttcagatctctgcttattgattggttctttgttcttcctcttgtcctgttctcgattgatccgatgaaatttgccgctgattggttcgttcaaaaaaaaaaaaaaaaaaaaaaaac

SEQ ID NO: 1380 - DNA, 632 bp, Triticum aestivum
  unsure (1)..(632): unsure at all n locations
  Clone ID: PAT_TA_1380
aaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgattcatccatccatctagtaccatgtaacgctacctgatcgagggtccttgtatgtatgttaagcacctgccaacatgagcagagcaagtgcatcccatgcatgtaaaccgacccctaaataaatctcccgtgggttaacctataaaaaaacactatcaatacaattncaaattcaagaatgacggtatacaatctggaaggtatctgaactcactgttaaccaggagaaattccaattgacttttcggggtcctnaaccaactatncntcnaacaaggacttntaaca

SEQ ID NO: 1381 - DNA, 676 bp, Triticum aestivum
  Clone ID: PAT_TA_1381
gccggccgggttccggaaagcagagcaagtgcagatcggatcagaccagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtagttatgcatggtgtgtgcgtttgtgttctctttttaattgccgccgagaataagacgagatctatcgtatcgtatcgtatcgtatcgagctagttcatggccccttgtggcttgtaccgtgtggtgtgcaaggcgcgcgtacgtcctgtgtctgtgacgcgccttttcctactgttctaagctccgtcccgtgccttcccgttttatctacatatatgtagacaacaaaaaaaaaaaaaaaggaaaaaaaaaaaaaaaaaaggccccta

SEQ ID NO: 1382 - DNA, 1074 bp, Triticum aestivum
  Clone ID: PAT_TA_1382
cccgcgtccggcccgggctgttcgtgctggagacggtggaggaagaggaggaaagggaggccgaggctgccgccgaggcggaaaacgagcggtcctccattggccccgtctccgagggggacgaggaggaaggggaggaggtggagagcgccagggagacgccgtggcagaggaggaccaagaagaccggcgggctcgcgagcctggacgccctcgacgacgccctccccatcaagcgggggctgtcgagcttcttctccggcaagtcgcggtcgttcgcgaacctgcaggacgtggccggggccggcaccaccagcagcaaggacgtgctggccaagccggagaaccccttcaacaagcgccgccggatcctgcggtgctgctccatccggcgggtctcctccacctcgctcaccgcgctgccgcccttcctgccgcccgagccgtccttcaacatcggcaacgacggcgtcatcaacggcggcggtggcggctccggcggcagtggctgatcatcaactgatccagggacgccgtacgtgcaccgatcaaattgatccaaaagagaaaagacatgcatatgcatgcaagttgcaagggaattagtaatggaaacaaactactagggaggagacaagatggatggatggatggatggatcctactttgtagtactccggggatctcactcatctcagctcacatcaccaatggccgcatagagcttaggtttttcttaattcttttactagctgctagtagttgcattgacatgcaaagagagggagagggagcaccgaacatggtgcatgtgatatccatcctagcctacaagttatgccagtgttctatctcattggagagaagaagcccgattaaccttttcaatgctagtatagcgccaaggtatgcatgcagatcaagcaagtaagagccccgattgatcatcgacatgtgtgttctaagtcgatctctaggatgtttcttagcagtgcattgcacatatgtaatataatacaaactaataattgagagtactaacagttgccgagcaccaaaaaaaaaaaaaaaaaa

SEQ ID NO: 1383 - DNA, 1100 bp, Triticum aestivum
  Clone ID: PAT_TA_1383
ttcggcacgagggcttgatgctgcttatcaagaagctcagtcaaagggctctgcatgccctatattcttgtttttctcagtgaatacaagtggtcagtttgttggtgttgctgaaatgactggtgctgttgattttgagaaaactctggagtattggcagcaggacaagtggaatggttccttctctgttaagtggcatattgtcaagtacgtgcctaacaatattctcaagcacatcatcctagagaacaatgagaacaagcctgtcacgaatagccgtgacacccaggagatacaccttgaacaaggccttcagatgctcaagatcttcaaggatcatgtcagcaagacatccatcctggatgactttaccttctatgagagccgccagaaattgatgcaggataagaggtcgaaacagcagcaggtccaaaagcaggtctgggacagtaggacccccatttctgtcaccagcgagcaacagcaggaagctgctaatgggaagcccaatccgtctgatgtaccaaatggtgtcactgcagaggtgaaggcggtgaaggctcctgcagagaaacccgtcctcgccaatggagtcaccaacggagtaaccaccactcccgctgtttcctatgcagctaaggtggcccaaacagcaacagggaaacccatcctcgccaatggagtcgccaagaccggttagctcgaccgccaccaatgcttccatagctagccgcaagcgaggttggatgtcctgacaactcgactgaggcgcaagggaaaatggtgtgaccaaccaaggcaggctgtggaactggcagcatggcccgaagagcgttgctgctccatctcatcgctactggagagcagttggctagttagcgtttttcctagtttctcttttcgctgtgttctccgtttgaagactcttttctacggtagtatcagaatgccagagacccgtggctggacaaaaggatttttgcgaaggccgtctggttggttgtgtgttgcgtcgtcggggtcgagtataccctgttctgttcgtcgttatattgagtggatctgaatgaaagtgggttagattggagctttaaaaaaaa

SEQ ID NO: 1384 - DNA, 583 bp, Triticum aestivum
  Clone ID: PAT_TA_1384
ccgcccgaatcggggactagctttcactagcaggaacggaggagggggaggatctcacccacacagagctcttgccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatgtatgtacgcacctgcctgcatgagcagagcgggtgccatgccatgcatgtaaacccctaaataaaatctcccgtggtttaaccccctaaaaaaagggggggcccggtacccaattcgccctatagtgagtcgta

SEQ ID NO: 1385 - DNA, 474 bp, Triticum aestivum
  Clone ID: PAT_TA_1385
cgacaacggctccggtctcggcggcggcctcgaacgacggggtgcccttggagggggcgacgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtagttatgcatggtgtgtgcgtttgtgttctctttttaattgccgccgagaataagacgagatctatcgtatcgtatcgtatcgtatcgagctagttcatggccccttgtggcttgtaccgtgtggtgtgcaaggcgcgcgtacgtcctgtgtctgtgacgcgccttttcctactgttctaagctccgtcccgtgccttcccgttttatctacatatatgtagacaacaataatttggagtttctctctatgtatgcatgtgtatctgtatcaaa

SEQ ID NO: 1386 - DNA, 1298 bp, Triticum aestivum
  Clone ID: PAT_TA_1386
caacggcaattgatagaatggtagaaggatcatatagatctaccaacattattgaactatagttccagatgaatataacaacactctccagccaaaattatgatacgaacaatctgcggggtagaaaggaaaaatgaaactgatacagattaccggttcaagaaattaggaaaattgctaacacaacacatggatgagataagtaaatagatgctcttcttgacaagctaataagcaaacgatggttcaccgggccggaagctccggtagatggaggctatcactgggacaagacccagcagcgcgatctggacctgctccgatgtgcttgtcctgacggtgatctgtccgctcagcttgttgttgagcccaaggcgaacagccatctttgaaccccttccaatcgagaactgggactgcagattagcccccagggcaaggtcacggcgccacttcatgagggacaggcccaaggttgacaaggactgaccaattggataatctttgtcttttaagcgcgcttccaggttggctccataggcggtatccccttgagctcgcattgcgccctgtgcttgccactaacgccagcctcttgccaacagagagctggtcctcgaccttcagcccagttgccacaatgtcacccaagaaagtcacagagaatcctccagtggtcttgttcttcttgatactcttgaatttggtctcaccacgaagaatataagcaagctgccgcccaacagtctggatgtcaaaaccagcaagggaagacgcatcctccccatgctttgctgagatggaagaatccaaatggatgctaaattccttcttgtccttggtgacctgaactgctacatttgctgggaacctgctaaggatagctagtgtctcttcaacgctcactccatcataaccacagtcatgatcccatccatgcgcatctaaaacaggtcttgctaggacagtcgaagttggctctagaaagcggtaccggtatgtgggattgtcacaatcaaatgaaggaggcagtaccatgtcaggtaagggaactgacacattctctggaggaggatcctgatcgtcctcaccagtgatattagcatacccataatcatccagatcagttttcccctcttcttcatctcctttaacctgcggatctcatccttccatgtttcttctggagaagcttaaccctgtagtcatactcatcaaaataagcattcttctgctcctttgtgagccttgcaagctgagctttggtcaagggcttgaagggtggaagctgatcaatt

SEQ ID NO: 1387 - DNA, 579 bp, Triticum aestivum
  Clone ID: PAT_TA_1387
gcacacaggcaagctcctagccaacaccaatcaaggcctccatccaatcccaagcaacctcgaatatgtcttgctgcggaggaaactgcggatgcggcaccgcctgcaagtgcggcaacggctgcggtggctgcaacatgtaccccgaggttgaggccgccggcgccaccctcctcgtctccgccactgccactcacaaggggagctccggcggcatggagatggcggccgagaacggcggctgcggctgcacccagtgcaagtgcggcaccagctgcggctgctcctgctgcagctgctagatcattgatcatgcatgcgccgcgtgcatcatatctatgatctacgtatccatctactaccatgtaatgccacctgatcgagggtctttgtatgtatgtagtatgtacgcacctgcctgcatgagcagagcgggtgccattccatgcatgtaaacccctaaataaaatctcccgtggttttgcttaaaaaaaaaaaaaaaaaaaaaaaaaaaaaaaaaaaaaaaaaaaaaaaaaaaaaaaaaaaaaaaaggaaaaaaaaaaaaaaaaagggccccta

SEQ ID NO: 1388 - DNA, 748 bp, Triticum aestivum
  Clone ID: PAT_TA_1388
ccttctatagctatttcaatatcttttttttaagtaatgagcctatcctctatcttcttttttatgtttatatttcaatataccgaaacctatataagactagataaatattaagaggactcttccgcctagataaaaatatatcatggtcagcaaagttgtttctttatttttatttgccctctagttaataatttcaatttcattaagaaaaactaactaaataaatggaaaatgaaaattaatagaattcttttttattttttttttcttcaaatccaaaaaatttctcttttttatacataggtcgtcgattcggcattggttaaaaaagggcagggtgcccccttttttttttttttctagtaaatagttcaaaccattttatcgatatgagtgttctatatcagataaattttacattagctatttcccgtttaaattcggtactaatactaatatagttgtagaaagagtacctctttttgcctggacttcaagcagtttagctttaaccgtgttaatggtctcacattcttggtttatagagaatcaaagttgatttaccaatgagtcgcgaaatgctatggttcttccatatgatttctgaatttattcagaagtaattcgtcgagatcgtgcacccttttcttatttatccgaaaaatactaaaaaatattataaagtgcagccggatagatccaatctattcttgaaatagaccggacgcgtgggcggacgcgtggg

SEQ ID NO: 1389 - DNA, 1840 bp, Triticum aestivum
  Clone ID: PAT_TA_1389
ggacagcaacaacggtgattgatagaatggtagaaggatcatatagatctaccaacattattgaactatagttccagatgaatataacaacactctccagccaaaattatgatacgaacaatctgcggggcagaaaggaaaaatgaaactgatacagattaccggttcaagaaattaggaaaattgctaacacaacacattgatgatttaagtaaatagatgctcttcttgacaagctaataagcaaacgatggttcaccgggccggaagctcctgtagatggaggctatcactgggactagacccagtagcgcgatctggacctgctccgatgtgcttgtcctgacggtgatctgtccgctcagcttgttgttgagcccaaggcgaacagccatctttgaaccccttccaatcgagaactgggactgaagattagcccccagggcaaggtcacggcgccacttcatgagggacaggcccaaggttgacaaggactgaccaattggataatctttgtcttttaagcgtgcttccaggttggctccataggctgtatccccttgagctcgcattgcgcctgtgcttgccactaacgccagcctcttaccaacagagagctggtcctcgaccttcagcccagttgctacaatgtcacccaagaaagtcacagagaatcctccagtggtcttgttcttcttgatgctcttgaatttggtctcaccacggagaatataagcaagctgccgcccaacagtctggatgtcaaaaccagcaagggaagacgcatcctccccatgctttgctgagatggaagaatccaaatggatgctaaattccttcttgtccttggtaacctgaactgccacagtacctgggaatttgttaaggagagcgagcgactcttcaacgcttactccatcatagccacagtcatgatcccacccatgcgcatctagaacaggccttgcaaggacagtagaggttggttccagaaaacggtaacggtatgtcggattgtcacaatcaaatgaaggaggcagcaccatgtcaggcaagggaactgaaacattttctggaggaggatcttgatcgttttcgcctgcgatactagcatacccataagcatccatatcagacttgcctctcttcttcatctcctttaacctgcggagctcatccttccactgtttcttctgcagaagcttgaccctgtaatcatactcgtcaaaataagcattcttctgctcttttgtgagccttgcaagctgcgctttggtcaaaggcttgaagggaggaagctgatcatattcctcttcatcttcatcttgttctatatcagaatactcatccaaatcaatatcagaatctccttcattaccaccctgatcaggtgagagtttcgggtgagctcttgactgcaacagggaggatagcaggaaaggaagtggcggggagcggaaacggaacccaaaaagcttcccaggagaaggatcctgaagcttcaaaagtgagttggcttctgataatatctttgatgagtagcacaagagcagcatctgatgcctccaactttggccatttggaagcactttctgaccctcacggttcttccggcaagaaggatggttctcaacaagggctactgggttcatcagacgcatatcccctgcagcctgcctgatggattgctggataatgtgggatcgctgtgccatcaatacctcatatgtcataggggcaccgttgaggccttcaggaggagcagaagcagcatgggtgagagcaacaatggcgttgaaccatatggaagaacccagaacagcccacgcgtccgcggacg

SEQ ID NO: 1390 - DNA, 1188 bp, Triticum aestivum
  Clone ID: PAT_TA_1390
tgcaggcaattcggcacgaggtgtttttctcggtgaatacaagtggacagtttgttggtgttgctgaaatgactggtcctgttgattttgaaaaaactctagagtactggcaacaagacaagtggaatggttcattctctgtcaagtggcacattgtcaaggatgttcccaacaacattctcaagcacatcgtccttgagaacaacgagggcaagccagtcacaaacagccgtgacacacaggatatcaaccttgagcaaggtatccagatgcttaagatattcaaagagcatgtcagcaagacctctattctggaagactttgccttctatgagaaccgccagaagttgatgcaggagaagagaataaaacaacagcagatccaaaagcaggtgtgggacagcagggctccgaaccctgttgctggagagaaacaacaggaagtcgccaacgggaagccaaaggtatctgtaccgaacggtgtcaatggagagaaacagcaggatgccgtcaatgggaagccaaagtcgcctgtggcgaatggtgttaacggggatgcgaaggttccggcagagaaagccgctgctcctccggccgttacctacgcggcgaaggtggcccaaacagcagcggccgagaagaagcctgtggcgaccgagaagaagcctgttgtcgccaacggtgctgtcaagaccggagtagctgcttgatcgcattacccgatcctcccagctagccatgaagaacaaacggacggtgctggcgaaccaggcgagacatgcgggttccaaggtactgatcatcaaaggtggcgtctggaaagcgggtcggatagttaggtttccctagctctctcctttttcttcttctgtcgtcgtcgtactatcatccctatttcagtttgcttagctctaaagactcctcctatagtggtatcatcggaatcgccagaagaagagaaaagagaagctgtggcaagacaaaggtagtgtcgccaggccgccatacccagtggcggtggcctggtgcggttgtgtcgcgtctgttttcggtcggtatttggtggtgtttcgagtaagtactatgtgtttgtgtcgagtgctgggtgagtggattataagtgggttctagattggagctgttttcgcgtcttattaagattatattacaacagaaatcttgctttgc

SEQ ID NO: 1391 - DNA, 568 bp, Triticum aestivum
  Clone ID: PAT_TA_1391
ccacgcgtccgaaagagtccaacaccaatcaaggcctccatccaatcccaagcaacctcgaagatgtcttgctgcggaggaagctgcggctgcggcagcgcctgcaagtgcggcaacggctgcggcggctgcaacatgtacccggaggctgaagccgccggcgccaccctcctcgtctccgccaccgccacccacaaggcgagctccagcgggatggagatggcggcggagaacggcggctgcggctgcacccagtgcaagtgcggcaccagctgcggctgctcctgctgcagctgctagatcatcgatcatcgatcatcgaccatgcatgcacctgccgcgcgcgtgcatcatatctatgatcgatcggtccatctactaccatgtgtaacgccacctggtcgagggtctttgtatgtatgtaagcacctgccagcatgagcagagcaggtgcactcccatgcatgtaaaccgacccctaaataaaatctcccgtggtttaacctatacatgtgtttgtgttatagaccagcttctggcccgtgtttactatcaacttgcgacgtgc

SEQ ID NO: 1392 - DNA, 741 bp, Triticum aestivum
  Clone ID: PAT_TA_1392
gtgcagatcagatcagattaaggcagagacacagagcaagagcggataaactcgagggagattcgatcatcaccacaccaaccatgtcgtgctgcggaggcaactgcgggtgcggatccggctgcaagtgcggcaacggctgcggagggtgcaagatgtaccctgagatggacgagggggtgaacaccacctccgagaccctcatcatgggcgtcgccccctccaagggcaccccgtccttcgagggccgccgccgagaccggggcccgagaacggagggtgcaagtgcggccccaactgcacctgcaaccccgtgcaccctgcaagtgatccatcaaatccgtggcaagggagacggcatggacggaccctgatgaaaggagcactaagtagttgttatgcatggtgtgttgcgtgtgttgtttcctttttaattgccaaccgaagaataagacgaagatcgatcgtacccgtgctagttaaatggcttatggtgtgccccttgtgggcctgtaccgtgttggtgtgtaaggcgtcgtcttgtgttgtgatgcgccttttcctactgttctagttcccgtcctgatgtgccttcctcgtcttatctagaattagaatctcaaattttctgtctatgtatttgtatctgtatcactctatgtgtggtgccagctcttgatattttctgtttgttcttctgtacgagggcaaattagagtcacaaaaaaactttcccctttt

SEQ ID NO: 1393 - DNA, 611 bp, Triticum aestivum
  unsure (1)..(611): unsure at all n locations
  Clone ID: PAT_TA_1393
ggcagcaagcacagaaagaagctcctagccaacaccaatcaaagcttccatccaatcccaagcaacctcgacgatgtcttgctgcggaggaaactgcggctgcggtagcgcctgcaagtgcggcaacggctgcggcggctgcaacatgtacccggaggccgaggccgccggcgccaccctcctcgtctccgctaccgccacccacaaggcgagctccggcggcatggagatggcggcggagaacggcggctgcggctgcacccagtgcaagtgcggcaccagctgcggctgctcctgctgcagttgctagatccatcatcggtcatgcatgcaccgcgtgcatcatatctttgatcgatccatccatctacttaccatgtaacgctacctgatcgagggtctttgtatgtatgtacgcacctgcctgcatgagcagagcaggtgccatgccatgcatgtaaacccctaaataaaatctcccgtggtttaacctatataaatgcgtttgtgttaaagaacaacttctgggccacgtttacaatcaacttgaaagggnctggggtgttaataaacaacnaatnaacttcagtgcanattcgnaaaaggcncat

SEQ ID NO: 1394 - DNA, 621 bp, Triticum aestivum
  Clone ID: PAT_TA_1394
ctcgtgccgaattcggcacgagcacacagaagctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacctatacttgtgtttgtactatcaacttgcgaggtgcctgggttgttactagaccagctgaatgctctcttgaagcaacgtatgccccgcttggaatcggtgtatgtttatacccct

SEQ ID NO: 1395 - DNA, 531 bp, Triticum aestivum
  Clone ID: PAT_TA_1395
cacacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctagatcgatcatcgaccatatgcatgcaccgtgccgtgcgtgcatcatcgatcatatcgatctactactaccataccatgtaaccgcaacctgatcgagggcctttatctatgcacctgacctgcatcagcagtcaggtgccatgccatgattgtaaacaggcccccctaaataaaatttcccctgattaactataaaaaaaaaaaaaaaaaactcgagactagttctctcgtgc

SEQ ID NO: 1396 - DNA, 533 bp, Triticum aestivum
  Clone ID: PAT_TA_1396
aaaagctagcaagcaagaagcacaaaagaagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcgagggtctttgtatgtatgtaagcacctgccagcatgagcagagcaggtgcactcccatgcatgtaaaccgacccctaaataaaatctcccgtggtttaaccaaaaaaaaaaaaaaaaggccccta

SEQ ID NO: 1397 - DNA, 1962 bp, Triticum aestivum
  Clone ID: PAT_TA_1397
agtttgattacgccagctcgaaattaaccctcactaaagggaacaaaagctggagctccaccgcggtggcggccgctctagaactagtggatcccccgggctgcaggaattcggcacgagccaacgactacaacagggtcagctactcctacatacccaaacaggatgtactcgagcacccagtcttacaaccagtatggaaattcggtcaaaactggtcttatgtatggaaacactggctatggaagcactggctatggaagcactggctacggaagcagcggctacggaagcaatggctacggaagcagcggctatggaagcagtggctacggaagcagcggctatgattccaggttatatggtcggtggggtgtttctatggataccagatacaacaggcccagaggccgtggcaacggatattatggttttggcaatgagagtcaggatggaacaattgagctcaacagaggtcctaggtctggtcgtttcaagaaccagaaagcatttggccatactgttactattgctgtgaaagggcagaccctcccttcaagtgaaaacaaggatgctagtgacatacctgataaggcacagttcaacctagaggatttccctgtccagtatgatgatgcaaagttttttgtcatcaaatcatacagcgaggatgatatccataagagtataaaatacaatgtgtgggcaagtaccaccaatggaaacaagaagcttgatgctgcttatcaagaagctcaggcaaagggctctagctgccctatattcttgtttttctcggtgaatacaagtggacagtttgttggtgttgctgaaatgactggtcctgttgattttgaaaaaactctagagtactggcaacaagacaagtggaatggttcattctctgtcaagtggcacattgtcaaggatgttcccaacaacattctcaagcacatcgtccttgagaacaacgagggcaagccagtcacaaacagccgtgacacacaggatatcaaccttgagcaaggtatccagatgcttaagatattcaaagagcatgtcagcaagacctctattctggaagactttgccttctatgagaaccgccagaagttgatgcaggagaagagaataaaacaacagcagatccaaaagcaggtgtgggacagcagggctccgaaccctgttgctggagagaaacaacaggaagtcgccaacgggaagccaaaggtatctgtaccgaacggtgtcaatggagagaaacagcaggatgccgtcaatgggaagccaaagtcgcctgtggcgaatggtgttaacggggatgcgaaggttccggcagagaaagccgctgccaccgctgctcctccggccgttacctacgcggcgaaggtggcccaaacagcagcggccgagaagaagcctgtggcgaccgagaagaagcctgttgtcgccaacggtgctgtcaagaccggagtagctgcttgatcgcattacccgatcctcccagctagccatgaagaacaaacggacggtgctggcgaaccaggcgagacatgcgggttccaaggtactgatcatcaaaggtggcgtctggaaagcgggtcggatagttaggtttccctagctctctcctttttcttcttctgtcgtcgtcgtactatcatccctatttcagtttgcttagctctaaagactcctcctatagtggtatcatcggaatcgccagaagaagagaaaagagaagctgtggcaagacaaaggtagtgtcgccaggccgccatacccagtggcggtggcctggtgcggttgtgtcgcgtctgttttcggtcggtatttggtggtgtttcgagtagtactatgtgtttgtgtcgagtgctgggtgagtggattataagtgggttctagattggagctgttttcgcgtcttattaagattatattacaacagaaaaaaaaaaaaaa

SEQ ID NO: 1398 - DNA, 586 bp, Triticum aestivum
  Clone ID: PAT_TA_1398
ctcgtgccgaattcggcacgagaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactatacatgtgtcgtctgtggtatgcataaaaaaaaaaaaaaaaaaaaaaaaaaaaaaaaaataaaaaccaacaaccacccc

SEQ ID NO: 1399 - DNA, 1449 bp, Triticum aestivum
  Clone ID: PAT_TA_1399
aaaaaaaggtcgccaatgtcgtaatattgaactcttaaagttaatgtggccccgttgcaacgcacgggcgttcttctaatggatgtagtagccggaaagtaatgtctcacgctcacgcacgcatcggagatgtgtagtcatgtgcacatcaccaaacccaacccgaacagcgacaagaaagcacccaccccatcatcaccaaccacaccagacaccactacaccgaccaactcctcacgcctaatcaagatctattccgttgtatggatggaccccgctcccactcactcagattcatgggggatcgaatcgagctgctcaccaaacgcaaccagccagagctacaaggacgggggccacccacgcgttggcccacccgtacgggactgctcctctcagcgccgccgcgcccgaggacgacttgccggtggggccgccggccgcaccggcgccgcccccgtcgatgggggagacgggcgcgttggcgtcgatggtggcggtgccgttgaggccggtggtgtagacgtcaagctcgatggtggcgtcggcgccactcgagctgttggtcttccacaccacgtaccccgtcgccatccggaacttccccgtgccgcccaccacggagagctcccgcgtggtggtcatgatgtcgtcgcggccgatgacggccagcgtgctgccgttgtagtcccccgtggtgagcagcaggttcacgcacatcatcagcaccatgcccgactgcgacgacatcatgtagaacccctgcgcgcgccccacgggcgccgacgtcggcgacgaggtctccgtcaacgcgtcgtcgatgacggtcgtgtcgccgaaggccacgcccgggaaggcgttggacgacgaggcagcaagaagcacacaagaagctcatagccaatcaaagcctctccatctccgaagctccaaccgaaccgaggatgtcttgctgcggaggaaactgcggctgcggcaccgcctgcaagtgcggcaacggctacggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactaaaaaaaaaaaaaaaaaaaaaaaaaaaaaaaaaaaaaaaaaaaaaactcgagactagttcacctcggccgcgaccacgct

SEQ ID NO: 1400 - DNA, 1241 bp, Triticum aestivum
  unsure (1)..(1241): unsure at all n locations
  Clone ID: PAT_TA_1400
aagagttttttttttttttttttatagctatttccatatcttttttttaagtaatgagcctatcctctatcttcttttttatgtttatatttcaatataccgaaacctatataagactagataaatattaagaggactcttccattccagggacccgagaatgccaatattagcacgaatcgtacggaaatgtaactcggtattcaaacaactattcagagttcctagagctccttgtacggcctgttggaaaacccgctgtcggacctgattcattgccctttgtttttcaaaataaagggtttcgtttttagacttttccaattgttccaaactaatagaagtagcattaatcaaatttgctttttctcgttctatctcagagtatccattcattcgatactcatccgcttctagttcgactttctgtaatcgaatccgagctttttcgagttgctcaatggtccctctacgcaattcttctgaatttcgaatagtactcaagatcctctgttttcgattatctaataaatcttttaatgaaagtagattattttgtaagtttacaacttttatgatctcttcccgaaccaaacatgaatctttcgattcatttggctctcacgctccttattttttttttttttctatagctatttccatatcttttttttaagtaatgagcctatcctctatcttcttttttatgtttatatttcaatataccgaaacctatataagactagataaatattaagaggactcttccgcctagataaaaatatatcatggtcagcaaagttgtttctttatttttatttgccctctttaataatttcaatttcattaagaaaaactaactaaataaatggaaaatgaaaattaatagaattcttttttttttttcttcaaatccaaaaaatttctcttttttatacataggtcgtccgattcggcattggttaaaaaaaggggcaggggtgcccccctttttttttctaagtaaataagttcaaaaccaattttatccgatatggagtgttcctatatcaagataaattttacattaagctatttcccggtttaaattcggtactaatactaatatagttgtagaaagagtacctctttttgcctggacttcaagcagtttagctttaaccgtgttaatggtccacattctgggttatagagaatcaaagttgatttacaatgatcgcgaaaagcanggtcctcanaga

SEQ ID NO: 1401 - DNA, 679 bp, Triticum aestivum
  Clone ID: PAT_TA_1401
ctcgtgccgaattcggcacgagtgcaagtgcagatcagatcagaccagaccagagacacagagcagagcggataaactcagagggagatcatcaccaaccgaccatgtcgtgctgcggaggcaactgcggatgcggatccggctgcaagtgcggcaacggctgcggagggtgcaagatgtaccctgagatggacgagggggtgaacaccacctcccagaccctcatcatgggcgtggcgccctccaagggcaccccgtcgttcgaggccgccgccgagaacggaggatgcaagtgcggccccaactgctcctgcaacccgtgcacctgcaagtgatccatcaaatcaagacaaggagacgccatggacggacctgatgaaggagcactagtggttatgcatggtgtgtgtttcgtttttaattgccaccgagaataagatgagatctatcgcatcgtatcgagccactagtagttcatggcgtatgtgtgccccttgtggcttgtaccgtgtgctgtgtaaggcgtcttgtgttgtgatgcgccttttcctatgttcgagatccgtcctggtgtgccttccccgtcttatctacatctacatgtatgtataagacaataataatttggagtttctgtctatgtatgtatgtatgtgtatgtgtggtgccaaaaaaaaaa

SEQ ID NO: 1402 - DNA, 3080 bp, Triticum aestivum
  Clone ID: PAT_TA_1402
cgcggatcaagccacagatctgttgcagaagatgtcgctggaatcgcagcctcagcccaaggcggcggcagatggaaccgagcttgccggtgccaccaaggggcctgtggccagccagccgctcagcgtgtcgatcccgcaggaccggtccatcacgccggtggttcaagattttacggatcccaacatgttctatctgccagcatattactatggaggttacgacggaaccatgagcgagtgggatgaatatactagatatgtaaatcaagatggagtggaggttaccccagcagtatatggagatatttatggatatgggtatgctccttatggcgcctactctccagctagttccccagtcccaacagttgatggtcagatgtttgctgcacaacattaccagtatccagcttattatcagcctcctaccccgatttcttctacaactcaaggtgaccagcagcattcagccaatgctgataataagccagcagctaaggcagatgctgccaaaacaaccacaaatgttgttcctaatggtactgctcagagtaacagcggaactgctccccttgggtcaagctaccagaattcatcactgacccctgatggaacctatagggcacccttgataggtggagtcccttctactggttacgtggactcaacctatgggtatgacaccacaggggcacactatgcttggtatgatggttctgcctataccaatgcacagcaaagaccaactacagctaattacacgccgtcttcagcgtataatagcaatggctcttctgcaaggtatcagaccaagagccccacaccgcagcagacgggcaacaggagaccaacgactacaacagggtcagctactcctacatacccaaacaggatgtactcgagcacccagtcttacaaccagtacggaaattcggtcaaaactggtcttatgtatggaaacactggctacggaagcactggctacggaagcactggctatggaagcagcggctatggcggcagtggctacggaagcaatggctatgattccaggttatatggtcggtggggtgtttctatggatagcagatacaacaggcccagaggccgtggcaacggatattatggttttggcaatgagagtcaggatggaacaattgagctcaacagaggtcctaggtctggtcgtttcaagaaccagaaagcatttggccatactgttactatcgctgtgaaagggcagaccctcccttcaagtgaaaacaagaatgctagtgacgtacctgataaggcacagttcaacctagaggatttccctgtccagtatgatgatgcaaagttttttgtcatcaaatcatacagcgaggatgatatccataagagtataaaatacaatgtgtgggcaagtaccaccaatggaaacaagaagcttgatgctgcctatcaagaagctcaggcaaagggctctagctgccctatattcttgtttttctcggttaatacaagtggacagtttgttggtgttgctgaaatgactggtcctgttgattttgaaaaaactctagagtactggcaacaagacaagtggaatggttcattctctgtcaagtggcacatcgtcaaggatgttcccaacaacattctcaagcacatcgtccttgagaacaacgagggcaagccggtcacaaacagccgtgacacacaggatatcaaccttgagcaaggtatccagatgctcaagatattcaaagagcatgtcagcaagacctctatcctggaagactttgccttctatgagaaccgccaaaagttgatgcaggagaagagaataaaacaacagcagatccaaaagcaggtgtgggacagcagggctccgaaccctgttgctggagagaaacaacaggaagtcgccaacgggaagccaaaggtatctgtaccgaacggtgtcagtggagagaaacagcaggatgctgtcaatgggaagccaaagtcgcctgtagcgaatggtgttaacggggatgcgaaggttccggcagagaaagccgctgccaccgctgctcctccagccgttacctacgcggcgaaggtggcccaaacagcagcggccgagaagaagcctgcggcgaccgagaagaagcctgtcgttgccaacggtgctgtcaagaccggtgtagctgcttgatcgcatacccgatcctcccagctagccatgaagaacaaacggacggtgctggcgaaccaggcgagacatgcggggtcccaaggtactgatcaccaaaggtggctgctggaaagcgggtcggatagttaggtttccctagctctctcctttttcttcttctgtcgtcgtcgtattatcgtcatccctatttcagtttgcttagctctaaagactcctcctatagtggtatcatcggaatcgccagaaaaagagaaaagagaacctgtggcaagacaaaggtagtgtcgtacccggtggcatggtgcggttgtgtcgcgtctgttttcggtcggtatttggtggtgtttgagtaagtactatgtgtttgtgtcgagtgttgggtgagtggatctgaaagtgggttctagattggagctgttttcgcgtcttattaagattatattacaacagaaatcttgctttggtttcgtatctgctgatgcggaggcctccgtttttgggtgctccactccactagatggatgatgatagatggtgcgaagctgaccgggcaaaggcaagtttggcaaaggtgtggcttcttttggaggccgttgcatctgtgctttgcttgtggttccgtttggggaagaaaagcggtggtgtgcttggttgagtgctgtgttgctcactgcttgtccacttgacatgcttcagaatttcgatgcctgtttttggttgcttggtgagtggtatgtgaataaatgtccttgtcagtgggtcactggtttgtatcctagagaggtgtcaagctcagcttaaaaagaatttggaacgatcgctagctgctgtgtcatggtggtgtcactacttgtcaacactactccaggttcaggctttggttttccagggaaat

SEQ ID NO: 1403 - DNA, 3139 bp, Triticum aestivum
  Clone ID: PAT_TA_1403
agctcgaaattaaccctcactaaagggaacaaaagctggagctccaccgcggtggcggccgctctagaactagtggatcccccgggctgcaggaattcggcacgagcggcactgtaccactagtaccaccactaccccctggcctgctgctgcagctgctagtctcccctggtggcggctcgcctccctccctcctatccccaccgcccgcctccctccttcatatctctccctctaccccaagctcgggccttgctagctagctatccgccgtagagagagaggagaaggaaggaggcccgggcgctccggttggttccgtcggatctcgcctccaggtcacccgtctgctgggatctcgcccgccccatggccgtcgtcgcgccgacccccgccccgcccgccgcgcccccgcccgccgccgcggctgctgctgctccggcccccgcccccgcccccgcccccgccgcggatcaagccacagatctgttgcagaagatgtcgctggaatcgcagcccaaggcggcggcagatggaaccgagcttgctggtgcccccaagggacctgtggccagccagccgctcagcgtgtcgatcccgcaggaccggtccatcacgccggtggttcaagattttaccgatcccaacatgttctatctgccagcatattactatggaggttacgacggaaccatgagcgagtgggatgaatatactagatatgtaaatcaagatggagtggaggttaccccagcagtatatggagatatttatggatatgggtatgctccttatggcgcgtactctccagctagttccccagtcccaacagttgatggtcagatgtttgccgcacaacattaccagtatccagcttattatcagcctcctaccccgattccttctacaactcaaggtgaccagcagccttcggccaatgctgataataagccagcagctaaggcagatgctgccaaaacaaccacaaatggtgttcccaatgtttctgctcagagtaacagcgcaactgctccccttgggtcaagctatcagaattcatcactgacccctgatggaacctatagggcacccttgctaggtggagtcccttctactggttacgtggactcaacctatgggtatgacaccacaggggcacactatgcttggtacgatggttctgcctataccaatgcacagcaaagaccaactacagctaattacacgccgtcttcagcgtataatagcaatggctcttctgcaaggtatcagaccaagagccccacaccgcagcagacgggcaacaggagaccaacgactacaacagggtcagctactcctacatacccaaacaggatgtactcgagcacccagtcttacaaccagtatggaaattcggtcaaaactggtcttatgtatggaaacactggctatggaagcactggctacggaagcactggctacggaagcagcggctacggaagcaatggctacggaagcagcggctatggaagcagtggctacggaagcagcggctatgattccaggttatatggtcggtggggtgtttctatggataccagatacaacaggcccagaggccgtggcaacggatattatggttttggcaatgagagtcaggatggaacaattgagctcaacagaggtcctaggtctggtcgtttcaagaaccagaaagcatttggccatactgttactattgctgtgaaagggcagaccctcccttcaagtgaaaacaaggatgctagtgacatacctgataaggcacagttcaacctagaggatttccctgtccagtatgatgatgcaaagttttttgtcatcaaatcatacagcgaggatgatatccataagagtataaaatacaatgtgtgggcaagtaccaccaatggaaataagaagcttgatgctgcttatcaagaagctcaggcaaagggctctagctgccctatattcttgtttttctcggtgaatacaagtggacagtttgttggtgttgctgaaatgactggtcctgttgattttgaaaaaactctagagttctggcaacaagacaagtggaatggttcattctctgtcaagtggcacattgtcaaggatgttcccaacaacattctcaagcacatcgtcctagagaacaatgagggcaagccggtcacaaacagccgtgacacacaggatatcaaccttgagcaaggtattcagatgctcaagatattcaaagagcatgtcagcaagacctctatcctggaagacttcgccttctatgagaaccgccagaagttgatgcaggagaagagaataaaacaacagcagatccaaaagcaggtgtgggacagtagggctccgaatcctgttgccggagagaaacagcaagaactcgccaacgggcaagccaaaggtgtctctaccgaacggtgtcaatggggagaaacagcaggatgctgtcaatgggaagccaaagtcacctgtagcaaatggtgtcaacggggatgcgaaggttccggcagagaaagccgctgccgctgctcctccagctgtgacctacgcggcgaaggtggcccaaacagcagcggccgagaagaagcctgtggccaccgagaaaaagcctgtcgtcgccaacggtgctgtcaagaccggtgtagctgcttgatcgcatacctgatcctcccagctagccatgaggaacaaacggacggtgctggcgaaccaggcgagacatgcagggtcccaagtaccgatcaccaaaggtggctggaaagcgggttggatagttaggtttattccctagctctctttttctcctgtcatcgtcgtattatccgtatttcagtttgcttagctctaaagactcctcctatagtggtatcatcggaatcaccagaaaaagagaaaagagaacctgtggcaagacaaaggtagtgtcgccaggccgccgtacccggtggcctggcgtggttgtgtcgcgtctgttttcggtatttggtggtgtttgagtaagtactatgtgttgtgttcgagtgttgggtgagtggatctgaaagtgggttctagattggagctgttttcgcgtcttattaagattatattacaacagaaaaaaaaaaaaaaaaaaaaa

SEQ ID NO: 1404 - DNA, 735 bp, Triticum aestivum
  Clone ID: PAT_TA_1404
ctcgtgccgaattcggcacgagctcgtgccgaattcggcacgagagagaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgttgccccctccaagggcaccccgtcgttcgaggccgccgccgagaacggggcccgaagaacggagggtgcaagtgcggccccaactgcacctgcaacccgtgcacctgcaagtgatccatgaggcctcaatcaaatcagatcaaggagatggcatggatggacctgatgaaggagcgagtagtagttatgcatgaatcgcaagcgtgtgtttcgttttaaattgccacccagaataagacgagatctatcgtatcgtatcgagctagttaatggattatccgtgccccttgtggcttgtaccgtgtgctgtgtaaggcgtcttgtgctgtgatgcgccttttcctacctgttctagttccgtcctgatgtgtagacaataataatttggagtttctgcctatgtccaaattagtatgtcctgatgcttatgcgttatctaattagcatctcaagaaacaatctgctctagttatccccatactaatggacatgataacaatcttaaaaaaaaaa

SEQ ID NO: 1405 - DNA, 2585 bp, Triticum aestivum
  Clone ID: PAT_TA_1405
tttttctatagctatttccatatcttttttttaagtaatgagcctatcctctatcttcttttttatgtttatatttcaatataccgaaacctatataagactagataaatattaagaggactcttccgcctagataaaaatatatcatggtcagcaaagttgtttctttatttttatttgccctctttaataatttcaatttcattaagaaaaactaactaaataaatggaaaatgaaaattaatagaattcttttttttttttcttcaaatccaaaaaatttctcttttttatacataggtcgtcgattcggcattggttaaaaaagggcagggtgccccctttttttttctagtaaatagttcaaaccattttatcgatatgagtgttctatatcagataaattttacattagctatttcccgtttaaattcggtactaatactaatatagttgtagaaagagtacctctttttgcctggacttcaagcagtttagctttaaccgtgttaatggtctcacattcttggtttatagagaatcaaagttgatttaccaatgagtcgcgaaatgctatggttcttccatatgatttctgaatttattcagaagtaattcgtcgagatcgtgcacccttttcttatttatccgaaaaatactaaaaaatattataaagtgcagccggatagatccaatctattcttgaaatagacaactcgcacacactccctttccaaaaaaatcaaaacaccaaccactacagttagatttattagatttgttgctaaaatatcggtattaagcccgaaactgccagcggatggccagtgagctaaaaaaacgaaagaatgggttacatttttcatatgctctcctcttatagataggacgaacaaagaacaaagtttttcgatcacttacttcgctcgcccttttttgatcggtttttttaatgcaaatagattcaatctagtaatttcttttagattaagtcttacgtcttgtttgaccggtgaaagacttcctttgttgaaatgttctgttcccaaaattcctaaaataaaaggaaaaaactttccactttcctaaactaaggacgggaaataagaaggtgagcatatcttctaaattaataatactcaactcagcccttcctagaatggggtattatctgtcccgataaatagataattccaagagtaataaataggagtaaattaaataaagtattgatataattggaattgcggaagcaaataccaatttactaaaaaaagaaaaaagtatctaatcgaaatcgaaagaattttttttttaagattaaacaaaagggttcgcaaataaaagcgctagtgccacaactagtccataaattgttaaagcttccataaaagctagactaagcaataaagtacctcgtattttaccttctgcttctggctgtctcgcaataccttctacagcttgtcctgcagcagtaccttgaccaactccaggtccaatagaagcaagccctacggccaatccagcagcaataacagaagcagcagcaattagtggattcatggtgagtagttcctcgtgtcaaaaaaaagaaatggttaaggatacaatcaaccaataaattcttacttctaagctctattggggagaagtaaagtaactaaaaagtacaaattgaaatcaaattgaaatgataatgtgaattgtccgaactacatagaagggaattccatatccatatatcggattagataatgaatctaacctaggaatatataatataatatcctatatatacatttgtttcttctattttgtttgcatattttctcattttctattgaatcggattctaaaatcattgcttaaagtggaaacccgcataaaagaggactccacttatagacattaaggatattatagtatagatctagcctgactccaccctccttaatgcatatatactttgaaaattccataatatagtctattctattctctctcctacaactctaggctatatattcatacgcatttctaactatttttttgcaaccaagcagattatccggaaccatgcatgaattgagctaagctgcaaaaaaaaaaatactatttccaaaaatagtcaattcaatgatgaccctccatgggattcacctatataggctgcggctaatgttgcaaaaataagagcttgaataccgcttgtaaataatccaagaaacatgaccggtatagggattactaaggggactaaagaaacaagaacaacaacgactaattcatccgccaatatattcccgaaaagtcgaaagctaagtgataatggttttgtgaaatcttctaggatgttaattggtaaaaggattggagttggtttaatatatttctcgaaatagctcaatccttttttgctaaagaccaacataaaaatatgccgctgacgtgagtaaagctaaagcaacagtagtatttatatcattcgtgggcgctgctaattccccatggggtaactctataattttccaaggtaaaagagcacccgaccaattcgaaacaaaaataaaaaggaacatagt

SEQ ID NO: 1406 - DNA, 1369 bp, Triticum aestivum
  Clone ID: PAT_TA_1406
gcttgttatttcacgcgcccgtgaaaaaaaattgtaagttggcaacagacggacactcactctcactcagacaccacaggtgcttgtttcatgcacgttacaaaggagcagcaccaaccacaactttactcgacacacacacacacaggaggagacaatgactgtctaggctatatgtgtaagaaacagaacctaacccaatcagtaaaaaaatgaagggagacaaatgtgtaaggaacaagatccacatgtgtgagaagatcagaagcacgagacgttctcggtcttcatgaccaggttgcacgtcgagtagatggatgctgcggcagcttgcactgcccactcgctctcggagatctccgggttcttcagtttccataattcagccattgggccaagcagtggagcctcacaggtcacttgttttaggcctttatcacaattctgcaacattccttgcacttccttcaaccgaatttccaagtgccttccctcctcctgcagtgttctttccatctgaaggaatagagacctccaccgtgcagcatgttcttctgaaactgtttttccagtgggcccagcttcagaagaatgtgcaatggatggttcattctcttgactagatgagaattctgttgatatcaggtgcggcagttcagtttgaagagcattcctcacgcagatcggatcagaccagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtagttatgcatggtgtgtgcgtttgtgttctctttttaattgccgccgagaataagacgagatctatcgttatcgtatcgtatcgtatcgtatcgtatcgtatcgagctagttcatggccccttgtggcttgtaccgtgtggtgtgcaaggcgcgcgtacgtcctgtgtctgtgacgcgccttttcctactgttctaagctccgtcccgtgccttcccgttttatctacatatatgtagacaacaataatttggagtttctctctatgtatgcatgtgtatctgtatcactatatgtgtggcgccagctctttgct

SEQ ID NO: 1407 - DNA, 740 bp, Triticum aestivum
  Clone ID: PAT_TA_1407
aaaccaacggcccgagtaccaaggagatcgatgcgcaacgcaagggtcgatccagtccagagctagctccgtcctacaccaaggccaagtggacgatcgatccggccagagacacatgtggtggccgtcgtcgctgctctacccgccgccgccgtcggccttcgtcacggccatgtcggtggtgtcgttcgcgtcgctggcgtccgcgggcctctcggagctccgcggccagcacatggcctactccaagttctggcacgtcgtgtctggacagcagcataacaagggctgcgcgccgagctcctcgccgtccacttcctcaagcgtgtcctcgaggtactcttcatccatcggtatagtgggaacatgccactcaacacggcgctcgccatctcctccagctacctgctcagcgccatcaccatgatctacgcgcagcacctcgccgtcggactacctgaccctacaacggacctcctctcgcaactcaggaagggaggtgacgacgatacggggtacaagatccccaaaggcgggctcttcgagttcgtcacctgcccgcactacctcttcgagatcaccggattcttcgggttcgcgatgatctcacagacggtttatgcgctcgccatggccttcggcacggcagcctacctcgtcggccgaagcttcgccacccggagatggtacgaatccaagttcgaggaattcccgacgagcatcaaagctctggtgcccta

SEQ ID NO: 1408 - DNA, 1028 bp, Triticum aestivum
  Clone ID: PAT_TA_1408
gccaggtggacgctcgcgcgtccggtcgatccagttcagagctagctcctacaccaaggccaagtggacgatcgataaagcgacatgtggtggccgtcgtcgctgctgtacccgccgccggcgtcggccttcgtgacggccatgtcggtggtgtcgttcgcgtcgctggcgtccgcgggcctctcggagctccgcggccagcacatggcctactccaagttctggcacgtcgtgtctggacagcagcagaagaagggaggcaccggtggcgcgcagcttccgggccgtgacgggatgctggtggcctacgcgccggctctagtcgccgccgccgcgtccttcgtcgtcccgggtgcctgcggcagggctgcgcgcggagctcctcgccgccgcgctcgccgtccacttcctcaagcgtgtcctcgaggtactcttcatccaccggtacagtggaaacatgccactcaacaccgtgctcaccatctcctccagctacctgctcagcgccatcaccatgacctacgcgcagcacctcgccgtcgaactacctgacccttcaaccaacctcctctacccaggtgtgctcctctttgccgttggcatcgccggcaacttctaccaccactacctcctctccgcaactcacggaagggaggtgacgttgatagagggtacaagatccccaaaggagggctcttagagtttgtcacctgcccgcactacccttccgagatcaccggatccttcgggtgcgcgatgatctcgcagacggtttatgcgctcgccatggcctccggcacggcagcctacctcgtcggccgaagctcccccacccggggatggtacgaatccaagttcgaggagttcccagcgagcatcaaggctttggtgccctatatcttgtagtgagccaactaattggttgacagccggattgtttatttacaagcagtctcacgtttatctaacctcggcccccattctaagcctttgtgtctgtcgactttgaaaaaaaagaaaaaaaaaac

SEQ ID NO: 1409 - DNA, 1583 bp, Triticum aestivum
  Clone ID: PAT_TA_1409
acgtccgcttaattccccatccgtctcgtccgcctcctcctccccgtttcccctctctccgagctgcagcccgcctcgccgtcgttacctcccacgcaaaccctaaccctaggcaccgccgccgccatggccagcggcaacgtgtccaccgtctacatctccgtcatcgacgacgtggtcgccaaggttcgtgaggacttcattacctacggcgttggcgatgccgtcctcaacgagctccaggctctctgggaaatgaagatgctgcactgtggcgcaatctcagggaacatcgaccgcaacagggccccccccgcttccgctggaggcgctcctggggccggcgcgactccacccgtgcacgacctcaacgtgccctacgaggccacgtccgaggagtacgccaccccaaccgccgacatgctgttcccaccgacgccgctgcagaccccgatccagacaccacttccagggattgatacagggatgtataacatacccacggggccgtcggactatgccccatcgccgatcagtgacatgagaaacgggatggggatgaatgggtctgatccaaaaactggccgtcctagcccttccgtgccaactccatcgccctggatgaatcagggaccactgggggttgatgtgagcgttgcttacggggagcgccgtgaggacccagaccggatgatgcaacctcagccattgactaaggattttctgatgatgtcttctggaaaacggaagagggatgaatatcctgatcagcttccttctggttcatttgtgccacaacaggatggatgtgcagaccaggttgccgaatttgtggggtcaaaggataacgcacaacaggtgtggaattccatcatgaacaagcaagaatcagtaacgaagacactttctatcgaagaaagcacaataccaccagttcttcctcaacaggacgggatacaagatgattataacgatcagtttttcttcccaggagttccaaccgaagactacaatacccctggggaatcttcggaatatcgaactcccacacctgctgttgcaacaccaaagccaagaaacgatacggcgggtggtgatgatgatgatgatgatgaacctcctcttaatgaagatgatgatgacgatgacgagatagatgacttacaggatggcgatgaggaacctaacacgcagcaccttgtcctggcacaattcgacaaagtaacaaggacaaagaatcgctggaagtgcactttgaaggatggaatcatgcatttgaatggcagagatgttctattcaacaaggcttcaggagagtttgatttttgaatttcatggtaaagatgatattttaggtgcctgctgtatctacttgtcttaacataaggaagggaaggtgacaaaaggctggtgctgtggcgagtttggcactatgatcatgtgtcttgttttcctgttgaggcttgcttcacccagttggtttgtttaccataactcatgtcactgtaaaaatggtatagttgggacggttgtggatattttcttgagatgctcacttaaaaaaaaaaaaaaaaaaaaaaaac

SEQ ID NO: 1410 - DNA, 1095 bp, Triticum aestivum
  unsure (1)..(1095): unsure at all n locations
  Clone ID: PAT_TA_1410
agcttcgatcccatggggcaccttgcgcccgtccaacctctccggtaatcgccaaatcgagcaaagccatcccatcgccgacggcgaagcccgaaccggggcggagcccgatacctagccaatcgccgcccacaatgcgtcacatcctcctcgttctcgcggccgccgcggcggtcgtcgtcgccggcgccgagcccgtcctccgccaggtcacggacttccccaccgccgtgtcctcgggcgtctccgacgcggacgcgctcttctgcgacagctggaggctgtcggtggagacggccaacgcgggtccctggcgcaccgtgccggcgcgctgcggggcgtccgtgcgcgcgtacatggagggcgagcgcaacgcgtccgactccgccgtcgcggccgccgaatccctcgccttcgctgcgcaggcattcgcgtcgggcgtggggggagccatgccggcgtgggtgttcgacgtcgacgagacgctgctctccaacgcaccctactacgccgtcagcggatggggattacaggaattcaacgagacctcatttgatgcatgggtagacatagcgaaagcacctgcattaccatctagcttgaaactgtacaatgaactgcaaggacttggtttccatattatcctcttgactgggcgaagtgaattgcagcgaaatgctacagaggaaaatctcttgtttgcgggctaccattcatgggaaaaactcatactgaggcaaatctctgatattggcacggttgctattcagtggaaatctgcacgtcgagctgcaatggaagcgatattattcaggccgctgggaaactcaaatcagagaggcgagctgcgatggaagcggaagggttcaagatacttggaaactctggggatcaatggagtgatttgataggattgccaatggcaacgagtctttaactcaaatccaatgtactcatcactgattttaatggtggcgcgaagaaatactatactatctctgtcaacactcaaccatttatggcccgcccaaattgtttgggnctaattgtaaaatctgatccaattgccactcacactcagtaccgggttggtca

SEQ ID NO: 1411 - DNA, 433 bp, Triticum aestivum
  unsure (1)..(433): unsure at all n locations
  Clone ID: PAT_TA_1411
accccctaccgacgcggcgcctgagcactcctgccccctcgtggcggcgagatccaggcggggcccggccgccgccggcgcatggcctccgtcgacgccgcgggtgaccccctccgctccttcgcctctgcgacgtccctccttttccggacccttggccctgccgcggcctccgcatccccctccagggcccctggggcgctgctcggcggatccctgaaacgctccaaggagctgatggagcaggccagcctggtcttgaaggagcggggggacatccagaagctctatcaggaggatcgagtggatggcaagaacaaccagcagggtagaaggcctgggctggaccgcaagcgggctcagttctctctcaagcccacccaaagcaacccagtgaatgttgatttctcccaggcgcttancattgacgatc

SEQ ID NO: 1412 - DNA, 741 bp, Triticum aestivum
  Clone ID: PAT_TA_1412
gagcagcaagcagaaggccaagaagcgcgggcgcaagcccaagaacctccccgcccacccgtccagcgccacggaggccccgacccagagcgaccggcgctgcagccactgcggcgtgcagaagaccccgcagtggcgcgcggggccggagggcgccaagacgctgtgcaacgcgtgcggcgtgcgctacaagtccggccggctcctccccgagtaccgtccggcgtgcagcccgacgtacgtgagcagcgtccactccaactcccaccgcaaggtgctcgagatgaggcgcaagaaggaggacggcccgctcacagtcaccgccaccgcgcccgccgtggcgtcgttctagctcgctcgctcgctggctggctggccactccgtccgcggtggctgtacattttcccgcccgtatcagtctttgtactaccgtactcgaaccctttttcttccatttctctgctagtatcatcatcatcatcatccgagtagttccgtttggagattaattagagtccagcaggtttaggtcatgttaggttttaggaattcggctcctccaactccaccaccttcattagcttgttagggtactaagtactgctacagcagcagcagtgcagcactagctcagaactttatttccagctttgtcccaaggagttttctatgagctagcatgtgtttgctagtgtagtgtaaatcaatggcgtgcttagtttttaaaaaaaaaaaaaaaa

SEQ ID NO: 1413 - DNA, 986 bp, Triticum aestivum
  Clone ID: PAT_TA_1413
atcaacccatactcctagcttcattccctccctgctccactatcggatcgatcgtgtcagcagcagcaatggcgccatttgcgacgccgatgaggtcggcgtccctgcagctctctgctctcctctgcatcctcctctgctcagaggtctgggtgctgcaatgcggcgcggcgatcggcatcaactacgggcaggtgggcaacaacctgccgacgccggcgcaggtggtgtcgctgctgtcgtcgctgcgggtcggcaaggtgcgcatctacgacgtcaacccgcaggtgctggcggcgttcgccggcacgggcatcgagctcatcgtcaccgtgcccaacgacctggtgcagcccatggccgccagcgccggccaggccatgcagtgggccaccgccaacatcaagccctacttcccggccacgcgcgtcacgggcatcgccgtcgggaacgaggtcttcaccgacgacgacgaggcgctcaaggccagcctcgtcccggcgatgcgcaacctgcacgccgcgctggcccagctgggcatggacgggtacgtgcacgtctccacggccagctccctcggcgtgctggccaactcgtacccgccgtcgcagggcgccttcacgccggagtgcgcccccctcatgctccccttcctccgcttcctcgccgagaccaacgcccccttctggatcaacgcctacccctacttcgcctacaaggccgacccagcaaacgtgtccctgtcctacgcgctgtcggacccgtaccacgtcggcgcggtggacccctacacccacctgcagtacacgagcatgctgtacgcgcaggtggacgcggtgaccttcgcggcggcgcggctgggctacggcggcatcccggtgttcgtgtcggagacggggtggccgtccaagggcgacgccgacgaggtgggcgcgacggtggagaacgcccgcgcgtacaaccggaaaccccctttggccttgggg

SEQ ID NO: 1414 - DNA, 835 bp, Triticum aestivum
  unsure (1)..(835): unsure at all n locations
  Clone ID: PAT_TA_1414
gccggacgcgtgggaaccccgtccgagttcgcgaacaatcccccgcctctccacccgaacaaaccccagctgcatccatggcgaagccgcggcttcttctctgcctgctggtcgccgccgccgcgctcctgctcgtcgcctccgcgaagaagtccggcgacgtctcggcgctccagatcggcgtcaagtacaagccagaatcctgcagcatctcggctcacaaaggtgacagagttaaagttcactaccgtggaacacttaccgatggaacagttttcgattctagctttgaaaggggtgacccgattgaatttgaattgggcactggtcaagtgatcaaaggatgggatcagggaattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagaggaggatgacgctgatctgtaggcagctcggcgcagcacgatcgcccagttatcaaatcgaataggactatgtatgggaaacttactcttgtagggcagacacaatgaggcaggaacattgtcttaccatgatcaaacagaggagcctagttctcaaaatcgaatagatcaagtgacttttgttaccctatgtaattctctggaataattctcctatctaccttgttacttttgcttttgttcttggaatggttataaagtactactcccttcatttctcattttactttgcctannnnnnaaaannnnnnnnnnnnnnnn

SEQ ID NO: 1415 - DNA, 637 bp, Triticum aestivum
  Clone ID: PAT_TA_1415
ggccacttccccctgccccccctcccccccgcccgcccccccccccaccagaaggaaagcacgccagcgagagaaggagcagcagaggctgcacggcagaattaccgtgagcaactcggaagccgcgccggagccgggtcgaatccggccgcggcgaggggaaatgtccggcttcgtcggggtcgtcgtctccgacccctccctgcagggccagttcacgcaggtcgagctccgatcgctcaaggccaagttcgtgtctctgaagagggactccgggcatgtcaccaccaagaacctcccggggctgatgaagaagctcaggggacttcacgaagtggtccccgaggaggagatcgccgctttcttgtcggagtcgtaccccgacagcgaccaggagattgagttcgagtccttcctccgggagtacctgaatctgcaagcaagggtaagcgccaaggaaggaagcgccactgctggcggcggcggggctggcggccgcaagaactcgtcgtcgttcctcaaatccaccatcactacgctgctgcacaatctcaaccaggcggagaagtcttcttacgtggcgcatattaacacttaccttggtgaagacccattcttgaagaagtacttggcaatc

SEQ ID NO: 1416 - DNA, 695 bp, Triticum aestivum
  Clone ID: PAT_TA_1416
tttttggttgttttttttttttttttttttttttttttttttttttttttgggagtgatgggttcatgcatccatacccagtagcactccagccagtgagcagttcacctttgaacaaggtaccctgtgatagcaagttcataatcacttgaaattatagactaaatatgcaacaaaattggttctatgggaaaacaccaattacctacaagtccattcggatattgcctccacacacatgtttggtgcacaggaatcccgaatcacagtgatgtcttccagtagcatgcagcagtgcgagaattcatcattcgtccatgttgtgacgcaacttggtagcatcttcatgtgtaatttaatgaggacgatgtctttcctctgttcagatcagccaagcgcaaccacacctgtgtattttccagcggctccaaatccacaccggcaactcggcgacagagtgcctctgcatatctctttaattcagccgacagtgccgacacaacgacatgcagaaatccattttggtgttatgcaccgacaaagggatcacagaataccactctgtactctatgccgagtgatttgtcagtgctaagccaattcgtgcctgaacgtatgccggtgcctttaacaaattgatgcatgcatagcacaacagttgcagtgtggaggcagaatggggggataagtgcatc

SEQ ID NO: 1417 - DNA, 716 bp, Triticum aestivum
  Clone ID: PAT_TA_1417
ggtccagttcagctgatgcagcttttcaacaaattggcttctcgctctgctaaatacaagtcggggcttgttcaattcctgcttaagcaggctggtgttgacaaaagaacaggcgacttgtacgggaaccgtgacctattaaatattgctcgcaacatggctcgtggacttaagggcgttgagaacgtatacacccaacaccagcctctgatcttccaaacaatggaaggaattgtcaaggggcgattacgggatgctgactatccacttgttggcaaccatttccagcagggcaggcctcaagatgttgtgatattcatcgttggtgggacaacttatgaggaagcaagatcagtagccctttataatgcagcaaatcctggagttcgtttcttccttggaggttcagtggttctaaattcgaagagatttcttgaaaacctgggggaggcacaaagaatatcgaagtctagcactctattatgagcatgctgttgtcccttcctgctcgaggcttgcgagaatgtgataattgatagtttcactgcatatattcagagagaatgcaatttgtggtaatctttgtaatgtatagctttagctgttagtgcaataccacagcgtatctatagagggctcagcttctgtacatttcacatttgttgtgataattttttactacccagttccagtccagttgacacgatcaagaaatg

SEQ ID NO: 1418 - DNA, 1007 bp, Triticum aestivum
  Clone ID: PAT_TA_1418
cctgtgcggcgctcgccggccgggttcgggaacaggcacaaacccaagccagccaccacctacaacagagagcagctagccatccatcctgcagacggtgtaatttgttcaaggaaggaagcggagcaagaaatggcggcgagggcggtgaccatgctggccgtcgtggcggcggtcctggctggcggcgcgtcggcgcagtcgacgagcgggtgcacgcagacgctgatcggcatgtcgccctgcctcaactacatcacggggaacgagacggcgccgtccaagtcctgctgctcgcagctcgccaccgtggtgagctccaagcccgagtgcctctgcgtcgcgctcaacgccgaccctgccgcgctcgggcttggcaccgtcaacaagacccgcgcccttggcctccccgaccagtgcggcgtcaagacgccgccgctcagcaactgcgcctctgcccccaccacctcgccgtcctccggctcgccggcgggacagacgccaacgtcttccggagcagggtccaagtcgacgccgacggccgacgtggggagcggcgccgcttcgctccagagctcggccgccggcatcgtcgccggcttcatcgtggccgcggtctacgccgtgtccgccatgtgatctgattgacggatcgacgcggtctcttcttcttcttgtcagtcagtagtgattccatttgtgattatacagggggttccgggatcggattggcgcgcatacatgtgatatgtgaatgcgatccatggccgattccatttgctgtacttgtaccgtgagcttatctacttgattcattgttgccttcggaataaacattgctacaattagaccttaaaaaaaaaaaaaaaaaaaaaaaaaaaaaaaaaaaaaaaaaaaaaacaaaaaaacaaaaaaaaaaggctgacataaacgaaggtctgactgtcccttcggcccgaaagagctgaaacgaaggatcttgaagacacaaccccttggctgggccc

SEQ ID NO: 1419 - DNA, 885 bp, Triticum aestivum
  Clone ID: PAT_TA_1419
cggacgcgtgggcgcacgcgtgggcggtcgcgtgggcaaaccaaggcaaccaccacctacagagagcagctatcatcctcttcaaggaagaaagaggagcaagaaatggcggcgagggcggtgacgatgctggcagcggcggcgctcgtcgtcgtggcggcggtcctggccggcggcgcgtcggcgcagtcgacgagcgggtgcacgcagactctcatcggcatgtcgccctgcctcaactacatcacggggaacgagacggcgccatccaagtcgtgctgctcgcagctcgccaccgtggtgagctccaagccggagtgcctctgcgtggcgctcaacgccgaccccgccgcgctcgggctcggcaccgtcaacaagacccgcgccctcggcctccccgaccagtgcggcgtcaagactccgccgctcagcaactgcgcctccgcccccaccacgtcgccgtcctccggcgcgccggcgggacagacgccaacatcctccggagcagggtccaagtcgacgccgacggccgatgtggggagcggcggcgcgtcgctccagagctcggccggcatcatcgccggcttcatcgtggccgcggtctacgccgtgtccgccatgtgatctgatctgattggcggatcgacgcggcctcttcttcttgtcagtcagacagtagtgattccgtttgagattatatatactggggttcggggatcgaattggcgcgcatacatgtgatatgcgaatgtgatccatggccgattccatttgtaatttgttgtaccgtgacatgcatcagcttatctacttgattgattcattattgctttttgattttacattactttacctaatatttctcttaaaaaaaaaaaaaaaaaa

SEQ ID NO: 1420 - DNA, 2102 bp, Triticum aestivum
  Clone ID: PAT_TA_1420
cggacgcgtgggcggacgcgtttaatcagatgctgggattcaacaattttccatgaaaagtatcgcatcactgctggattagggggtgctggtagtggaagtgaattttgtatatggtcattactatttctaaggtgcggaacccttgttagcggagatagttctgggagcgttcaattttgggataaccgccatggaactcttctgcaagcccacacttaccataaaggcgatgttaatgcactagcaactgtgcctagtcagaaccgggtattttctgcaggatctgatgggcaggtaattttgtacaaggcatcaaaaaatgagttcagtgctcataacgagaaggtggctgaagagcaaatgcacaagtgggtctatgtgggatatgtcagggcccattctcatgatgtaagggcattgactatggccgtaccaatatgcaaagaagatccggcccctgtgggcggggtgggttcggcgcgcgttcaattttgggtcagccgccgcgggtcgcctctgctggccctcccgttcctcattgccggtggggacgcccccgcgccggtgccttgtccggcccgggtgttctctccaggttctcctcggcacgtttgcccggccccgccacctccattggtgttccgtgctcgtgatggcacagtggctggagaccctgtgctcctgggcctctctgtgggttgcgtgggcgcccgccctctggctgttagggccttgactatggccgtaccaatatgcaaagaagatgctgtaccagaggaaaaggtggtaaaggttcgccgcaaggatgaattcagttaccgcaagtgggcacatctgggtgtaccgatgctcatttctggtggggatgacaccaagctgtttgcttattctgcacgggcgtttgcggaatatgcatctctcaacttcagccctgcatgccaacgtgaatatcatgctctcacaagatgatgttcactgatgattcatccagtctggttctatcttgctgtcgatgggaaaatttatgttgtggatattgcgtcaagaaaaatttcaaatatatttcgccctacaagtaaggcagatggaacaaaaacttccaaagaaccacctgtcacaaaaatgtttgtgagtgctgatgggcagtgggtggctgcagctaactgctttggggatgtctacatatttaaccttgaggtccagaggcaacactggttcataccgagaatgaatggtggctcggttacatctggtggcttttgtcccaagaacaatgcccttgttataactacctctaaaaatgaggtatatgtatttgatgtggaagcaaaagaactgggcgaatggtctaagcgtcatacacatgaattacccacaagattccaagacttccctggagaggtcattggcctctcatttcataaaatgagcccattttcagtcatgatatacagtgccagggcaatgtgcgttattgattttggattgccagttgttcaggatgtccaattgtcaacatcagaaaagacagactcacaaaaggctgcgaaaacaaaggttaagcggaaacatcgtgacgaagatttgaaacaagagaaaaggagtaacttcaccttctttgcatttaaagatccggtgctgtttgctggccacctactggacagttcaattctggtagtagagaagcaatggatggatgtcgtccaaggattcggcccaccggtccacagacacatatacgggacatgatccatccatccatagtagcttttgaacttgtggccctcgtaacaggcaggcagcccattctttttcgtcaccgccatgaaatgtttccaaccccaagcaagttgtctggcatgacactcccaagatgtagcagcacataatgtctgctattatcatctggcgcgatagcagtctgggtcaatttctctttggtggcttttctttcttgagtagcctcgttgtattctttttcttcactgaagtatgttagtggacccttcacagcgccagttttgtcgtaccgtgtcaaaatgcgcaaattttgtcatatgtaaacaatgtatcatctactgttatgtcaacatatctcg

SEQ ID NO: 1421 - DNA, 739 bp, Triticum aestivum
  Clone ID: PAT_TA_1421
aaaacgcggctagcatacccacgcgtccggcggcggcggcggcggcggcggttggccctctcgagtcatggtgctacccgccaccctctcgcgcgacgccagagctcactcgtgccctgcacaggacggccagggggaagcggggccgccgcgcccgtgcagaccgcccgcgttctacagctccgtgttcgcgcagatcgaagaggtcgggtgggggcagctagtgagcgccacaggcgacgacggcgtgtcgtgcatcaccttccgcgtcgtggatgagcagcgacggcaacatttactggagatcacactgcccatgaactacccggcatgccctccttcaattgctgcggatgttccttatctccccaaattacagtggtcaaaaagctcgagactgaaggatgttctctgccagttccaagcgcacctgaaggtattgcaagattactggtctacaatggatggcattgacaaggccctttgggttgtcgatcctacaaagccgacatatgctatgtctcatcatcgcatagctttgggtgatgattgctatattttactacatgttgatacgcacaagcccaactccttaccagagtaagctgagatgtcaagtctgtacatgaaaatgcaagcatcattgttgatcgtcaacaaattttccaggtgccgcttcctaggcacagatgggaaattggaaaggctgataaagaattggagaaaaaatcgtaagaga

SEQ ID NO: 1422 - DNA, 591 bp, Triticum aestivum
  Clone ID: PAT_TA_1422
aggcgaaatgtgcgtgtcccatgcactgtttcgcccgaggtagcaaggggcagcattagaacgaatcgcccctgattagcgctgatgcatgcgcgtagactttaaacgcggattctgctgcatcttgctaccagatctgcaggatattggtgtggatggtatccagatatttcggtacgccttttgggtcctgatctctgcacctcggccgttaccactcattttagattcgtaaaatctgccatcttttctgacgcagctgacttttgtcagctaccgttagtagttttgtttgaaaagccgcaccaaaatcgtagtccccatgtgttccttcttttgatgaaggatgagaggacccgattttcattcagaaacacaaacacaaatacacaattactccaggtcgtgattaggccgtaacaatactaattggcctttgacgacaggcaatctttcagttctcagagaggcaggccgatgccgtggccgttatgactagcacaaaaaatctctttttccaacgaagcacggcaggcggagccatatgcttctcgtgctcaagtcgttgggatactatcatatcatcgtagc

SEQ ID NO: 1423 - DNA, 412 bp, Triticum aestivum
  Clone ID: PAT_TA_1423
aggaggcagcggtggtgggataatggcggcatcctcgcagcccctcttccggctcctgctctcgccgccgccgagaccatcccgcctccgcctccgcctccgcctcggccacccgcacctcctcgtccccgtccggtcccgcccgcatcgaccctccacatccacccgctgctgctcctcctcctccgccgcggcctacaacggctgggccgaactcccggccgccgacgacccgctgggcctccccttcctccgcatcacgcagcagtccctcgccggcgccccgcttctgctactcctcccggtcgccgcgcttttcctttgccggcttccggccgtcccggttcttgacggcgtcttcgccgtcgggttcggcaaccgcagggcacctggcccgggccccggggccttc

SEQ ID NO: 1424 - DNA, 1405 bp, Triticum aestivum
  Clone ID: PAT_TA_1424
gagccccagcaactggatcgcccccacacacagatcactatcagggagaggagaaacgagacgaccggcgggccggaggcggagccctcaaccggcccgagagagccatgtcggcggcgtcctcccctcctccggccgacgcggcggccgcgggggcggagacggaggccacgcccgtcgtcttctactgctacgagtgccaggccaccgtctccctccctgcgccggccgccacgccctcgcggctatctgctctgcccccgttgccgcagcgacttcctcgaggagaaccctaacccgtcgacctcgtcccctccaccgccgccgcccccgccgccggggttcctctccgactcctcggaggagcccgacgacatcgacctcgggatcgatcacaccgctgcccaggcctacctcacccgcctcgttcgccgcctctacgatgatcccacctccgtggccaccgccgcggccgcggcggtgtccgtgctgcagcagcaggggcacatcggtgggcagggccagcccccggcgcccgcggcgtccatcgccgccgtgccgacggtggaggtgtccgagcccgcctcggtctgcgccatctgcaaggacgacctccctctcgccgtcgccgcgcggaggctcccctgcggtcacctctatcactccgtttgcatcgtgcagtggctggagatgcacaattcctgccctgtctgccgctcttgcctcccgcccaccatcctcgaggaggtggagccccaggaactggatcggccaccaacacagatcactatcaggtttaccaccaaccgccgccgcatccgcacaaacagtgatgcagtggctccggccgcgacgtcgcctactcagctcgcagaggcgatgacaggggaaggaggtgctggacctgcgaatagcgcagaaactgtatcgtctgaatggccaccgcccccagaatctgatgccgtcgtgtcagagacccgtgagattgagggcttctttgattgagccagaagatagagtttgcaggtaagaacatcttatgactagtgtccatggagcatgaattgaactgctgcttagtggactaatcagttgcagtgaagccagtactttggttctgtgatatggactagttgagttacatttgcttgtgtgttccatcttctatgctagttgatcgatggtaagctggaatagcttataatcatatgaacattcatatgtagttgaacttggagttattatacttactttggaccgcatgttagctgatatggttggtgatatatgtgttttctgttgttaattttgtaagtcttgtaccttgtacactctttttcggtacaactgtaattatttgtcgagagttgttgtgtttgtgacatgttctatatatccgttcgcc

SEQ ID NO: 1425 - DNA, 1942 bp, Triticum aestivum
  unsure (1)..(1942): unsure at all n locations
  Clone ID: PAT_TA_1425
cggacgcgtggggcggcggcgatggcgacggcgacgagggcgaaggacctggcgcggaggtcgccgaagaagtacgtggaggaggcgctctaccggcggctgttccggcgggggtcgacgccgcaggcggtgcgggaggaggtggacggcttcctcggcagccgcaagcgcgccttcaagtgggaggtcggcgtctgcgtccgccgcctccggcgccaggagctctaccgccccgccctcaagcttactgaagttatgactagaagaggcatgaatcctacagtcggtgatcaagcaatccgcttggatcttgttgccaaatcgagaggcatcgctgctgctgagaagtacttcatggacctcccagaaacttctaaaacacatctcacatatggcgctcttctcaactgttactgcaaggaagttaaatgactgagaaggcttgggtcccttaatggagaaaatgaaggagctcaactttgctttcactgctatgtcctacaacagcttaatgacactatacaccaaggtcaaccaacctgagatggttcccagcatcatccaggacatgaaggcagatgatgtattgcctgatgtctatacctataatgtttggatgaggtcccttgcagctcgtcaagacatattaggggttgagagggtgattgaagagatgacaagggatggccgtgttgctcctgattggacaacatacagtaacctggcttccatatacgttgatgctggactgcctgagaaggcagaagccgctcttaaggagctagagaagcgcaacactagcaatgatcttgaagcctaccagttcctcattacactgtatgggcgaacacaaaatttagtggaagttcatcgtgtttggcggtcactgaagcggaataatcctaggaaggcaaacatgagctatcttaacatgattcaggttcttgcgaacttgaaggatctgcctgctgctgaggcctgtttcaaagagtgggaagctcggttcatccgtccacctaagactaaagcaactgatgctgtgacaactgaaacttctaagttggaagaagaagcttcaaccgaggcatctaataatgattctgatgttaaggaagcagaggataaggaaacagaggagcttgacctgaaacgtcctaaatacgacatccgggttgcaaatgctctgatgaaagcatacgtcacagagggtatgcttgacaaggccattgctctcaagaagcgtgccaagatgcgtggaggaaggcttaacgcgaagacgtgggagattttcatggagcactatctcaaggtaggggatctgaagaatgcccattggtgcgccgaccgtgcaatcaagaaggggcacagcagcggcaggatctgggtgccgccacatgacgtgaccgagaccttgatgggctactttgagaagaagaaagacgtggacggcgctgagagtttcgtcgaggtgctaaagaaggtgcagaaagatctggggacggtggtgtttgagccgctggtacggacgtacgcggcggctgggaagaagttccctgggatgcggcaccgtctgaagattgaaaacgtggaactcagcgaggaaaccgacaagctggtcgattccatctgtgttgattgattatgtttattagaatcccactttgttccatctcaataacagacagcaggatgctctcaatttttgttgctgttttcttctgcaaaacctgtaacaccaaatgttagccagacatttatttcggttggccaaggtctctgcgcaccatcggagtccttttgctgttgaaatgctctgcttttctgtggtactgcggccttgtcttcggtgaaccgaatgaactacaagtgcttcaattgtttaaacaaatattaatttatgtactgtgcaatgtccttaaatatgtacatagcgtanaaagaa

SEQ ID NO: 1426 - DNA, 886 bp, Triticum aestivum
  Clone ID: PAT_TA_1426
ccagcgagttcttcgactatttcaaggtgctatgcattcaaaggtttcttacttgtcggaagcatgcagagcgtgttatacttcttgtggaaatgttgcaagattctggcttcccgtgctttaaaggtggtactcgcactatactgaacttgaggaagaggttccacttgagtctcactgaagagcaatgtgtatcgctggtgctctcattgatcagtagcagcatggatgcctggcgttctccccggtgggagggcttcctccggggattgttggggccccggtgtcctgccccgggtgcgctgaccccttggcgcgttctgggacctttttgggcgtggccccggccccccctggggcactttcggatcagtttggggctgatctagcttgctgttcccaccatgattggtaatgactggcaccaggtaatggagcaacgtgttctgcattctgcacgcctggagtctcccgtggaacccaagtggcattgtgctcgtgtattatttcacaccctatggagaaaggttgagaaagtgtatagtcatcggcagttagctagttagggcttcacactaggaggtttgctactggtgaagctgttaagcgtattggaatttggaatccgagccgcggtgctgtacagacactagatttgcgtagcttgggcaggggttttaggggaggaccgagccatacatgaagtgaacaagtgtaaattaaagacgcatggaagctgggagtcacctgtggcagcagcaagggttgtgtttgcgcgattctgtggcatcccaatataggcatcgaattagacgatgacaatgtgcattgtaaattaccattactgtacagggcccaacaataggagctcgttgtcccgttttcc

SEQ ID NO: 1427 - DNA, 861 bp, Triticum aestivum
  unsure (1)..(861): unsure at all n locations
  Clone ID: PAT_TA_1427
aggtccgccagcagaaggcacacactgtaatagatcacgcaccggcaccacctccggccagagcgccaaggcgcgaagcgatggagtcgggcgagccactcccacgtcgcgacggccgccgcggcggctggcgcgccgcgctcttcatcgtcgccgtcgggttcttggagcgcatcgggttcaccggcgtggggggcaacctgatcacgtacctgaccggcccgctgggcatgtccacggcggccgccgccgccggcgtgaacgcctggtccgggaccgtgctggtgctgccgctcgtcggcgcgctcgccgccgactcgcgcctcggccggtaccgcgccgtcctgatagccggcgtgctctacctgctgagcttgggaatgctgacggtctcgtccatgctgcaaacgccgcaacctcatcctgccggctgccacagcacaggcagcacctgctcgccgctgccctcggcatcatcgcctgcccggctcgccttcttctacaccgcgatctacctgctagcactggcgcagggcttccacatgccatgttcggaggctttgggcgcggaccagttcgatcccagcgtcggtgcgtcccggagctcctacttcaactggtttcacttctccatatcgtggggctacgccatcgcggcgatcgtggtcacctacatcgaggagaatgtcggctggacggaggggttcgccgtgtgctgngccaccatggtggtgtacctcgtcgtcttcttgctcggcacgaggacttaccgtgtagagcagcccgtggacagcagttccttggcgcacctcacaagaagctcacatttgggaacccacatgccaccactgacacacaccg

SEQ ID NO: 1428 - DNA, 1494 bp, Triticum aestivum
  Clone ID: PAT_TA_1428
cggacgcgcgggggctaagcagcatccagcagcaggtggcaagcgagctcactcgatcgcgctcgccatggccgcgtccaccgccgcccgacgcttcctcctcctcctcgccgcagtgaccgtcgtctccgtggccgccgcggcgccggcgccggcgccacccccgccgttccggacggtgtacgcgttcggggactcgttcacggacacgggcaacacgcactccaccaccggtccttactcgtacggctacgtctccaacccgccctacggcgccaccttcttccaccgctccaccaaccgctactccgacggccgcctcgtcgtcgacttcctggccaccgacgcgctcgcgctgcccctccttcctcccgccctaaccgtctccccatgcgccagggcccaacgccaccatccgccaggaggcaggagcaagggactactacggcgccaacttcgcggtggccggcgcgacgaccatcgtagcacggctgcctcgcctggaccgacctcaggggcgacatcacacccctcaaggcgagcacggagatgggggggttcgacgcgcacgtgaaggcgcgccaggtcaaggcaggtgcccatcgagcagcctcgccgctgcctgcgtcccgtcggcgcccacccggacgccgaccgccgccagggcccccacccccctccgccggctcccgtccaggggggcggccgtcgtcggggtccccgggctgccgctcaccggctgcctgccgctggccatgacgctggcgcggcccgaggaccgggacaacctcagctgcgtcgcctccgtcaacaagcagagcatggaccacaaccgccacctccaggccgggatccaccggctccgccaggcgcacccgggcgccgtcctcgcctacgccgactactacgccgcccacctcgccgtcatgcgcagccccgccaggtacggcttcgccgagcccttcaagacctgctgcggctccggcggcggcgcctacaacttcgagatcttctccacctgcggctcgcccgaggtccccgccgcctgcgcccaccccgcccgctacgtcaactgggacggcgtccacatgaccgaggccatgtacaaggtcgtcgccggcatgttcttccgcgacgcctcgggcaccttcatccgcccatccttcggctccctgctcgccgccgccaggaaaggccacggcaactgagcgagcgccagcatcatcatcatccaccgcctgacttcagcattcagcagcagcagcagtcttgtggtggctgttgtaattcagttgaactgtgaccatcaccttgttctgaatccagtgtgatttgtgagacagatgtagttgacgctatggcgacgaacagcgaattttaataaagagtatcctagagtttcatcgggttaaaaaaaaaaaaaaaaaaaaaaaacaacaagacagaacgccactcgagggggggcccgggacccccccccccccgttgtgggtc

SEQ ID NO: 1429 - DNA, 802 bp, Triticum aestivum
  Clone ID: PAT_TA_1429
cgagacacccgcaagcgtgagagaaaaaagagcaaagggtgagccaagggccgctgcctccgcccaccaaccgccgacgccccctcgggccgcgcttcgccgccgcagctcccccacttcatcggcctccggagcatcctgccgctctctccaccccgtctcactccctgcgtactgattgggtctccttccttccagctggtcatggcatcagctgtttccatgacttcagtcagtgctcaggccgcttcggtttcaaggccaaggagccatggcatcacaagctatggtggcttaaaggcatcgtcgtcatcagttaactttgaattgggatcctcattcctcggcaagaccgcatctcttcgggcatctgtcaccacaagggttgtgccaaaggcaaagtctgtggctcagatactacctgaggcatcttacaaagtggcagtgcttggtgctgctgggggcatcgggcagccattgggcctgttaatcaagatgtctcctctggtctcagaactgcgcctgtatgatattgcgaatgtcaagggagtcgctgctgatctcagccactgcaacacaccttctcaggtcatggactttactggccctgctgagttagccaactgcttttggacggctggtatgttgttgtcatccctgctgtcatccccgccggggtcccaagaaagccaggggtcacgcgtgacgacattttcaacatcaatgcgggcatcgtcaagtcacttcgcgggcctgtgcccggctgccgccctccggcctttctccatattatcagcaaccc

SEQ ID NO: 1430 - DNA, 1274 bp, Triticum aestivum
  Clone ID: PAT_TA_1430
cgtcgacactttcttgttttcctcgctctctgccgcctcgccggcccccacccgcgggcgcatccgcagtcacactcacacgggttcagacacatcgcctcgcctcggcccgctgttcgccgccaccagctagctagtccagcgccaccgccaggcagcccacggccgcagcaatggcgcgtctcgccaccatcctcagcttcggggaccacgccgaggagggcgccggcgccttcacggagccgcaggaggactaccagcaagaacacgacgacgacgacgacgcggcgtcggacgccagcggcgacagcttcgagttcgcgttcgcgcggccgctggcgccggcgggcggggaggcgctggccgacgacctcttcgcgcacggccgcatcctcccggcctacccggtcttccaccgccgccaggcccacgacgacgacgcctcggcctcggccacctccgcgacggcgccgccctcgccggacacgtactgcgcgtgggcgccgcggtccgcgccggggtcgcccgcgcgcgagccggcggccttccccaagagcgcgtccacgggcacgggcgaggccgcgcgccggttccgcctgcgcgacatcctcggctccggcggccgctcccacagcgacggcaaggagaagttcctcttcctccagcccacccccgccaagcccaagtccaggaccagcgcattgtccaccccgtcagcgccggccgccaagaagacacaggcacagcagaagcagagcaagaagaagggcgccgccgcggctccgacggagatggacatggccaccgcgcaccggctcttctacagcaagcccggagccgcggccggccccggcggcgagaggacgacgacgaaaacgtcgtacctgccctaccggccggctatcgtcggcttcttcgccaccgcgcacgcgctgcgccccaagcaccacccgtactagccatcccatcccgtcccatccccggctccgctgatgccacgataaatcaaatcaaattaaattagttggttaattcgttcttttgtcagattccacgctcccgaaaaaaaagagattcggtcagactgctggttcttgttggtgtgtaaatataaaatcgcgtgctttcttgaccctgaacttgtcaatttccagctactgcacgcaccctatagtttactgccgattgtgaatccatctgttctgccctgtaaattagtcagctaattcacccgagaccaacggtttggtgtagattagtcatcagttaatact

SEQ ID NO: 1431 - DNA, 812 bp, Triticum aestivum
  unsure (1)..(812): unsure at all n locations
  Clone ID: PAT_TA_1431
gcgttcctgccgccacctcgactcctccgtgtctggtgcgccgctggagcacccgtcgcgtgccggcgagctcaccagcgagcagcagccgtcctcctgtcttgcctttttgccgtccttccctgctcctctctcacctctctctgcctcacctccacagggacatcaggacgccgccggcgcgcggaacgaagccgccccaattggatccacgccctccaccatcgcccgctctcctaccgtctatcctcacctcgaatcggtcacgctgatagccgtcgatgccagatcctagcttggccacccgctgaaagatccagcaccctatgccttgcgacctcgcgcctctcaccgtcgagggcggtaggaacgatggagtcgtgcatgtgccggctcctatgtggtgcgtgcagagccaccggcttgagaaacggctgcaggcctggagcgcgccctgcctcgagcagcatgcatgcatggctggcggccgagacatcagaggagcttcagcagagaaacgagtctgccgagccaaatttgctgaaccaggctgccaagtttgagtactgaggaccacatttagaaaattcaaggtgaatgagttcaatcaggtgaaaaattgtaggtcgaacatgaaaggatgcacattcgtttttgaagatgtgcaataacgtttcatgaagcaaacttgagatattctgctaatgataggaagcgtggttgaaaactgctctggctggnagtgtatgctttgtgactgaagactagagactggtgtcacggtgacttgcacgcactcctgatggtcctac

SEQ ID NO: 1432 - DNA, 909 bp, Triticum aestivum
  unsure (1)..(909): unsure at all n locations
  Clone ID: PAT_TA_1432
ggcacgagggcagggccatggagagagagacccatggagaccaaggccaaggacgcatggggcctggcgctggttctcttcctcggccagctcgtggccttctccatggccgccgccagcttcgcctcctccttcctcgccaatctcggagttaacacacctctcacacaatccttcttcgcctacctcctgttgactctgatttatgtgccgatcctcttgcaccgacggcagaagccacggataccttggtactggtacttggcgctggccttcgtcgatgtccaggggaactatctggttgtcaaggcataccagtactcgtccatcaccatgcgtaacgttgttggactgctggaccgttgtatgggtcatcatactcacctggtacgcactgggcacaagatactccttctggcaatttgtgggggcgggcatctgcatggcagggctaactagggtggtcctattctttgtaggcactttcgatgagccagggacctgtgtggctgggctacgcgcttagtgctcctttcagacgcgaaaaactcctagatccttcaggatcctaataaaacaccaatttctaggggatgcccttcgtttattgccgggcgcagtttttgctatttcatttatgcttatgtcgggaaggaagactttcatattagaaacgaagagcctagaagcattggcctggttgccatcaatgatgtgtttgttcgttccatttgcagctgtatttctgcatctatacacctttacgctatttttgcctcaccattattgatcaacatcgttgaatcatccggcattgctatctgcgaattagtcttccccctttccactactctcctantctatatcncntnagcncctanttncccctnaattcnngacntangaccg

SEQ ID NO: 1433 - DNA, 1045 bp, Triticum aestivum
  Clone ID: PAT_TA_1433
cccacgcgtccgctgacatggcgtgcaggccggccgtatccaacccctccgcactcacgccggcgccgcgccgatgcgtcgtccctggccgcagcagcactaggggacgcgttgactgctccctccgctccagctccgcgggtgcggtcagactcggtgcgcgccgcgcccctgccgccgccttcgtcgtccgcgcggcggctgccgagggtgacttggatctccaggctaaggtgacgagcaaatgcttctttgacgtcgagatcggcggggaacgcgcaggcaaggtggtaattggactcttcggcgaggtcgtccctaggactgttgataacttccgcgccttgtgcactggagacaaaggttatggatacaagggctgctccttccaccgaattatcaaggatttcatgattcagggcggtgatttccagaacaacaatggtactggtgggagaagtatgtatggtgaatgctttgatgatgaaaattttacattaaagcatgttggtcctggtgtactaagcatggccaacgctggccctgacacaaatggaagtcagtttttcatttgcactgtgaagacaccatggttggacgaccgtcatgttgtgtttggacatgtgttggagggcatggacgttgtgagggagcttgaatcgcaagaaaccagcaggtccgatattcccaagcagccctgtcgaattgtggattgtggtgagctgcccttggacggctgatgagtaggtcaatagctcagggttcagggttgcctcacatatccttcttttctttctgcggctataatctctggggaaagggttacttgaatctccagccagctagtcgactttttttgagtaaagaaatcttatgagaccttgttttgtttcacggctgtaatattgttgcagggaaaacagtacagtattcatatggtaaactgaaataatgccatgtgtttaaacaaaaaaaaaaaaaaaaaaaaaaaaaagactactcgagggggggcccggtacccaattcgccctatagtgagtcgtat

SEQ ID NO: 1434 - DNA, 1586 bp, Triticum aestivum
  Clone ID: PAT_TA_1434
aaatcctccgccatgaaagccgccgccaagcccaatcctcctccgctgccatcggcggcgacttcgacgcagccgtcgaccaaggcggcatcgtcctcctcctcctccgccgccgatcccaaccccaagcgcatcctccccaccgcggccgacgccgcgcactcaaccccctcgcaccctaatccaaatcccaacggcgcgcccaacccacccccgctcctcccgtccccgcacgtcgcccacctacagcccctgcccccgccgcgcccgctgctcaccgtcgcggcggtggaggccgccatggcatccattccacccccgccgcagtatggtctcgagtgcctcgaccgccgcaccgtcgcgctctccgacggcacggttcgcacctactttgcgttgcccctagagcctacaccgcaactccgccagccgccgatattccctgcgcccgctcgaggccggcccggcccggggtctggccttaacaggtggattccgccactgatgcacgccgtacctcctccctggccgccccagaagcgcaagcgggagggtcagagcaatggtggcccccccgttgagtcctcgggccgccaacaccaacaacatcagaaaccagaggagaggcgtactgcaaagcaggtcaaggtcgagacgtcagagctggatgcgaaaacactcgagagctcctttcttaagatggtgagggtgatcaacgaaaacacggaggtgaagaagaattaccgggccaatggacagatttcccagctgagatgcgttgtctgtaatagggactcgatggacttgcatgcactcctcaatcattcatacaatacgaggaatccagagcttcgtgcagatcatcttgggttgcacaaagctatatgtgttcttatgggttggaactactccatagatcctgtaaacagaaaggcttaccaaacattatctactgctgatgctgaagccaatcgaggagatcatattttatggccaccaacaatcatagttgagaacacatacaagtcaaataacgacgggcaaaaggatgtcatgactaataaagagatggatggcaagctcagagaaatggggttcgccggtgtgagtgtgaagccactagtgggcaaggatggagccatgctagtgacattcgcaagcaacctggctggtctgaaggaagctgtgcggcttgctgagctcttggaggcggaaggccatggacgagcgcagtgggtccacgcccggggcctcaccccatcttttgttgggggcagtaaccccatgtttgtcaaggtggatgagaagggcgaaccgacatgggtcctctatggctatttggccacggcatgggacttggacacgcttgacgcggagttgaggcaaaatgttgtaataaagagcatgaaagagctcgatttatctgagtaggaccccaccctgttacaaggtgtgtattttataagttataaaacggactagtttgtcgacagcgacagccacatttcacaagtttgctcatccttgttaatcatttcatcgactcagcggttttaatgtaaaatcccaaggttggatttggtttt

SEQ ID NO: 1435 - DNA, 1579 bp, Triticum aestivum
  Clone ID: PAT_TA_1435
acgtaccgccccacctccagttcacactcccctcacatgcccatggccgcctccgcctttgctccccctctccgcgctcctcctcctgctcgccgccgcctcccatgcctctgccaagcccgtccagactcaggccctcctcgccacccctctctcgcccgaccgtgtctccgccccgtcggaactagcccgcgaggacgacaccaacccccttgccgctgcagacgacgcccgccgcctcgacagttcgtttccgcgttgtccaccgggcgcgacttctcaaaggaacgccaccgcgcgccgagctcgctcgcgcaccggctgggagcgggaccgagaagacgggcggcgcggctctcggcggcccgccggccgcggccaacggcacgcgtcgcgcctctgccggggcgcgggcggcggtcgctgcccctccgccggggtcttcgccaccggggccctcaccgtcgccggcggtgcccgtgtggcgcgccttgctctggggtggggcgcggcgacgagggtttgatcgtcgtggcggcggcgctccccgggctggcccgcgggagcctcgacttccccacccagatctcccgccggtaggggcggagcttctcgtactgccttgtggaccgtacctcgtcggccaactccgcctcccgctcttcgaccgtgaccttcggctccggcgccctaggctccacgggcgcctcgtccttcaccccgatggtcaagaaccctcggatggagacgttctacacgtgcagctcatcggtatcagcgtgggcggcgcgcgcgtccctggcgggcgaactccgacctccgtctcgacccgtcgtccgggcgtgggggcgtcatcgtggactccggcacgtccgtgacccggctcgcccgcccggcctactcggctctgcgcgacgcattccgcggggcccgccgctgggctccggcgctctcccggcggcttcttccctgttccgacaccgtgctacgacctgagcgcgcccctgcggccgtgacgttcggctccggcgccctaggctccaccgccggctcgtccgaggcggctctgcccccggacaattacctgatcccggtggactcgaaaaggacgttttgctgcgcgctcgggcgcctcggcgccagcgggaccatcagcgcccgcaggccgcggcagggacgcccggcggcgcgcgcccgcgcccgcccgcccgccgcccccgcgcccgcggcctgctgcggcagggtttccggcggcgcttcgtcggcggcggccagcgcggcgccgtcgggcccaagggctgctaggggggacgtcgctggtttggcggtgggtgggaccgctgggtccggcgtaagccctgcccgtggggctcccttagttaaggtgatgggtgagagctttggatgctgtgaaagccctggcggtgcgcagagttgtcgggcagggcagggcagggtgtgaggataaggctgtaaaagtgttggttaaaaaaacaggctatctctccttttctagcatttctcatccattttactgaactccagtggcctttttacgtgctgctgcggactaccgtgt

SEQ ID NO: 1436 - DNA, 808 bp, Triticum aestivum
  unsure (1)..(808): unsure at all n locations
  Clone ID: PAT_TA_1436
cgacaggtcataccagcccggtagagctaatccttgggacacaaagcatgggaccatggtatcccgcgctcgcctcctccgcgctgtcgccctgacggcgcggctgtacggcgaaacggcgcacgcgggcagcggcggcgagcggtgtagcctggagttcttccacggtgactccgccaggtcaccgttccacgaccccacgcccagcccgcccgcccgcggcctggaggccggtccgcggtccgctgcccgcgccgcggcgctctcgcgctcctacgtccgcgccgacgcgccctcagctgacggcttcgtgtccgaggtcacgtccaggacaagcgagtacctggaggcagtgaacataggcacgccgcccaatcgtatggtcgccatcgccgacaccggcagcgacctcacctggctcaattgcagatacggaggcgacggtccggggtctggcggccgcccgtgacgcggacgcgcagccgccgggcgtccagttcgacccctccaaatcgacgacgttcggcctcgtggactgtaactccggcacgtgcagcgagctccccgaggactcccattcctgcgacgccaactccaagtgcacgtacatctactcctacggcgacggctcccaaacgagcggcctcctctccacagagaccttcaccttcaccgacgccccgggcgcccacggcgatgggacgacgcgcgtggccaaagtcaacttgggctgctcacgaccttcgtcggntcgtnccgtcggggacggcatcgtcggccttcggcggcggcgactttctcctcgtca

SEQ ID NO: 1437 - DNA, 817 bp, Triticum aestivum
  Clone ID: PAT_TA_1437
gcacacttcagacgcgagttccacttgcgcgcaccggtgaccggagagcacgagagcgagctgcaggcgccgattgttctagctagctctagctccatggcggcacggcaccggcgccaccacgtcgaggcaccgaagccagcatggctcgtgacgatcaaggctgctccgcctgcgccggcgaggggcgacgctgccaagaagctcgccgcgcccgctcgctcgccgatcctgctgtccccgtcagcatggcagaaggcgcagctcgacaagaaggacgtggccgtcggtgaccgtggcgacaccggggtcgcgccggcgccggcgtcgccgaggatcggctgcatggggcaggtcaagggcacacagagatgctcgagggcacgctgcccggcctcctcgaggggaccggcggcgtcgggcctcccgtgcggcagcctggcggggctgctgatggggctattcgggcggcggtcgacggggaggaagacgcgcgcatactccaaggtccgggacgtggcgagtgacacgtcgtcttcagggagcgcaaggggtgcccgtgcgccgagcccgcttgagctcgacccaccgctgccggtgccggcgccggtggtgagacggccggccttggaagagaacgcccccagcctttgggagcggcggcgcggcggcgcaagggtccctggagggtctccagctagcgtaggatccttcctggtagatcagagttgagttgccgtcgcgtcggctagtgatgccagggcaaattcctgacactacgctaagtacaagatcaggagatcactatctcccccgc

SEQ ID NO: 1438 - DNA, 1487 bp, Triticum aestivum
  Clone ID: PAT_TA_1438
gcgtcttaaaatttctccaagtaatccccacaaatcgaaggcggacgcgtgggcgcaaattcccgttcgcttaccagtgctgtcctcccctgcttgctgcccccccgccgccgccgtttctagggttagcgcgtctgcccctcccttccctccgtcctcggggatggccgagaacacgccggagccggcggccgcccttctgtccagtctcactgtcgcggaggacacgacggcgacgccggccgcgaccgctctcctctccgcccccgcgaccgcggtggtgggcacgccgtcgccgccgccgctgcagctcttcaactcgatgacgaagaagaaggagcccttcgtgccgcgcgtcgagggcaaggtcggcatgtacgtctgcggcgtcacgccgtacgacttcagccacgtcggccacgcccgcgcctacgtcgccttcgacgtcctctacaggtatcttaaattcttggggtatgaagttgaatatgtgcgcaacttcaccgatatcgatgataagattattaaacgggcaaatcaaaatggtgaaacagttactagcttgagcagtcggtttatcgctgagttcctcgctgatgtggctgagcttcagtgcctgccccctactcacgagccacgcgtgacagagcatattgacaatatcatagacttaatcaaagagataatcaagaatgacaaggcctatgttgtagacggtgatgtttacttctccgtcgacaattttcccgaatatctcagtttatctggccggatattggaccataatcgtgctggttcacgggttgctgtcgatacaagaaagcggaaccctgcagactttgcattatggaaggctgctaaggaaggtgagccttcttgggagagcccttggggtgacggaaggccaggatggcatattgaatgcagtgcaatgagtgctcactatttagggcatgtgtttgatattcatggtggagggaaagatttgatatttcctcatcatgagaatgagcttgcacaaagtcgagcagcttatccagaaagtgaggtcaaatgctggatgcataatggctttattaacatcgatgatcagaaaatgtcaaaatcagttaataacttcttcacgatcagagatattataactctgtatcatcctttggcgctgagatttttcctgatgcgcacccattataaatcagacgccaatcattctgataaagcacttgagattgcatctgatcgtgtgtactacatttatcagactttatatgactgcgatgaagtcgtgtctctgcatcgtgaagagaatacatctgtcccagtccctgccccgcggctgggactggttgtggtcctcggtaaagcttttttggaatcaatgtcagatgatcttcgaacgacagatgtgctggatggcttcatggagctgctgaaggcaataaacggcaatttaaatgatttgaagaagctgcagcaaaaactggaac

SEQ ID NO: 1439 - DNA, 516 bp, Triticum aestivum
  Clone ID: PAT_TA_1439
acttcaaggatttttgggtcctcatggcagtctttaggaagaacagcgttgttgccgtgtgcgtgggggctctcatgctcatgaccacccttctctcctcggaaggttcagagtttgttggatgtatggagccccaccagaactgcttcccagatgactgccagaagacatgcgcggacaatattactggaaaaaatgtgaaaggttcctgcgaaccggagcatggcccgctgaaaccgtatcccgcgcttgtgtgttgctgctatagagacggtctccgatcatgataaacatggcgcttaattagtccaccacgggagtgagaccatctgttcgatccacctgttgtatcgaattaataattgaatatctttgaggaaaatcagattagcaaagtcgtgagccacgacaaaaagtacaacctacccgatatgatatatgataattataattctctatgttatagttattgagagaaataataatattgttgtctgcggtgcattaaaaaaaaaa

SEQ ID NO: 1440 - DNA, 795 bp, Triticum aestivum
  unsure (1)..(795): unsure at all n locations
  Clone ID: PAT_TA_1440
aatttccacaaatcattgacccgtttataaacatctgcctccccttccatcatctgcatatcatacctnttttgctcacaagtttgatacccatacctaaacaacacaaaacaacacattcatcatgtctgccaactctaccatcaacgtcaagaacatcgcccccgccactagcgacagcgagatcaaggactttttcagcttctgcggaaagatccaagatctcaaggtctctcaggacggcgagacaaagtccgcagaggtcatcttcgagaaggagaccgccaagaagactgctctcctcctcaacaacacccagctcggcacaaaccaccttgaggtcaccagcgccaccgccgatggcgaagacgatgtccctaccaccaagaacactgatcgcgactcggacgagatcactcaggaggagaagccccgcgcccgcatcctcgctgagtacctcgcccacggctacgtcgtaggtgacgccgccatccagcgcgctcttgacctcgatgccacccacggcgtcaccaaccgcttcttctccaccctcaagggtctcgacgagaagtaccacgccaccgaccgggccaaggccaccgatgagagctacggaatctcccagcgcgccaacagcatgtggctcggcttgagctcttactttgagaaggcctccaacacacccaccggcaagaagatcgccgagttctacaccgagggcagccgacaggtccaggaggtccacgctgaggctcgtcgtcttgccgatctcaacaccgaggagcacgttggaag

SEQ ID NO: 1441 - DNA, 586 bp, Triticum aestivum
  Clone ID: PAT_TA_1441
gcagcttaacggtagcggcggagggagacggtctgtgtgggttgagctgccccatgcacaccttgatagtattcgtttgaaccatcagattttgctacctttgttcggaaactccttgaagctcgtgctagaacctttatgtcgaggcaatatctgttgaactatttgctatttgcctgtgttaccagaacaaggattgaattagtaatcgtatgctgtgtgcaaaaaaaaaaaaaaagggcggcggagggagacggtctggttgcgcttccaggtggctctcctcgagggcctgttcttgtggtggcggtggcccttgccacgcagaccacggaatttctttccggctgacgtgagtccgcgaagctcacggtgcttgtgcacaggcttgcagagccagttgatccttgggtcgttgcggacagcactgtgagcaacatcaacaaggatgacctcaaagtacttgtaggtagcgagtcccttgaggtccagggtttcaactacatcaccctgcacggcggcgaccgccttaaacgccttaccattttcaagaacactgggagggtgaatactggcgggatagaca

SEQ ID NO: 1442 - DNA, 858 bp, Triticum aestivum
  Clone ID: PAT_TA_1442
tttttacttcaatcattcgaattccaggtaacacaggcacatagcaaatagttcaacagacatgcctggaggttcagccacagaacgaaggtagcaaaatttgacggtgcaaacagatactatcaaggtaagcatagggcaggttccacagaacataacagcacataagcttaacggtagcggcggagggagacggtctggttcctcttccaggtggctctccttgagggcctgttcttgtggtggcggtgacccttgccacgcagaccacggaatttctttcccgcagaggtgagaccacgcagctcacggtgcttgtgcacaggcttgcagagccagttgatccttggatcgttgcggacagcgctgtgagcaacgtcaacaaggatgacctcaaagtacttgtaggtggagtcctcattcacccagtaggagttgaggacacgaagaccaccaagcctgcgcccagctctttcctcagcaacagacctcttgttcctctggaacttgagttgggtaataccctggtgcttaggcttgccataaacaatacccttgggcactgggcgcttcctgccaccacgtctcacacggatacggtagaccacatacccctgcttggccttgaagccgagacggcgtgccctgtcggggcgggtgggcctggtgatgcggacgatggcgggctgctgcctgtactcccagcaacgcacgcgctgcacgaacctcatcacgtcggactgcttcctcctccatagctccgacacgaacttgtacgcgcccatggctgcggctgcggcggcagagggcggaggcggcgggaaacggagtgtggtgattggccgcccggccgccggc

SEQ ID NO: 1443 - DNA, 1518 bp, Triticum aestivum
  Clone ID: PAT_TA_1443
aaaaaaacatcaaagcattaaaacaataatcagcacacatcgttaaggattacttaaatcattcgaatttcaggtaacacaggcacatagcaaatagttcaacagacatgcctggacataaaaggttcagccacagaacgaaggtagcaaaatttgacggcgcaaacagatactgtcgaggtaggcataggacaggttccacggaacataacaacacataagcttaacggtagcggcggagggagacggtctggttcctcttccaggtggctctccttgagggcctgttcttgtggtggcggtgcgcagccgagccatgggcgcctacaaggtcgcgcaggactgagaaagaattcaaccgaacatgccgagttcgcacaatgccgtcgttgccagagactacaggcgcgaacaggcccgtgtcggacatatccaggcggcaccggcccagaatggggtcgttggtacagcgcgaggcataagccgggataggacagcagccggccgtcttccggacaagcaggctcgacgggacccgtacgggggcaagcggtctgtgcttcatggccactcgcgggagtgtggtcccccgctctccgtgtcaggcgagatttcaggcgcagacgagggaagaaggatccagcccacgggactgagtcggacacagcgtgaacttgcccacgctacagttcctgaagaaacgaggtggtcccttggatgcagcaagaagctcaccgggcagcacgctgagaccaatgtggtcaggtccgtaccaggcataactgggctaggattcccgtacacaccaacgttgacggtcctcgggctcacgtctgtccgaccagacgcctgccacccagaccacctgagtatcttctgccggctactaggtccaggccgcgcagctcgactggtgctatgtgccccgggttgccgggccagttaatgcccttatgcctcatggcggacagcgctgtgagcaacgtccagcatggatgaccatcaaagtacttgtaaccggtggagtcctcattcacccagtgggaccgttgaggacacgaagggcccaccaagccctgcgcccagctccttccgtcagcaacagacctcctttgttcctctcggaacttgagttgggtaataccctggtgcttgggcttgccataaacaatacccttgggcactgggcgcttcctgccaccacgtctcacacggatacggtagaccacatacccctgcttggccttgaagccgagacggcgtgccctgtcggggcgggtgggcctggtgatgcggacgatggcgggctgctgcctgtactcccagcaacgcacgcgctgcacgaacctcatcacgtcggactgcttcctcctccatagctccgacacgaacttgtacgcgcccatggctgcggctgcggcggcagagggcggaggcggcgggaaacgggagtgtcgtgattggccggaatggggcgggaaggggggccggttggccgaagggccccccccatggctg

SEQ ID NO: 1444 - DNA, 904 bp, Triticum aestivum
  Clone ID: PAT_TA_1444
cgtccgcacgctccccctccccgccgcctccgcactctgccgccgcagccgcagccgcagccatgggcgcgtacaagttcgtgtcggagctatggaggaggaagcagtcggacgtgatgaggttcgtgcagcgcgtgcgttgctgggagtacaggcagcagccggccatcgtgcgcatcaccaggcccacccgccccgacagggctcgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaggctgggtggtcttcgtgtgctcaactcctactgggtgaatgaggactctacctacaagtactttgaggtcatccttgttgatgttgctcacagtgctgtccgcaacgacccaaggatcaactggctctgcaagcccgtgcacaagcaccgtgagcttcgcggactcacgtcggccggaaagaaattccgtggtctgcgtggcaagggccaccgccaccacaagaacaggccctcgaggagagccacctggaagcgcaaccagaccgtctccctccgccgctaccgttaagctgccccatgcacaccttgatagtatttgtttgagccatcagattttgctacctttgttcggagactccttgaagctcgtgctagaacctttatgtcgaggcatatctgttgaactatttgctatttgcctgtgttaccagaacaaagaatgaattagtaatcgtatgctgtgtgctatggtgtcatatgtttggtggtttaccttataatgttatgatgtttttc

SEQ ID NO: 1445 - DNA, 1140 bp, Triticum aestivum
  unsure (1)..(1140): unsure at all n locations
  Clone ID: PAT_TA_1445
ggttaagaaggaacctcacatctccaagcccggcggcccgcaccctgccaagactcaagacaccgccgtcgcccctcgtcgccggcgctccaccgactcgccgccatggcccccgccaagtggctgatgcactggcacccgaaccctggggtgacgctcaacacccagatcctgtcggaggcctgcggctgcgcggagtccctcggcggcaccaaggacggccgctggaagacctccatcatcttctaccgcccgatgacgcgggacggcgcgggcggggcgcagcagaacctgccccccgacgtgccccgcgagctcctcggcgtcgcgctccacgagcgccccgggctctacttctccatcctccggaaccagcgcctcgtcctgcaggcggacgctgccttctcccaggtcatggagaagctccagtccttcaaggcccgcgtcaacctcaacttcgagggattccagtatcaactgggtgacttttgcttgaggataggaaaatgtgttcctaacaatactgaaacactgagaggaatcatgatggaggtagagtattaccccctgtcttccatcgaaaagtccagggcaattatggtagacttctttgacatatggcaggaaacactcgccaagaagtcgctgcctggtcgattcatccatgtcgaatctaattttgcagagtatggcctttcagaccattactctttccagcacaccgcagttcagtacgctacctgcttgcaacaactaatggcagctgtgagggcttagatctgaagatgaaagtttcagaatatcatgatgtttaacgtgttcccaagatcatgataacatcaacgtatgccaggacatgtatcttatgtgctgaaatgtaatcaatttgtacgttcttcgcggctaagtatcccttcctctaccatgtttgagatgttaacgtgatttatttgcaaggaatagcaagttgtaatggtcatctgagggaccgagtagctgtgttttatgttctcattagctcccagtagatgctgctgggtaatgttgttgtacaatgtttttgaacatgaacatctgatgctgtagtaactatcatgggtgtgtatctggctatattttacaacttttttangagactat

SEQ ID NO: 1446 - DNA, 587 bp, Triticum aestivum
  unsure (1)..(587): unsure at all n locations
  Clone ID: PAT_TA_1446
cgcgcgcagggacagtgaagggatcctctgccatggccagagcggcggcacccttgctccccttcttcttcctcctgctgtcctcgacatcgccggcggccgcccagaagaatcgccttggccggactccccagatggggtggaatagctggaaccacttcggctgcaagatagacgaggtgataatccgaaaaatagctgatgccatggtggatactggtcttgcgaaactggggtatgagtatgtcaacttagacgactgttgggcatctcatgacagagactcccagggcaatctagctgcaaatggaacaacatttccatcaggaatgagggccttagcagattatgtgcatgggaaagggctcaaactcgggagtctacggcgatgcaagactgcgaacttgcaggcatgctacagcccggttcgctaggatacgaagaccaagatgcgagaactttggcagcttgggggaatgactactttaagttatgacaactggcaacaaacaaaacattaagcccactaacaagattttacnaggatnagttgnaaccctttatnaattctggnaagggnctttttn

SEQ ID NO: 1447 - DNA, 176 bp, Triticum aestivum
  Clone ID: PAT_TA_1447
cggacgcgtgggcgtctacacctccggcctcgacgaggacgaggagtccggcggcctctcgctctaagccatagtcttctcgtcgtctcatgtaatccgctcgcgagcatcgccatgatcggtgtaatgtaattccagagatggatatttgtatctaagcgtttccattctgagag

SEQ ID NO: 1448 - DNA, 644 bp, Triticum aestivum
  Clone ID: PAT_TA_1448
caggccgcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctttaagctacacatagtttcctcgtcgtctcatgtaatccgctcgcgagcatcgccatgatcggtgtaatgtaattccagagatggatatttgtatctaagcgtttccattctgagatgtttcgccgtcagatggtttgctcgccccgccttgaagactgcgtctcgcgacttggatgaataataaaaacatccaaggaaaatttcacgcacgcacagataggtccaagttctcagtaaaattggtgatctgtgatggtatgtgccattttggccatatagttcctttgcttttaagtgtaaaaacaaa

SEQ ID NO: 1449 - DNA, 1408 bp, Triticum aestivum
  unsure (1)..(1408): unsure at all n locations
  Clone ID: PAT_TA_1449
ngaatacangacggaaaaaaaaaaaaaaaaaaaaggtttgcgcttggggcaatgaagtgataccgaggcgcgtcaattgctggttgaaaactatttccaaaccccctctttggccctccggggccactgaattctgaaagggctcctttcctttggggaggccggaccgcccagccaagcaagacccgagcaagccacactctccagcaccagcaggacgaggagaggggggagaggcgccacgccacactctgcagcaccagcaggccggcggcaagcagcgcaagcacagcagcaaatgcctaccatcagcgccgccgcggcggccccgagcgtggcacatgctccagcaccagcaggccggcggcaagcagcgcaagcacagcaaccaaatggccaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctacacatagtttcctcgtcgtctcatgtaatccgctcgcgagcatcgccatgatcggtgtaatgtaattccagagatggatatttgtatctaagcgtttccattctgagttacaccgtctacacctccggcctcgacgaggacgaggagtcggcctctaagctacacatagtttctcccgtcgtctcatgtaatccgctcgcgagcatcgccatgatcggtgtaatgtaattccagagatggatatttgtatctaagcgtttccattctgagagatgtttcgcggtcagatggattgcttgccccgccttgaagaccgtgcgtcccgcgatttgaatgaataaaacatccaaggaaaatttcacgcacgctcttggggaccatgataccagaagcaattgtcttaataaacgttaggttcttagacagtgagctataggtttggtttgtagaaggatcagacagaaagttatcaggaaagcgaaacacaagctttgttctgccgcgaactcttttagatatgcttttgaggaaacctatctcaggtgatgaaatatacttcacagagacactctttaggatggaaactccacggggggcgcggtgaccgcgttctggg

SEQ ID NO: 1450 - DNA, 609 bp, Triticum aestivum
  Clone ID: PAT_TA_1450
gccggccggttcgggagaacgctcgtcaagcgcaactggttcgtccgtcgtcgcgtaccgaatctccaccatcccccccgcgcgccgccgcctccgcctccgccctcgacgatgggtctctgggatgccatgtaccgcgtggtgatgcgccgtaacggcgtgtacgtcaccttcgtcgtcgccggcgccttcgctggcgagcggctggtggactacggcgtcaacaaggtctgggagatgaacaacgtcgggaaacggtatcaagacatatcagttctggggcaaaggccggttgaggagtgaagacattgaagcccagatttcccatgatcttttaagtgaaattaggcaccttataaagctccatgttttggcattttcttttggcacaataatattgtaaaactcttgctgggtgttattcactctctttgagcactatggcacccatctgttccacagcaaagtgattgctatgtctggtcgctctggaaccagttcaatactattcaaattatgaattgaacttctttctaatgcttcatatgtaattggcatgctgttgctcgtctcttttggacaagctaatgaatatttggttgatatacg

SEQ ID NO: 1451 - DNA, 833 bp, Triticum aestivum
  Clone ID: PAT_TA_1451
gaaacgcccctcaagcccacctggttcgtccgtcgtcgcgtaccgaatctccaccatcccccccgcgcgccgccgcctccccgtcggcgcgcgccgaatctccacgatcccccccgcgcgccgccgcctccgcccccgtcaacgacgcaactggttcgtccgtcgtcgcgtaccgaatctccaccatcccccgcgcgcgccgccgcctccgccgtcgacgatgggtctctgggacgccatgtaccgcgtggtgatgcgccgtaacggcgtgtacgtcaccttcgtcgtcgccggcgccttcgctggcgagcggctggtggactacggcgtcaacaaggtctgggagatgaacaacgtcgggaaacggtatcaagacatatctgttctggggcaaaggccggttgaggagtgaagacattgaagcccagatttcccatgatcttttaagtgaaattaggcaccttataaagctccatgttttggcattttcctttggcacaataatattgtaaaactctcttgctgggtgttattcactccctttgagcactatggcatcaatctgttccacagcaaagtgattgctatgtctggtccctttggaacaagttcaatactatccaaattatgaattggacttctttctaatgtcttatatgtaattggcatgctgttgctcgtctcttttggacaagctaatgaatattttgttgatatataaaaaaaaaaaaaaacacaaaaaaagcgctacaattcccccagacgatccacccgcccccatttaccccggttaatccctgtcggtagcctggctaccacttatccctgacaac

SEQ ID NO: 1452 - DNA, 478 bp, Triticum aestivum
  unsure (1)..(478): unsure at all n locations
  Clone ID: PAT_TA_1452
cggacgcgtgggcaacatacccggcggctagaacaacgaaactgggagatcttctcgtcgagtagataatcgatggcgtcggcgcttcgttccgcggcgagaaagatgtgcagccgcgtccttcagcgagcaccgcatccgtatttgtcggcgagcgcctcagcggccgtcaaggagggacagcggcggatcggccatgccgggagctcccttcgccgattttgctcctcaggatcacctaatcttgttaataacaccaagcatggagtgcaatcagccgcggaatcagcttcgttcatcagtaatgcggaatacacaccatggtggtcagataatcaccctaagtttctacgcaacatatttctgtatacagtcgcggttctacaggaaccgttgcaacgccttagccgtggcccgtatcatggggggccttttccaggggacctttgggtggggcccttcccacaccacgggatcn

SEQ ID NO: 1453 - DNA, 782 bp, Triticum aestivum
  Clone ID: PAT_TA_1453
agcattctttctttcccgagcatccatctcatcctcaaatcgcatctccggcagcagcaccgtcgagggccaccacctctgcgcgccccgcgcactcggagcttctcagccgcttcccatccattttatgccgccgtcggctttctccggcgaactcatccccttctctccttacaagtcatgcccaacccactattccactcctccgtgtcagcagtggagggggttggttgcccaaagcgactggagacagggggctgtgcgtgcacgcgatgggcggcgagctctccagatttttgctggatgccggcggtgctaggtgatgacggcggcgagccggagccgaggacgcaaggatgttgcaaccatggcgaccacacgctggaaccggctgtcgtcaaagctgcatccattgtgaccacaccctgtgacccatcggcggtcgtgctgcaatccctgtggccacgagtgggggacatcgccggtgctcgtcgggccacggccctggccccagccccgacggcagggcaaatactagttttgagatttggaagcggcaagccggggacggcactggtctctctcccccttcttttttcctctctgcttttgtttttcctatgaggtggtcgaaaaaaccgcatcggacagtttaaaaaagtctaatcgtgtggtggtgcgtcgaccggcccaaatttcggccgacgtgccggcgcctatcatcgcccattatgtacaactctcatactttaagagcaactccaatggcggtgattgatccc

SEQ ID NO: 1454 - DNA, 849 bp, Triticum aestivum
  unsure (1)..(849): unsure at all n locations
  Clone ID: PAT_TA_1454
ttttttcttttttttttaaggaacttgcaatagaatttacacctgataaccaaacaaacaacaatattttagagaccttaatcccattngggtggtggattatccccaaccatattaaactctacatcgtatgaataactacagaaaaaattgtaaaaccaatctggcatataactaattgtacgcataaggggctagcaggttgaagctcggccaagagtggaagtttacgatgacgaagcagttgttgtctttgctcctcctgttcactgactgaagctctcatagcagcggacgtttacagcgacgcaagagatgttgtctacgctcctcctattcaccagttgctccgtcagatgcttcgcagctgcctgtccgcccctccggtgtgagcgatctcagctgcaccctcgtggttgctccgcactgcaataaatcaatagttctgatcagaacagcgcgtattgatcaacgatcatcgggtccttcacattgctggccgaccggcatgatggctgacttctcgcaggcgatcaagagaatcagcacgaggcataagggtatgcggctgcttcgggcaccggaagaagaggccattgttgagcgttgatgatgagagtggctgcaactaaaatctgaattgtatgatgcatggttacccaaatcgacatttagtaaagtacaataagaaatataaatttaccggaaagaaatagtttgtggaaaatcaaaatgagaattcaaagcagaagatttacacatgacgatgacccatgttaattaagttgtataaagcagcaacattaacatgagagtagcctagaaagtataaatttatcatacattggc

SEQ ID NO: 1455 - DNA, 1161 bp, Triticum aestivum
  unsure (1)..(1161): unsure at all n locations
  Clone ID: PAT_TA_1455
caggcgacccactccgccaactgccggtcgattcacgttcactgcgagggggaggaggaggagcaggacggccaacccctgcgcgagccgagcctagaacagggcttctgcggtggctaatttcgggaggtagaagagggaggaggagccatgaacggtggtagcaagcaaacgctgatatacagcttcgtggccaagggctccgtggtgctggccgagcacacggccttctccggcaacttcagcaccatcgccgtgcagtgcctccaagaagctggcctccgaacagcacaaggtccacctactcctgcgatggccacaccttcaacttcctcgtcgatggtggtttcgtgtttcttgctggttggccgaagagggcactgggaaggagcgtgccgtttgtgttcctagagagggttagggaagacttcatgcagcggtatgggtccagtatcgatgaggagggacaacacccgcttgctgatgacgcggatgaggacgatttcctgtttgaagaccggtttagcatcgcctacaatcttgaccgggaattcgggccaaggttgaaggatcacatgcagtattgtattaatcatccagaggaaattagcaagctctctaaggtgaaatcacatctttcagaggttaaagggatcatgatggacaacatcgagaagatattagatcgtggcgagaagattgaacttttggtgggcaagaccgaaaccttacagtcgcaggccgacagcttccataggcatggcagagagctcaggcgcaagatgtggcttcagaacctgaggtttaagctgatggtcggtggtggcatcgcgtttttgatcctcatcctctggctaatggtttgcaggggcttcaagtgctagagagttcagagtcttcattcgcccttttttccttgtcatttgatgttctgtttaccgtgtcatgtgcatataatgaccaccaaattatgctttcgctatgttccgaacacagttatgtggtgtgagacccttaattcctcatagaccatccttatgttccataagaccatagggatctggagtacttgtgtaagctttatgagagagggggacgtcactcgattatctgtacattctgaaatgcaagcttattgcctggacctacgttcaggccacn

SEQ ID NO: 1456 - DNA, 467 bp, Triticum aestivum
  unsure (1)..(467): unsure at all n locations
  Clone ID: PAT_TA_1456
aagctcccnttctgttccncacccatctggtgatccacacataaacacgcacgcactgatcacgcgccacgctcgcagacgcggcgatgaagaacaacaaggcggccttgctcttggccgcgctgctctcgctgctgatgatctcttccgctgccggcaaaggtgctccagtccacaacactctgaaagaccatgacatgatcggcctctcctccacattggaggatgctggccatggcggcttcgcccaatcggaaggggtcgccaccgtgaccggaccaacgtcgcttcctcctttcaatccagcttcttccaaggcagcacgcggcgccagcaagctccattgaacttcactctttgtgtaagggacaaccatatgtatgtgaacatgcgtgtacttggattttaatcatggaataaagctgtgcttaccacgtggcacacgtggtaaacaaccctcttttttt

SEQ ID NO: 1457 - DNA, 702 bp, Triticum aestivum
  Clone ID: PAT_TA_1457
aaaaccgaaaccagtggaggaagaaaagaaaccatgtctccacccacccccgacctatctgcgcactccaccacgatccccacacccatcccccaccttcgctgcagtgctgccggccgccggatccgctgccacacccgcgtgtgctgccggccactggagccgccgcccacacccacgcacacaagccccgacgatctctggccatgagcgccgcaccgccgccacaaggctccggcgacctccggccctatgcgccgcactgccgccctaaggctccaacgaccttctgccctgtgcgccgagctgccgctgtgccgcctgtccatgcctccatgctacccacgcgcccaccaccatctccgcgccaggatcctgtgcaccgcgctgtcatctccggcgtgtctccacctacgcacgtcccaactcggcgcccccgcacccccatctcttgcgcgccgctgcctacggctgggatctcgcacctgcagccgcttctccaccacaaccccacgagctgcagcacagcgacggctgtcgtgctccatctctcatccatttcttccacacatgctccaaacatacctctatctctctttgtccctgttcgtcagcaacaagcatcagttgtttcttgttgtttgttttatgacctgctcactatattgtatgatccaaaggatttgatgtaccagcaatcac

SEQ ID NO: 1458 - DNA, 389 bp, Triticum aestivum
  Clone ID: PAT_TA_1458
atttcaagtcgcggacacacgccgctagcccgcttgctataattcctagactagacgcctcccggcgatgtactcctgcaacgaccgagaccgctcggctacggcggcgcgtatcatggagtccagcgccaagtaccagccatgcaacacggcggcaacgcggacggccggcggccaggtcccctcggacgcgcagccgtccccgcggcgcgccaggaggaagcacccggcgtcggcgtcgcgccggtcgtccaccaccgtggtggcgaccgacgtgtccaacttccgcgcatggtgcaggagctcaccggtttcccgccgggcgccatcttttttttctgcctcgccgggcccacgccgtcggccactcgctgaccgccgccgcgcat

SEQ ID NO: 1459 - DNA, 2215 bp, Triticum aestivum
  Clone ID: PAT_TA_1459
ggttttacgtgtctttgtgggatgcaaccggcaagatacaacagcagtgcagtgacttcataatgacgcgaaacatccaatgccgtgaaatgatcgaggatgtgcaaagaaagttagcaggtttcaacttgtcgtcttccagccacaacactaacacgccgaggagctcttccgttccaccggatcagcacagtccatcaccaccgccacatgctcctcatgctcagtcctcgtacggtgctccacctgggggtgacccgaggccagtttactcccaaccagagtcaagacctccgtactcacagccataccccacctatggtgcaccgccgcagcaacctccatatggcgcagcacaccatggtcagtaccagcagcacccgcagcagcatcagccacctcctggccatgactatggccaaccggcgtatcccgggtggcgcgggccgtactacaatgggcagcagccacagccgcagcaaccagggccgtatccacaagcaccgtacagtgccccaggcgcgtaccctcctcatcaccagagcaactactacaggcctcaatgaaagaccatcttggtctggaggaacgatttgttctcttaatttttctcgcggatatgtgtccttgtggattccattcttgtgtatactggcatactggttacgagttccggtggagtaatgtcaattgtgctcgggttggttaggcggtagcctgtatgatatgtacgtgtaataatgcaattggcgtgccattgcttggcttcagtattggaagatggaaatgaggaacgattacttttttcggaagtcgatggactaggcctcaatcaagcaccctaacaaagaacattcaagaccgattgaatctttttgctggtaatcttaaaaaagcggctgcgagtgatgctttgatcgaacgagatgtgaaggagagctaccccttgatgtctattcttgacagaagaccgatagaatctgcactaccaagtatttcaaggcctatcatgtccttggatgggaatgaagatgctatcgttggagcccttaaacaaagcttgaggcaactggaatctcttggtgcacaaagggcaggccttgaagaccatctcaaggaaatgaagagaaaggatgatatactccctaagttgatggctggtgttggagcacatgatgatctttttaggaaggagattgcgaagtacgatcctatctgtgctgaaattgctgataacattgtagcacaggaacaattattgttgcaaatacaggaacaaaatgcgcaatttgctgctgtattcaatctagatgattacaaagttgctcgtgagagatgttacaagcaaattgctgcagctgttgctaaataccaggcaattaagaagaacatgaatgacggcctaaatttttacgtgtctttacaggatgcaaccggcaagatacaacagcagtgcagtgacttcataatgacgcggaacatccaatgccgtgaaatgatcgaggacgtgcaaagaaagttagcaggtttcaacttgtcatcttccagccacaacactaacacgccgaggagctcttccgttccaaccggttcagcacagccctccaccgccgcctccgccccctgccccgtcccccctccgggctccacctgggggcgacccgggccctgtttactcccaaccagagtcaagacctccgtactcgcagccataccccacctatggtgcgccaccgcagcaggcctccatatggcgcagcacacctggtcagttaccagcagcacccgcagcagcatcagccacctcctggccatgactatggccaaccagcgtatcccgggtggcgccggccgtactacaatgggcagcagccacagccgcagcaaccagggccgtttccacaagcaccgtacagtgccccaggcgcgtaccctcctcatcaccagagcaactactacaggcctcaatgaaagaccatcttggtctggaggaacgatttgttctcttgatttttctcgcggatatgtgtgcttatggattccattcttgtgtatactggcatactagttacgagttccggtggagtaatgtcaattgtgctcgggttggttaggcggtagcctgtatgatatgtacgtgtaataatgcaattggcgtgccattgcttggcttcagtatttggattatggaaatgaggaacgattatttttttcc

SEQ ID NO: 1460 - DNA, 2350 bp, Triticum aestivum
  unsure (1)..(2350): unsure at all n locations
  Clone ID: PAT_TA_1460
ggaagcacagccacttatcctgaactccccctgtagaaagtccaagctgccgccgcggcccgtgtccggtgtcttgttaacctccgccccgacccgtccggcgtgtcccttgcggcagtgaggcggtccctatcgtgtctttcttgcctcaatcccttgccggtcagcggtattgcttcccttcctgatatcccgtctggctttcttccacgctatgcatcagcggttgttgatctggctcgcggctgccgccatgcgcaagcaacatagccacgctgcggtgcaacgagattgccgccatccgcgacgcccatgacctgcttctagctggactcggcagtgcctacactcgtgacgatgtagaggcaacatgcgttgctgtttgcatggttctagtccatttgaaaactgggaggcgtgtgatcagggaagacaaccacccggaagaagaattcgaagcgggctgagatctataaggaaactgaagatgagtgtttgctgctgatcgagttaaagatctaagtcttataggtttctatttgtatatataatatgaagctctgttttggtacacacctatatttaaaacatccccattttcaaaattgcaaaaatccctcgtggttctttgctcctgatccacacaaactcaaacacctcacaaatttgaccttatatagtttgtgctgtcctcagaggtgtaacttttgatgaagtcagatacaacagcttcattgatcttcaagacaaactccatcaaaatatttgccggaagaggactcttgttgctattggcgcccatgatttggacactctacaaggacccttctcatatgaggctctaccaccgcaggaaatcaattttatcccactaaagcaggagcaaagcttcagagcggatgcattgatggagttctacagatcggacatgaagttgaagaagtttttgcatataatcgagaactctccagtttacccagttatatatgatagcaacagaactgtattatcgttacctcctatcatcaatggtgcacattctgctatcacccttaagacaaggaatgtgtttatcgaatgcactgctacagaccttacaaaagcaaatattgttctgaatacaatgggtgcaatgttctcggagtactgtgaaaataagttggtggtggaaccagttgaagtggtatcttatgatggaagcacagccatttatcctgatctttcatgttataaaatggaagttccgctctctgatattgttggacccattggaatctccctatatgagacgcaggttatctcccttctgaacaaaatgcaattgcaagcggaactttgttcatcaaatggggagccttgtatttcagtgtctgtccctcctacaagaagtgatgttctgcatgctcgtgatctagcagaggatgttgctatagcttatgggtacaacaatgtgccaaaatcaaagccaaagtctatgacaataggtggaaggcaaccactaaaccgtttctctgataaaattcgtgctgaggttgcaagagctggttatatggaggtgctcacatttgttttgacttcacacgaagaaaactttgacatgctaaacaggacagacgatggaaataaagcagtcattattgcaaacccccgtacttctgaatttgaggttgtaagaagtagtctgatgtcatgtttgttgaaaacgctgaagcataatatagaccatccaagacccataaagatttttgaagttggtgatgtagtgtcattggatacttcacgtgatgttggtgcctctaataatcgccggcttgcagctttgtactgtaatagtaattctggatttgaggaaattatgggtttggtggataggattgtcaaaatcgtgagagctcctcacataaatttcggccagacttactatgttccttcaagtgaacccgagttctttactaaaagacaatgcaaaattgttatgagtgatggaaagcaggttggctacttaggaattgtccatgctgaggtgctaagaaaatttggcattccggacccctgcactttcgttgagattgacattgaggctcttttgtagttgccatgtatatgaatcaggggattcgcccattggttttgttcacttggcagtttggcaggcgtgtggtatctcaacacaacaggaccctcattttagtttggacaccacatgctcaattgtagtactagctcacattggtgcttgcatgtttttgagtctgaaaaaggaagaaatatcatgatactgtagatgcctctcagctttttgtgagtgaaagatgtgccttactttgtttccgtattgatacaattaana

SEQ ID NO: 1461 - DNA, 599 bp, Triticum aestivum
  Clone ID: PAT_TA_1461
acacatttctatgatggaggtacccttggtggattcacatttgattcagctggagagggtgataggcttcatgaacttaacgcttctcagaatgatccaaacaatgagaatgaagatcaacctaaggggaaaaccaaaggaaagcaaccgtgaagccagcggcaaagggacagaagaaggcaaaggttgctaagaagggaacaaggaaaacccaaacaacgaagagagcgaagaaggcaaagaaatagttacttgccgaagaactggggtattcactctgaactagtttctgaaatagtaaggatgaggattcactctgcactgacacaacgaagcgatgccctataactgatccaggtttggatatagggtagctgttggtgagcccacatgttacatgatctgggctaattttatttttttgactgaattggtgtaccatgttgtacttttttttaggaagacaagggggaacacagtgttgtaatgctaataccatatactgtgtactggtagttagccaattcagtatcgagaaatcaaacacttcatatttgtttgtaataaggagatgtgccttgttatgcatgtgcagtgat

SEQ ID NO: 1462 - DNA, 686 bp, Triticum aestivum
  Clone ID: PAT_TA_1462
acagaagcaaagatagaggctatcgtgaatgacttcattcagttggaacctcattccaatttatttgaatcagagactatgatggaaggtacccttgatggaattcacatttgattcagatggagagggtgataggcttcatgaacttaacgcttctcagaatgatccaaacaatgagagtgaagatcaacctaaggggaaaaccaaaaggaaagcagccgtgaagccagcggctaagggacagaagaaggcaaaggttgctaagaagggaacaaggaaaacccaaacaacaaagagagcgaagaaggcaaagaaatagttacttgccgaagaactggggtattcactctgaactagtttgtgaaatagcaagggtgaggattcactctgaactgacacaacgaagcgttgccctataactgatccaggtttggatatagggtagctgttgctgagcccacatgttatgtgatctgggcttattggtgtaccatgttgtactttttttaggaagacaaggggaaacacagtgttgtaatgctaataccatatactgtgtactggtagttagccaattcagtatcgagaaatcgaacacttcatatttgtttgtaataaggagatgtgccttgttatgcatgtgcagtgattccattgtattcgtaatgtgttccaccaggtttatc

SEQ ID NO: 1463 - DNA, 830 bp, Triticum aestivum
  Clone ID: PAT_TA_1463
aggactccctggtcaacgcaatccccattcccaaacacgcaatcgcgaacgccgcgagcagagcgggagcagccccaccgcggcagcatggcagcgccgccgtcccactcgttcgtctacatcgacgccgaggcgctccacgccgtcctccccttcccgtccctgatctcccacctccgcgcgggtctccccgccttctccgaggacatccactgcccgcaccgcgtctccttcccggtccccacctcgccctccgcggcgctcctcctgatgccctcatggtgcgctcacccctcgctcccctacctcgccctcaaggccgtcacctccttccccgccaactccccgcaccgcccctccatccacgccaccgtctccctcttcagctccgcctccggcgtgcccctcgcatccgtcgaggggtccgcgctcaccctcctccgcaccgccgcggtctccgccctcgccgcctccctccttgtctccccctcccggcccccctccaccctcgcgctcgcgggtgccggggccctcgcgccctacctcgccgacgcgcacctgtccgcgctcccctcactctcccgcatcttggtatggaaccgcaccaaggccaagtccgccgcgctcgtcgccaagctccgggacgcgcacccgggagtggccgtcgaggaggtcgacggcatggacgaggcagtgtccgcggcggacatcgttagctgcgcgacggggtcgcaggagccgatcgtgcgtggggagctgctgaggcccggggcgcacctttgacctgggtggggtcgttcacgccggcgatgcgggagtgcgacgacgag

SEQ ID NO: 1464 - DNA, 1234 bp, Triticum aestivum
  Clone ID: PAT_TA_1464
tgttgttgagccaaggtcgaccttcctggtgtcggtttgaacttccaggatcattacatgaccttctctgtctaccgggcaaaggccgaaaccgagagtttcgacgacttcgttcgtggagaccccgaagttcaaaaaaaagtatttgacgaatggaatttgaagggtactggaccgcttgccaccaacggtatcgaggccggcgtcaagatccgacctactgagcaggaactcaaggagtaattgagaggtggcccactcctcatttcatcgacggatggaagtcctacttcaagaacaagcctgacaagcccgtcatgcactactctgtgattgctggtttcttcggcgaccacatgcttatgcctcctggaaagttcttctccatgttccatttcctcgagtaccccttctctcgtggattcactcacatcaagagtgctgatccttatgacactcccgattttgatactggtttcatgaacgatgagcgagacatggttcctatggtctggggatacatcaagtcgcgtgagactgctcgccgcatggacgcatacgccggcgaagtcgagaacatgcaccccttctttgactatgcctgtcccgcccgtgctcatgatctcgacctccagaccaccaaggcatacgccctccccggtaaccttaccgctggtatcggccacggaagctggtcttctcctctccccgaggcagaccgcttgccagccgccaacatcctcaactccaacaaggctcatatccgagaggagctcaagtatagcgagaaggacatcaaggctgttgaggaatgggtcaagcgccacaccgagtctacctggcactcccttggaacctgctccatggctcccaaggagggcaacagcatcgttaagcacggtgtcctcgacgagagactcaacgtccacggcgtcaagggactcaaggttgctgatctgtccatctgccccgacaacgtgggctgcaacacgtactctactgctctgctcattggtgagaagtgtgctatgcttgttgctgaggacctcggatactctggcgaggctcttgagatgaaggtccctacttaccaggcacctggtgagtttgtggtccgacaccgcttgtaagggatgaatgagatattttgcgacttgatgtcctgtttgacggccaagattggatgtagccgatctaatgtcagtttagcgattaatttatttatgttgatggc

SEQ ID NO: 1465 - DNA, 677 bp, Triticum aestivum
  Clone ID: PAT_TA_1465
cgggctgcagggcacgcggcagaaacaaattcttcgcaccagcgccgtcgagcgagagagagatacagagatgacgtcggcgatccgctccgctgcggcgctccgtcagcggcttccacgcctcctgtcctccgccaccagatctgtgccgcgagcgcttgaggaggagcggcccctcctggtccggcgcgccggcgggcctgccatgggagatcctcgacttttcagctccagttccgccgggaagtcctacacgcatccttgtaaactcaacctgcggcacaaaaagcaatccctggaggacagcttggcataccttaacagaatggcgaagaaggaagctcgtgactggagagagatgagggaacatcttgaagcatcggagcaaagacaaatagagctcgagaaagtgtacaagcgacaggatagggtggtaaattgtgccgctgccactctattccttgccttgttagccggcaatgtgttctttggttgagtcaggaagagaaatgggaaaaggcaattaggcctctaagttagtgtatattagtgttatatgagttttggctaattcttacgcttaagttgtggatctgttttcttggggtcctaagttgtggacctgttttctggtgtaaacctaatcaagaatcataatgttgaccaaaaaaaaaaaa

SEQ ID NO: 1466 - DNA, 1034 bp, Triticum aestivum
  Clone ID: PAT_TA_1466
acggagcgggataaaatgatgccacgtggaatacgtgagacaaatacgctgctgacacggatccagctgaaggctaacgccccagataaagagcgccaggtagctcgagctctattaggcatttttggaagaaaaagagcttttttttagcaccagtacagacacaagcgctcatatacacgcgcatacactcatccctatgaacacacacacgcacaccctattcctatgagcaccttcgagagactgagccggcatatcatcttgagatttacgaactcaccgtaggcgcctcgtcgtcgacgggaacgtctcctcccatttgttttgacactgacaccgtctgatccagcaatgatcactgagcttgccatgttcaagaacaacccatgctcaacaactccttccaaagttgcaatctccttgcccgcgcccaacgcatccttgattggcgtcttgaagtataaatctacgatgtagttcgagttgtcagtaacatagggcttgtcatcctcattcaatctcagctttgcctcgcaaccttcttcattgaacagaccctgcagtcttacttgattgtacttccagcagaactgcacaacttccacaggcatggcaagcgggatccctcctaggctggcctgtctcgaaggctcgtttagaggtgcaaccgccgttgactgcggagactgtgccgctggcgaggagcgcgccgatctcggcgacggcgaaggcggccgtagaaaccgtcccgagccccagggccgtgccgctctgcacctgctccaccgcgcgcgccgccgcgatcctcttgaggtcgtcctgcgtcagcgccgtcgccgcccgcgcggcgtccgcgcgcaccgcgaagcgcgccggccggcgcggggcggcgcggcgcgtggcggccgcgtggaggcggacggcggtggcggtcgcggcggcgaacatgccgggtgggtgggtggcggcgggtggtgggagttcttggagctcgggagaaatggatggggagctggtgagttgtatgaagc

SEQ ID NO: 1467 - DNA, 1314 bp, Triticum aestivum
  Clone ID: PAT_TA_1467
gaaacatagaaaaactatattttatagaacaacataatttcctcattttacacagatagcttattcattgaaaaatcgtaaattcaacacaccgacaacaggtagctgacccaaaacactcactttgttttgactgtttacggcaaaaagacatacgtcgttgttggaacaccattgtgcccaatcgtacaaagatagcatattcactccaaagtcgtactcacaacacaccagcgactcctgaccatcagtacacactcaacctctcatatacacgcgcctgcactgacgccgatcactgaagttgccatgttcaaacccatgtcaacatctccgacagattccaaagccgcaatctccttgcccgcgcccagcgcgtccctgatcggcgtcttgaagtataaatcgacaatgtagttcgagttgtcagtaacatagggcttgccatcctcattcagtctcagcttcgcctgcagccttcttcgttgaacagaccctgcagccttacttggttgtgcttccagcagcaactgcacgacctccaccgccatgccaaggccctccctccctggccggttcttagagtatcttttgagatcgaggtcgagctttcaggaagctgggcatccctcagtcgatggctccgcgcccttgccaggcttgatcggggtcgcggcccccgcgccgtcgatgtcgaggagaagccgcgtcgtcacgagcatggcgaggccgctccctcccaggccggcgaccagcttcgtctcatcgacgacgacgacaaactttcctgatgcggcctcgaccatcttctcccggagcagggctccaccccgccctttgacaaggttaagatctggatcgacctcgtcggcgccgtcgatggcgaggtcgatcacggggtggtcgtcgagcgtggaaagagggattcccagggacatggcctgctcaaaggtgcgcttggaagtgggcacaccgacgatgccggagagcttcccgttggcaagaagcgcaccgatctcggcgacggcaaaggcggccgtggagcctgtcccgagccccagaaccataccactctgcacctgctccaccgcacgcaccgccgcaagcctcttgaggtcatcctgcgtcagcgccgtcgccgcctgcgcggcatccgcgcgcacggcgaagcgcgccggtcggcgaggggcggcgcgtcgcgcggcggccgtgtggaagcggacggcggtggcggcggcggccatgctgggtagcagcgggtggtgcgagctcgttgaggatggggagctggtggaggcgcgccccgtgcccaat

SEQ ID NO: 1468 - DNA, 1204 bp, Triticum aestivum
  Clone ID: PAT_TA_1468
aggccctcttcttcttctttcccaagaaacaccaccgaagccaacccgaaacaccacttctcccccaaagccgccgagcttgcctgcgcgcacacaatcgagcaacccagcaccgcctccccgggacgcccaaaccaaaagcctccgtgaccggcgacgacgcgcaccagcaccgatggcccgctacgaccgcgcgatcaccgtcttctcccccgacggccacctcttccaggtcgagtacgccctcgaggccgtccgcaagggcaacgccgccgtcggccgccacggccgcccgacacccgtcgtcctccgcggcggcgccgaatccagcccgcaagctccatcgactccaggtccgtgcgcaagatcgcgagcctggtccgcgcacctcgcaccgtggctgcgcgggtctgaaggcggacgcgcgcgtggctcatcaaccggggcccgcgtcgagtgccagcagccaccgcctcaccgtcgaggaccccgtcactgtcgagtacatcacgcgctacatcgccggcctgcagcagaagtacacccagagcggaggggtgcgcccgttcggcctctccaccctcactagttggctccgacccctatacagataagccagccctgtacccgcaccgacccatccggcacgttctccgcctggagggcgaaccccaccggccgcctctccacccccatgcgcgacttccttcagaaaggaacaacaacgacactgccggcaaggagaccatccaagatctccatcggctgccctccctacggcatgtcgagagttgcgacacgaacattgagattgctgagatgacgtacaaggacagacctggcaagctgaacagaagactaaatagctgagcctttcgctaggttgttgagagtggaaggaagaacatggagattgcaatgatggcaaggaaggaaggccttcggcgactcgaggagacagaaatcgatgggtatgttgctgagattgatgtggtgatgtccgcggcttatccggcaaagaagagtggtccgaaagatatttaattacttaatgtgctatatcttcattctgtcggccgaaaccttttagtgtgtcacttgttacgttccgtaactttctttaaactgctttaacaagatattgaagtcattcgtaaatgaattgccttgttttcttgaaaaaaaaaaaaaaaaaaaaaaaaaa

SEQ ID NO: 1469 - DNA, 836 bp, Triticum aestivum
  unsure (1)..(836): unsure at all n locations
  Clone ID: PAT_TA_1469
actatgacagcgacccaaacccaaacaggcacgaggaatagtcagccagtcgagcgagcgatcaagtcatggtggccgaccaccagtcctcctcccccgcctccccgcggccgcggttcaccatcggctacgcgctgccgcccggcaaggcgggcagcgtcatccagccgcccctggaggccctcgcggcggagcgcggcatgcgcctcgtcgccgtcgacgcctcgctcccgctggccgaccagggccccttcgacctcatcatccacaagctcttcgaccggccctggcgcgcgcagctggaggccttctccgcgctccacccctccgtccccgtcgtcgacgcccccgccgccgtcgaccgcctgctcgaccgcttcaccatgctcgacgtcgtccccgggctcgccgccggcctggacttcccgctgtccgtccccgcgcaggtcaccgtgagcgacgccgccgcgctcgccgcggacgacccctcccacggcctccgcttcccgctcatcgccaagccgctggccgtcgacggcagcgcggggtcccacgacctgtgcctcgtgtaccgcaccgagggcctccggggcctccacacgcccgtcgtcctccaggagttcgtcaaccacggcggcgtgctcttcaggnctacnntggggtgggcggccgcgncccgtgtgcgtcccggcgcagcagccttgccggacgtgcccgcggngcgcctcgcggaccccgacgccgacgcctctgtccccttcgccacatctcagccgcccgcgctggaacaaggggaagactcgatgccgcccgccgcgttcgtcgacaggtcgcgc

SEQ ID NO: 1470 - DNA, 689 bp, Triticum aestivum
  Clone ID: PAT_TA_1470
cagcacggggctaaacgcatctccccgactgcgcatcggcatccatctccagttatccaccgccgcgctcgcttgcacaacaccagcgccgccagcgcaacctccctcgcgccgctcacccccgtccctcgcttgtccggctatcctgtggcgcacggcgaccgtcggcggcccgcccgtccgcctcaccgtcggcggccgtccgcggacgcgtggggtggcgctcggcgcctgtgcctggcccgtcccccacacagccgatggcgactccgccgtcctccacacggccgtcaacaaagactacacgacgccgcgacaacgtagaagctcctcccttagcagatgcgttcttcctctgcgccacctgtggaacagttcgtgcgcccagtgccgccgattcgatggtctgcagatgtttgatctaagatgcccgactgtactacatgtacatggaagaagaaagctcaatgaaccgaagctggggaaaaggaataaccaaggaggggaggggaggtcacatccttgaagccaacggcaaattaaggcatcaccttgaatttgtaactccagtaactaaatggagatccttttttaggtcgaacttgtgatccttcttattactgaaaccaagtatcaatctgagaatgattgttctcttattggggtctgaccagacttaaatgttggat

SEQ ID NO: 1471 - DNA, 569 bp, Triticum aestivum
  Clone ID: PAT_TA_1471
gccggcccaccgatcagaagcccccacgccaacgctgcgccgccgccgaactttggagaggagacgcggaggacgggaagatgggattcgagaaggagatcctgaaagccggcaccggccccaagcccgtcaagggccagaaggtcaccgtccactgcaccggctacgggaaggatggtgatctgtctaagaagttttggagtaccaaggaccctgggcagcagccattctctttcaacattggtctgggttcagtgatcaaaggatgggatgagggagttatgggcatgcaattgggtgaagtcgcccgtcttacgtgcaccccagactacgcttatggaactggtggctttccagcctggggaattcaaccaaactccgtgctgatattcgagatcgaagttcttagcgccaagtgattcatgatggatccatagggcactgccgcatcgccatgcctctcgattaccaaaataattgtaatgccacatcatgttaagtgccacattatggtgaatgcatcgagtgaaacttcggaaccctattaaacttaaaaaaaaaggccccta

SEQ ID NO: 1472 - DNA, 842 bp, Triticum aestivum
  Clone ID: PAT_TA_1472
tcccactcgttctccccgtaccttcctcttatccgcgccacctacgttcccgctcgagatgggggcagagctgctgctgctcggcgggaaggtgtccgccggcggcgcggcaggatctggcgccgtcgctgcgtcctcggcgggagccggacggtgcgtggccggcgggcggcgactcgcgccggtgcagccggcggcgctgcaatggcggcatagtagccgcaccagcacagatcagaagccaccactgcaacgctgcgccgccgccgaactgtggagaggagacgcggaggacgggaagatgggattcgagaaggagatcctgaaagccggcaccggccccaagcccgtcaagggccagaaggtcaccgtccactgcaccggctacgggaaggatggtgatctgtctaagaagttttggagtaccaaggaccctgggcagcagccattctctttcaacattggtctgggttcagtgatcaaaggatgggatgagggagttatgggcatgcaattgggtgaagtcgcccgtcttacgtgcaccccagactacgcttacggtgaaggtggctttccagcctggggaattcaaccaaactccgtgctgatattcgagatcgaagttcttagcgccaagtgatgcgcagtgcgattcatgatggatctatagaacactgcagcatcgccatgcctctcgattgcaaaaataattgtaacgccacatcatgttaagtgccacattatggtgatgttccaagtgcatcgagtgaaacttttggaaccctattatcctttaaaaaaaaaaaaaaaaaaaaaaaataaaaaaaaaaaaaaaaacgcac

SEQ ID NO: 1473 - DNA, 1052 bp, Triticum aestivum
  Clone ID: PAT_TA_1473
gagcaccacgcccaccccgcccgctcagcggccaccacgccaacgctgcgccgccgccgaactttggagaggagacgcggaggacgggaagatgggattcgagaaggagatcctgaaagccggcaccggccccaagcccgtcaagggccagaaggtcaccgtccactgcaccggctacgggaaggatggtgatctgtctaagaagttttggagtaccaaggaccctagggcagcgagccattctcatctccgaccttggacccgcgacgccaacgctgcgccgccgccgaactttggagaggagacgcggaggacggcaagatgggattcgagaaggagatcctgaaagccggcaccggccccaagcccgtcaagggccagaaggtcaccgtccactgcaccggctacgggaaggacggtgatctgtctaagaagttttggagtaccaaggaccctgggcagcagccattctctttcaacattggtctcggttcagtaatcaaaggatgggatgagggagtcatgggcatgcaattgggtgaagtcgcccgtcttacgtgcaccccagactacgcttatggatccggtggctttccagcctggggaattcaaccaaactccgtgctgatattcgagatcgaagttcttagcgccaagtgatgcgcaatgcgattcatgatggatctatagaacactgcagcatcgccatgcctctcgattaccaaaataattgtaacgccacttcatgttaagtgccacattatggtgatgttccaagtgcattgagtgaaactttggaaccctattatcctttaggatcctggtactagtttctgggtgcccttgttgcaaaatttacgttgagggggctttcgtgatcctggtactaagtttctggttgcccttgtcgcaaaatttacgttgaagggggtccttacctcagaggggatcaagagatagcggttgtgtgatcctgcttgaatcctcggcttccctatgagcctagccgacagttttaatcgcctgagaccagttcgttcaaaaaaaaaaaa

SEQ ID NO: 1474 - DNA, 727 bp, Triticum aestivum
  Clone ID: PAT_TA_1474
ttactgctctccactacaacccgtagagtaatttaacttaggctgatacgaggatccacaatttactgcacattagtcttccatttcagcaaagaggtcgatcgagattgccgtcgtcgtcgctcggtcgatggggggcagcatggaggagcagctgcacatgacggcggcggcgaataagatcgcggtgccgttgaagaagcaccacccgaacctccacatggcccacgctggcgcgggcaagggcggcggggaggcgccggcggtgatggtgaccacgcccaaggcgtcgtcgcaggcgcccaagcacgcgcacctgctggcgagcccacgggcgtgcctctgctcgccgacgacgcacgccgggtcgttccggtgcaggctccaccgcggcggcgccggcgtcggcctccacgagatgggcaagaagagcagccctggcgcgtgacgcgcgcgcccacccgtccgcacgttcttgtttctgttttgctggatgggtggtgtgcagtgcatgggaagggaaaatattttttttctctccttctttttggatcctctgtttgcgtcgacggggaacttcatcttgtcatctgcagtcgacgattacgaatgttgatcgattctgtgcctgatggaaaccggccgcctgtatatataacaaagtgtacataactgccggttcagaaatgggcaattgcagagttctagatcaaaagttttccctcat

SEQ ID NO: 1475 - DNA, 673 bp, Triticum aestivum
  Clone ID: PAT_TA_1475
aagctccagaacagcaaagctagcgagtaatcccaggctcccagcacattaacacacggccacacactgctaccacagccactaatctcaggtgatcaccgaatcaagcaggcgaagatggtgcacgccgcgacagccgagcgcttcagcagcgtgttcgcctccttcgactgcgacgccgacggcaagatctcggcggcggagctgcggcagtgcatgaaggcggcgctgggcgaggacgtttcggtggaggacgccgaggcgcttgtggcatcggcagatgccgacggcgaccggctgctgaatgaggaggagttcctcaagctgctggcgcggccggagacagaggcggaggaggaccggtgcagggggctgagggaggcgttcgcgatgtacgaggtgaagggacaaggctgcatcacgccggcgagcctgatgcggatgctcgccaggctggggtccgagcagggcatcgaggagtgccgcgccatgatccgcagttttgatctgaatggagatggagttgtttgcttcgacgagttcaaggtcatgatggatgcctagcagctttttgtccatcggccagtctactgaattctgatcctgatacttggctacagttttaacctgtacacagtttactaggtacttaatctatttcgccagggaatat

SEQ ID NO: 1476 - DNA, 2125 bp, Triticum aestivum
  Clone ID: PAT_TA_1476
gggctctggtacctcttcaacatctacttcaacatctacaacaagcaggtcctcaaggtttttccttatcccataaacatcacaacagttcagtttgctgttggaactacgatttccttgtttatgtgggccacgggtatccttaaaagaccaaagatttccggtgcacagcttcttgctatcctccctttggctattgtccataccatgggcaatcttttcaccaacatgagccttgggaaggttgcagtgtcatttacccacgcgtccgaagccatggagcctttcttctcagttctactttctgcaatgttccttcccccgcgcccccggcggcggcctactccctgggttgttttgtctcttcttcctattgttggtggtgtggcattggcatctatttctgaagcttcttttaactgggctggatttctgagtgcaatggcttcaaatgtgaccttccagtcaaggaatgtcctcagcaagaagcttatgctgaagaaagaggcactctctggacaacatcaatctcttctcgattattacagtcatgtcattcttcctcttagcccctgtaaccttgttgacagaaggtgtcaaggtcactcctacttatctgcagtctgctggtctgaacttacaacaagtgtacacaaggtctttgattgccgcattctgtttccatgcataccaacaggtgtcatacatgatcctcgcaagcgtgtcaccagcttcccattcggtaggtaactgcgtcaagtgtgtggtggtatttattacatgtattctgttcttcaagtttcctttgtctccaatcaactctatgggcaccgtaatcgctcttgctggagttttcctgttttcacaactgaagagacttcagaccaggcccaagacttcttgattgcattccgttggtcaggttcattagggcgttgcccctctcatgggatctgtgctttagtttagccgcccttagtaaggagccttgttcagtaactagtaccatgcaggatcatttgtaattcattatcgatcatttttaccatgttattctttggactattttccatagtcctcttgtttgatttgtgacttgctccttaataatgactcggagttttcttcgctccacttacaaaaacttcttacaagtgggctgaatgtcttgagttgaatcgcttcataccgatgactttcaactcaagtcatgtcctcagcaagaagcgtttgctgaagaaagaggcaccgctggaaaccatcaatcgcttctggtttatttcattccttctgttctgctcctcaggccccctgtgtctcctatcagaactatcggagctccgaccgctctttcgggagtcttccggtatgaacaactgaagagacttcagcccaagcccaaggctgcttgattgcatcctggtcgtcaggatcaatagagcgttgccactcttggaatcggtgctttagtttagccggacatattgggaagccttgttgagtaactagtaccgtgcaggatcatttgtaattcggccccgggctctccgaccagctctgtcgggaccgcgctcgctccggccgcagttttcctgtactcacaactgaaaagacttcagcccaagcccaaggctgcctgattgcattccgttcgtcaggatcagtagggagggagcgttgccacactcttggaatcggtgctttagtttagccggacatattgggatgccttgttgagtaactagtaccgtgcaggatcatttgtaattcagtaatgagcattttgaccaggaaagttttgaaatctctttcaccgttctctacttggacgttctagttgccactttaataaaacctccgcagtttgattgtgccgtgatgaagtcaccgatgagcaacatctgtaagggttcatttctgtcccttttagccattttcatagataattcagaaagctttagttgctaacactacatgaagttcatgaacaagatattgcaacttacattgtatttaaccggacagtactacattcatgtgtgccctgatgccctccatgtctggtgtcagggcatcgtgcatggttgtgaacttgcattgctgtaaccttgtttctaacaaacag

SEQ ID NO: 1477 - DNA, 409 bp, Triticum aestivum
  Clone ID: PAT_TA_1477
attctcgaattgcaattgttgttgatcaagttaataaatcctccgaccaacttcgatcagcaattggagcttgagacaaccgatcttctgaatcgatcaccgatcaatcctagagaagccaaaataaaacctcgacacaatgtctcaagcatctaagctcaccctactggggacatcgctactcacagtcggcacagttgttgctgtacactaccagcaaaagtttgagaaagcggccatgcacgagggcgttgtccgcgatatggaacagcagcgagtaaagcgagaacgacaattggacttcgatatgcagaaacaattggaggcagagtacaagcgcgaacagacagtacacgactcgatagcagcagccgagaaaggtcttccgaatcaataacactatggcgtc

SEQ ID NO: 1478 - DNA, 1400 bp, Triticum aestivum
  Clone ID: PAT_TA_1478
cgtccgcctcgagttgccgtctagttcccctcgggtctcctccgctcccggggatcctcgccgtctgccaccaaatcgcctcgcctctcctcgcctccagatctccgcccggcgacgcggaggccccagtccggcgccattcggccggaaccgccccgctccgggctcactcggtcggcggtgatgcggcgggcagcggcgctcctcctcctgctcgccttctcggccgccgccgccgtcgcagcagcagccgaggatagtaccactggtatcctaccagcaggaggaaacaatggtaccgatatagcggatccaggtgttgggaggacagggcagaatggcgaggcagatcctaacacgcaacagaaagtacacggggagggggagctcaagaacgtcattactgagaacactaacacggataattccgtcgaaggaactagcactgggaaagatgagccagtacagaaaccaaatgacaaagatggcaacacaacaatcgtcggcagacttcttgcaggatccactgattggcgaatgtgatccatcccatagatgtctcattgaaaaacagaagttcatcgcctgcttgaaagtttctggagattcgtcagctctatcccttttgatggacaacaaaggtgcaaacccacttgatgttagcataacggctccagattatgtcatcttagcagaagatacagttcatgttgaagcaaacggtcacaatgagacgcaggtgagtgtttctgtcagcgataccgtgaatgacatggcgatagttctcaaagtcgcagaagaaacctgtaaaatcaatcttgagaccgcagtcacaaggaacacaggccgagtgataccaatgcggcttactccaacctacatgctggtgcccgtatttgttctccttgggctggcaggactatgcgtcaaactccggagggcgcggaagcaagatggtgggccagcataccagaagctcgacgcaccagagctaccagtctccattggagggaagaaagaagctgatcagcctgaccagtgggatgacaactggggagatgactgggacgacgaggaggcgccgtcaacaccgtcgaactccatgcccaacctgtcgtcgaaaggtctggcttcgaggaggtcgaccaaggatggctggaaagattagccgccggtctgatgtctatatcgacgcctatatttttctctcctgtctttcttgaagagtttttttttttcgcttagcttttttgataggtttcactgaggagaccactagagaatgtaatacgctggtaacactagaagaaatatgaatgctattttttgctagttttatgttactggtgaatgaatgcagtattttagtggcaaaaaaaactaactaaagctgaaagatt

SEQ ID NO: 1479 - DNA, 770 bp, Triticum aestivum
  unsure (1)..(770): unsure at all n locations
  Clone ID: PAT_TA_1479
tattcccgcctcagatacgtgtggaacccatggcctcgctgcgtccatggcccaggagctgcttagcgttggtcatgtccacggacgcgccttagctcaccgcatgatggacctcatgttcatgtccaggctctgcttcactatcctgtccacgatgctccggcaagccttcgtccccgtcgccgtcattgccatggcatgccgttggcggtgcggctttcatgcgagggccggagtatgccttgatcctctcttgcccgtcgtccttgaaccactgcaggatcttggccgccctactgtgcgcgagggggctgccgggcagccagacacctcgaggagcgcctgcatgatactgagctggcgtatcctccacggcagcgcccggacgccgcctccgtgcgcgagcaccatgaccaggtttgtcgcgtgcccctggcaccccgcgctctcgtgccatgtcatggcctccaccagcgccctgggctgccatctcccacctccccgccgcgctcgctgccgtcacatcggcccggacgcccagcgccgcctccgctgccgtctatgtccgctccagtagggagggcgccaggagagcgcgcacgatgccgcaggtgaccacggtccggacttgctcgagcttggcggagaggttgcagagcgcagccaggcaagccagcttcgtgtacgatcgtggcctgcctcatgtgtgtaattgtattgctggtcgaggccagatcctatccctaatgctatcaatcagattcagatnc

SEQ ID NO: 1480 - DNA, 873 bp, Triticum aestivum
  unsure (1)..(873): unsure at all n locations
  Clone ID: PAT_TA_1480
aatttggctagtccacctgccatcctcgcctcccctcctcctctcctcgtaaaaggaggcgccgagaatacgtcagaggagctgcgcttccccaagccccaagcgaccgccgccgccggaaggaccaggctgcccgcgggaggcggtttcgcgaagctaggcaagctaaggggcctccggcgatgtacccggtggggacggccccgcggccggggtcgcggctgccggcggcgtcgcgggtggacaaggccaccagccatctgctgcaggggcccgactgggccgtcaacctcgaaatatgcgacaccctcaacgccgaccgatggcaaacaaaagatgcggtaaaagcagtaaagaagcggctgcagaataaggacccgaaagttcagtttttcactttgacgctcttggagacaatgatgaagaactgtggtgaatatgttcattctgaagttgctgagctgcatgttttacaagaaatggttaaaattgttcagaagaagcacgatatgcaagtgaaggataagatattgatactgctggactcatggcaagaagcatttggtggacctgggggcaaatatccacagtattattggtcatacattgaactaaagaggtcaggagtaatgttcccacgccgtcctatggatgcccctccaatatttactcctcctgtgacgcatcagtctcagccatatggttcacctgcatatcccactggaagtctaaatgacagaatggcatctgatgttgaaacgctgagntcaggggatctggataatattagagnatgcacagaattactgagtgatatggtgaatgctttgaatcctgctgatcgcatggctggttaagatgaaattggtactg

SEQ ID NO: 1481 - DNA, 727 bp, Triticum aestivum
  Clone ID: PAT_TA_1481
aggggcggagaggggatcgatcgatcgatcgctctcgcggccggcggcatgtcgcggttggcgtcggcgctgcttgccctggcgacggcggccgcggtggcggtggcggtggcggcgcggccggcggtggacgtgaccgcgacggtggccttcggggagggctacacgccgctcttcggcttcgacaacatcctccgctccgccgacgaccgcaccgtcagcctcctcctcgaccgcaccaccgggtcggggttcatctcgtcggccatgtaccagcacggcttcttcagcgcgtccatcaagctgccgtccgactacacggcgggggtggtggtggcgttctacacgtccaacggcgacgtgttccccaagacgcacgacgagctggacttcgagttcctgggcaacatccggggcaagccgtggcggatgcagaccaacatgtacggcaacggcagcgtcagccggggccgggaggagcgctacgtgctgcccttcgaccccaccaccgagttccaccgctactccatcctctgggcgcgcgacgccgtcgtcttctacgtcgacgacgtgcccgtgcgccacctgcgccacgcccgcgccggccgcgacttcccggccaagcccatgtcgctctacgccaccgtctgggacgcttccaactgaggcacctccgggggtcgctaccgcgtaaactaccactacgggcccttcgtccgcctcttta

SEQ ID NO: 1482 - DNA, 740 bp, Triticum aestivum
  Clone ID: PAT_TA_1482
attccattccaatccatttgagcttcacaacagctagtgtgtccgtgagcgttttttctcctcgtgtgtgtgtcttgccttgcactagtaagtgtgtgtgctttgctagtgtgctgagcgcaggcagtaatagcacttggctcctccaccggtcgtgtatcagtgtactcgagtgctagcgagtagttctgggctgacagtagggaggagtaggcttctgggctccgagtggagtgggtgcgggcagttaggccgtacacgcgtgtaatgtaattgtattgtggaggcatgctttgcccttcttctttaatatatgatatgcacactcgtgcatattcgagaaaaagatctggccgaggctgcggcaggcgtttcagccgcggattctgcaaggccgtgaggcaaagcggtcgccggggaggctactggagaataagagagatccgtagttgttagctttttgagtggcgctgctctcctgttcgtggcactgggctgagagctgtgccgttgggttcgacggccatgtactccatagcattcctgacgggtatgactgtcttactactcacccgtcatcctccacattcctctcttgctgggcacagtatatacgtacttttaaagttcacttaattacttagttgagctcttaaatctatttagatgtatggtagagttacctagttttgttaattataattcatgcgatgatctgatacattctgctgggtgtcatg

SEQ ID NO: 1483 - DNA, 650 bp, Triticum aestivum
  Clone ID: PAT_TA_1483
cccgggtcgacgaggaagcccatgatgccgccaggtccaagaacaaggctgcacaaacctcgacgactgtacatgttccgcgccactctcaggaggcgcaagaccaacagcgtcatggcacttgcagtgccatacgcatgataggccaagaccaagctggtggatctcggggcgctcaagaccagcatgcacgccagcatgctggcacgagcggggcacggtcgcctggacgggatactgctccttctaacatagttagaagttcgagcacgtcccgctcctcgcgccgtccgccactgccacccaccactccagcagaagctttggcgcgagctcaacttctcctagattaccctccgacgtcggacaagatcgacgaatggagggccaccattcagagtctcatcggctacgccaacggcgacactccacggcggacgagcgcgtcgccgtcgcggcagggttgccgggcgcgagccggtgacgacgaaacgggtggaggtgcaactaccatgcaatcaccgccccgaaggccaagatcgccgactcgccggatccacctcgacagcgactctactgcatcatcggatccacaagctcgtcgcgatcagcgccaagtccttcatgatcagcaacctcgtgccgaattc

SEQ ID NO: 1484 - DNA, 2163 bp, Triticum aestivum
  Clone ID: PAT_TA_1484
tcaggaactgaatctgggttatacccgcctgatgctgcctgccgtgttatagccagattaaggaagcgaagagatgagtctagagcactgccggctctagctgagagacagattccaacaacgctagcggctacaaccttcgttccccgccgcctcgtccacccgtcgccggcgcgctgccactgccaccgccagcgagattgcgacctgagaggtcccgcgtcctcgtgctgttcccggctctaccttcgccgcggccaccatgatctgtgcaatctccggcgaggtgccggatgagccggtggtatcaaagaggtcggggctcctctttgagcggcggctcatcgagcgctacattgaggaccatggaaagtgtccagttacgaaggaggaactctccatggacgacatcgtgctggtgaagaccaacaaggtcgtgaggcccaggcctctgcaggctgcaagcattcccggactccttggaatctttcaaaacgagtgggatgctcttatgctttctaattttgctttggagcagcagcttcacacagcaagacaagaacttagtcatgcgttataccagcatgatgctgcctgccgtgttatagccagattaaagaaggaaagatgttactgtgcatgcgactcagaagtactttgtgaccgcggccaaggataatacttggtgcttctatgatatttcaactgggtcttgcctctcacaggttggcgaggcttcaggacaagagggatatacatctgcgtctttccacccagatggtcttatccttggaacaggaactactgaagctgttgtcaaaatttgggacgtgaaaactcagtccaatgttgcaaagtttgaggggcatgctggacctgtcactgctatgtccttctctgaaaatggttacttcctggcgactgctgctcttgatggtgtcaagctttgggatctaaggaaattgagaaattttaggactttctcgccatatgattcggatacgccgacaaattctgtggaatttgattttagcggtacctatcttgctgttgctggttcagatataagggtttaccaagtagccaatgtcaagacggaatggaatcttatcaagaccttgccagatttgtcaggaacagggaaagtgacctctgcaaagtttggcactgatgccaaatatatcgccgtcggctctatggaccgtaacctgaggatatttgggcttcctggagatgatcaaatggatgatgatgcaaaaccatcggcagagtgaggaaatgcagtgtacctggttttacttgtttgatgctccctgcgctctcttttggcagtgtatggatgggttgcgtatgaggaaaagcagggtcctcagggagaaatggggatgttaagacccagtccaatgttgcaatgtttgagggggcatgctggacctgtcaatgatatgttcttctctgaaaatggttacttcctggcgactgctgctcttgatggtgtcaagctttgggatttaaggaaattgagaaattttaggactttctcgccatatgattcggacacgccgacaaattctgtggaatttgattttagcggtacctaccttgctgttgctggttcagatataagggtttaccaagtagccaacgtcaagacggaatggaatcttatcaagaccttgccagatttgtcaggaacagggaaagtgacttctgcgaagtttggcactgacgccaaatatatcgccgtcggctctatggaccgtaacctgaggatatttgggcttcctggagatgatcaaatggacgatgatgcaaaaccatcggccgagtgaggaaatgcagtatatctggtttttacttgtttgatgctccctgcgctctcttttggtagtggatggatgggttgcgtacgaggaaaagcagggtcctcagggagcaatggcgtgggcttccgccgatgtaaacagaccgcgacattattgtattgtaggcttcactaattttctaatgaggatataatttgttttgaagaggaatacaatctcaaagggctcgagccacgggcatgcaagtttcttttacccgaggccgttatttgatgaattaatgagattttaaagaacatgcattatgcactttctactaaaagatgtttcttgtgcc

SEQ ID NO: 1485 - DNA, 1262 bp, Triticum aestivum
  unsure (1)..(1262): unsure at all n locations
  Clone ID: PAT_TA_1485
cccacgcgtccgcccacgcgtcctcccgcatcgcgatcagtcatctcctcccagcctcccccgcctcgccggagatcacgagaggcggcgccccccatccccgcgatggacgcctcctaccgccgctcaggtgcgggcggcggcggcggctcagccccccgcaccgtcgaggacatcttcaaggactaccgcgcccgccgcaacgccatccaccgcgccctcacccacgacgtcgaggagttctacgcgcagtgcgatccagagaaggagaacctgtgcctgtacgggtacgccaacgaggcgtgggaggtggcgctgcccgcggaggaggtgcccaccgagctgccggagccggcgctcgggatcaactttgcgcgcgacgggatgaagcgcagcgactggctcgcgctcgtcgccgtccactccgattcgtggcttgtctccgtagctttctactatgccgcgcggctcacccgcaacgaccggaagcgtttatttggcatgatgaatgatttgccaaccgtgtatgaagtcatctcaggtatgagacaatcgaaggagagggacagatcaggtggtattgacaacagcggtagaaacaagctgccatcaaagcatacagtcgaggcgccgccaccaccacgtgcagaaaataatgccagggatgccgatgaaggctacgatgaagatgacggcgaccacagcgagaccttatgcggaacatgtggtggcatatacagcgccgaggaattctggattgggtgcgacgtgtgcgagaggtggtaccatggcaagtgcgtgaagataactccggcgaaggcggagagcataaagcagtacaaatgcccaagctgcagctccaagagacctaggcagtagcagcgccgcctccttttggcgggggacggcccccatggatgggggccttgaagcagcagcagcagcggttgagacttttagactccttgtgcaaggctaactactaccgtcttgctatgtttactgtacctttcgtttcaggtttacatatggtgatgatgctaatgcttgtgagggaagatgacacacattttcaaagccttctaacgtttccatgtcctgaagaggagtcaaaggtgtatgttgccgggaagggatagtagaatgatgaaaatatgtgtaacttttcatgggaagttcatgttccaataatccgtgaggtttatttatactaatcctaacctatgttaatatatgtanttantaagtccngttcaactgtc

SEQ ID NO: 1486 - DNA, 1846 bp, Triticum aestivum
  unsure (1)..(1846): unsure at all n locations
  Clone ID: PAT_TA_1486
tgttcagaaagcgaaccccgaaactcccatccttcccactggccgccggaaggagacgaaccccaaaaccctgacctgaccctccccgtcgacctcatccgccgccgccgccgccggaggaggaggagatggacttccaggtcgtcgtcctcgccggaggcacctccgagaagctctcgcccctcgtctccaaggacgttcccaaggccctcctccccgtcgccaaccgccccgcgatctcctacgtgctcgatctcctcgagtccagcgacctcaaggacatcatcgtggtggtggaggggcaagaggcggcccgcctcgtcggcgcgtggatctctagtgcttacctggaccgcctcgtcgtggaggtagttgcagttactgaggacattggaactgctggtgcattacgagctatttcaaagagactggtcgcaaatgatgttttggtgattagcggcgacctagtaactgatgtacttcctggggctgttgctgctacccatagaagaaatggtgcagctgttactgctttactatgttccgttcctgttagtggtccttcagatgctgcttcttcaggagggaaagataaggctaaaaaaccatgtcgactgaacatagttgggctagacataacaagacaattcttgttgcatgttgtatcaggaactgatgttgaaaaggatgttcgagtttataagagaaaaattcgagctgtaggtcagatggaaattcgaagtgacctgatggatgctcatctttatgcctttaataggacaacattgcaggatgtactggaacagaaagaaacataccgtagcatcagacttgaagtactcccatatttagtgaagagccagttgaggtcagctccatcaggcggtgaaggaacaatagttgatgaaactgggaatgttgtagttccgcccagcagcaatttacagtgcttgtcacaacatcgcgcaattgcaccatctgctttcaagcaagatttattaccaagttcaggcggcggaacacataggtgctgtgtttatattgctagtaaaaacaagtactgtcaccgtttgaactccattcaggcgtactgtgatatcaatcgagatgttataggggaagctagtcacctatctggttattccttctcttcacataataacatcatccacccatcgtgtgtgcttggatcgaagactacagtcgggccacagtgcatgcttgctgagggttcacagttaggtgacaaatgtggtgtcaagcgatctgtgattggccgtcattgtcgtattggttcgaatgtgaagattgtcaactctgttgtcatgaaccatgtggttattgaagatggctgtcacatccaaggttctgttgtatgtaataatgtgcaacttcaagagcgtgccgttctgaaagattgccaggttggagctggttatactgtgactactggtagtgatcacaagtcagaatccctggcgagaaagtagagcacattttgatagttttgcggtggacttgagcacatgtgcgtatcagatgcacccctatgagtaaagaaaggggatacagttctgttttgagattttttttcttacagtttctcgtttgaaatcatagcacaggctttggtcccggcaacattctgaaaattctcgctgcctgtttcgcctacatgtggttgctgccttgagctggtttgcgagtaatgcttcccgcgctaaatgtttgttttccgaatggccaaaaccgtgttaattgaaactacccccaaagtataaggagtagtattaatgtgcactttcggacagggatcaaatnacacaacaattatatgtcccatatc

SEQ ID NO: 1487 - DNA, 803 bp, Triticum aestivum
  unsure (1)..(803): unsure at all n locations
  Clone ID: PAT_TA_1487
acggtgaggtgagtaggacgacagtcatatggcgatgcatccccaggttgctttactcctcaccctcatcctcctccttgcggctggagacggcagcctcgccgtcggcactccatcggcgatcatcagaaagacatgcaccgctcttgaccgacccggcgggagcgtggattacgactactgcgtgggcgtgctctcggccgacccggcgggcgcgtccgccaaggacgcacgtcaactcgccgtcatcgccaccaacctcaccgtggccaacatcacgtcgacggtgctcgtcctcgaggacctcgtcaatagcctcagcgactgcctccgcatctacagggaaatgaacaggcccctggaggccgcgctcggtgacctccgtgccgggcatgtcaaagcggcgaacgacaaactgagtcatgtcttcggagagcccgagcactgcgacatgctcttgttcgcggggagcgcccacaagaacccgataagcaaggagaacaccgacgccgatttgctgacccgactgggattcgacattactagcttgattcttggttacattcgttaatttccatttgctcgatcgatcgcataattttttttgctagtatatgtttgttgcccaacgtacgtgtgcgatgtcgcggatgggagccgtacgtggtgtgctgcctgtccacgcagtcttttttttaatgatgggacttgtccatgcagtcccgacaatgatgtgataggcccgnnctagtgcctactacaaatatatatgcgcngtaaatcatactactcgtcccgtatgc

SEQ ID NO: 1488 - DNA, 749 bp, Triticum aestivum
  unsure (1)..(749): unsure at all n locations
  Clone ID: PAT_TA_1488
ccctccggcaccggacgtccacctccgggtcctggacggccgccacccgccggacgccggcgacgagctggctggacgggttctacgggttcatggcgcaccacgtgacgaagcacccgagggaggcgtacgtcaacttccgggacctggacatcgggcagaacgcgctggcggacgacttcggcgccgccgagaacgccaggttctgcgggcacagcgctacttactcacgcaactacgagtacctcgccaaggagaacgccgccgttgatcccaacaactacttccaggaacgatcagagaagcccgcccatggccaagccagccacgcgcagtcgagcaagataagggttgcacacccaaggcaaggcctccatcggatcaacaaactaaatcattcaatggggccagacgatggtttacttttgcttgggtaatgaatgcttctacagtaatttttattggattgggtccttcttgactgcttcaagaataagactgtctacttgtctcgggttaggatctgtcggttgcgtcttctgcctctgaccgtttattttcatggttaaaaattctaaagtttatacttgtgaactttcctgcatccatgagatctaaaatattacggattccggggggttccctccgggaaaggtcatcccggacgcaatgaggcctcataaaaagttaagcggctaccccccnaaggngtaacntgtttgggttaatggtcnatnaaaaaaaaaaaa

SEQ ID NO: 1489 - DNA, 694 bp, Triticum aestivum
  Clone ID: PAT_TA_1489
accaatctcagagcattccgatccagaccagccgccccccgcatctcgagtagcttccagctcgccggagaggtagcaagcaagatggccggaaggaagggaggcgacaggaagaaggcggtgacccgctccgtgaaggccgggctccagtttcccgtcggccgcatcgggcgctacctcaagaagggccgctacgcccagcgcgtcggctccggcgcccccgtctacctcgccgccgtcctcgagtacctcgccgcagagatgctggagctcgccggcaacgcggccaaggacaacaagaagacccggatcatcccgcgacacctgctgctcgccgtccgcaacgaccaggagctcggaaggctgctcgccggcgtcaccatcgcccacggcggcgtgatccccaacatcaactccgtgctgctcccaaagaagtcccccgccgccgccgagaaggaggccaagtcgcccaagaagaagacctccaccaagtcccccaagaagaaggtcgccgccaaggagtagccgccccatagactacagtcgtgacattgcttaggtccatatcagggagaggatgaggagtttcggttggttgcatcctgtcatcctgtgtgtaattgcctagcccagtaagcgctgtattccatctctaacttatgtccggaatgactaaagatgcaatcctttaaat

SEQ ID NO: 1490 - DNA, 530 bp, Triticum aestivum
  Clone ID: PAT_TA_1490
cttttcattctgtccaaaccaaacaaacagaaaacactcgacgccacttagtatcaggcatgtcagaaatctgcgtccagagggtggagaagatcgatgctcagggaaagacgacgacgaccgccggcgccgtagcgcagttgcgcggcatcgacgcggccgcggcggagtatatcaagaaggtgcatgagcggttggtggcggaggaagctgcggcggctgctactgctgcagcaaggcgctagctagctctaggtgcgcgcagcctagcatatgtgatatgcctgtgcaaaatcgatttgttcttttagtttttttcttctattcctatgctcagctatacttatatgtaaataacatgtcgtatgttttagcaggatttgttgtttctactcctagggtcagtttttttaaagaaatagtactatgtagatttttcgcaaaaaaaaagtactatgtagatagcatgtcatactatgttttaacaggattacatataaataataacgaagacgggggctgttgatttt

SEQ ID NO: 1491 - DNA, 1961 bp, Triticum aestivum
  Clone ID: PAT_TA_1491
gcgagtttttttttttttttttttaaattgtaatcgaagtgctccattaaatctagctggctccattgtgaacatgcatttgcattttgaatgtaacaataaaacatttcacctttgagtactctcggtgccctatcagctaccgtatttccaacataagaaggtaaaaaaaggtactggtaaaatacatcttagtaatgaaatcgtgctaaacaaacaatccctaaagttcatccaacttggcgcctgaaataacaggactgattctcctccaggaactgccagtagaggcgcattgacaaaaagtcgcagccatcacttgtggcgggttggagaggcccatgtttctgttcactgtacagaagaacacaacttctaccagcatcgggacttctaccagcattgggatcatccgcaagggcttagccaggcgcagaggctactaaggagaatattcgcaatgtgcagctgaataaatacaaccatgtttgctgttagttagttttcgcaagaatcctggggcgagggtatcactaacgggctccacaactcccccctcccgcccctggcgacagtcctccgctcctggcgcgacggtctccttccactggttctcctccacatgccacgctacagtgttccagaccaacgcaaaagagaaattccactgtttatcctccatttgtgaagaaggtgagactgacacaggtggtgataaatacttctccttagcactgtggagtttggcaattacagatggcagggttgctgaaaacccaggtatgtgatcaaatatccagatcaactccttttccagaaaatacaagagttggttgttgcataacgagatgataaacagtgtctgaatatgagtcttgatgatggccttcccgatcaacgttgcaaagaagaattcccagaagggtataccaaattgaccacacataataccagcaaggtcaaacagagggtttggaaccgaagcaagtatcaagatagtgaagaagttgagatgttgtgagtgagaaagcagccagcgttttgtacgattcacagtggatgctattggaccatcttctgacgaaggagcaacatctagctccttgacagcttctaactcacttccggctcgtgatataaaataaggagggagctcgccaagtgctgtcccgataccccaaagaacagcttccagctgaacctgagggagtaaatcaatgactgggatcatcactgaatgatctgatgaagggtacatgggcgatccaaattccgaacacttcttgtcaagccatgatggcgcctgtttaagcagtatggtatcatatggagcagtcttcaaatcaacacggccacattgaacagccttaatagtgaagagagcaatgtggggcccaagatacagcacaaacgtatgcaaacctgaacctagtccgattgaagaggccacacctaatgaaacccaccacaacacaaatctagcataattaaggaactcctgcacatgctttttgtgcagaccatcagtaaccagaagtgcaactccaggaattaccaccataacaattaggagaacaaacaaagctcttttactcaggatatatgctgctgatcttttcaagtattgcaacatagctaaattgcagaagtgcaatgtcctgaatgggtgctttgttagtgtcaaattctccaattccaatctatgtttcccccggatttcggagattacgccgtcgccggccctcgaggagccccgagccggccccgccgtggccttccggcgccccatcgctcccgccgcggcgcgaaaaccctagatctcgcggccccgatgtgccgtacccaccatgggacgccgggggcgcgggctcgaagctcctcccgctggggctcggcgggcggtcggagatcgcgcgacgaggtcgggggagggaggtggcggttggaggagggcaaagcga

SEQ ID NO: 1492 - DNA, 762 bp, Triticum aestivum
  Clone ID: PAT_TA_1492
cagcagcatcatcccgagctagctagctcctcgatcgatccataggccatagccatggcaaccaaatcgactccaagcatggggccttcgttcttcaacttcctaaaggaaggcctcctcctcccggcccgcaaccggaggctcttcttggcggtctacgccgtcgtcatcgcctccaccgcgctgctcctcctcggcggcgacctcgccgtccagcccctcgccgacgagatccatctggacgccaaggcgctgaacagcaccgaccccggcagcccggagttcgccaagctcgtgcaggagatccaggatgacaccagggagctcctgctcgtgggcgcggggttcctcctgttggcggtcgtcgtcagctcggccgtccggatcgtcctcctcttcgccgccgtctccacgtactccgacgaggagcagcctgctgctacctccttgggcgcgctcctggggaaagccaaggcgcagctcaagggccctctgctcacgctcgccttcgtctacgtcctggagatcgtctgcaccgtgcttctgggcgttcgtgggcgcgcttctcggcgtcctcatggtcatgctgaagcagtacttcgcggtgctcctcctggcgtcaattctaatcgtcgctgcggccaccgtcttcctcgtgtacttctctttcctgtgctctttcagcatcgtcgtggcggtggccgagcccggctgccacggcgcggcggcgctaggcaaggcgtggaggctggcaaaggggga

SEQ ID NO: 1493 - DNA, 786 bp, Triticum aestivum
  Clone ID: PAT_TA_1493
aatcccacacacaggcaactcaaaaatggcgccggtgaaggtgttcgggtcggccgcgttcacgaacgtggcccgcgtgctggtgtgcctggaggaggtcggtgcggactacgaggttgtcaacatcgacttcctggccaaggaacacaagaaacccgagcacctcgcccgaaacccatttggtgaaatcccagcttttcaagatggagacctcgtgctctttgagtcccgtgccatcgccaaatacattctccgcaaatacaggacgggcgaagtcgacatgctgagagaaagcaacccggaagaagcggctacggcggacgtctgggcgaggtcgaggcgcaccagtacagcaaagcagtcgcgcctatcgtctacgagtgcatcgtgtaccccacggcctacggcataccgacgaaccagaaggtcgtggacgagagcgtggagaagctgaaggaggtgcttgagatctacgaaggccgtctgtcgaagcatgagtacctggcgggaagcttcattagcgtcgcggacctcaaccatttccccttcacgttccgcttcatggaaactccgtatgcgtccgtgttcgactcgttcccttccgtgaaagcgtggtgggaaaagctcctgttgaggccttccgtgaagaagatcagcgccgacatgcagaaagaggtctaatccccctgattctgagactccattttcatattcatgtaaaaaaaccgtgggtcgatgatgtaaccatgatttgagtataaaggtggcgggaattgtaagattttt

SEQ ID NO: 1494 - DNA, 580 bp, Triticum aestivum
  unsure (1)..(580): unsure at all n locations
  Clone ID: PAT_TA_1494
ccatagaccatttcctctcctctcctcttctttctctcatggctgctcccgttctcaagttggccgccgtcgtgctcctggccgccctctgcgctgccgcactggccccagtggcgtcagggcagcagatggatgcgctagcggcatgcatcgagggctgcgagtgtgtgccctgcccggaaggacaggtctgcatcactgtgtgcacgcccctgccgtcctgcgaggccagatgccgctgcaccttttccggcacgggctgctaggccggctgcggccctggcaacgccgcctgcgcgtgccacggcaccgtccgccaggaagcctggcaccgcaagcgctgaagccagcaggcagcagctagctcatacgttctacagtgtattgtaagccctgtctgtctgtccatgcatgtactgcatgttcgtgtgtttgtgtggtaataaagtttcaacggtcgatccgttggggttgttggtcagtttctcatcgaaatgttcaagccttacagtggcctattggttanttnnnnnnnnnnnnnnnnnnnnnnnnnnnnnnnnnnnnnnnnnnnnnnnnnnng

SEQ ID NO: 1495 - DNA, 846 bp, Triticum aestivum
  Clone ID: PAT_TA_1495
atctgactatctccttccatttccccatctccgcatcttcctctcctccgttccccgatggctcgcctgctcgcgcaaagcctagcccgcccctctccggccaccgcctccctcctcccgctccgcgggctctccaccaaggtcgagctcatcgagatcgacctcgccgaggaggacccgtcgtcggtcgaggtcgtggggatccggcgcatggaggaggccatccacggcgtgatggtgcggcgggccacgcccgagtggctccccttcgtgccgggcgggtccttctgggtgcccccggtgcggcgcccccgcggggtcgcggagctcgtcggccggatcgcggcgtccggggtcggcgaggtgtcgtacgaggcggagccctacgtccccatgacggaggaggaggtgctctccctctccacggcccgggggtggccgtcggcggcctacttcgtcgaaggtgagcgggacgagtgaaccgagatccgatctcgttgtttgcgtgaatccgagcgatggcaaggtgctccatccatttccagatttccttgtggagttagtatgggctgtcagatttatgctacatctgcccaactcacattcaggctatagcgtcggtgaagcgcaccggaaagcaattgagcatcgtgtatgatggcatggtgaatccgttgaatgtgttcagttttttatgtatatacatgataagtcatcttggagcaccttcatcggtttttctctcgacatatatgcaaaatactattgatgataataactgtgtatggaaaaatggttggttgacggttgttttctcaaaaaaaaaaaaaaaaaaggccctagggc

SEQ ID NO: 1496 - DNA, 607 bp, Triticum aestivum
  unsure (1)..(607): unsure at all n locations
  Clone ID: PAT_TA_1496
cctgcggtccccgatgtccgcccggctccggtcgctgcgccggctcctgagcaggggcaagcaggccgtggtgggcgcgtcatcatcccccagcccgcgcggcggcggcgacatcgagcagggcctcgtcgggcgcccgccgaagacgccaaagacgcctccggcggctaactgatccgaaaactacatagctctccgacgcattggctcgcctcgccgatcaccggagtgtctatacatacatgtgttcattctttctttcttcttccctttctttgattcttcttctctttttcgccaaggattttggccagaaattctgatgtaaacaaaaagatgtttggcattggtgtcactgattggttatctcgcctcgccgatcaccggtgaatctataaagctctgtgttcattctttcatcttctcccctttaattctcttttcttcttctcttttccgccaaggattttggccacaaattctgatgtaaacaaaaagatgtttggcattggtgtcactgattggttattgatgtcgatggatcattgatgaaaaaaagagaaaaagancttcacaaannaacgaagtnnnnctcnnnnnccaatnn

SEQ ID NO: 1497 - DNA, 851 bp, Triticum aestivum
  Clone ID: PAT_TA_1497
gaatagcgaatagcctcgtccgagcccccacgacaggcaatatattcacaatggtatctaccagtacgatacggccacttgccggtcggatggcccgggcctcctcgacaaggatctcgtccgccgtccctcaagttgctcgcttctccacgaccgcaccacaatgcaagcgcaaaacgaaggacaacaacccgaagcgaggtgtcagtagcttgtatggttccggaccccgcgagcctctgtccatgtcaaacatcccactaccgaagccccgtgatttcaagcccaagatcgaggttgaccccaatcatggtctatggggattcttccccggacaaggcaagctgctcgcaacacccaaggaaaccgaggagcatggacgggcatggactgtcgaggaattgagaaagaagtcgtgggaggatctgcatgcactgtggtgggtatgttgtaaagagagaaacatgctttccacatcaagggcagagctcctcagaaccaaagtcggattcggtgaacgagaaattgatagccgagacgaggaggtcatgaagacacagcgagccatcaagcatgtgctgacggagcgatactatacttggcaagatgccgtcgacgttgccatgaacgacccagagatcaactttgaaggcggagatgggcaggcctacacaccatcggcatacgaggatgaaaccaacgctgccgagtggacacaacttggggcagagtcagaggcggccaagcagatcgatcctgtcgcaacagaggcacagggaggccaagatcgagaaggagctgaagaaataataagaaactaccacatggcgagaccatgttatgttactatc

SEQ ID NO: 1498 - DNA, 1561 bp, Triticum aestivum
  Clone ID: PAT_TA_1498
ccaaccagaccacgcacataccggcgagcattcttctcacagttttggcaaattaagtcactccagggacggtggctagacacgacccggtaagcaaatccacacagctcctgcccccgctattctggcgcttgcttcatttgctggtgaaagcgccgcgttttttgcttgcaccggcatagttatcgctaacaagccaactgtgcctcccactacaagctttctgacttcattaattttggtgaggtcttttgatgctggtcccccgagttatccttattttggcgttcctacaaaaaaggagctgaggtccaatggttatcccctcccagtttggcagaatgtgggcatgcgtttgcttaacaattttgaagatgaaatttagtgaagatatctggagtaaactcgaaagaaacgttgcttcaaatatgtctcaaagtgttgttgcattggcttcattcagtggaaaaacaaggtgttttgcttgcactggcgtattcatagactgcaatgggtccaccacaagagttctgacctccgcaagtttggttagaacttctgacaatgaaaacaaggttgctgataaccttaagattgtagtgtgccttccagataatcgtcataccagagggacattgcaacattacagtctacattataacattgccgtagtctacatcaagaatttctgctgtactcagacagcacaaatcgataaccagatgctaattaaacctcacaaggaggtagtagctatagggcgcgtctaccaatcaggcaaattaatggccacaagtgggatcgtgattgacaaaccaagtaagcttggctgcaaagagcttaagatttccacctgtaaaatcaccaaggctgggattggagggcctcttgttgattttgatggaaattttattggcatgaacttctatggcttggaagaggctccatacataccagtgaatataattctgaaagtcttgaagaattttgatgcacaagggactgttgctagagacgatgatgatagcccaaacagatggcccgtgcctaagtcattttggtgctatccgaagtggcacgagattgaggaagaaatagatgtggaagaagaaattatatatcatcggcagcggcaacaattctaacctgatgaagtgcatctggatgcatagtgcccctatcttgtcctcaagctgctgatccagttgaagcacaagccgattctgtctagcaagtatgaagtgtttgtaacttgcctaatctgaagcctgagatactagcttacgaacgtacttagtctgaactagagccgttaagagatgggttggggagactgtcgtattttttggtaccaagtttgtttgcagctgtggttgtgattttaaggcacaagtctgatcccaaatactaggttgatgatttgcatatcctggcaatcggattcttttggaggctaagttgagtagcaggagacggtagctccattctgctgtgctcaaacatggatccaaataggcttcatcagcattaacttttaagcactttggtgcagctcttgttc

SEQ ID NO: 1499 - DNA, 2354 bp, Triticum aestivum
  Clone ID: PAT_TA_1499
cggacgcgtgggattctttactctctccctctctctgatgcaccagcaggtcactcacaccatatcgccactgcccactgttgggtagccctcgtctaatctcctcatcggatcagaagaatcccagcgaatccagggaaagaagactccctccgagtcccgtccgagacgcagagtgtcagctccgactccgagcggatggcgtcgccgccggagggggtggagccggcggtgatccacgcgtggtcggcgccgcgctccctcagcaccagcctcatgtactccttctccgagagggatgacatggatgtgcttgacgagcctctctacgctaatttcctgcgtgtcactggcgttgacaggccctaccgccaggagcttctctctaaaatggatccggatggcaacaaagttgtcaaagaagttatttttggaccaggagagaaagcatatcgttactgcaagcacattgcgaagcagcgcctccctaatctcacaggtgacctgatgaagaagggaaaacatttcatattaatacgtaaccctatgaatatcctgccatcatttgataaagttgttccaccatccttcctggagctcggtgtagcagaacttgttgcaatatacagtgagttgtgtgagcttgggagccctccacctgtgatagatgcagatgatctccgaagagatcctgaggccgtcttgagtggactctgtgaggacctgggtattcctttccagccacaaatgctcaaatggaaagctggcccaagggactttgatggtatttgggccccctggtggtatgaaagtgtacatacatctacgggcttctcgaaatcccgtcgttaccctatgacttttccatttgcattttatgacctacttgagcaaagcttgcccttctacaatatgctgaagcgccaggtacggagaacaacaggatccctgctgccaccaccacctgatcctcctcttcctgtaccagaaaataaaaaaattcttgtttgggttggagatgaacttttgccacgtgatagtgcaagggtttcagtgttcgattcagttgtacaaggaggggatgctgtgtgggaaggattgcgtatatatgatgggaaagtattcaaacttgaagaacacttggatagattgtttgattctacaaaagctatggccttcagcaatgtgcccagtcgtgattggattaaggatgcaatatttaagactcttaacgcaaatgggatgttcaataatgcacatataaggctcactctcacccgtgggaagaaggtgacatctggaatgagtccagctttcaatctatatgggtgtgtcttgattgtacttgcagagtggaaaccaccagtttatgataactcacatgggataaagttggtaactgccaccacgcgtcgtaattctccaaatagcgtagattcgaagatacatcacaacaatcttattaacaacattctggcaaagatagaaagtaatcttgcacaggctgaggatgctatcatgctagatcaagaggttttgtatcagaaacaaatgcaacaaacatatttatggttaagaagggcattgtattgacacctcatgcggactactgccttccaggaattacccgtgcaactgtcatggatcttgttgtgaaagaaaacctggtattacatgaacggcgaattagtctatctgaatttcatgctgcagatgaggtgtggacaaccggaacaatgggtgaaattacaccggtcgtgatgattgacggccgtgaaattggtgatgggaaaatcggtccggtcacaagacaaatccagagcgcatacaaagtcctgacagcagggttaggagtaccaattcccaggaatgcggaggcataatcatttgtgcagacattcttcttttccttttgaaaaggagaaggcacctgttatctatggacaaactttcagggttcagtttcgagtaatgataataaatactccctccgtcccgaattacttgtcgtagaaatgggtaaaaattgatgtatctagaactaaaatacgtctagatacatctatttctccgacaggtatttccggatggagggagtagtagctagcgttcaaagaagcacccagtgaaagtggcacatcggacagaaaactgagtattcgaaaatactggttgggtctgtgaattcatgatttagtgtgtgcctgtgtgcgccgaaacctgttccatgtcatttggaagctgtggctggtcctggacatagaacagaaaatggaatgttatatgcggttttattttttgcttgatttttttcgatccgtcgatcaatttacaggaacccccatgatgttgtg

SEQ ID NO: 1500 - DNA, 1050 bp, Triticum aestivum
  unsure (1)..(1050): unsure at all n locations
  Clone ID: PAT_TA_1500
cccccgggtccagccaaaaccccaatttcctcccgcgggagcgccaggaaagaaatgaatcaattcgcccctcagcaatcatcgctcgccatggactcaggggagagctccgccgcctccaacgccgcccacgcggcaatggccgtcgactacgcccccgaggtcgcctgctgcgtatcatccatggtcgacctcggcggcgccgccggcgtggagagccagcgcctgttcctggcgcgccgcacggcgctggagatgctgcgggaccgcgggtacagcgttccggaggacgagctcgcccgcaccctcccggagttccgcgcgtggtggtccgagacgcccgagatcgagcgcctttccttttccacaaccctcgcctccgacgagtccaacaaggtgcgaattgtcttctgcccacctgagcccgtcaaaatcgcagccatccgggaggtgtatctccgaatcaaagaagagaacttgtcttgcctgattctgattttgcagagcaaaataacatctagagctagggagtccatcaaaggaggatgttcaaattctaaagtagatgtatccaagatcacagagttactggtgaacattactaagcatgtcctgaagcccaagcatgaagtgctgactgcagtaagaaaaagcgaagctcctgaagcagtacaatgtgggtggattcacagttgcctcgcatgctagagaccgatgctgttgctcgctactatggccttggcaagggaaccgtggtggaattcacatatgacagcgagctcaccgtcgaccgtgtcacctgcggacgcagcggcccttggggccgtggggtttccgtgggatggtgctcgctggccgcggtttgccaaaacggcctcctggctcaggtacttgccctcccgtgctgtcttnctgttaggcctcgcgacaatgtagttagaaaacctggtagtcagtttcagatgttacttagaaagtnctggcacaagtttgtttnccagtgtaccatggtcgctgcatgtnctttgaaaactgaaatgtgtgcggaga

SEQ ID NO: 1501 - DNA, 650 bp, Triticum aestivum
  Clone ID: PAT_TA_1501
ccacgcgtccggctccctgcaaaaaccctagctttacctccgccaccaagcgcctctacgatgaagctcgtcagattcttgatgaagctgaacaacgagacggtgaccatcgagctcaagaatggcaccaccgtccacggcaccatcattggcgtcgacatcagcatgaatactcatctgaagactgtcaagcttacactgaaagggaagaatcctgttacccttgaccaccttagtgtgaggggaaacaacattcgatattacatccttcctgacagcttaaacctggagacgttgctggttgaggaaacaccaagggtgaagcctaagaagcctactgcagggaaacctatgggtcgtgggcgcggccgtggtcgtgggcgcggtcgtggcagggggcgctgagctatgttataccttggaaattttgcactgcatgcttgtgtgcagtgtaatctggtttcttacttgtacggagcaatattcttattagagccaagaagacgttgatattggctgtaccagctgttcttgatgtggaattatgttatgttgttggtgtttgactgatgttctaaagtgtgctagctttatattgcgggtgttcaaaaggaagttgagttatggagacaaaccttggaatcgaaaaa

SEQ ID NO: 1502 - DNA, 867 bp, Triticum aestivum
  Clone ID: PAT_TA_1502
tacccgggcgtctcctccgaaccctcccgcagacgaaccagctcgacctcctccgattccgcccgcctccgttcctccgcatcttcccggccgccgccaagaatgaagctcgtcaggttcttgatgaagctgaacaacgagacggtcaccatcgagctcaagaacggcactaccggtccacggcaccatcaccggtgttgacataagcatgaatactcatctgaagaccgtgaaagctcacaatgaaagggaaggaatcctgtaacccttgatccacatcacgcgttgagaggaaacaacattaccggtactacatcctcccttgatagcttaaacctgggaaacgttgctggtttgaggatacccccagggtcgaaggtctaacgaagccaactcacagggaagcctatgggtcggggtcgtggacgcggccgtgggcgtggtcggggccgggggcgctgagctttattggttccctgctttggtaagctcgtcgcagtcgcaagtccctataggcgtaaacctgcttcctcttgcgagctatgtcgaatgatggtttctgttctgttagaagatgtcaatctaagtacgtgttgatgcggaatcatctcgcctgtttgacctatgttcttatatattgttcgtaatgcattttctcgggaatttcacttgcaggcctccagacttttgaaatgctaagtggcatcctgtgctgttacttgttaccctggaattcttgcccttgtgcttttgcgtagcagtaagttgtgtttgagtagaaactgaccctttttctttcggggcaatctgattttctgcccgggggtgggttagtttcctaaaagtttgggaacaaaattgaatcat

SEQ ID NO: 1503 - DNA, 1008 bp, Triticum aestivum
  Clone ID: PAT_TA_1503
cgtccgaagatgtcaatctaagtacgtgttgatgcggaatcatctcgcctgtttgacctatgttcttatatatgttcgtaatgcatgtggctcgggaatttcaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaaaaaaaaaaaaggggcggccgtttaaaagaatcaaagttaacaaacccgtgaatgcaacgtaaaagttttttaatagggccaccaaaataaaatcaactggccgtgttttaaaaacgtcggaactggaaaaaccttggcttaaccaaattaaatggctttgaaaaaaatccccttttcgcaagttgggtaaaaaaaaaaaaggcccgatccaatcgcgtctccataactcaacttcctatttatcaacatcagtcaaacaccaacaacataacataattccacatcaagaacagctggtacagccaatatcaacgtcttcttggctctaataagaatattgctccgtacaagtaagaaaccagattacactgcacacaagcatgcagtgcaaaatttccaaggtataacatagctcagcgccccctgccacgaccgcgcccacgaccacggccgcgcccacgacccataggtttccctgcagtaggcttcttaggcttcacccttggtgtttcctcaaccagcaacgtctccaggtttaagctgtcaggaaggatgtaatatcgaatgttgtttcccctcacactaaggtggtcaagggtaacaggattcttccctttcaatgtgagcttgacagtcttcagatgagtattcatgctgatgtcgacgccaatgatggtgccgtggacggtggtaccattcttgagctcgatggtcaccgtctcgttgttcagcttcatcaagaatctgacgagcttcattgtggaggcgcttggtggcggaggtaaagctagggtttttgcagggagc

SEQ ID NO: 1504 - DNA, 736 bp, Triticum aestivum
  unsure (1)..(736): unsure at all n locations
  Clone ID: PAT_TA_1504
ggtttcacgtccagagctgtagcaaacaagcaagcaacaagaagcaacttactaagagatcgagtggaaatccgttcaacttggattgatctgatggcgcgcggtaaggtggccgagtggatacggaagcgggcgatgccgaggaagtcggcggccgggcgcccgagcagggccagcggggcgtcagagccgatactaagagacgcggaggagagctggagcggcgccagcggggcggcggcgccgatgcctgctagaaaggccgccgggagcgggaagggtgccaatggcggcgcgccggcgcactcgagctcgaaggtccgggcggtcggcttcttgtcggcgctgcggtggcggccgcgcgtgaacgtgctggcggtggtgtacgagaaggtggtgtaccacgtgatgtggctggtggagtccgtggtggtggtggggaggctcgtcttcttcctcatgcgcttcggcttcaagcagctctgagctcacccgatgctattgctatggcgtggagggtggtggtggacaagaagcgtgcgtgattctttggttgactgttttttggttcgttccgtttcctctgtgctgaatagtctgccgttcttcggaggcttccgatccgtaacaagttgtaaatgccctcactcatctctcttgtgcataaagaaaatttctgtggctggttcctggtttaacggaaatgtctggacnnatagatggtggggcattttta

SEQ ID NO: 1505 - DNA, 1082 bp, Triticum aestivum
  Clone ID: PAT_TA_1505
ggcggcgggaagggggaggcggcaccgaagcccagcgcaccgcaccgatgggaccgccgagcgccgcaaggcggggaagggaggagagggggtgggggccagcgcgggcagcagcgactacgtcctgccccagccggcctcccgccacggcggccgccggcccgcgccggggccgggccagccgggggcatgagactgcggccgaggaggcggcaggcggggctcgagggggtgagcggggaacgaggcgggggcgaggggccacgcggggcgccgccgcgggcggtgctgcggcgcaggaggcgggtgcgcgggggcgtggacgaagcgtgcgatggtaatggtgccctcatggccgcgcgccccgaaggcgctgatcggggcgcctaccccagtctcctacccgggcggcttccccgcggcggtccacgtggtgccgcggcgcgggcgcgcgcgcggcccccacgcccccgcggttgccaacgcactccggtccctctgcaagacctgcaagtcctacagggacgcacgcggcgcttgttctcgaggcgcctatggtggccaccgtcctccgcgatcgtacgaagctgaagccgcccgtgctcgtgctcctgccaaatcaagccctccccttacttctgcttcctgcggagcctcggcaaggtgcaggtggaggagtgcaccagcaggccggaagggcctgacgctggcggttcggccgccgagcaagggcgtcggcggctactctggcagcaccctgtggcatcagaaattctgactaatggcttgacgctcgttcactcacaccaagagcctcgctggatgattttaccccctatcgagaggctaatataagagattattgcaacaatgatgctccggtactccttgtatgtttgtttctgtgcgtgtgtttttctctctttctctgtgtgcgtgtgtgttgtcattccttggttaattaattagcaataaccctcacttcgctgatgtaaagccaaaagctgacccgcttcatgtaacatatctgtgctctggcgtgtatgtttgtttgtttgttgaaaaaaaaaaaaaaaaaaaaa

SEQ ID NO: 1506 - DNA, 1034 bp, Triticum aestivum
  unsure (1)..(1034): unsure at all n locations
  Clone ID: PAT_TA_1506
ttcgcctggtgcgctctcgcctgctgtggcacatcctgcaaatgcagtaatgtctgacgagatgcgtgctgctgtgaggcatgtagcatcacttttcccgactgcaatcattagtggaagatctcgtgacaaggtatttgactttgtgaaactaaccgagctgtactacgctggaagtcatggaatggacatcatggggcctattaggaagtctgagtccaatggtcaccatgtggaatgtgttaggtccactgattcagagggtaaagaggtcaatctcttccaacctgcaagtgagtttttacctatgatagctgaggtgtttgaaaatcttagtgagagtataaaggacatcgaaggtgcaaggatggaagataacaagttctgtgtgtctgtgcattaccgaaatgttgcaccacatgactacgaaacagttcatcagcgtgtaactgctgttctgaaggattacccttgtcttaggcttacccatgggaggaaggttcttgaagttcgccctgtcattgactggaacaaggggaaagctgtggaatttttgcttgaatcgcttggactaagcgagagtgacgatgttcttcccatctatgtcggagatgacaagactgacgaagatgcattcaaggttctgaaagcaaacaaccatggctttggaattctggtttcatctgtgcccaaggacagtgatgccttctattccctgagggatccatctgaggtgatggaattcctgaggacattggcagcatggaaggagggttctagctgagcagacgggaagaacggttttgctgtcctggagaagcccccaattatatatacaagctaaccaaataagttggctgatataagagagtcaggccaaagcttttttgatttggcattttgtaaatgtggctgccactttttttggcaccaccttttgtcttttgttaatgggacttatcagtttcattcttttattgttaaaaggttcttttagtatatatcaatataagctgaaatttttccggctggnn

SEQ ID NO: 1507 - DNA, 1094 bp, Triticum aestivum
  Clone ID: PAT_TA_1507
cgtccgcggacgcgtgggttgagatgtggaagatcaagaagctgatcaagggactcgagtttgctagaggcaatggcacaagcatgatctctctgattatgcctccacgtgatcaagtctcgcgtgtgacaaagatgttgggtgatgaatatggtactgcttcaaacataaagagtagagtcaatcgtcaatctgttttgggacccacgtcacctcagcgcagcagaggctgaagctgtataacagggttcccccaaatggactagttctttacactggaacaattgttactgacgatggcaaggaaaagaaggttacaatcgattttgagccattcaagcccatcaatgcgtccttgtacctttgtgacaacaaattccacactgaagccttgagtgagctcttggaatccgatgacaagtttggcttcatcattatggatggtaatggaactctttttggcacacttagtggcaatactcgtgaagtgcttcacaaattcagtgtggatctccccaagaagcatggaagaggagggcaatctgctctgcgttttgctcgccttcggatggagaagcgtcacaattatgttcggaaaacagctgaacttgctactcagttcttcatcaacccagctaccagccagcctaatgttgcgggactaatattggctggttctgctgattttaaaacagaactgagccaatctgacatgtttgatcagcgccttcagtgcaaaatacttaatgtggttgatgtttcttatggtggcgagagcggtttcaaccaggccattgagttatcagctgaaattctagcaaatgtgaagttcatacaagagaagaagttgatcgggaagtactttgaagagattagtcaggatactgggaagtatgtctttggagttgatgacaccctgaaggctcttgaaatgggtgctgttgaaactttgatggtgtgggaaaaccttgatgtcaatcggtttgtgcttaagcacagtgcaactggagaaattatcataaagcatctgaacaaagaaggtgaagccgaccagagcaacttccgtgatccatctaccaatgctgagttagaag

SEQ ID NO: 1508 - DNA, 2175 bp, Triticum aestivum
  Clone ID: PAT_TA_1508
ccggacgcgtgggcggacgcgtgggcggacgcgtgggcggacgcgtgggcggacgcgtgggcggacgcgtgggtgcgtccagccagaggagaggattccccacgccttcagccacaccgcccgcgtcccccctccccccccccacccccccgcggccccccccgccaccccccccgtccccgtcccccgtcgtcgcctccccccggttcgcaacccccgacaaccgctcctcaggtgaactgatcacccaacttttatcaagatgtctgagagtcatgaaacggaaaagaacattgagatatggaagatcaaaaagctaatcaaggaactggagtctgctagaggcaatggcacaagcatgatctctcttattatgcctccacgtgatcaggtctcacgtggtggcaaagatgttgggcgacgagtatggtactgcttcaaacataaagagtagagtcaatcgtcaatcagttttgggtgccatcacctcagctcagcagaggctgaagctttacaacccaatggtttagttctctacactggaacaattgttactgatgatggaaaggaaaagaaagttactattgattttgagccattcaagcccatcaatgcgtcactatacgtttgtgagaacaagttccacactgatgcattgaatgagctgttgggatctgatgacatgtttggcttcattattatggatggtaatggaacactttttggcacactaagaaaacacgtgaagaatttatcctaaagcgcaaggatgactctgtgtaccgatcctcgaagagtagggcaggtttcgccaatcttttctaccttttgctcgccttcgcgtcacaattatgttcgaaaaactgctgaacttgctactcagttcttcttcaatccacctaccagccagcctaatgtagcaggactaatattggcctggttcggctgattttaaaacagaactgagccaatcaggacatgtttgagttgcatcagcgccttcaggtgcaaaatacttaatgtggttagatgtttcttaatggtggcgagagcggtttcaaccaggccattgagttatcagctgaaattctagcaaatgtgaagttcatacaagagaagaggttgatcgggaagtactttggaagagattagtcaggatactgggaagtatgcctctggagttcgatgacaccgggtgctctcgtaacttggatgctgtgggaacttcttgggggcgggcagtccgtgcttacgcacggtgcgtccggaagaactttgcaacaggcgtctgtatcatagagcgtctggccagaccagagcaacttccgtgatccatctaccaatgctgagttagaagtccaggagaagacctcacttctggaatggtttgctaatgaatacaaaaagtttgggtgcacccttgagtttgttaccaataaatctcaagagggctcgcatttctgtagagggtttggtggcattggcggtatcctcccagtagcacctggacattcgctcctttgatgatcttgatgacgacgagggtgtctatgaagactctgattagcaaccaatcaatcacatgcctgaggcagtcgcggttaaatctgaatttggcgcgactatttgctccggagcacctcaaagaagctatccattggatgatgggcgcgggtcagctacatactatgctttggaagtctgagacgatacaatcgcaattcctctattaaacaacgtcgagatgttatcctaaatcacaatgatgactctagtgtactgaactctgtgtttgttaccctcttgttttgcccatcttttttaatccatagaactcggtgcttgtctgcctgacttgaactgtgttggactgccaccaatggttgtatttagcgagggatatcttgaatagtggaataacactggcaaatgtctgcctgaatttgagttgttgtaagctacctattgttgttgtcatagcgggaaagggtttaattgggattaaatctaagtcatctcattcaaaacccctcctaaaagcaccctacaacccgacttgggcctcttttatctcggtccggaggcctgggtgcctggacccctcgaagtcccctcccttggggttaaaaaaaaggccccttcctccaaattccacaaagggagggcccaaaaaaa

SEQ ID NO: 1509 - DNA, 868 bp, Triticum aestivum
  Clone ID: PAT_TA_1509
tgcgtgggtacatcagcctcggggagcgatggctagcgtgtttcatcgttctctccttgatctccatcaacgtggttcggatcctcgtcgagagtgcgcacgaggcccaccaatgggtcgccaaggaggaggaggccaagtacaaggccgccaaagacgcctacgagctggccagacgcaagctcgcgaaattcaacgggcccctctcccaccgcaaccgcgaggcgcgcgatccggcggctgagcagccgcaccttcgtgcggcggctctgaatgccgcgcaggaggagcacgacaggctcttcaccgacgagaagctcgcaaaaagggagatggaaaggttagtgcagaaacaaggcatggagcggattgagggatggccgttggttgtgatccgtggtttgttcttcttttcagttctttgctcccagatttcttgcgggtttgcaacagcaggcttctattactccaggcagatagagtcgcgctgtgctctcggtccgcttgatatctttgctttcgtgttgattggagtcgtttcactgccgtaccatttgttccttttctgggtttctctgcgcgggaactaatgatgtcgatgatgagtttcaaagcggtcggtttgttaggctaggtcttcaaagctgatgtcatcgtgggcaagatcagcattagtagtagtagttttagcggattccgtgtgtgctagtagttaatttgtaccagttcatttgtatcccttgttgtaataggtcttcaaagctgatgtccccatgggcaagatcagcattagtttaagcggaatctgtgtgcgctagtagttaatttgtaccggttgaaactcataagtactatgtaatcttccttg

SEQ ID NO: 1510 - DNA, 1129 bp, Triticum aestivum
  Clone ID: PAT_TA_1510
ggtttctcccctcctgccccccctcccccccgccgcgctcgcgctcgcccccgccctcccccacgccgccgccggaggcggctgcggggtctacgtccccgcgcgggtcgcccagatctcctggcgccccagggcgttcctttacagcggctgcctctcgcacgccgagtgcgaccacctcgtcaagctggccaaggggaggctggagaagtcgatggtggccgacaacgagtccgggaagagtgtcatgagccacggtgcgcacaacgctctggcaccttcttgtccaagcgccgaggatgaaatttatctctggaattgaaaagcgtgtagctgcttggacgtttctccctgaagaaaatgccgagtcaatgcaggttctgcattatgaagttggtcagaagtatgatgcccacttcgattattttagtgacaaaaagaacataaagcgtggtggtcatcgggttgctactgttcttatgtacctgacagatgtgaagaagggtggagagaccgtgttcccaattgctgagggaagagatttacaacataaggatgaaacgtggtcggagcgcgcgagacatggcctggcagtgaagccaagaaaaggcgatgcgctactcttcttcagtctccacgttaacgcgacaacagatccgagcagtcttcacgcgagctgcccagtagtcgagggcgagaagtggtctgccacaaaatggatccacgtccggtcattcgacaaccctccagatgttatgacggacgcacggtgttctgatgacaatgagcaatgccctagatgggctgctcttggtgagtgttacaagaacgcaaaatacatggtgggcacgaaggacaccctcgggtcttgccgcaaaagttgcggggtctgcgatgcttgaaccccggcaccaatcttaactgaatttgcatggttactgagatgtagattacaaaaccaaataggttcttagtagcatggcattagatgtttactctccttgtcatgtagtttgacctcagagcatcttgatataaagcaaaaagggaattgactttgtttcagaagaatttggatataacctgatggtatcaaatatttccaacaaaactttgcaaaatttctttc

SEQ ID NO: 1511 - DNA, 798 bp, Triticum aestivum
  unsure (1)..(798): unsure at all n locations
  Clone ID: PAT_TA_1511
accttacaccacaccacgcttgaaacaacaacaagcacacggaggagaaaaacagagagagcagaccaacaagaaggaccctgcaacccctctgctctgttacgccgtggaagtgaaacaccaaggaaaccatgaggcccggagccgagttcgtcgccgtgagccaccgcgtgggggccccgacggtggcgccagcgcacgggctgatcaacgggacggtggcgccacactcgccgtggcagtcgccggtgccgtacctcttcggcgggctggcggccatgctggggctcatcgccttcgcgctgctcatcctcgcctgctcctactggaagctctcggggtacctcgacggcgaccgggacggccaggcggcgggggacgccgacggggagaaggcctcggcgtcgggcgcggccaggccagccatggatttcctggagcacgtggtggttatcatggccggcgacgagcggccaacgttcctcgccaagccggccgccagccgggctgctgaggtggagctcgcaaccgcggccgcggcagcgagcgcgctcaccggcggcgaggggcaggagaagaaggtggacgagcagggcagcgaggcgagctcgcatctcggcgccgactcggcgaggccgagccgtgatcaccacgacacggcgagccggagccacgtccatgaccaagacgcggcgggccagagccgcgaccaccaccacgatgaccaagacgcggcgagccagagcagcagcacgacggncctgcaagaaagctcgcaatgaaagcagccgtcttttg

SEQ ID NO: 1512 - DNA, 666 bp, Triticum aestivum
  Clone ID: PAT_TA_1512
cgtccgcccacgcgttcgagcgaggcgggccaaggagagaaaataggctcctcgcggctcgccaaggccgtattctgcagccagccaccgccactctccgccgcccgcctccgtccgggttccgccgtgccggggctgctcgagagagcgagcgagtcgccggcctcgccgcctccgtcccgtattttcctccgatcctgccctctccgtgtccctgctttgggtctcagggaccaaaccatcccaccgcggcttgctggcgagctgaagacataagattgtccttcgctggagtttaccaatgtcggcaggagccactataaactggatcagaaccccatttcacgcccagagatttcatgacttctcaagtttaagttttagatgccgaaacacttttggatcaattcagccttgctggttggcaactgatcaggattcatccctctccaaagtccgtgtggctgcagactactcagattcagtgccagattccaagtacatgagagatcggggataccatcctcttgaagaaatcaaagaacgcccaaagaaaaaggacatttcactggacggatgtagaaacagctagaacagtagtagaggcaaatagcaagggattgctcgtatttcctgccagggtgcataatgaacctcgggcacttg

SEQ ID NO: 1513 - DNA, 868 bp, Triticum aestivum
  Clone ID: PAT_TA_1513
gacagtgagactaataatctgaaggaggagacaatcaagaagcagtacgaagtggtaaagaagcgaacctcagacatgaacagatatagtgccggttcgcatgttatggagtatggcgacaagaccttcaaggatgagaagctttacctttatcaaggtttcaatcctgcaaacaccaacattacaaacaagctatttttgcaagccccaaaggctgcaatcaaccaaagagacgcagatcttcttttcttgtggaggaggtatgagctgctacatgaaaagtcgaaagagaagacgaacgttctgagggagatcagtgagacagtcacccacaggaagcatcttgacagcagcatcgattttattgggaagcttctatttggctacgagaatggaccttcggtgcttcaagctgtcagaccttctgggaagcctctagtggacgactgggattgcctgaagaggatggtgcggatctttgagtctcattgcggatcgctcactcagtacggtatgaagcacatgcgagctttcgcaaatatatgcaacaatgggatttctggcacaacgatgaaggaagcaagcatcggggcttgcggcgttcagaactccgcgagatggagcagcttgatccaagggtacagcgcttgatcaaccaacctgctgaggtgcatgctagtatgttgttacttgtcgtcggcttatgtgaatatgtagtattgtatggggctattagtagtgtatcatcatctaaataacctttaggccgactatataagaatgtggccatgtacgttgctttagctgtgtgatgtatattataccacgtactattaatcgtgcatggtgtgtggttagctgaacaacc

SEQ ID NO: 1514 - DNA, 2337 bp, Triticum aestivum
  Clone ID: PAT_TA_1514
ccctgcatggcggcgctggcgcctactttaccccgcaccctgcgccgctcttctcgcccgtacgttccggctcccccgcgcggtgctcttaggcagtagtgctactgcgacctcacctgcgcagacggatggcgccgcggtggtgcttcgcgttgctcctgctgctgtgtgcggcggccggggccgacgcctcgaaggggaagtgggacccggtgatccggatgccgggggaggaggagcccgccaggcgaagggagctccgaggagggggagccgacggcgtcgggacgaggtgggcggtgctcgtcgccggatcctccggctacggaaactacaggcaccaggccgatatatgccatgcctaccagatattgagaaaagggggcgtaaaagaggagaacatcgtggtgtttatgtatgatgacattgccaacaaccctctcaacccgaggccaggggttatcatcaaccacccagagggtgaagatgtatatgctggcgttccaaaggactacaccggagaggcagttactgctacgaacttctatgcagtgctcatggtgaccaaaactgcagccactcgaggagtaagatggtcataaatagcacaccgaatgaccatatatttacctacttcccagatcacgagggtggaggagcagttactattaagaacttctatgcagttctcttgggcaataaaactgcggtcactggagggagtaagaaggtcatagacagcaaaccaaatgaccatatatttatctactactcagatcacgggggtcctggagtccttggtatgcccaacctgccatatctgtatgctgctgattttatcaaggtcttgcaagaaaaacatgcatccaatacctatgcaaaaatggttatatatgtggaagcttgtgaaagtggcagtatttttgagggtttgatgcctgcagacctcaatatttatgtcacaacagcatcaaatgcagaagaaagcagctggggtacatactgcccgggaatggaaccatcgcctccttctgattatagtacctgctttggtgatctctacagtatttcttggaaggaagacaaggagaatcattatctagagtacgagccagcaaacaacaacattgcagtggaacaaattcgacaatccgaaatgactgcattcagtgccagttagccagttcttcagtttttctgaaagacgtacgagcttctgcatggtaactgtaatgagcagtcaaacgatgagacggagatcagtgagacagtcgcccacaggaagcatcttgacaacagcatcgattttattgggaagctcctatttggcttcgagaatggaccttcggagcttcaagctgtcagaccatatgggaagcctctagtggacgactgggattgcctgaagaggatggggaggatctttgagtctcattgtggatcgctcactcagtacggtatgaagcacatgcgagcatttgcaaatatatgcaacaatggtgtttctggcacgacgatgaaggaagcaagcatcaatacctgcggcagtcacaactcggcaaaattgagcaccttgatccaagggtacagcgcttgatcgatcagtctgctgaggtacatactagtatgttccttgtcctcagcttacgcgaatgtgaatatgtagtattgtattgtattgtactgttagtgtatcctgaaaataaccttggggccggcgatataagaatgtactatcgtagttacttgtcctcggcttatgtgaatatgtagtattgtatggggctgttagtagtgtatcttcatcaaaataacttttaggccgactatataagaatgtggccatgtacgttgctttagctgtgtgatgtatattataccacgtactattaatcgtgcatggggtggggttagctgaacaaccaagtaatgcgttcacaagcagacctctctttcttgtctgaaagcttgagtggagccgtggcctcgcattagacacagataagaagcaaaaatttcttggctgcaaggtgttccgtctacatggtaacatggaccaggaagaccgcaaaaagtcatacctgggattcagttctgaaaaatctgcaatccttgtatgtactgatgttgctgccagaggcttggacattccgaaagttaggtgcatcatacagtatgattcacctggggaggcttctgaatatgttcacagggttggaagaactgcaaggattggtgaaaagggagaggccctcctgtttctccaacctgtcgaacttgactacttgaaagacctatagctacatggtgtatctctgacagaataccccttccaaa

SEQ ID NO: 1515 - DNA, 481 bp, Triticum aestivum
  Clone ID: PAT_TA_1515
ctttattctttgttggcagtgaagttgtccatccagcacatcagagttgggtagtaattgggcccaatattctcgacatgctctatgctgaaccttgatgacgtgctcatggcagacactacacgggccaaagaaggaaggcaaccaccaggaaatatatattctgttaagaagtctggcctttttctgtattgctcgtaccgttcctctggagctgagatgaactgcaggcacattatgccatcttcagccaagtaagactcgcagcaggcaaaaaattcgtccatgcattcatggccaacatgttcaatcatacagatgcttatgattgcgtcatacttgtaaggtggtatgtgacggtagtcacacagcagaaaagttatgtggtcctctaagccagcttctcttgcttttccctgggcgtatttaagctgctcctccgacaaagtaactccagcggacgcgtgggcggacgcgtggg

SEQ ID NO: 1516 - DNA, 1397 bp, Triticum aestivum
  Clone ID: PAT_TA_1516
gttatttacataaaattgtaaacctataacataacttcttaaacttctaaatcacaagcaacctggctataaatatagcaagtgcactccatttaaatgttaattgttagctacaaataaactagcacgataaaaacaactgatgcaataaaaatcaacatccttgatcaacaaaccaacggattgcatcgccatttttaacaaggctgaccagaaaaaacctcgttaaaggccctagggttccaagacgtaacaggtcatcatccgaacggagacggaaaggtaaagtacagcaagcaaagggccacgaggcggtgggcctttggccgatggcagaccatctggacagctccagctgctcgagacctgaaactaacagaaaacaatcttaggtgtctccgaactagctggagacattaagcatcatgacccgtatctaaaattgcaccacaatttaccattgagtgttccctcaaagccatgcctgttgtgttggaattgggtccaacttacgcgagatcctcaatgcatgggccttatgacgtagtcatgcccgatcttatatgcttcaaataaggaaatccctcgccacagtgtatcgattgtattgtgccgccggacctgagttggtttaactcaccataattcgtacttcggcccataaagtccctcccttgtcgataaattcgaccatggatccacggccaatcagctttattcatacagaagcttatgattgcgtcatacttgcaaggtggtatgtgcacggtaatcacacagcagaaaagttatgcggtcctctaagccagcttctcttacttttccctcggcgtatttaagctgctccgccgacaaagtgactccagtgtatttgcagccagtttgcttaaccgcttgtattgctaaacttccccagccgctaccgatatcaagaacatgatgccccctcttgactttagccttgttgattagaaggctaagtttacgttgctgggctgcttctaagctttcgttctccatcttgaaaattgcacaagagtaagtcatcgatttatccagaaaaagcgagaaaaaatcgttactaagatcatagtgctgagagatgtttcgacgagtttgtgtcgcagtgttcttcatcgaggtgtggcgcaaaaagtgtttagcatatgccagttgagctagtacatacacgggtgacaaccaaaacccttttctggcaatacgtcggttcctacgctcgtctctgttagcaatgagaatctgcaaagtaattgatcatggatttgatctgtaatgaacaggaaacagctctacccataagctcatggactatgatttagttttaccaggataagattcagaaggccttctgtcttgtcaagaacagagctcgtgcc

SEQ ID NO: 1517 - DNA, 376 bp, Triticum aestivum
  Clone ID: PAT_TA_1517
cccacgcgtccgggtgtgcaggttggaccagccggtctttggtcgtgtgttgcagctgccggtgaataccatatctggctgcgatcggggcgatgatgtggcggcatccatgggcgtcgtgaccctgttgagggtgtcatcgctgcatcttgtctccctgactatgtctccggctttggggactcgtggttgttggtgttgccggggcggccaccccgggttttggtggtggcgggtcctgacacggggcggggcgtgcctgggcgtggcggataaagggatctcgcgaccagattggggtcagcgttctgcaggggtgtggtgctcaatgggcgggggtttatgggtggtaggttggtccctacacctccgggag

SEQ ID NO: 1518 - DNA, 855 bp, Triticum aestivum
  Clone ID: PAT_TA_1518
acttcattatctcttccttaccttcatccttttacacagtaactgcccaagatgaaaaccaccactttcgccgtcgcccttctcggcctcttccctgccatctttgcccaagagactctcgctccttcgcctaccgagtctgtaggatgtgagcctcatggcgaccactggcactgcgacggtgccaggtctactcttgctaccgaggccaaggtcaccaccgacgctgagcatgacgacgaacatgaccatgaccatgaccacgataccactggaactggatccctggctccctctcccaccgagtctaccggctgcgaacctcatggtgaccactggcattgcgatgctgccaagactggctcttcagaggccaaggctacagatgatcacgaccatgaccatgaagacgaggaccactcccactctgctggcgcaaccaagtcactgtccccttctcccacagaatctactggctgcgaacctcacggcgaccactggcactgcgacgctgctgccactgctgcggccactggctctggctctggctctggctctggctctggctctgccactgcatctgctactgagagcgactctgctgctgtgaccgacaacgctgctgtcattcaaattattcctttcgcaggaattgtcgctgctgctgttcttgctctgtaaagtactttgagcgtctggattggagagtctgggatggtctttcgtgtcgacttcctggatgcaacgcagtggaggatagaaaagacatgggttgatgcgcaactcttattttcttgatgaaccagatcactatagatgtatgatcattaattatgactttatttgacatgttct

SEQ ID NO: 1519 - DNA, 1081 bp, Triticum aestivum
  Clone ID: PAT_TA_1519
tggacagcgccgcgcgcacgcccgcacccgcgagcggcagagagagcgagcgagagattgggaggagctccggcaggcaggcagcaggaagtcgagccgaggagccaccggagagacctgccggccggagagcatggaggagccgtccatggccgacccgccgcggatcttctggaagtccaggaggaggccgtcgtcagccaatggccggagcttgcaagcacaagaacatagcaacgaggccgctgccaccgaagaggcagcagcggacaatcttccggctcaaggagaagccatgaagattgatgacgcaaatgcagcaagcaccaccacagaggatgatgctcatcaggcagatccgatggctaacctatctgagaagcgaaaggcgctcttcgagcccctggagccgatcaatggcaagcgcagcgctgacatgctgcttccgccaccggacttcgagcctacatcgtatcccaagggatggctggttggtaagaagcgcaagctcgtcaatgtcgatgtggtggagagcatgaggaggatagcgatcctggaaatgaacagaaaggaccgtgaaatcggcgggctcaatgaacagctagaggaggactcccgcgtgctggagcttctgcagaagcagctcacggacgagcgcaggaagcggtcggagatcgagaaggagaactccatgcttcaagagcaggtgaccatgctgatgaccatgcttgcgattaagcatttccgacaactgcaggttcccctttttaagaaaaggcgtctgcagcacgtccgtctttgggtgccaatttgagagtatcccggaggtttctattggtctccttgtgtagtattcaaatattatttcgtttcacggtttggtttctagtagtctcaggggtagaattcaatttatattatttcgtttcatggtttgcatcgtgtaggcgaagggtgcatgttttattgttacctgttacgtgtctaggtttgttgcagatgtatggagacatttgcgacgcattttatttgaaatgcaattgtgtgtatatggtattacgattattttgccagccactgc

SEQ ID NO: 1520 - DNA, 777 bp, Triticum aestivum
  Clone ID: PAT_TA_1520
ccggccgggccggaaccttcgtttcagatccagcgagagagagagacagcgaaatccccaatccaccaaaccctaacccaccaggagagatcggcgagagagatccagcgatggccggtgagaaggtgcagtttgccatccccatggccgccggcgagaaggagcaggccaaggtggagaaggaggcggcactcaaggccaaggcggggtgcggttccaagaggagggcggaggaggaccgcgaggaggcgccggcggctgttggcgtgaaggtgcaatggaacggcgaggatgagtcggaggacgagctctacaaggcgtgcatggcagaggactcgttcgactacgactcggacgatagcctggatgtgtacgccgccaagtacaaggcgttgttcgagcgcttcatagaggcctgcgacgctcgctgcccttggttggtgggcaagagcaaggtggcgaatgctgatgctgatgagtctcttttggtgtgagaagctgattcattgctcttgtgattctaccagcatagagatgaaggaggttcagttcatgctatctaccaaccatgtatctacctatatttctactagttgttcatgtggtaatcgtctgtgttattgatccacctacccctgtcatgttattgttatcaagttaggcgcggatgaaccagtggcctgcgtgcaactgataatctagtaactctgtgttatctactagtaatgttattgtcatctcctgaaccaagtatgctattcgtctgcgataaaaaaa

SEQ ID NO: 1521 - DNA, 1985 bp, Triticum aestivum
  unsure (1)..(1985): unsure at all n locations
  Clone ID: PAT_TA_1521
ggtcccgttgctgcggcccgacccccgcctccgccggcgcgcgtacacgcaaatactcgcgctcaggtccacgcccccggatgaaaccctaggacccgatggcctagccaccattcccacacacagcccgcccgccgccgccgccatgccgccgttccggcgctgggcggatctgccggcggacctcctctgccgcatcggcgacagcctcgacctcaagtgctacgccagcgcgcggggcgcctgcacggcctggcgatgcgcgctctcgccgccgtccccgtcgctcctcgtcgtcctcgacgacgccaggtgctgcccgtccgccgcgtcgctccccacccaccgctccttcgagctcaagaacatcctctcggggggccgatgcgtcggctccagcaacggctggctcgccctctccgtctgcctctacggcggccagagcatgttcagcctcttcaaccccatcaccgccacggagatccttctgccgccgctgatctacgagagccgctgggtctccaagctcgtcttcgcgcccaaccccgccagggacgacttcgccgccgccgccatctgcgacatcgacaggctcgcctacgtcaccgcgggggccaggaggtgggccatcctcgatcccgtccgcctctccagcggagatcagctcgccgacgtcgtctaccatgaaaaaggtagggtctactgcctcacccgctatggcgatgtccacgtgctccgcctgccggagcgccgccgcatgaagcctatcgtcgtcgaggatccggctggcccatcagagccagagatgcctttagggcgtccctcactcagtcttcaaggaagaagacagcgcaacttgcgcatgctctgctatgaacatcgtagatggagagagcagcagcttccaattgctacaatgaaggctgccttctgcccagatgtgtttatgcctcttaggagagttcctcctggatctgtcggaccggatctaaatgcaccggccacagtcgagcccatgttgtctgagtgcaacctaccgttcgatcctgctacctgttttgccgcgccatacaacacggtgtcggtttttactagtgccaagaacctggtgttctgtgacggtaacctgtaccagatctggagaaatgcaagctgcacggtcactttgcagctgccaggaggcggtcaccgccgtgtagccgagaatgaaatacttgttctgaggtattatccccggcgccaaccatgctgggatgctgtgacagacttgggaggctactcagtgtttgttgggaggaacaatgccgtgtcgatgtatgctgaagatgttccaggactgaagggtaattgtgtctactggatcggcgggaggggcagggatcagggcatggtctttgacatggggactgggaggtctacaccttgccttcccgttgctggtgctggtgtcgttccggggcctccacagagtacaatctgctggtactttctcagcgacatagtgaataactgcaacataagtgcaggaagaaaagtttatcagacccgggcaagggtccgggctgaacgtgagcaagatttggaggattgatgcgtcgccaagcagattggcgacatagtgagcaccaccggccacatcggtggaagttatgtttatcatgcctgagcaagagcctctcatatggagaggcactgaagagtttatcatgcctgagcaagagcctctcatatggagaggcactgaagaactggcagagtgtaattgcctattgtagccagtagttcgttttaattcatctgtttcctaaaataatttgcttcagtactgttgttggtttgtactctagtccctatcatctttgtgtgtttatgtcctgtaatggaataatcggtgtttgtaaaacttatattcatcatattatgatggaataagaggatgttcagatatttgcaaaaaaaaaaaataatcncgtaaaaaaaaaaaa

SEQ ID NO: 1522 - DNA, 1526 bp, Triticum aestivum
  Clone ID: PAT_TA_1522
gatgaatataactgcatgaacgaccctagtcccagtttccatgtagtacctaccactaccagtacctcagcccgcacaagcccagctcactcgatgagatctaggaggactggtggatcatgggctaggcctcgtggttctgatgatggttattcaagtgattctgtattgaagcatgcatcgagtgatttccaaaagcatggccagcgtatatttgtttttgtcattggtggtgctactcgatcagagttacgtgctgcacacaagctttcatcgaagctgaagcgtgaggtcatccttggcttcgtccagccttgatgattcacgccacgttcatcacaaaactgaagatgatgtccgctgaagagctaacactggcacggtcttcacatataacaagcattatgcacatgtatttggtgatgctgggacaaaagacttattcaattttttacgtacacaattgggtgtaagtcgtgaaaataagttgcctccgctcatgatttacgcagcactcaatccagagaagtttcaaagcgataagggtacaaaaatgatgcagttggcaggattatctgctgatgacatgatcgctgtgaataatatgcgctgcttatgcactgacacaaaaaagtcctcaggaggaggttttacactgaaatttgatgttcagaagaaaaaacatgcacatagaaaagagcgaacaacggaacaatcagcatgggcactgtcccgattttatccggttctggaggaattgattgagcagctcagcaagggtgaattaccaaaagatgaatataactgcatgaacgaccctagtcccagtttccatgtaggacctaccactaccagtacctcagcccgcacaagcccagctcactcgatgagatctaggaggactggtggatcatgggctaggcctcgtggttctgatgatggttattcaagtgattctgtattgaagcatgcatcgagtgatttccaaaagcatggccagcgtatatttgtttttgtcattggtggtgctactcgatcagagttacgtgctgcacacaagctttcatcgaagctgaagcgtgaggtcatccttggttcgtccagccttgatgatccaccccagttcatcacaaaactgaagatgatgtccgccgaagagctaacactggacgatcttcacatataaaaagcattatgcacatgtacttcagggctccatcgggaattctcctttattttggtattttctttgtgatcgtttggtttgttacacactagttgcatcaaaaccacaggctatcaatacgttaagctgcataatattcattctgtaaggagcgacttcccaaaacccgctactcataattgaatgaatgtacataacagtcgccagaaactgtaactatgtgagttttaattatttggctgacggttcattttcctctctagtggacgagacagggggcgccggttcagtttcaagtaatgtgcaatgcgtacctgatcaaaaaaaaaaaaaaaaaaaa

SEQ ID NO: 1523 - DNA, 2641 bp, Triticum aestivum
  Clone ID: PAT_TA_1523
cactgcacgcccatcgctttcgtgctcccgtctccccccacgagccccccctcccgaaaccctaacgaccttccccggctagatccttccaccgtcccccgattggggcggcgcccgagccctccccgctgatggcgtcggggggcgcgcagatggaagtcgagcgccggcagcgcgacgtcgccgcgggcttcgtctcgctcccggagtccaacaaggaccttcacgcccttctcgaggaagctgatttctggttgtccagagtggaccagtggccacccgatagcatgcgctcgcgtattcggcccatgatggagactttgatcagaggttgtgtgccaacccaccgtgctccagggcaccccaggggtttaacaagttgcgtcaggcgctgcgccaggatctctagacctggttgcccttgttacgccaatgcgatgaggggtgtgatcagagcggctgtgggtgccatgagcaaggtggatgataccaaaaacccattgtacgcaacgcgcgtttcaattatggaaaccatagctagtgtcagatcttgggtcataatgttggaccttgacgatgacgacttgatccatgaaacattcacacactttttcaggatcataagcccaacacttcaagaaagtgtcatcacctctatggaaactataatgatgtttgtaatccaggagagtgagcctgtccatccaggtctggcatcttgcctccttcagaatcttaaaaaggaaaggaaggattctcatctagcatcttatcggcttgcaaagaggataacacgtctttgtcctgaaaaattaaagccggcatttgctgagttactccagggcactcccttagatgagtacagcaaagttgttgcatcttcggtagaaagttcttcagatgctggaagagacaacaacattgatgctgttgaaaatgacacggaatcttcaaagtcagagaaagatggacaagatggaagtcctacaaacagtactccaaatggattagcttcttctgaacagaaatctgaactgcctactgatgataagaaaacagcagtttctgatgacaagggggcaccagaaccagtcaccgcagagaccgaaaagctatctggtgtcaactcaaagaaaagcagtaaggttggcacttccactgagtccaaggtgactgaacattctaaggttgctagcgataaccaggaccttgcatctggggagctgtcaccaggggcaaatgatggcaataataagccgatggtagaggcttgcaacaaagcgacagatgatacatcaaagcctcttgatagtacacctgcggatgacacatcaaagcctgctgatggtacacctgctgtagataaaccaaagcgaggccggcctcctgcagtaaagtcacaggagaagaagcctgttgggaagagtcaaggatcaggtctagaatctaaagaagtccgctcaggcagtccttctggtgggagacctgcaagaagacccgctaaagatgacaaattatcatcaagaaagtccagtgaagaagaatcttcaaagaaacaaccaacggccagtcccgatctgaggaaagaggacactctctctgatgaagacactgatgaagatctcagtttgaaggaaatggcgtctcctaaatcattgaccaagacgggaaaaagcaaaggccaaccaggggacagtggagtgtcaaaaagaaaacttgtgcaggaagctgaagaggttcctcagtcaaagaagagcaaagtttttgatgggagccttgttggctcaagaatcaaagtgtggtggcctgatgacaaaaagttctataagggtgctgttaagtcatttgacgcttctgcaaaaaagcacaaggttgtgtatgatgacggtgatattgaacatctgctacttaagaatgaaagatgggagttcattgatgtggagcaagacgataatcctaatgcagcatctgataggtctcgtggtaggagaggcaagcaggacagcactgttgacagcaatccttccaggaaaagagggcgtccgaaaattgtgcgtgaggatagccctgtgtcttcagccaaatcgaaggtgaagagtgcagaaaaggatgctgaaggtggggggaggtggcctcgatctgctagcaggggaagcagcaaggatgaggctggcggcaagactccaaaaggcgcaagcgctgtgaaagcttctgatggatccaagagcaacggtctttcaggcaaacggaagcccaaggagaaagtagcagagtcatctgatgaagaggaggaagaagaagagccggtgtctgctaaggcatccacagggaagaagcgcagaaggaagatgctcaactagttgctctactgctgaaccagctagctaatagttgtagctagtctcctgattagtagctgtaatgttttaggctttacttttgtttgcgtgtggtcggcgttgaaacctctttggaagattggatgccatgcttgctttggttcaagccgttttattattgcattgtgatgtttatgtagtagttgggttaccttgctatctgaaagttcactttgtagtaccaaatataaatgaagaaagtcttgaaaggaaaaaaaaaaaaaaaaaactcaaaaaaaaaa

SEQ ID NO: 1524 - DNA, 652 bp, Triticum aestivum
  Clone ID: PAT_TA_1524
accctccactccttggagcaggggaaagctagaagagaaaggaacaggcatggcgtcggagatgctgctcaggaggatccattccatctgccgtctcgcccgaggcgaccgccggccgcagctgttcagccgcggggaggggctccgccgtccggtttctccggcgagccatccatcattctgcagcgtcgcgtgtgagcaagccggcgcgggcagcgcaagcaaggatcaagataacctcggcaggttttcagacccaaaggttgcacatgaggatcgccggttcgttcaattcttggacaggatgctggacgccacaagaaatccccagagccttgcgcagatacggcgtgagaagcttccaaatgatctgaaaatattggatgatgagatatgagtcaagttctcttgcaggaatataataagagttaacaagcgtgacttatgacatgtaaagtgaccttgagcttaaccatgccaaacttgagcatgtgagattgttattgttcaagttctaattatggaccaatacatcgactgatgtcaaatgttttatgtatttgagttagttttctgcaactgattccatatcatgtatgaagtatgaactcacaaaaacaaatatatggccaaccaattaactactgttcta

SEQ ID NO: 1525 - DNA, 495 bp, Triticum aestivum
  Clone ID: PAT_TA_1525
catggcgaggtggaatccctgaaagggctacggactgttcgcgcagcttgtggtgtgtggcacacagccgccgttgtctgaagttatggttgggaattcaagttccagcaattgttcttctggcaagatatttacatggggtgatggtgataaaggtcgtttgggacatggtgacaaagaaacaagacttgtcccaacatgcgtggcttctttggttgagcctaacttttgccaagtagcttgtggtcattgtttcacggtggcactaacaacctcagggcatgtgtacacaatgggaagttctgtctatggtcagcttggaaatccacaagcagatggcatggttcctgcgcgtgttgaaggaaagctacataaaaactttggggaggagatttcatgtggcgcttatcatgttgctgttttgacttccacgacagaggtgtatacatggggtaaaagtgctaatggccggttaggacatggtgatactgatga

SEQ ID NO: 1526 - DNA, 636 bp, Triticum aestivum
  Clone ID: PAT_TA_1526
tcgacgggccccctgaaatgggcaatgtttctttgtaattggatcgggtgacttacgagagtacaccctttagttcggacggggggtttactgagagccggatgatctcagaagtttgtttgggttttccaggcgctttccatcgcacagtactcccgtactatggccgccaagtcagcgaagtgtgttatgtcacggcgacttatggcattgaggattcccttgtccgtgcaatttttgcaaaagaatgaaattgcgtcttcctcgcgacggtccttgaccttgttcattacaaggaggaatctggcccaatagtgatgtactgtctcttggggctcttgtctaatgtgggaaagatcgtttatatctgggtgggtgggtggatttaattccagaccttgacccgatctaagacccaggggcgggggagtctccgatcttggaagttcaggctccgggatgttgccccgcaggttcggcatgctgcatgattccaggttcagggttagggcgatgtcctcccatggacgggtatccagctcggagagctcgggaatccggacatagttcgtcctcaggatagaggaagaatcaccgtattgctcctccactaccgcgatctgatgggtgaccggc

SEQ ID NO: 1527 - DNA, 655 bp, Triticum aestivum
  Clone ID: PAT_TA_1527
cggccgctcaagccggccgggccggatcccagagcccccacggacaccagcaaaagcgcctcgccttttccgttaccttttcttccttgtcctcccctacctcggagcgaaagagcaggagccggaggcggcggcggccgagatcagcaagatgtgctgctgcccgagcaaggcgtgctgcatctgcatgctcatcatcctcgtcctcatcgccgtcggcctcgtcttcggcttcggcgtctacacccgcggcttccacaagctctcctccaacatccacctccaggacggcgcctcctaccgcgcctacggccacctcaacctcgcgccgccgccatcctactactagagctccctccctcccccgagatctactctgtcagcagcacggcatggattgggctctgtctcccgtgttccgtcgcgcggtggggatcgatcccctgcacagcgtcatgccgtctgcgaagaagagattccggggccggtcgatttacattgatttcctgctgaattaattcccgtttgttgcttcgctccgatgatgtcgatattttagcagagattatatttacagattgatgatgataattaccgttactatatccctccgtttgcgttttgttaataactgctgctcattagtttagtgcgc

SEQ ID NO: 1528 - DNA, 843 bp, Triticum aestivum
  Clone ID: PAT_TA_1528
ccgtcccgtaataccgcccaccgcgccctctccgttcctactgaaccaatatcaacaacatcgaacatcatccaagagatgagtagtcgcggcggtaaattagccccagaagtcaatcgagctctgttcgtaaagaacttgagttacaacgtcactccagaagagttgttcgatctctttggaaaattcggccctattcgccaggttcgacagggtatcgccaacaacaccaagggaaccgcattcgttgtctatgaagacgtaaccgacgcgaagcaggcctgcgataagctcaacggcttcaacttccaaaatcgatacctcgttgttctataccaccagcccgacaagatggccaagtcaaaagaggacctcgaagcccgccgcgaatctttagctcagctcaagcagcagcatggtatcgattgacaatccgaccggtctgtggatagcctgcctaggaagtcgacttcctcgtctgcaggccggtcttcgtcttctcctaaatctccgtcgcccgatccgaagacgatcctccgaaaaggccgaaccccgaccaagagagcagccaccaagagccacgcatccccccgagtcgtccgctttgacgacggacttcgacctgcactgacctgtgcatgatgtatcaacactcttatcacatcgctttttggagggggctctagagcaggagcccaatacacgcatcagctctgaggtggtttatcattggttcggactcgcttgacacgcaaacacctccttttacggttttcggaattaggtgcactgggggaaattcaagggtgattcagcacgtggcgatacgaccagtcacaaact

SEQ ID NO: 1529 - DNA, 719 bp, Triticum aestivum
  unsure (1)..(719): unsure at all n locations
  Clone ID: PAT_TA_1529
aatttccccagactttccgagcccaaaatcaaaatcccacctctctccgatcaccccttcttcctcctctcgtttcgtttcttgcggccgaggggatcgtcgatcgatccatggcaacaatgggcgtgggcggagcggtgaagatgatcatcggggcgaaggaggagcgggtggtggccacgggcaaggcgcccggcgcttgcccgtcctgcggcggccccgtggtggcgaccgacgtggagagcgagcggcgcatcctctgcctcccgctgtgcctcaagagcaagcgcaagtactactgcaccaggtgcttccgccgcctcgtcaccgtctacagctagtagctcatcaagcctctcctcatgccgatccatccatccatccatcgatcaactagcgtgcggagttctttggttcttagttggccgtggttacggccctagagtagcttgctagcctggctaatgtaatgtaatggtgattctgagttaattcttctatatctagcttatttggtgggcgtgcatcccgtgaagggctgcaaaactggcactctgctgtgtcttgcagcaacctctggcggtgcacctccgcgttaatgcgcaggccagtaatggaaacctggaacgcgccagctcctccttcctgattaagtttttttttgagtaatccttcttgattaagtttttttgagatnnnnnnnnnnnnnnnnnnnnnng

SEQ ID NO: 1530 - DNA, 512 bp, Triticum aestivum
  Clone ID: PAT_TA_1530
gaactccggcgagacgagaggagatattggcctatctgctctcctcgatcaagtaccgaagtacgtgtacctttttcctttgagttgccgaggtacgtgtaggtgcaggggtcaccaggtgagacgtacggccggccatgagaggcagcaacgcgaggctgctctgcgcgctgctgctggtgctgctctgcgtcgccgcgtgtttccagggcgcgtgctgccgcggcggagggggcggcggagggcggggtggaggcgggaggggcggcggcggatggaacggcggccgggtcacaacggggtcgcgcggaagcagcgccgccggcgacccacttgcgcacggagtctggagggtctccggtgccgccgccaccctcgtggccgcggcgattctttggtgagccgtgctggcatgatacgtactagtacgtcgtctcgtagatggttggctcaatgtgtaaatgtcagtgctttggacagaagcttgtactagaaattggaatgttcagttc

SEQ ID NO: 1531 - DNA, 1724 bp, Triticum aestivum
  Clone ID: PAT_TA_1531
cccagcgctaccaaacgccctactttaattttaattatcgccgctgctcccacgcgccttcacgtacgtaccgacgacctttcgctcgcttttcttccgcctagtctgcccgccagatctgcatccgcggagatgaagatcacggtgcggggatcgacggtcgtggtgccggcggaggagacgccgcggctccggctgtggaacgccaacccggacctggtcgtgccgcggttccacacgccgagcgtctacttcttccggcgcggcgcgggggaggggggaggaggcgggccgctacttcgacgcggagcggatgcgccgggcgctggcggaggcgctggtgcccttctacccgatgcgcggggcggctggcccgcgacgaggacgggcgcgtggagatcgactgcaacgcggaaggggtgctcttcgtggtggccgacgcgcacgacgccaccgtcgacgacttcggcgacttcgcgcccgccatggacctcgagcgccttatccccgccgtcgacttcaccgggggcatctcctcctacccgctcctggtggtccaggtgacccacttcaagtgcggaggcagtgggcctcggcataggaatgcagcaccacgtcgccgacggcttctccggcctgcacttcatcaactcatgggccgacctctgccgcggcgtgccgattgccatcatgccgttcattgaccgcaccctcctccgcgcacgcgacccgccgacgccgtcccacccgcacatcgagtaccagccagcgcccgccatgctggactcggaggagccgcaggccctcaccgccaagccggaagcgccgcccacggccgtggacatcttcaagctgtcccgcgccgacctcggccgcctccgcgcccagctccccacgggcgagggcgcgccgcggttcagcacctacgcggtgctcggggcgcacgtctggcggtgcgcgtccctggcccgtggactgtccccagagcagcccaccaagctgtactgcgccacggacgggcggcagcggctgcagccgccgctcccggagggctacttcggcaacgtcatcttcacggccacgccgctcgcggtggcgggcaaggtgaccggctcgctggcggacggcgcgaccacgatccaggcggcgttggaggtgatggacaacgagtactgccgctcggcgctggactacctggagatgcagccggacctgtcggcgctggtccgcggggcgcacacgttccggtgccccaacctcgggctcaccagctgggtgcgcctgcccatccacgacgccgatttcggctggggccggcccgtcttcatgggccccggcggcatcgcgtacgaggggctcgcgttcgtgctccccagcgccagccgcgacggcagcctgtcggtggccatctcgctgcaggccgagcatatggagaagttccggaagatgatctttgacttctgatcaaaccaacaagacgcacgcgcaacgcagaaagaaagaagcagcaccggagcgatagtaggatgcagcaatgattctttgattacacacgtagttcctgcacattttcccttccctctttccactttgggctggacgaattttgtgcatcgttatcaaatttccgacaaatgtatctacttaatgaacagtcaatgcatgcaaacgtatgaagaatatacagggttacttatattttatttaaaaaaaaaaaaaaaaaa

SEQ ID NO: 1532 - DNA, 902 bp, Triticum aestivum
  Clone ID: PAT_TA_1532
cagtagctttcaaatattcgaggctgtactgtacagctcaccggtcctgccttggcagtgcaccccatccgcgcggagctgagcaagacgtcggacatgaagtcggcggtgcgcatctcgctcgtgctctgcgccgccatctacgccgcggtgggcttcttcggcttcctcctcttcggggacgccaccatgcccgacgtgctcgccaacttcgaccgcagctccggctccggcgtcccgcaggcgctcaacgacgccgcgcgcctcagctacgcgctgcacctcgtgctcgtcttcccgctcctccactactcgctccgcgtcaacgtcgacgagctgctcttcccgggccgccgcccgctggccgccgacacgcgccgcttcgtggcgctcacggccgtgctcatggggttgctctacgcgctcgccatcgccatccccagcatctggacgctcttccagtactcgggctccacgttcgccgtctgcatatcgctcatcttccctggcgcaatcgttctcagggatgttcatgggatagcgaagaggaacgacaaggcaatggcagcgatgatgatcactctggcagtgatcacgagcagcatcgccatcgcttccaacgtcatgagctccatcaagggcgaagtgaaaggtgttagtgccggagctagttagcatgtacagtttcattatatagctaaatcaaaattctttcacctgcaaagattgtagcgttcctccgctttaggttttgatcgtggcaaatttgatacgaggcattgtgtatgttgtgtgtaagcaaatggcagtcggccgttgttgtataaaacagttgggaaggcatacatttacctttgtataaaaaatatcaggcgaagaaaaagagcgcctttggtcagacg

SEQ ID NO: 1533 - DNA, 999 bp, Triticum aestivum
  Clone ID: PAT_TA_1533
acgttcgcttagcaagtacatatatcctctgttcctcccccgcaaacgatagacaggcctggccggcgcagcctgcgacgttcgagctcccgccgcgcgtccacgcgtcgtctccggccatggggttccccctggtgtgctactgcgttgccatccccaagccggtcatcgccttctgcaagctcgtcgccgccgtcagggacgccttcctcctgctgctctccctcgtcggcctctgccgctccccgcgccgctccgtggacgacgccccgctgcccgaggaggtcaaggagcgcctcccggccgtcgagttctccttgctggcgcgtccggcaaagcaggggtgccacgacggggacgacgacgtcgccgccgcggcggccacgtgcatcgtgtgcctggagaggctgcgggcggcggacgaggtgcggcggctgggcaactgcgcgcacgccttccaccgcggctgcatcgacgggtggatcgacctcggccggaccacctgcccgctgtgccgctcccacctgctgccccgcgcgcggagcctcgtcccggccgtttagccgacgaccaaccgcgccactcgttcgttagctcccactcgacgtctttccttgtcccaccgcggtggcggccgacacagagattcgcgatctcgaccggctgcacgtatatttattgtgggtttacatcgtctcaaaatcgggattttatttaagtaattaattttagggcgccactttggtatatccatccaatcacgaggtcaccaataggtgcacaagcatagttttttttttccgttatagaaggattagtcggtcaaatatatgcgtggtcctgtttggctagtggttctgaaatgtcaacagcccgagaacgcatgtccctgttccacttgtccaatcccactcgtgggactacgacgtacagttgtagtataactcatactgattcctcatatcaaattgatgattgtttgctgccaaaaaaaaaaaa

SEQ ID NO: 1534 - DNA, 1026 bp, Triticum aestivum
  Clone ID: PAT_TA_1534
aaaccctccaaaatatgccgccctcttgggagcagtccgacgtcgccgccgtcgatggcggcgtcgaggagaatgtgatggccatcctcgactctttcgtcggcatcaaggattcccgtgacctccacgacgaccgagccagttttttggaggccgtgcgctccgtctgcctggccggcgacaaaccctcgacccccactgagagaatgtacgatgctgtctttcagatctttcaaagcagcagctctttggagctaaccattgcaagttttcatctcttaatggagctgggcaagcaatatccaagagtatatttgacaaattctggttccgaattcgccacaagtatagttaaagagtcatggtcaccatttctccttggcaacaatgtagcttctggtgagattgggagaaacaccagtcgctcagatcatctctttgattctttgagattttctttgttgaccgaggctatggttgaagcatcgaatgacacaggtgctaatagtgggcttaagcatatagagaacatggtgctgttccaatatctcgttcgcacacttgaggctgattttatacctcgtcatattgcatataaagagtcattagactgggtgatcatcagggaatctgttttaaacgtgcttctgggatcgcgaaaactggtattcaaaatgtttgtcaagaactgcatatcccttctgaaccaacatcagcgtgaaattgaagatgacatatcttctaaatcagcatctgatttagattcttccttaaccttttcattgcttgagtttgaaagagaagcgcttatatccgtgaaaaaacttttcattatggttataaaccttgacttgattaggaaagaagcagacaaattgggcctgacttcaagggctgatggcctcaggaatcctatcctggaagttattctagaggagctaacttacaacacaatctacttatccccatttcttttggccttcacggagtgtaagtggaaattgcagattatcctgctgtacttct

SEQ ID NO: 1535 - DNA, 811 bp, Triticum aestivum
  Clone ID: PAT_TA_1535
ggtttacgagccctcttctgccagattgctctccgacctattccccgattcatgatcaagaagcttcaggctcgtggcgaggcccgcaagggtcgtggcttcggtttcgttactctagcttctgaggagcttcaacagaaggctgttactgagatgaacggaaaggagattgagggccgtgagattgccgtcaaggttgctattgacagccctgataagaccgacgaggaacagcacgagggtgatgctaccaacggccagaaggagaacattcccaccactgaggctgcccctgtggctgcccctgctactggcgccgcggctgcagcccctgctgccaccaaggctgccgaggccactcctacctctaccactcccgccactactgcctaagtaaaggcacggcgcgagtttcacggacatgaacctcgtactatgtcatgatgattactctaacgatttgggcatgcgatttcaacgatttctcttacagtagattctcgctacaacgatgaaaagaaagattgaggtttttccaccttacctgagtttttttttggggggacataggcgagagcaaatcgaactctgatgaatctcgggattgggtctactttgtcaacctttacttttcacatcaaaacactaatatttccatgatcgggacacaaaaacattcacgagccctctgttatcttgtatttgtatcaccttttctctaactcactactgctgggatgtacactagtttgcaccgacgcgggtggaaagggagaaaagtttagcgctatcatgaatgggcattcgttga

SEQ ID NO: 1536 - DNA, 884 bp, Triticum aestivum
  Clone ID: PAT_TA_1536
ggtcagggactcccgggtcgacgggacgcgcaagaggacaaacgacaaggtggtgcttgattactttcctgggaacaccggggatgtctgacggttgccacgcaaacacgtcgacattcgcccgcaggaaagcaacgagcgcgctttcctatttggggtcaagagtggcgctgatggtgaaggtaccaccagtgccatcctccttggcggacaccttcttggtctcaggtggagctgccattgccttcttacacttgccggtggagctcgatggtgcgtcctcgacggtagcgcagcactccgaagaggtgcgcttgccggagtgggcatcagagctcttgccggacttggtcttcttcttccccccgggagcttcagcggcaagtgtcttgcgttctgctgcggctgctgcttcccggtagatcttgtcggcacagataagagcatccttcttgtcgccagggacagagatgacacttatcgggcctggcattttcagtacgttgtacgcatagtgagaggctgccatgaacttggcgagtgctggacggccgagtatcccattataaggcaatggaaaatcggcaacgtcaaaagtgaccctctcagtcctgaagttcagctcactgccaaatgttaccggcaacgtgatctttcccttcggcttgctccttcccgggttgattccttgaaatgtgccggtctcttcaagctcgctgtcagggatctggagtttctggagcaccgcggaggagatcaggttcaagccggccccgccgtcaactagcatcttagtgaccttgaggttgcggatagttggtgaaaccaacatcggcaagcacccgaccgcagttgtgcgatcagggtggtcctcaatatcaaag

SEQ ID NO: 1537 - DNA, 1867 bp, Triticum aestivum
  unsure (1)..(1867): unsure at all n locations
  Clone ID: PAT_TA_1537
cccatccgtcgctccaaacagagaagaacgagaagcgcttccattacaacagacgaaactactccatcgatctccatggagatctccggtggcctcgaggccggctccctcagcctctccgtctctcccagcaaccccgcggccccggccaggaccggcccgccgctcctgcgacccctgcgacgacgccaggccgccgccgagctccccacgccaccctggctacctggctcatctgcgccaggctgccggtaggccctcgaccgaaaccaacgacatcttcaaagtgcagacgctgacacccctttctggagggagggagtgcaggggaaggtccagatcgaacgatgcaagggaggcgcgggagaggcagtacggggagggcgggaggggcagcggacaagcgacagcagcagcaaccaagagcacccccacggatgctgccctggtcgtcgtggttgcagccttgcggaaacaagcccaaccgaggattttcaacagctagtttgaggaccaaaagtcgcggatggcttaggaagcctagataaagttcagggaagtcggcagcgtcggatctaccggtccaagcccggaagtacacatcactgccgaagcataccggcaacgcgttcttgcccgctggcttgcgtcctcccgggttgattccttgaaatgtgccgctatcttttagcttgctctcggggatctggagtttctggaggttcgcgtatgacgtcaggtttaagccggccccgttgtcgactagcatcttagtgacatggaggacgaagattctttgtgatatcaaaataagcaaacacccgaacgcagttatgccacccgcgtggtcctcaatatcaaagatgataggcgtgccggaccatttcagaggcttgcgtgactcgacgggtggttctgccgcattgacttcccgcacccactgcttgagctggcggtgcgaggtatgcagagaagcaccaccgtcaacgcacaggacctctgtggctttctggaactcctgctcatcagcggcacgaggctcgtgcctacctgaaaagaaagagaagcattagcagtttgcagaagaaactactccatcgatctccatggaaatctacggtgacctcgaggccggctgcctcagccactccgtctctcccatcaagccgacgtccccgccgaggaaggccgtgcccggccgcctcttctgcgacccctgcgacgacgccggcgagctcctcggccaccaccactacctggacatctgcttcaactgccggaagcttctcgcaggaaacaaagacatcttcatgtacagaggtgacacgcccttctgtagcgaggagtgcaggcaggagcagatcgagatcgacgaggcgagagagaagcgctcgaatcagaccgggagggcggaggagcagcggcagagacagcagcagaagcagagcaccccgaggatcccggtctgggcgtggtagcagctttccggcaacaaagccgaaacgtaggattttcagcagcagttcatgatgaacaaaagctcgatgatgagttgggcaggctagatccagttgagggaagcttggatcgccggttcgacgggacgaccaccaccctccaggctgcaaacctgctgcatcttatgctgtctctgaaccgcatggatgggttctcatccttttgatctccgaagatggagactaagagttaaattttgtgtgtgaattatcgctggttttttgttcttgtgtcgcgtaaggttgtactatagcctgtcgatatgaaagaaaagagagaggcataacaaaaaaaaaaccggcttgcctgctcccttcccaagctcccatccgtgcttgagnnaaaaaaa

SEQ ID NO: 1538 - DNA, 301 bp, Triticum aestivum
  Clone ID: PAT_TA_1538
agggacaaagagaacagaataaaagagcgctttatatttgaggccaaagctggcgaccttaagaaatggtcctatgtgactaacttgtcatattctaaattcaagccagaggaactagaaagctgtatgggtgactattcagatggtgaacagcatctaaaatattttgacatgcaatatataaccactcaaattgaagcaattgcctctaataaagaacctagaggcacccttgcaactgatattactgggcccaatctagaaaactcaccatcatgattgaaacaaatgaacataccaa

SEQ ID NO: 1539 - DNA, 579 bp, Triticum aestivum
  Clone ID: PAT_TA_1539
aagatcgcaattacttagcacttcaaggtcgaccccgacgactccttcgctgtccaacgacttaagccacccgcccaattccctccgctaccatgtcggcaaaatacgctttcacaaaatccctccgcgaggtgcgattcctcttttgccagacttcggagcagagcgcggccctccgatcattcattactcgatcgtatcctaccatgaagcgcaacaaccccaacattcccatcctcattcgcgaagccgccggcactcagcccaagatcttcgcccgatacgagcgaggtgttgagaagtcacagatcctcgagggtctttccgacaaagagattgaagacactgtcactagcttggttcagcctgctcaatagatgattattgattgatatttgcgaaagagaactgaaatggggggggcttgaagtctggctccgcgacgatgaaatgcacataaagatccaaatcagtatgcgacgaaagagtattgcgccactataaaatcaatctcgtctcgcgagtcgaaaaaaaaaaaaaaaaaaggccccctaaggcctccgacgggccgcactaggg

SEQ ID NO: 1540 - DNA, 780 bp, Triticum aestivum
  Clone ID: PAT_TA_1540
ttcttggttgccctctgccaggctattgacttgcgccacattgaggtgaatgtcaagagtgccgtcaaaagttgtgtgattatggtggcaaagaagacactaagcaccaattccaccggcggccttcacgtagcgcgcttctgcgaaaaagacctgctccaggagattgagcgagaggcagtgtttgcctacgccgacgatccttgcagccccaactatccattgatgaagaagctacgtggtgtgcttgtggagcgcgccctctccaatggcatgggcgagtttgatgcggagacctccgtgttcgcaaaggttgccttatttgaggaagagctacgcaagacgctgcccccggcggttgaggccgcacgtgctgccgtagagagcggcacagctgaaatgcccaacagaatcattgagtgccgctcataccccctctaccggtttgtgcgtgaggagctcggaactgtatatctaactggcgagaagacactatcacccggcgaggagcttaacaaggtgctcgtggccatgaaccaaggcaagcacatcgatgcactgcttgagtgcctcaaggagtggaacggcaaacccctgcccatctgctgaactgagaacatacaagcagaagataagaggacacggagaaggtggtttctcagatttccgacgacaagtgaatagtgatacatttagcgaagcagaatgtttttctctttcatgtttcttgtatgcaaagctgcaataaaaattatttaccttgaggccttctaggcttct

SEQ ID NO: 1541 - DNA, 605 bp, Triticum aestivum
  Clone ID: PAT_TA_1541
aaggcgtcctcccaggtgaagaatgtcctgcccctcctacgaacagagtcggaaggcctcatcccacgcgttcgccgacgcgtcgccgagtcggatcaaagccgaactgcctccaggggcaagttgccgatgccaacgactacaggccactggagtccaaatgatgcgaacacggtcctgcgggtcctgtgctaccggcacgaggaggcggctacaaggttcctcaagaaaacctatggccttcccaagaagctttgacgcatgggatgatagctcatgacacacaggttgtacatttccagccgccgccgctatctatcacaacagatatttgctcgggataatgtattgggtatggcatgaccctgcgagtaacaccattgtaaaggttccacagaggggagggggttttgtttttcttttctcacccttttttggagggtgggggtatttgttgattattatttgtatacatgtttctctgacccagttcttttgctgatgttagcctttgtgcgcccgtgtttgtaacagatatatctcgattccgttttactagtttgcaacaggtatatccattcatctttgtgaataaaatatgtgtt

SEQ ID NO: 1542 - DNA, 693 bp, Triticum aestivum
  Clone ID: PAT_TA_1542
aatcctgtttgaatgtagtagattcccacatcttcaggttctattcatctaccgaactcgccagccaccatgcgtttctctaccgtcttcacagccttagtggcttgtgtttctaccaccgacgctgccatcacttggacactggaaaaagctgccaacccaaccgccgatcagcgcgacgcctatggccgcattgaaaatgccatgcgactcgccgcagaccgctacaaccgtctcggaagcgcgaccaagaatattcgcgtctcgtacaacacaggcgttcccacagccgacgccaactacaacggtagccttcgcttcggcgccaaccgatcttacatgaacgagcgcactgctctacacgagatttcgcacaccgtcggcattggtcagactgccgcctttgaccgcaagtgcgcggcgaacgattggccatctgcgacacggctcttgaggtcttgggatggcaatgcggccaacatcaactgtggtggtggccacatctggccctatggactcaactatgacaatgagtggagcgagacaaacgccaaccgacatgttcagcttgtcaatgctatgatacgtgatggaatgtaagggttatgagagaatgagacatgagtatgcgttgggtttctatgtagatatttgacgacaagtacatataaattacaaatactatttgatgtt

SEQ ID NO: 1543 - DNA, 683 bp, Triticum aestivum
  Clone ID: PAT_TA_1543
atttcctactgttagcgaccaacggcctcatgtccgctcaacatctacagctacattacaaccacaaccacgcgactatcattcaacatggctgaccaagctcttgaccagatccgagacgttgtcgatggacagattgactttgaaggacagaagctcgtcgagttcctcgctacagctcttctcatcgtttctggtctgatctcgttcgttgtcggttacatcctccaagatatcaagctggctgtatacctaggattgggaggtacagccctgaccttcctcgtcgtggtgccagcttggccattctacaacaaacaccctgtcaagtggttgccagcaggttacgcgtacgatcttgcaagcaagggaaatcaatagattgcatggtctcgctgtttatgacagtatcatctcgaatgcagctaccagtgccgaatgccacatgtcgacgatcccttttatacacacgtttcctttcttcataagacataaaccccagagacgccgcttgcatatcctctatcgcccgtacttctggaactcccagtccctattgtccagaggacaaacagatcgagccttcaaccatcgtgaaatgcaatggaagtggaatgcatgctaggtacccgttaatctaaatacgtgaaagaaaacaagatgatgcggtcgtcttacgttgc

SEQ ID NO: 1544 - DNA, 1574 bp, Triticum aestivum
  Clone ID: PAT_TA_1544
ggctgcgcgtctttgttgccacgactcatgacggttagtgtattagctagataatggccaggctttgaggagattcggattgtgattagtagtggataaagtagttgcgtgagcaaatttattctattaatttccagccattaatcctctgtctaagcttcatggatgagatacggataatgctcttttgtgttttagactatattcagtaataacttcttctgcttgcaattgaccctactctggcatattgaagtgtctgattctttttgtagtagcgcaagctcctatgatagtgaccgcgaggcatctggcagatcacgtaagcataagaagagcagtagatcaaggaaggtactgccccagcaattcatatatgtttgatgtcttgtcggttttttcagcatacacctagtacttggcctctcattgactcactgtatcctcattctggcagtctagggaaagagagcgaagcaaggataggcatcataaacgggacaagagtaaacatagagaggtaaattttctacttacctaaaaaaccctaccttttatcatagcataaatttatcacatgtaataatcgttttctgtaaatcagcaactgtatttatcattggttatatatgaattgaaaaatattcaatatcatgtactacacactgtcttagcaacagaaatatttcttatcctttttatttccatgtgagaggccctatcgcggcctaggtgctcctgggttggctctttgacattggagctgggattcgtgaacgggtgacaacatggtgtattggcttgctggttgtcttggttgttatgttttgttctcttcaatgcgggagctttatgcagaagaaagagagtgaacgttctagcggtccggtccagctttccaagttccttggtcgcgagaaggaggaaagcggcaaaaggagtgttatctctggtaaaaagataatgatgaagctcgagaaatccaaggaggttaaggcggctgagagcaagcgcaatgaactgttgaagtttctgaatgccagttatggttgacaacttatcccaagtggtgatgcttggctgggtggcagcgaattgacctgttgaagtttcttaatgccaggtatgattggcaacttgtcgaaagtgtttatgcttggctttatggcttggatttgtcttgatgccactgcttagtcatgtgtgcgtttggtgataccaagaagttttttgtccggttttttaaggttaatgactgtgacgatcagtgctttttatcggtatatttggctagtggttggacaaaggtcacatgtatcactaggtctcacaatttttaagcttggggtgtttgtgctcttaaaaatttgatcgttaccagtttgtactttgtagcctcctttttgtaacgcccgtttaacctggagatacaccaaattttatagaattttcctggcaagggtacttgatcgaaaaacaatttttaagcgtcggcgcggcgcgctcttaaaaatttgatcgttaccagtttgtactttgtagcctcctttttgtaaaaaaaagaaaaaaaaaaa

SEQ ID NO: 1545 - DNA, 506 bp, Triticum aestivum
  unsure (1)..(506): unsure at all n locations
  Clone ID: PAT_TA_1545
attctcaaccataattnttaccnanttttcccatcacacttntaaaacacnccattacccccctaatacactcactatanncaaattnttacctgccccgcccggctcctcctcaaaccgccgcccgactcctcaacacgccgccgaccgacgcctcgacgccgacgtacctcctccgccgtactggccttctccccggtgcctcttccacgctccaccaccatcagcctccttaaccccgaccgaagagctgaccttttcccctctaagagacctaccgcgtggaatcttgtcagagtgaacaaattaccgccgtcttgagattttatagtttgtagcaagttttatctttgttgtaaaattatgtggtggctgtgatgaattgttattgccgtgaaagattatgatgttatgataaattatgattgatgggattcggattcgaagtcatgttattatgataaattatgttgttgtgatgagacaaaaaaaaaaaaaagaaagga

SEQ ID NO: 1546 - DNA, 1071 bp, Triticum aestivum
  unsure (1)..(1071): unsure at all n locations
  Clone ID: PAT_TA_1546
tggtggcctcccctccatcccaccccgaacccattaaacaaccggagccgtcctcctcctccccccacccagatctcagatccgcggagctccggcgcgcctcccatggcggtcaaggtctacgtcgtgtactactccatgtatggtcatgttgctaagcctgctgaatgagaccaagaaaggtgtttcctttgtggaaggcgtggagtttaaattgtggcaggtccctgagaccctgaacgaggaagtccttggcaagatgggcgccccgcccaagaccgacgtgccggtgattttcccccgcagagctgtggcgggacgcggacggccttgttcgggtggcccccccaggttcggccgatgattgggcggcccaccaatggaggcgttcgtcgaacgcgggcgggctggtcgggggaacggggccaggcggggaggggggcaggcccgcgggcgtgttcttctagcacgggcaggcgggggcggcgggcaggaagccgacgccgctgacggcggtgacccagctgaccccaccacggcatggtgttcgtgccggtggggtacacgttcggcgccaagatgttcgacatggacaaggtgcagggcggcagcccgtacggcgccggcacgttcgcgggggacgggtcgcggtggccgtcggagatggagctggagcacgccttccaccagggcaagtacttcgccggcatcgccaagaagctcaagggctcctccgcctgagtgcatgatcattgatcacctgatcactggtggtggtggtggtggtgctgctatctgtatctgtggagcttaagtttgatgtgtggtgtgggcactgttatgttaattattatggctttgattgaaccggttgtaaagtttgtaagtggattttgaatttcatagtattatcatatcactgacattgagtaaatggattttgcgtttcatagtattatcatatcactgccattggatacaaataaaaaaaaggactgtggccatctcgcgctgtacgcgtaattacgtccctgcgnccttttctgcntgtttggtctgcttggacatttc

SEQ ID NO: 1547 - DNA, 743 bp, Triticum aestivum
  Clone ID: PAT_TA_1547
aatactatttaccacgagcgcactctctctgcaaccaaaccccctagctagctagtaaccagaccagttcgtcccaccatggtcgccgcaccggcaggcccgggaggtggaggtccgcccctctctccgtgcgccggcttcgtcgcggactccctgatcctccccacccggaacgccaggctcttcgcgccggtcttcgcgctcgtgctcgcccacactttcgtcttcctcgccgtcgccgtccacttcgcccacgagtacgccctgtcgggccccacgatctggctgcacccagcggcgctgctcgtcctccacctagcctacctcgccagcaagctcgccacgcaggccgccgtcgcgctcgccgcctgcgccacgctccgcggcgaccggccgcgctcgctcgccgagctcgtgcgcggcaccccccggccccgcgccctcttcgcctgcgccgcgctggtcgccgtcgcggagctcgcgtgcacggccgtcccggcgtattacctcgactcctggtacaggtacagctggagccactcggacaccggcggcgtggagtcgttcgtgcagggcgtcctgctgttcgtcttcctcgccacgctcctcctccgcctctgcctcgccgcggtcttcccggtcgccatcgccgcgtcggcgacggcggcgacagaggaaggcggcgacggcggtggcggcgcgagcgcggccgctcatctcccgcgcgcgtggcggctcatgac

SEQ ID NO: 1548 - DNA, 2107 bp, Triticum aestivum
  unsure (1)..(2107): unsure at all n locations
  Clone ID: PAT_TA_1548
ctcccacggccctggcgcgcgcccccctcgggctgccccgccactccgggtcccccctcagctcctcccacccctgcgaggatctgtggagctcgtgctcctgcgtgctgcctgggcggagttggactggtacttccccctcgctccggcggcggcgcgcggtggggcggaggatgcgcctccagtgagctcgggccgtggtgctggtgtggctgctcggacgcgtgggcggacgcgtgggcaagaatatctgaatattaagttatggcgggattaccttgattatgttgaagagcatgatcagtcagtgtctcaatgttcgcaatctggtctctcgaaaatgagggatttgtatgagcgtgcaatcactgcagggggtctacacgtgaccgaaggcagcaaactatgggaagcctacagggaatatgagatggctattttgaccataaatgatggtaatgatgaggagaaggcaaagcaggttcaacgtgtccgcgcgctcttccaccgccagttatctgtgcctttggctgacattgagtcaacacttgctgcgtataagagttgggaagctgaagaaggcaatacaagggacccagattcccaggttgatgatgttcccccaaatgttttatctgcttacaaaaaggccagcgagatgtacaatgcacggaagcagtatgaggatgaactaagcgtcgcggctgaatccgaggctaacaaactacaagtgttcctgaaatacatcaaatttgaggagtcttttggtgaccctgctcgtgtccaagttttatacgaacgggccgtttctgagcttcccgtttcaagtgatctatggatgggatacacgagttacctggacagaaccctaaaggtacctgctatactaaaaagtgtttaccacagagcgacgagaaactgtacatgggttagtgacctatgggtccactacttgctgtctttggagcgcattcgtgcatctgaagacgaactgcgacatgtctttgagctagccattcaatgttctttcccaagcatgaacgagtacctcaatatttatcttactcgagttgatagtttaagacggagaatgccaactggcttggatttcgaactgattaggcagacattcgtggatgctgctgagttcctctcaccacaactaggaattgaggagctattactcttgcatgcatactgggctaaattagagtgtaatattggcaaagctatagctgcagcacgcggagtttgggaaaatgctctcaagaaaagtgggtctgttttggaggtttggcagcactatatttcaatggagatagaaatggggcatactcatgaggcaagatcactttacaagcgttgttatagcaaaaaatttgctgggtctggatcagaggctgtatgtcatgcgtggataagatttgaaagggagcatggcaccttggatgattatgaccttgctataaaaaaggtcacccctcgtttgaaggagcttataatgttcaaggctcagcaggaggctaaatcggacccatcctcagcccccaaagaaacttcttatgcaaatgattcctctcagaaaagaaagccaagtaaaatgaccantaaagtgcagcctcctgctaaaatgnggaaagataatccacctaaanagaccgtgtcatcagatgaccacagntcgaaggaacaangcacagacagtcatcttcaanaangtggnaaggtcatcaaagggaacgccgangtgcctgtgngaaatganngttgacngtgacagcatgagaggaaatacaattcaattcaancgaagccgtacttctacagtgacattgcactgcctacatgtcgatatggacntganagcanctgaactgcacatccgtnggttcttttctganattngntggcgtgcntgacattaagttactgatggacatttcangatcancaaggggttgncttagtggcttcaancatgttatcttanggcggnattagacatcatcaaagtgccaatanangtagtttctctnagtcaagnanagattgacgtaacaggattctcaagataattncncgagggtttgggaaaggccatnnggnt

SEQ ID NO: 1549 - DNA, 1000 bp, Triticum aestivum
  unsure (1)..(1000): unsure at all n locations
  Clone ID: PAT_TA_1549
gnnnngattagcgtggtcgcggccgaggtcccacctcgccaagagagagggactaggagcggtttataagccctgagtgcagagacgatgaagaagaggctcaatgctcacgttgcttagcttcaagcctttcagaataggatagattgcactgagctatgtgcagtgcagtctacactattccgaaaggcttgaagcaaattaacccgcattgcacctcttttttatttttaataacttatttggtctccggacttcttgtgtgttcagtatgcagcattcaaagtgacgtcatcaatttccaacatgttctgacatcatttgctgtttttcagtcatttatctaattgtttagagagctaaatgaccatgaaattgaaaatcactacaaaatgaactgtgaaaatgttgaaacttggcatggtatcatcatttcacccgcacagcatgtgcgaaagagtagagagggtcacggcaaaaactggacgcacttcgtgtacctgcccgggcggccgcttcggagtatcagggttttggatcagaacttatctgttacacgggcacttcaatgttttttaaacttatttgaactcgggacttcttttgtgttcagtatgcagcattctaaacgacgtcaccaatttccaacatgttctgacatcatttgttgtttttcagtcatttacctaattgtttagagagctaaatgaccatgaaattgaaaatcactagaaaatgaactgtgaaaatgttgaaacttggcatggtatcatcatttcacccgcatagcatgtgcgaaagagtagagagggtcacggcaaaaactggacgcacttcgtgtacaaactggacaatctcattcggagtatcagggtttcggacgagaactcatctattacacgggcactttaatgttttttaaacttatgctgtagaagaaaagaaataatgcacaacagaaaaaaaactatacagagaattactaaaaaataattagaag

SEQ ID NO: 1550 - DNA, 518 bp, Triticum aestivum
  Clone ID: PAT_TA_1550
cgtggtggagtaaatatttcgtttcagtttagccatcgttgctgctagttcgctgctcctacctaagtgtacaatagctgataaatcagtggtgttccactcgtcccattgctctggatcttcacgcggtatggattcaagtagcatctcattgcttagccgccaccgagattgtagagcacagtgtgagccagtatggtgctatcttccgggaaatcaagcagaagcaccggcactgtttgtgtgacaatgtcccctcttagccagatggagcataatttggatgatcatctcatagcaggggacttgccttggccagaagtagggcatcatgttcgcttccttgctccctcggagatcgcttgtattccatttgacattgattaataagggtcaaagtttcgatgttgtactgatcgttatgtttgtgttcgtgctggctgagcaatacagtttatgcatgatgtagatcaagccaatatatgaatatttctttttcgaaaaaaaaaaaaaaaaaa

SEQ ID NO: 1551 - DNA, 1209 bp, Triticum aestivum
  unsure (1)..(1209): unsure at all n locations
  Clone ID: PAT_TA_1551
gcggcgtcggtggcggctacgtcggcgacattctcgcacaccgattccctgctcgcgtcgccggacgtggtctccgattagtggttgcgcggacgtggcgatggattttcccgtagctccgatggacaggttgcccatattcccggatgaggcatctagcgcggcggccctaattgaattgattggtggggctggtcgtgcgaaaaggaattagccaacggatctcgccgggcggtggtcggaggatttgggcgcagctcagctgggcagttcgggggtggtgccatgtgcggcgaggaaacaagtgtggctgccggcagctctgccgtgtaaacgcagatgccgttgaccagggcggcgttgaaacacattttgattgagatcagggcgctgtgatttaagatcgaacaggaagtggcgatggaggctctgcgcaatcgactggcaaggtggatccccaagcctctggatggactaagagtgaatggtcagtttgataaaatcattatttggggacttcttgctgacggcggagagagctgcggccctgaggccttctgttggtggccgtgcatcgagcatgacccaagctagcatgttgccaagagaaagaagatggctacatccattagctgctcagctccggtgtcctcacgtcaggcttggctttgagtgctgacagcanagcattctacatgttgatggtgtcttcagccaaattgctgatctatccgatgacaacggggaagctgcagccgactccagagaggacgatgaccacaacatagagccatagaggttgtggcagagcttgatcccaatgccaaccatctgcttggcgaggcggagcagcctgttctgtaagaatatgacgagtttgtgatggtttggaaaactgacgaagattcagagggtaaagaagaagtggcaagccacgagcgtcctcgcctgtgctagacgctaaatcgagtcaatggaccagttgactagaactagaaattaagtgcgtgtattttgtgtttacgcctccgtgtattttgctggaatcttagtgtgtgtccattgctgggaggaactgtctctaaattagttgttattttttttgagaagagattagttgttattattgtagagtagtagccgacgtgagtgtggactaatgtttaattatatgagattaccccaaaatgactgatgttgttaagctgc

SEQ ID NO: 1552 - DNA, 578 bp, Triticum aestivum
  Clone ID: PAT_TA_1552
gatcaaacccaaggaaagaaagaccatctatccacgtccccggccagagattcagacaagtcttctgtgtgcttgtgctccttgggattcagaggagatccatccaattccaagggcgcgttcgtttcttcttgggaggccatggaagctcgccgccgcctcgacttgttcctcgtcgtcgccgtcctcgtcgcgatcctcgccgcgagcttcgtgcggtgcgccgacgccgcgaggcccgtgccgccgagcccggcgacggcgctggtgtcgtcgctgatggagatgctgcccatggggccgagcaggcgaggcgcggggcactgatccatcgttggttgcaaccattaatcggcgaggagtatatacatagtttagatttagaaatcattccttttggttcttggttaattctttcttttcaaaataaaccatttccatctctgccttgcgcctccaagaggtgtgtatacaagtgtaatatatacgtacgtatgtacacagagagttcgatatgcagacgaaatgatctgaaacaaccaaacaggatccccttaacgcgccggtcttgcgtcttg

SEQ ID NO: 1553 - DNA, 812 bp, Triticum aestivum
  Clone ID: PAT_TA_1553
tctaacccgacatttcatcgacctcccggcggctcccgccggcgtcgttaacttcttgacccgccgtgccatgaccacgcagtagaaccaccacccagcagcagcatcccgccaactcccgctccactcgccgggctcgtccactggctctgccgactccacgccatggcaccaccgtgctctgaccacgccgcccctgctcccgttcgacaccaacgatgccgacgagatgctcctgctccacatgctctcacagcaccagcaacacacgcacaaggccctggcggcgccggtgaagctagaggcggccgacggagaggaagcaggtcaccaagtcagcgacgggcgcgcgttccgcggggtgcgcaagcggccatggggcaagtacgcggcggagatccgtgactcgacgcggaacggcgtgcgtgtgtggctgggcaccttcgacagcccggagactgcggcgctggcatacgaccaagctgccttcgccatccgcggcggcgccgccgtgctcaacttccccgccgaccatgtccggcgttcgcttgagggcgtagcagacgacgtgtgcggtcgtgcccatagcgtgtcgcccgtgctcgcgctcaagcggcggcactccatgcggagccggaaggccacggcggcgggcaggaaggtgaaggccgccacccggggggcgcagccagagggcatggtgatggagcttgaggacctcggtgcggagtacctcgagcagctgctcggcgcctccgaggacacagccaccatggattcatggtgctggagccaccactttatctgatttt

SEQ ID NO: 1554 - DNA, 781 bp, Triticum aestivum
  unsure (1)..(781): unsure at all n locations
  Clone ID: PAT_TA_1554
attgtctgtctctatctatcaactcattcaacaccaacagcaagaactataacacctctcatctcacaacaacaactctcgactctactcaactcaactctaccaaaatgtctgaccttcctcctcaaaacttcctccctctcactcctcctcccaagtcatccttcctctcactcgcaccggctacatctccttcataccctcagaagcccgccgtccgctcccacactcgtcctgctgccgagcgacgagcatcagtcgagtccagcgccagctccagctccggctccaacaacagctaccgcatcctcaagctcggacctgttcactggggcgagcacgccgacgaccacaagcacgacttccacgatatcgttcttcactaaatcaaatgtgaaatgattgaaatgaatgaatatgttttttgtttatgggcaaagcgcagcgatcatctcttatactcaggattcaaattgcaattttctttttatcaaacatcaacgtcagggaaaacaaaggataccacagattacaattgggaaaaagcaaaaaacacgctaccaagaagcgggataaaataaaaacaacagtatcaaccacccaaanaaaaaaaaaaactacatggggggtcggttgagtgaatgagcaagcaagcaagcagggcttcagctatcgctctcggttgaaaggacaggaagaagaaaaatgagactaggattaggaataagccaactttccaggcaatttcttgctaaattcaatactactatttctctcctgg

SEQ ID NO: 1555 - DNA, 1034 bp, Triticum aestivum
  unsure (1)..(1034): unsure at all n locations
  Clone ID: PAT_TA_1555
tcggcacgaggggacaggttcctcatcctctcctcggacgggctctaccagtacttgaccaacgaggaggcggtggcggaggtggaggtgttcatcgcgacgacgcccgagggcgaccccgcccagcacctcgtcgaggaggtcctcttccgggcggccaacaaagcagggatggactttcacgagctgatcgagatcccgcagggcgaccgccggcggtaccacgacgacgtgtccgtcatcgtcatctcgctggagggcaggatctggagatcctgcgtgtaaatatacatacaataataaacatactagtagtagtagtaggctagagagaggaaacgtatatatatatatatataagaggagagagagagagagagtgagaggtgttcttgcattgcattggaggccatgagcagttggttcgtgtcgtgcgcgcggctactccgtcccaagtcgcgaatccacccttcttcttccccccagctgccgctgtacaatatcaacaaagtgctgggtcggatccggtcatctggtgggtgcttggcacgttagctgagtcacggatgatgagccggccatgtgtcatttgaggcgtccgtttatttggtcagagtaatcaatcgattgctgtcttgtgttgacctctcaactgatggatagatagtcctagtactacttcctttagcgcccacccccccccctgctggactctcggcttcatcagcagagactgccacttgccatccttatctgctctagtagtacacgacactgtaggagcagtaccgcccttctttgaatgcttgggctgacattgtgatcggtgcatgtgcatggacttaactctggtctcttggtcagccccccccnnccccccccaatggatatcctactcaggtcaagannctnaaattgantggttggntgcggtccnaaaagaaaanaacagggggaaaanaacccttnnttnagcctcccttcaacaaanggtttaatangnggaacggtggttacaacaaggttttgtcccc

SEQ ID NO: 1556 - DNA, 1213 bp, Triticum aestivum
  Clone ID: PAT_TA_1556
agaaacgttgcagaaagttgcacaagagcaaacttctcttagcagtttagttgaatcgctgaggctggagttacaggctgtaaaggaggaacacagtcagctgaaacataaggatgcagaaattgaatctattgtaggggacctccatgttaagctccagaagtgtaaatctgatcttgagactgcagtagccacagaatcggatgcaacactagcttctgatgacctgatgttggccctcgagcagttgtcttctgagtcaaaaaatgctcttcaggaagctgaggtgctgcaaaagcgtgcagccgagttaagagacgaagctgaagcagcacgtgcttcattagtggaagcagagcaaaagttgcagtcctctttgaaggaagcagaagtagcaaaagctgctgaaacaagggctcttgatcagatcaaccaactatcagaaaaggcaagtgctgtccgcgcctcaatatccgagccaggtgcaaacatcacgatctccaaggaggagttcgaagctctaagccgaaaggtagagcagacggagaagctggcagagatgaaggtcgcggctgctatggcccaggtggacgctgttagagccagcgagaatgaggcgatcaagaaactggaagctgcccgcaaggagatggaggacatggaactggcaacagaggaggcgctaaagaaggcagagacagcagaagcagcaaacaaggcggtcgaaagtgagctcaagaggtggcgagagaaggaagaacaaaacaaaaacgccgagacctacgtgcctccggtgggagcgacatcactggcagacgctccatctcacaaggcttcttccgcaaaagccaatgagaagagcaacggtcatcagaagaacagcaaagctgtattgcggaagagcttcatgctgcccagcatcacaggaatgttccaccataagaagaagaacaatgccgatggcagttcccactcataatatgtcccaggctcttacttgcaaattcaaacttttaacacatgttcatttgtacgagtatattctagtagtgttgtacctttgtaatgtgctgaactcctaacttttgtcgtgtaacccatgttcatgttgtatatgtatgtctggtactttttggtggtcatctcctgtttctaaaagttcaaatcaaatcacaccttattgatgcttttcaatggtatggtatggagtgac

SEQ ID NO: 1557 - DNA, 597 bp, Triticum aestivum
  unsure (1)..(597): unsure at all n locations
  Clone ID: PAT_TA_1557
cccactcgtacgataacttttgcttaatagtaaagatgaggagcaggatttgcactagtataaatcaatactgtcgatgcactgcgactcactgtgctgcatcatgctatttggttgccacaataatccacatggtcccaaggccatccccacggtattatttaacatgcggacgcgtggggtcttatttcatactatcagtttacgggctacagaatgaagcaattaaagaaggcgatcgagtggtactgctggaaccatactacaaaatcctagatatatcttggaaagaacagcgctataagttcaagtcaattcgtgtggacttcccagaacaaattattatcaacgagaaagctccagctgctcatcaggttgcccgggcttcaatccgtgctcagcataaaccataattgttggcaaaacactccaattattaccttatttgctgtactggacttttaggcgtacaagagaaagtgtacacaaaaaggttattaattgatgtccatccactcattatgcatataattccatgtaaatattttttgtagagtacaccgttggcataataatttttatagaagtcagcanaca

SEQ ID NO: 1558 - DNA, 1935 bp, Triticum aestivum
  Clone ID: PAT_TA_1558
cgcgccagcgcccaccacccaccccaatccaccccatacatacctgcaccagtcttgcaacccaacacccacagctcgcatcgaagtccagcggataagctgggccgcgaggagcacggcgtctccgtctccacagcatcgcatcgccgcccagggaaacgatgagccgcgaggccagcggcgcgtcggtgagctctgccccggttccagagccagagcggcaacaggggcaggggatccaaggggaggaggcggtgttgacgccgctggagatcgtggcagataacgtggcggagctgtacagtcgccgcgacaccttcttccctcgagacccttccgagaagtctgatcccttcagcggctcccgagacaacgcactatggaggcctagagacccagactcccggagccaaaataaaaaccccatgagagggctttgtttaaacagcgctgaaaggacaagtcattgcgggcgtacctcccataacaaaatatgaccaacgagaatgttccacctgcactaaagctcgcccgggctcttgtgcgtgctcagcataatccgggactgttcccctaactggcacgcctgttggtaaccctgaagcggatgttatagtactagtactgaacctgagtttgcaacgaacaatgagctgtgtgactgcgctaggattcaatggagtgtggctgagtgtattgaatacgccacctttttcctagatgaaagcatttaagaggacagatgatctgtaatgctaaacataaaagatggaaattcctggtataatctgggtaatgcatacctcacaagcttctttgcgagcggagcctgggacaaagccccgcttcatcattcgatgaacgcatatcaaaaagctgacaccaattattaccttatttgttgtactggacttttaggcgatcaagagaaagtgtacaaatacttagagaactatgaaagtgcccttcgcggatttgaagctgctgcattaaaagatcctgctctcagggctgacatagaagttcagaagatcatcaatctccttgataagttagagaatgcaacgaagggacgactacgacccaagagatcagcatcattggtgtcatctctgaatgaagtcaatttcaagttattccacaagaaagcaaccataagcatcctatcaggaggtttgaacaagacagttgctgttgtgtgtaaagtggttctttggataagacatgacgatgatgctccactgtattatttaacatgtgacttggatcagtcttatttcatactatcagtttacgggctacagaacgaagcaattaaagaaggcgatcgagtggtactgctggaaccatactacaaaatcctagatatatcttggaaagaacagcgctataagttcaagtcaattcgtgtggacttcccagaacaaattattatcaacgagaaagctccagctgctcatcatgttgcccgggcttcaattcgtgcgcagcataaaccataattgttgtctaaactgtcacgcctgcagatggacctgcagcggactgaagagtgcaagtgcagaacctgaacttgcaacgaccaagtcagcggggaggctgggctgggacccacctgccaggggtgtgcgtgtgtgctacgccagctgtagcctacttgtaaccgtgtgagtgaacagacgatggcaatgagcaaatagattaactactttccccttcctcacgtctccctcgctctcacctaccctgctcctcctcctttcccctgatctcctttcccctctcaatcccctcttgatcgggtcgtgacaaaaacactccaattattaccttatttgttgtactggacttttaggcgtacaagagaaagtgtacacaaaaaggttattaagtgatgtccatccactcattatgcctaaaaaaaaaaaaaaaaaa

SEQ ID NO: 1559 - DNA, 730 bp, Triticum aestivum
  Clone ID: PAT_TA_1559
gcagaactaagcccattaggctagcttataaattaagcctgcagcctaacatagaccatctcaaatcaaggaggctctgttcgttgtcaacatcgtcattggtcagattctcctattaggtcaaattcttttgttttcaattgaaacaatggcatacaatatgctcgatgcgattaacaatgggaaggattcctggaaagtgaaggtcagagtaattaggctatgggacgccattaacctcaataacaatgaactaattagccttgacatgatactgcttgatgaacagggcactatgatacatgccaaggtaataaaacatatggttaacaaattcaggccattgatccaagaaggtttagtctacatgatagcaaattttaaggttatgtctgcaatgaatttccgtccagttgaaagtgaaaaggttctaaatttcttgcacacgacaaaaattcaagagataagaggtcaaaaaaatatcaaaatagcagaacaaagcttcacgttttgtactgttgaagttctttccacaagagatagccaaaagatgttcttatctggtatgattatatttgtttcaaatattaacttccatgtattatgcatattaataccactttattagcagatgtcattggcatagcaagttacataggacatattgaagaaacacagacaacccacgggatttcaaagattcgagatattgtgcttcgaattgaggatc

SEQ ID NO: 1560 - DNA, 1598 bp, Triticum aestivum
  Clone ID: PAT_TA_1560
cctcaagctcatccctaccactcccgcgtgccctaaattgtctccacctagtctcacatgctgccttctatattctgataacgaatcagaagatgatagcctggagaaagatgactgcaaagtgaaggtctctcgccccaaaagctagcgtacaattagcattactgaaaaccaagattcccaaaaagatggaacagagaatttttcacagaccagcattaggcttactgggtgttgataagggatctaagaagacaggaattcagaatgatcaccatgagcaagagaacaaattatcactttcaaaaactataaagcaagaatcagaggatgatgaactcactattcaccagactaaaaggggtaggagacggagcacaggtcgtgctgcacatcttgacgatgaatcaaaagctgaaagtagtcaggaaataaacaagtccaagtctatggaatcaagccccaagaggaagcgtgttgtacgcaaatacgtcggtgttgatcaggagcacaatgattcaaggcctaagacaaggcttagttgtgtcgataaaaaatcactgagcaaaggcattcagaagtctggtgtattaaggactcgaaagacaagtcgctaattagtggagatccgttaatttaggatgtagtacaatagatgggagcaacacatttgtactttttatgatcttcgccattgttgaagatatgtttattaaacgtataggaatccccttgagttagcaagatttaaggacctaaaattttcagaatagcagaacaaagtttcatgttttgtagtgttgaagttctttccacaagagatggccagaggatgtacttatccgatgtcattggggtagcaagttatatagggaatattgaagagacggagacaacacatgggatttccaagattcgagatattgtacttcgaattgaggatcaaaaagttaatattagactctggggcaataaggtcgaccaaattgatgaagattctatgggacgtgttgtcatagtaacatcaacaacggtcagaaaactgaaagagtactcgctgtcatctacaggtgcgaccaaagtatatatcgatttggatatccctgaaacagctgagctccaaacgaggtattgcttggaagatgatatcatagaggaaacacggccggaagcccacttgcaaggaacaattcaagaacaaatgctctataacagaaagacactaagagaaataactgaaattgcatatgaatctgaaaaacaggaaaagttctatactgcagaagcaaccattaagtcaattgatacatcagatgagtggtactacataggatgcggcaaatgtaacaaaaaactacaaaaagaagggaatcacttctactgtccaaaatgtgagaaagaacctgagaagacatgtccaaggtacaaacttaagctagagatatgtgatcatactgcaacaacaacttgcaccatgtttgagacagaagcaaaaaaactgattaagcaatctgcaagattcttgatagatagggatgactgtgatatccatgagcaggcagaaaaatttcagaaaatatgtgggcagagattgattt

SEQ ID NO: 1561 - DNA, 620 bp, Triticum aestivum
  Clone ID: PAT_TA_1561
gcacgagggccacagccagatcccagagcagcagctactagctgtagtgagcatggcgtccaacgccgcacccgacgacaacgaggtggcgcacgactacggcctcgtccgcgtctacaagagcggccgcgtcgagcggcccctggtggctccgcccgcggcggccggcctcgaccccgtcaccggcgtcgagtccaaggacgtccagctcggcgactactccgcccgcctctacctgcccccggccgcggccatggccgcagtcaagctccctgtcatcgtctacgtccacgggggcggtttcgtggccgagtccgtcgcgtcgcccaacggccaccgcttcctcaacagcctcaccgccgcctgccccgccctcgctgtctccgtcgagtaccgcctcgccccggagcacccgctccctgcggcgtacgaggactgcgtcgccgccctcgggtgggtgctctcggccgccgacccgtgggtcgccgagcacggcgacctgggccgcgtcttcgtggccggggacagcgccggggccaacgcctgccaccacctcgtcattcagccggacgccgtgcgcctcaagggcgcggtgctgatcccccctggttctggggctc

SEQ ID NO: 1562 - DNA, 2627 bp, Triticum aestivum
  Clone ID: PAT_TA_1562
gcggccgcccgggcgggtgctgccgcgactctggcaagatgaggcctgaagacagagttgcaattcatgaggccatcgagcacccccccatgtgtctgcccaaggccgcccacgcacgcgccctcgcctcaaggaccgccgttcccgccgctgtgaagccaattgaggaggggtatgatttctacaagaccccagcagagatcatagagctggacccagcaacccctgaccgcatcgatcaaaccttcatacttaaagatgtcggaatttatgagcaagataagcgaatagacaaccaccttctcaaactgtaagcgagtggtgcagaaactcaagcatacaagcacacacatgcaaaaccaggagagaattggcggagaacatacgtcgaggatcggcgcagcgcatgtagactacgggtcgcagttcaagaagcccgggtgcgacgggctcaacaggtttagatcaaacggaaaatgagagagcactcccatgagggaggaagagctgcagccatacccatcactgtgaggcagcttgaagctatcatacggttgagcgaatctcttgcagagaggagactggctagtgtggctacgccagagcactttggagaggcatttagactgtgcaatgtctcagctgtcgctgccgcaactgctctgctagaactgcagctgtgtgaggactgtgacgtgccgaatgaactcaagcaggccgatgcgcagacaatgaggaggtcgggaatcggggcccgcatatctgagcgacggctgctcgacgaacttagtcggacggggatgaatgaatccattgtgagaagagcccttgtgatcatgcaccagagggacgaagtggagtacaagagggagcgccatgtgattgtccgcaaggcttgagctgaactgaaccgatggagctaccatggaaccctctggccatctgatgtgtgctacagtgtattccaagcatcggggaccaacaaccagaaaggtgctgttggagttaaacagccctacattagaatcgtggggttagagcagtctcgagatgacaacacaaatggcccctcacatttcacactcgatgaggaaatggaattcaaagaatttgcacagaggccggatgcatatgccaagatttgttcaatgattggcccttcaatttacggtcatggtgatgtcagctaccagatggcgtccgtttgagaggggacattcatgccttgcttttgggtgatccatccacagcaaaatcccagtttctgaagtttgtagagaagacagcaccaattgcagtctatacctctggaaaaggttcatctgcagctggtcttacagcatctgtaacccgggatagtaactcgcgtgaattttatttggaaggaggagccatggtattggctgatggtggagtagtttgtattgatgaatttgacaaaatgaggcctgaagacagagttgcaattcatgaagccatggagcagcagaccatatctattgccaaggctggcattacaacagtactcaattcaaggacctcagttcttgcagctgccaatccaatttcagggcgttatgatgaccttaagactgcacaagataacatagacctgcagacaacaatcctttctcgatttgatctaatcttcatagttaaagatgtcagaatgtatgagcaagataagcgaatagcaaaccacatcattaaggtgcatgccagtggtgctgcaactcaagtaaacaggaatgcagataccaatgaaggagagaattggctgaaaaggtatgttgagtactgccgcaacacatgtagaccacgactctcagaaaaagcagcagagatgctgcagaacaaatatgttgagatcagacagaaaatgagacaacaatcccatgagacaggaagagctgcagccatacccatcactgtgaggcagcttgaagctattatacggttgagcgaatctcttgcaaagatgagattgactagtgtggctacgccagagcacatcgaagaggcatttagactgttcaacgtctccaccgtggacgccgcaagatccggaatcaacgagcatctgaatgtcaccggagatgcaaacgaatcaagcaagcggaagcgcagtaaagagaaggtgggatcgggagccacattccgaacgtcggctctcgatgaactgaaccggatggggttgaatgaatccattgtgagaagagcccttgtgatcatgcaccagagggacgaagtggagtacaagagggagcgccatgtgattgtccgcaaggcttgagctgaactgaaccgatggaactaccatggaaccctctggccatctgatgtgtgtgtataagtagtgctgacactgcagcctgtttcctgaggaaatttgttgcgtcgttgaaattgagttgtagttgtactactttaagctgtagctgtagccctaaattatcttgtgtcgaactgaagatgtaccacagtaagttcattcatgaatgcaacatttgggcgttctgcagctgagcagagtcaatgcctaggaaacaaaaaaaaaaaaaaaaaaaaaaaaagaggcagctctgataaaaggagtgatacacatttgaagcatggaatgttctttg

SEQ ID NO: 1563 - DNA, 582 bp, Triticum aestivum
  Clone ID: PAT_TA_1563
cccacgcgtccggtgggcaatggtgctgattatggaagtgcagggcatgccagtgtggtggatatggtaatgcgggatatggtggttacagtggtgctgcaggcggcggcgagtattctagcatgaacaacaatgctgttgctggtggctatggcggtggtgacggaagctacaataatgccagcaactcgggcggaagtggtggtagctatggtagtggtggtggaatctacaataatgcgagcaactctggtggaagttctggtggctacggcggcggtggcggaagctacaataatgccagcaactcgggtggaagtactggtggctatggtggcggtggcggaatctacaataatgccagcaactcaggtggaagtgctggtggctatggtggtggtggcggaatctacaataatgccagcaactcgggtggaagtgctggtggctacggcggcggtggcggaagctacaataatgccagcaactcgggtggaagtgctggtgactacggccgctgtggcagaagctacaataatgccagcaactcaggtggaagtgctggtggctacggcggcggtg

SEQ ID NO: 1564 - DNA, 842 bp, Triticum aestivum
  Clone ID: PAT_TA_1564
cgcgacagcaacaataccaccatcaccactccgcaagcttctcaccatgatgactcctctctcgccaaccatcgtagtgatggcactattgttggccccgctggtcgtgctctcctcggcgcacgaggaccaccaccgcacgcctactcaagcaccgagccccgctcaccatcatggccattttgccccggcgccgagccctcatcatcatcacaaagctccggcgccgtcgccgatccaccaccatcatcacaaagctccggcaccgtcgccgatccaccatcaccatcaccacgctccggcgccgtcgccgatccatcaccatcaccacgccccggcgctgtcgccgatccatcaccacgccccggtgccgtcaccgatccatcaccatcaccatgccccggcgccttcgccgatccgtcaccatcaccacgccccggcgccgtcgccgatccatcaccatcaccacgccccggcgccatcgccgatccatcaccatcgtcaccacgctccagcgccgtccccggtacacctcgacgccgacgaggtggacacttagagtgatatcgtctcctatgtatatcttcgtcttatttttcttggggaagtgtttaatgaaaggatcatttgatgggatatcaaatccccccttcccctccgaaatggttatggcctctttaaaagtccttaagaatagcctacctgctaggattggtgcaatgggatgctcaagcatatcaagaactagatgataccccgcccgttgctgtgggatagaaatgcagagatatctatttatagaattagagacaaacaatcatagaatattgagcaacatggaa

SEQ ID NO: 1565 - DNA, 618 bp, Triticum aestivum
  Clone ID: PAT_TA_1565
cgtcgagcccctcatcccaaaagcaaccgccatggctcagagccttctttcctctgcttacatcttattcaaccactgtgcgcctccctccctcgtcgcttccacttggtctgtggctaactcggccggatctcgggaggcagatcaactttgggtggatcctggcgaggagatccgtgtctcgcggcctgcacgcaactagatccggcgatacgtccatgtcccttgttgccaaccgtgggggcctcgcttgaagctggtgatgcatcctctgtattaggccatggcgttctttttccggagaaagctccggtgtgctggaagcagcgggggaggcacaccggacagctcggccgacggggaggcctcaagttgacgagaggaccggcgccggggaagaggattgaagggtctcttggtcaggtgatgaattatgtctgtattttcagatctgcgcaaacgtttccttgcccagcagatttttcactagtatgacttacatctgggtcggggtctccatccttcctctctggtttgccctctcctcatgtcttagatccggctgtcgagacctggttttttctttcgtttgttttctagtcttcgagaaatcgagag

SEQ ID NO: 1566 - DNA, 531 bp, Triticum aestivum
  Clone ID: PAT_TA_1566
agtatatctcccagatcgatttgctcgtcagtttggtcaagaacagcatccggtcggcgatgttggtgggttccagcgacatcagtggaacgcgtcagtggattggagcctcgagtatgcatcagagatcaaacatttcgagcagttgatcaatgctactcgtcctgatcatacagcagttgctgccacttgtaaaacgactgaggatgtttttacgccagcgagcacggcacgagaatttcctggtctcaatttgcttgcagtggtggagagcatcaagaaggagctcccaaccatcacgcgatttctggagcaacggtcacttcccgtcgaggtagccacgtcgtttgctcggatccatgaactactggaggattctaacttgaaggaaggaaatgccgcagtggatgctgggggcgatgggacctctgagttgactgcaccgcaccctcctgccattccaccgcatgggcctgtgcctgatgaagcggtgcagaacggcagcgatcatcctgcgccggaatgctgtga

SEQ ID NO: 1567 - DNA, 753 bp, Triticum aestivum
  Clone ID: PAT_TA_1567
cggaatcatccttccatcatcgatctcccattactttgtccatctcatcgaaccatggccaccaacccgcgcttcgtggcgtcattcgacgtggagagcagcgacaagtacaccagcttcatcgccggcatccgcagcaggctggccaacacggagcactactcccacaacgtccccgtgctgccgccggcggacccgcccggcaccccgccgcgccggtggttccacgtggtgctcaggacgcggaccagcacgctcacgctcgccatccgggccgacaacctctacctggagggcttccggagcagcaacggcgcgtggtgggagctcaccccccgcatcatcgcgggcgccacccacctgggcttcggcggcacctaccgcgacctcctcggcgacacggacaagctggccggcgtcgcgctcggcccgcagcagatggccgaggccgtgaacgcgcctcgccgggcgcaccgcggccgacgccggctcgggcgccaagcaacagcaggcgagggaggccgtggtggcgctgctgctcatggtgaacgaggccgcgcggttccagaccgtctcggggttcgtggccggcctgatgcaccccgagggcggcgaagaacaaaggggcccatcaccggggacatgaacgcgcaggtgaacgggtggcacgacctctccgcggcgctgctcaagacggataaatatgaagaagagaagcctaataaaccagacaagaagaagccggagaaaagg

SEQ ID NO: 1568 - DNA, 603 bp, Triticum aestivum
  Clone ID: PAT_TA_1568
agcgtggtccccgccggggcaccaagttcacttcccctcaacatgccgtccagaaccatgttggtcgtgtgtgttatcacggccatgcttctcctcgtctcacgtgatgttgcaggtgccagacgagtgcatgctcaaaacgaagatggcgatgccagaaaggcggtgaagaaggccaatcaggcgaaaacgatcggtggctatgtgactgtcaaagaaggatcaccatataccgtcgaccctaatcatcctacagccccatgttatggccctccttgtaaaaaatagttatgcatttgacgccattgtgaaatggttatgttgcttctatgtactactagtaattatgcacatcctacacaccaaacctatcaaccattatatatgatgaaaaacatagccgatcatatatgttacctctctggtactatctgtatggaaggtcattgtatacatagcgcactagctgaaatatatcatttgctatcagtacaacagtgctcttggagtacgagtttgtccgaatttgggacacatatataacttatcaataaagagagtgaggggtggtgtatttcagttcttaaaaaaaaaaaaaaaaaa

SEQ ID NO: 1569 - DNA, 738 bp, Triticum aestivum
  unsure (1)..(738): unsure at all n locations
  Clone ID: PAT_TA_1569
gctggccggagacgccagctgcttggagtggctcgacgcgcaagccccaaaactctgtcgtgtacgtggcgttcggcagcctcaccatcttcgacctgcggcagttccgggagctggccgaggggctggagctcactggccggccgttcctgtgggtggtgcgcccggacttcacctccggcggcctcagcaaggcgtggttcgacgagttccagacgcgcgtcgccggtacgggcgtgatcgtcagctggtgcccccagcagcaggttttggcgcacccggcggtggcatgcttcgtgtcgcactgtggatggaactcgacgatggagggggtgaggaacggcgtgcccatcctgtgctggccctacttctccgaccagttcgcgaacaggagctacatctgcgacatttggaggactggtttgggcgtgactcagagcgaggacggcctcgtgaccaaggaagaggtgaagataaaactcgaacggctcaccggcgacaaaggcattgcggagagggcgcgggtgctcagggatgcagctcgcaagagcgtgaacgaaggtggctcctcgtacgagaatttcaagagatttgttgatctcctgacggagtgagctgcaccatttcactcttcctatctttatcgtagcattctgagataggctcacgaggctaaggagaatatattatttcacttaaagggatcgagagcagatacggtctgncctttctacgaaa

SEQ ID NO: 1570 - DNA, 1981 bp, Triticum aestivum
  unsure (1)..(1981): unsure at all n locations
  Clone ID: PAT_TA_1570
gcaaaagcgcgccaacgtcaggccgcaatcatggcaaaaatgaaagcagagcagtcaaaatttgctgaaagtatgaaggcatcagaaaatgaagggcatcctgatgcaacatttgagccagatgcatccagttcaaccgccgttgcctctgaggagtcacgaccagtttgctctctatgccgggattcggattccaaaagtccactctgctatttgattcttcttcagaaatctcggcttgcatcttttgttgaaacgggcaatccatcctgggataacttgagtcaatcaaagaagacatctgggtccatcagacgggaaaaatcaaccgattcctcgggtgctgggtcttctagttcagaggaacttgtcagggatacaacgatagaaccttcctttgaattagacagcatggaagttgacgcatttcttgatttctcaaatgagcaacatccactgattagatatatatcatgtttcccaagtggacgctgtactggcaatgcagatgacaatatctcccttgagacaattgaggctgatgcatacaagtctatcgtaaatgatctggttggcattcaaggtggtgagcagtgtttgtctacttcaaatctcacagctggctccaagacaagcacaagccctaaaagttctgttctgggaacatatgttacttgtctttcaacaaaataccgtctttcttctttctgtgatgtagcctccaaatcttctgccccagtaacaataagaaacagatttggtcctgttgattgtgatggcatccacatctcttcttgtggacatgctgtacaccaagaatgtcatgatcgatatttgttttccttgaaacaaagatatatcaggagactaggttttgaaggaggtcagattgtcgatcctgatctgggagagttgctgtgtccagtgtgtcgcagatttgcaaattccattcttccagcatcaccggatttctctggtataactaggaaggcgatgccaattgctcaaaccatgtctactgaagctgctgcaactatacataatttacagttccctcgcgcactggccctccttggaagtgccagaaaaattgttggacaaagcacatttctaaaagcttttcctgggaatgtgaatgacactgcggagccagctttagatccttcccttcgaagactcactatgctttactatcctcgcagcaaaagcagcttttcagcatctgaaaggctaagcccatccttgtttctctgggaaacacttcggtactctgtcgtttcaacagagattgcttctcgtgatagaatgtcaagctattctgctcaatcgaagtcttgcttagaatctctgcgcagtgaattgaattcatcgagtggattcatattgtctctattgtttcgtgtttctcactctgcacgtgttctgaaccgccgtgaggttcttctgagatttgaaggtatccaactgttagcagggtctatttgctctggtatttctggcgataaagatcttttggatgctaccaagcgaaaaggcacttcgctacctatggttgacccggaaagtgagggtgaaatatttcctgatattcaattttggaagcaatgtgctgatccaatccttgctcaagatccattttcttcattaatgtcagcacttttctgtctacctgttgaagttttgacatccacagaattcttcatccctattgttcatctattctacattgtttgtgtcattcaggcactaataacatgctatcgggaagaagcctttgacagatcaaacttccgtaactgccttctcaacgatgtttgccaggagatgtcaggatatgatattgctagagaatattttgtatctaagcacattgatccctcttgtgatccaaaagatatggtaccttactcggagngtcatgcttgggacgcaaaccctcccagacctaanaagtcatattggaaggtaanctcatnnaatn

SEQ ID NO: 1571 - DNA, 865 bp, Triticum aestivum
  Clone ID: PAT_TA_1571
gtgttcgatcactgcccccggcagaccacctgacccggccgctcgagatggccgccagaaggcacgccgggagcagctccggtcccacttcggccaacctaagcatgaagctgctggtggaggtggacaggcgcggcacgcccaggcgcgtggtgtacgccgaggccggcaaggacgtcgtcgacttcctcctcaccttcctcaccttgccgatcggcacggtcgtcaagctgctcaggaggaactccatgcccatggtaggctgcgtcggcaacctgtacggcagcgtcgaggagctccccgacgacttcatctgccacagggacgccagggccgccaaggacaccctgctcaggcccgccggcggcaggcttcccctgctcaccaacgcggggtcgtcgtcgtccagcaccggcggctttgtgagggcgggcgtgacctacacggtcatggacgacctcgagattgctcccaggtctaacgtcgatttcatcaccaacctcaacaaatatggtatcagggacatcagctgtctcccacgggaaggatgtccaagttggccacaccgagggtctccagatactgagggcgtcactcaagtcgaagacggtcctcaccgacgtcttccttcggacgaacactccgagtccgagtccgagggccttaaccgcagggtgaagtgtcctcgccgtgtcatccttgtggtgcgtgcatgtgtgtcttttggtcatatggttcgtggccttcggcatccttgactgaagctcacttcttgaacccacgaaacctgtgttggtcactggttcacggctcacatactatgaataaaggcaaggagttatatcaaaaaaaaaaaaaaaaaaaa

SEQ ID NO: 1572 - DNA, 521 bp, Triticum aestivum
  Clone ID: PAT_TA_1572
gggagacagttatggtgcttgtggttccatcttgacatttacatgtccattcatttgtgtgctgtaggcattttccatcactttctttggtgagtggggtgacaagagccagattgctacaattggcctggctgctgatgaaaacccattcggtgtcgtcatcgggggagtcatagctcaagcactctgcactaccgctgccgtgatgggagggaagagcctggcctctcagatatccgagaagatggttgaattgtcgagcggggtgctattcctgttgttcggcataatgtccttgttgtcaggaccagaagggcaattgtaatttgtccgggaacttcggcaggactctgccagccagcatggcctccttcctggagtagttaccaagcttaccttatttgatgggtgatggcgacgaaagccggccgtccttcaccaactggatggcgattcattagtttagtcaacacatcattgtaacacttggcttgccactcataaataacttgatgttactg

SEQ ID NO: 1573 - DNA, 1218 bp, Triticum aestivum
  Clone ID: PAT_TA_1573
cccgtccgcgggcgcgtgggcccgagcccacgccgcacgcacacatcctctcctcaccccccgagatcggaatcggcgcccacctccgccgccgccgccatgtcgccgtctctgctcggggggctcaccaagtcgctggccatgaccgtgctctccgaggtcggcgacaagaccttcttcgccgccgcgattctggccatgcgccatccacggaagctcgtccttgctggctgtctatcggcattaacagtgatgacggctttatctgcttctctaggctgggttgcaccaaatctgatatcacgtaaatggactcatcatatcaccactctgctgttctttgtgtttggcatctggtcattgtgggaaggcttcaaagaagaaggagagtcagaagatctggctgaattggaagcaaagctggatgcggactttaagagtaacaaaggggaatcaaaaaataaatcaaaggcaactgaagatacaaagaaaaagcaaaggccatttctcatgcagttcttctcgccaatttttataaaggcattttccatcactttctttggtgagtggggtgacaagagccagattgctacaattggcctggctgctgatgaaaacccattcggtgtcgtcatcgggggagtcatagctcaagcactctgcactaccgctgccgtgatgggagggaagagcctggcctctcagatatccgagaagatggttgaattgtcgagcggggtgctattcctgttgttcggcataatgtccttgttgtcaggaccagaagggcaattgtaatttgcccgggaacttcggcaggactctgccagccagcatggcctccttcctggagtagttaccaagcttaccttatttgatgggtgatggcgacgaaagccggccgtccttcaccaactggatggcgattcattagtttagtcaacacatcattgtaacacttggcttgccactcataaataacttgatgttactgaaatctctgctgatggctttcctgttggttctgaaacctggaaatattcagtaaaaactgctgagaaattgctgttgaataaaattgacagcggtacgtgtgtgaactgcagggctttggcactgaatctcgaaatgcgacaagtagctttgagttgggttatttgcctttgaaagatccagatgaaattcgtcttgcttgatttctttctgtcatcttaggga

SEQ ID NO: 1574 - DNA, 2123 bp, Triticum aestivum
  unsure (1)..(2123): unsure at all n locations
  Clone ID: PAT_TA_1574
cgtccgccattgatgaggagaagcctgagcggccggtgtgtctggtgcgagggctatcagccaaagggccgttcatggatgacctctcgctccgtgtcacaggcctgaaggcaaatgcagtggtctgtgcaagcagtggtgaaggcttggctgaagagaggaaggtgtctggtgctgcagtggcgtcgttggccacggcgcgctcgtcacaggctacggaaactgtgtccttgcctccggattcggaggagaaggactgtgtctgggatgcatcgctccctcccagcggcaatgtcagccctcacagcagcattgatagcatgggagtggtcactgccatgagcatcgcgagcaaccgcagtaacacatataaaagtgaagccatagctagcggaaccatgcttactgtcgagaggaactttggaagtgtaaagagtagtgttcgaggtgactctttagaaagtgcaaaaacaagcatgagccgagcaagtgacagcagtggtgttagcgatgatagcagctggggccatatcactggggggaccagcaagcctcataaggggaatgatccgagaggaaaggcgattcatgctgtgcggattcgagatggcgtgcttgggatgggccgcgtggggctgctcttgcgtccgggccggggtgacattggcagcgtatacctctcggagttgagtgggactaggtgctactttgcaatgaaagtgatggacaaggcatccttggccagcaggaagaagttgaatagggctcaaactgagagggagatcctacagcttctggatcatccattcctaccaactctgtatacacattttgagactgataggttctcttgtctggtcatggaattttgtccgggtggcgacttgcacactctgcgacagaaacagccaggaaaatatttctccgagtatgcagcacggttttatgctgcagaagttcttctagctattgaatatctgcacatgctgggagttgtttacagggacctgaagccagaaaatgttctggtgcgtgatgatggccacataatgctttcagatttcgacctctccctgagatgtgcagtgtcacctacattaatcaggacatcggcctttgattctgaccccagaagggcgggtggttcattctgtgtgcaacctacttgcatggagcctacttcggcctgtattcagccagcttgtttcatacccaaattgttcggtcagaagagcaagaaaaagaccagaaagacaaggtctgagctaggacagagtgccatcaacctgcccgagctcctcgcagaaccaacgtcagctcgatccatgtcatttgttgggactcacgagtacttggccccagaaatcatcaaaggcgaaggccatggaagtgcggtcgactggtggacctttggtatcttcttgcacgagcttctatacggcaagacaccattcaaggggtcaggcaaccgtgccacgctgttcaacgtggtcggtcagcagctgaagttccccgagtcgccgtcgacgagctacgccggcagggacctcatcagggggctcctggccaaggagccgcagcagcgcctcggcgtgaagaggggcgcgacggagatcaagcagcacccgttcttcgagggcgtgaactgggccctcatccggtgcagcacgccccccgaggtcccgaggcccgtcgaggctgagctgcccgtgaagtacggggtgtcggaggcggtcgcgagcaccaacaagagggtggtcggcgcggacgccaagtccggcgggaagtaccttgactttgagttcttttagagtttgcgccttagcggcagagcttgttgtttgcatactgttggtgttgttgggtcagtgtggtgttgtgattttcacggtgctgtttatgtcagtcaccgctgttacaaatttcttgcatctgaactggccgaaattagctaggtgtgtttggtccgcctcacctgatgggaatagcctgtctctgtttctgaacatgttttgcgtgctacagattttgcattgcagaaacactctgaagagtggcgtcttcggggttttgcgccatcactcggcgaatcgggcattcgacngatttaaagaatataattg

SEQ ID NO: 1575 - DNA, 795 bp, Triticum aestivum
  unsure (1)..(795): unsure at all n locations
  Clone ID: PAT_TA_1575
gcatacccagtagctaacccagctcaagtcttataaaaacatattacaatcctagctgctacgtggctagctacgtgatatagtttgtctgtaatcacttgactgaatttctctagccagctagcagaaaatagtgcacgtaccgatccatcgacgaaatggcgccggcggcgaggatggtgagggcggtgatgtttgtcgccgccctcgtgctgatgcagtgctgcaacgtgatcgtcgcgacgaggttgcttcaaggggacggcgggcggccgtggcttcggcagggcgccgggtcgctgaacatgatgcaggtcctgcccaggggcactccgccggctggctcaggcaaccaggtctgggtcgaccccaaccacccccggccgtagcttctcccgacgttttcacaaacttatgtagactgatattcgttcattcatttgctcccccgttcgtttgtacttgtacagtagcccttcgcgtctaagagctcccatgcgaaaatcggagccttggaagctgatagagctgatcacattctagtgctatacaagtgaatattagaagtttaggtcgtggaattcaatagaacgtagcgtctctaatctaatataacgccggtcttgtaaccgagctgattaattaattatcaggtcaacctgtgcagaaagatttccacagcatgctgaggacttcttacatccaattccagttangcgtgtcgntgatgaagtccatgtgttgcacctcgatcagtgcttgctgaatactatcggtcnaggtcatctctttgac

SEQ ID NO: 1576 - DNA, 405 bp, Triticum aestivum
  Clone ID: PAT_TA_1576
cgccccactctcctctcacctcacctggtccggtgccagctgctgccgtgctgctttccgttgttgctcggttcaagaacacgggcgcacggagggttgaaaaaggggggagccacccagcaacgacggcataaaccaaatcaatcagtcagccggactcgcctggagattggaggagccaaaaagagagtggggagagcttctctcggtcagcaaccaaagcgcgtccccaccccctctgcattgagggaggagggcatttggtgcgggcgggagatggggacgaggaggaggggtggcggaatgccgggcgcggcgtcgctgctgctcctggcctgctgctgctccgtctggccccgggcgcaaattttggtcgccgccaccaccgacgccactgaccttact

SEQ ID NO: 1577 - DNA, 2099 bp, Triticum aestivum
  Clone ID: PAT_TA_1577
ggtacaaagaagcgtccgatccggcccgagaactcctccgccccaccagcgctccgcgccgcatccaaacagatccacacccgaaatccccgaaaccctcgccggcgaccatggggcagggcacgccgggcggcatgggcaagcagggcggcgccccgggcgaccgcggcaagccgggcggcgacggcgacaagaaggacaagaagttcgagccgcccgccgcgccgtcccgggtcggccgcaagcagcgccgccagaaggggcccgaggcggccgcccgcctccccggcgtcgcgccgctctccaagtgccgcctccgcctcctcaagctcgaccgcgtcaaggactacctcctcatggaggaggagttcgtcgccgcgcaggagcgcctccgccccaccgaggagaagacggaggaggaccgctccaaggtcgacgacctccgcggcacccccatgagcgtcggctccctcgaggagatcatcgacgagagccacgccatcgtctcctcctccgtcggccccgagtactacgtcggcatactctccttcgtcgacaaggaccagctcgagccaggctgctccatcctcatgcacaacaaggttctttctgtggttggaattctgcaagacgaagttgaccctatggtatctgtgatgaaagttgagaaagctccactagaatcatatgcagacattggagggttagatgctcagattcaagaaataaaggaggcggttgagcttccgctgacccaccctgagctatatgaagacattggaataaggccacccaagggggtcatattatatggagaaccgggaacagggaaaactctacttgccaaggctgttgctaactccacatctgcaactttcttacgtgtcgttggaagtgaacttattcagaagtaccttggcgacggtccaaaactagttagagaactatttagagtggcggatgagctttccccctcgatagtcttcatcgatgagatcgatgcagttggaacaaagaggtatgatgctcattcaggaggggagcgtgagattcagagaactatgttggagctgctgaaccagctagatggttttgactcgcgtggagatgttaaagttattctagctacaaatcgcattgaaagtcttgatccagccttgcttcgccctggccgaatagaccgaaagatagaattccctcttccagacattaagactaggcggcgcatcttccagatacacacggcgaagatgacattgtcagatgatgtgaacctggaagagtttgtcatgactaaggatgagttttctggtgctgacatcaaagcaatatgcaccgaatctggcttgcttgctttgagagagcgtaggatgaaggtgacgcacgccgacttcaagaaggcaaaggagaaggtcatgttcaagaagaaggaaggcgtgccggaggggctttacatgtgatgaattgtgcaccggtcttcactaccagaatgatattgtgtagtgataatatatttggtatcgtgggatatgtttccctggtttggagaatataggcgcaaatttgtttgtaacattttcttcgcctgaatggttggataattgaatagtttgttgtactacgatctgttgactcctttcgtccgaagtactgaatcataagcttaaatcgcaatggccagttattaaaaccgtaccgttctggtgcttctaaccccgagacccggcggcatcactgtcccagtgtggagaaaacccaagggtgaagcaacccatgtttttcggccaaagtattgatgatgatgatgaatgggcaaggtcaggagacggcatgggagttgggatataacttaatttatggtccctagctagctcttatgtgtcggccgtctctttttatgtacctcttgagttagtactcaggatggatgaattgaaaacattccaagctttgctccttcattttggtcttgtggccctctgtcgtgtaggtgctgctttatttataattgtaagatttccaatttcttgtcctgtcagaatgttgaaacattcctgtcttgtcctggatgttttgagataagaatgtttgttgttccc

SEQ ID NO: 1578 - DNA, 686 bp, Triticum aestivum
  Clone ID: PAT_TA_1578
attatcgggccgacggcttctgcacccttgaaactagtactcgggtgttcgtgaagacccaaaaattctttatccaaagttttggtcctttaaggaggtgtttggcgcagtgaacaaggcaatcggactattcggctttataactctcactttaccatagaagtctacaattttaaatttcggcgaagcccatagtattcggaaagccaaactaggcattatacacacctaaatcgaacgaagcccattcctcgccttaagcggaaaaaatctttagggattttggtacctctcgaacaacgaccagtctctcgcctcgtcatgacagtcagttttagctttctctactgaggtgctcagcccagctcaactggggcacaatcgcagtagttctcctagtgctaccttagccaatatagcggaacgtaaggcaccaaaacataggagccgtgcaaacccaactattgacccaaatcatgattcagagccgatgcatatagtgctataagttcggggtgccgcacttgtgaaagtgttcggacttctcacaccatattgaggggtactggagcccctggcgtatttgccgtaccatagtgtacgggtgtagcatgttattaatgaacatatatatgaaaagagattaatgcaaaagatagacaaaaagctatgcattgtttataaaa

SEQ ID NO: 1579 - DNA, 704 bp, Triticum aestivum
  unsure (1)..(704): unsure at all n locations
  Clone ID: PAT_TA_1579
tacggcaacgatccagctcgctctcgaagcggcataagtctttagggactcgaaaaaacctctcgaacagcgaccggctctcgcctcatcatgacagtcagttttagctttctccactgaggtgctcaacccagctcaaccggggcacaatcgcagtggttctcctagtgctaccttagccgatatagcggaacgtaaggtaccaaaacatgggagccgggcaaacccaactattgacccaaaacatgattcggagccgatgcatataatgctataagttcggggtgccgcacttgtgaaagtgttcggacttatcacaccataataaggggtacagaagcccctggtgtacttgccgtaccaaagtgtacgggtgcaacatgtcattaatgaacatatatataaaaaagaaatgcaataggaaaaaattgatgcattgtttattcaagaaaaactgccatgagtgcagaacgatacaattggtgcgataagccagggatgggactgttaaacatgtccccctccaggggtaggctgcgtaatggtgtatataacaaatttaatgctcgtaatggagaccacctaagtgttcgtcgtagcctttgtccctccctggctgttgcatcgtgagttcggcagatctactgccggacagggcctctgatgaacggagtcctgtgggtaaaaaaaaaaaaaaaaaaann

SEQ ID NO: 1580 - DNA, 1162 bp, Triticum aestivum
  Clone ID: PAT_TA_1580
acggtcaggtattccgggtcgacagggtgcccgcactattgcgggtgagtgctccaaagatgtaatatttgagtagactcgcattttgttataatgtgcgctgaaaacttgcttcatatgcgcctaagcaacgcttgttaatcttaaaatatgaccttctgtgcggctattcatcaaatctgagagatggcaattcgtcggcttcagcccccatgccacgagtgctagggtgttcgggataaactcgagcgctcttgttcccatttttgggtctatctagggaggcgctcgacacaacgaacaaggcaaccggacttataatgcttgaacactctcacttagccatacaattctataattttaaatttcggcgaagcccctagttttcggaaggccgaatttggggcgctatccacgccttggccgggcaccccccacgagtgctggggtgttcgggataaacttgagcactcttgttcccatttttgggttcatctagggaggcgctcaacacaacgaaccaggcaaccggacttataatccttgaacactctcacttagccatagaattctataattttaaatttcggcgaagcccctagtcttcggaaggccgaatttggggcgctatccacgcctgggccggacaaagccggctcctcgctctaagcggcataagtctttagggactcgaaaaaacctctcgaacagcgaccagctctcgcctcatcatgacggtcagttttagctttctccactgaggtgctcgcccagctcaactggggcacaatcgcagtggttctcccagtgctaccttagccgatagagcggaacgtaaggtaccaaaacacgggagccgggcaaacccaactattgacccaagacatgattcggagctgatgcatataaggccaaactcgcgacgccgaacactccataaggtattcggactttacaacatataccgggctgagtaacgccctcgttaatgagccctgaatttccagatacgtgcataggtctggtgtgacgaaatgccaataacgccggcatccctctcggttgcgttgagtgcccggagggtgtgaagcaacaagagacagtaaagaaggtttacacatggtcttaatctaaaaagaaacctttgcgcacggtcgtgctg

SEQ ID NO: 1581 - DNA, 626 bp, Triticum aestivum
  Clone ID: PAT_TA_1581
tacggcagcgagaagacgacagaagtcgaggggataatgggactatttatatagcccctggtggtgattgcgctcgcccgaatatggggcgcgtatgttcatggccgggaaacggcccttcattaatgcggaggaatcccaaaaattctgatgagtcatcgagtggttgaccagctctcgccatatcatgacagtcagttttcggctttctctactgaggtgctcgcctggccgaaccggggcacaatcgcagtagttctcctggtgccgccttagccgatataacggaacgtaaggtaccaaaacacgggagccgggcaaacccaacatttgaccaaagacatgattcggagctgatgcatataaggccaaactcgcgacgccgaacactccctaaggtattcggtctttatgaagacgggccgaaacagagcccttggtaataaagcccctggtgtccaggtatgtgcaaaattctgacgtggccacatgccaaaacgccagcatcctcctcggttgtagtgaaaaccgggggatgtgtgtcaacaagagacagtaaaaaaggtttacgcagggtcttaatctaaaaagaatccttgaaacgggttcctgctgcccatcggccc

SEQ ID NO: 1582 - DNA, 607 bp, Triticum aestivum
  Clone ID: PAT_TA_1582
accaggagactcagggaaatcgatccttggcatctttgctaagggaaaacttccgctacacttcatctctaaccttccacttgggtaaccaacgaggggcgagaagccatcagcattcgacgctgccgcattctaccgagctcaagagggcagctcggtagagagtgtgttctggtctcaatattctaagggcggacaccctatgccccttagcgatcagctgaagcagctggtcgagctccacaaggcggccgaacaggccatgaagggccttatagttcggctgtggcctaaggaggccatgcctgggagctacttcggcctggtgcggcggctggtggatgcgtgtccctgggttgaagtcatcaagcactccgcctgcattgaaggtgcccgtcgggcccttgcccgtgctaaggtgcactggggcaagatggatgcccagaagcttgtgacggacccgccaccaccgggcaaggagcattacacgcccgagatgtattataagggtgtgctgaagggcgcccgcactattgcgggtgagtgctccaaagatgtaatatttgagtagactcgcattttgttatcctgtgcgctgaaaactttg

SEQ ID NO: 1583 - DNA, 957 bp, Triticum aestivum
  Clone ID: PAT_TA_1583
cggccgccctcgccgtcagccataatccttccagaacgtggggaattcttattaaccgcggggtttgacactgtattatgcgtttccgcctccctcttgttatttaaatgttgcatacgcggccgcggagctgtcggccccggtctccttcattttccccggaggcttcttcggggccgccgcattcaatcgagccgaggagggcagcgtgtcacagtggcggttgttggtcgcattgcgctaaaggcccgataccccgtgcccactgagcgacaaagctgagattatctggtggagctttcacaaggcggtcgaacaggccaggaagggcctcatcgcgcggctgtggcataggtggtcgcgcggctgggatgtgtctcggtcgagggaggcggcacgtgcagacctgttgacgggtggaaggcaacgaacgcgctgcatgtattgaaggtggccgtgggtccctcgctggcgctaaggtgtcctggggcatggtgcattatcagaggcttctggaggacccgaccccaccggagagagagcggcgcaagggcgcaaaggaccaaaaaggggcattgcaagctgactaccaaggggaggatgaagggctaagggctataagtcctcactgaaaattacgtatgtttgctaggcgaaccgcgctatgagggcgaaaaggtagggataggagtttttataagagccgcctccgtggggtccctgcgtgtatgataataaaaaccggctttgagcctcaatttcgagaccccccggagatgtgccgcggctcctctccttgcctgtctctcccagggtgtgttaacccgttgtattgccgcacaagctatctactgatggggtttctggaagtaattaaagggaagcggtacgactatacgtctgcgcccgtgtctcccttgtgacgtatgctcaaggggagcggaacgacgttccttg

SEQ ID NO: 1584 - DNA, 802 bp, Triticum aestivum
  unsure (1)..(802): unsure at all n locations
  Clone ID: PAT_TA_1584
ccgctcgaggccnnggccgggccgggaaaacctctctcaccaaaccatcaatcctctcgaatataaccaaccatggcagaggccacacgatacggaggctgttgagaagcagcccgactccgactttaagcatattgaccaagctcccagcaaggtcagctccgatatcgatgcagaccatggcttcaccccagaggagcagcgcagcatcatcaagcgcattgatcgtcgtctggtcatcactgtcggtgccatgtactgtgtatcgctcatggatcgcaccaacatgagtgctgccaacattgccggcatgggtgctgagcttcaactcactggcttccgatacaacattgccaatctggtcttcttcatcccgtacatcatcttccagccgccttcgacaatccttatccgcagaattggtccccgctttcatttggccatcatcactctcctctggggagccgtcatgattggcatgggtttcgtcgaaaagttccctcagcttgcagctctccgtgcggtccttggtttcttcgaagctggtttcttccccagctgtgtttatctgcttagcacctggtacacacgatacgaggttggaaagcgatactcggtcttctatctcctcggctgtgttgcttcagctttctccggtattctcgcctatggtcttatgcagctcaacggtcgcgagggtctcaccggctggcggtggatcttcatcatcgaaggtgccttgacctgcgcccttggtattgctggctactggcttctcgnntgattcccgactcgaaacgca

SEQ ID NO: 1585 - DNA, 345 bp, Triticum aestivum
  Clone ID: PAT_TA_1585
ccccgcccgcctcgccccgctcctcccccgcagcggcgagctactcccgagccagggagagacaggcggcggcggcagcttccccttcccctcctcctctcctccctcgccctcgccgagaaacaacgagagtttcctcttccgtcagcaatggagaacatgagatccgagaacaaccgtggcgcggccatggagggcgtcaagctcgcgtctgaggcggcggccaacaccaaccgcagggccctgagggacatcaagaacattctcggcgcccctcaccagccccaggccgtcagaagaagggcttgcagaaaaaccccccttccgtgccaagagccaagcttg

SEQ ID NO: 1586 - DNA, 1816 bp, Triticum aestivum
  Clone ID: PAT_TA_1586
gcccgcctccgcctcctacgctctccccgccccgctcctcccccgcaccagccgccgccgccagctactgtcctcccccgacctcgagcctgggagagacaggcggcggcagctcccccttctccccctcccctccctcgccgtcgccgagcaacgagggtttcctcttccgtcagcaatggagaacatgagatccgagaaccaccgcggcgcggccatggagggcgtcaagctcgcgtcggaggcggcggcgaacaccaaccgcagggccctgagggacatcaagaacattctcggcgcccctcaccagccccaagccgtcagcaagaggggcttgcaagaaaaacccgccgccgccggtgccaagagccagcctggcgccgtcggccaccggccggtcaccaggaaattcgccgccatcctgcagcaaacgcagcctgcaaacgccccgctggcaccaattggcagtgagaggcagaagaggaatgctgacactgccttccatgctccttcagacatggagtgcagcaaggcttcagatgatgaccttgatgagatgatgaccaatgagctcaaagaaatcgacatggaggacaccgaagaggaggaaatgcctgacatcgacagctgcgacgtcggcaactcccttgcggttgttgaatatgtggatgaaatttacagcttctacagaaggaccgaggagttgagctgtgtgtcccccacctacatggcacaccaatctgacatcaatgagaaaatgcgcggcattctggttgactggctgattgaggtgcactataagctggagctactgggtgaaaccctgttcctcactgtaaacatcatcgacagatacctggccagggagaatgtagccaggaagaagctccagcttgtgggcgtgacagccatgctgctggcatgcaagtatgaggaggtcagtgtgccagtcgtcgaggatctgatcctcatctgcgatcgcgcctactcccgggaagatattctggacatggagaggaagatcgtcgacaggcttgaattcaacatgtcagtccctacaccgtactgcttcatgagaaggttcctcaaggcagcagggtctgacaagaagctggagctgctctccttcttcctaatcgagctcagcctcgtcgactacaagatgctcaagttccagccgtcgatgctggcggcggcggccatcttcaccgcgcaatgcacgctcaacgggtgcatgtcctggaacaagtgctgtgagctgcacacaaaatactctgaagaacagctcatggactgcagcacaacgacggtggagctgcaccagggggcggcgcgcgggaagctcaccggggtgcaccgcaagtacagcaccttcaagtacgggtgcgccgccaagtcggagcccgccgccttcctgctcgacgcgaggaaggcctgaccgaccgacaacttacatcaccgtgtctgtgacaactgctaaaaagatggcgagctaaagaagaggaagaggtggtggtgtacattgaggtgctctgttctgatgagatttacaccaaggaagaaggggagaccaacgttcgctgttggccgtgtcgcgtgcgtttttactgctactgctctctcggtataacttaacatcgatccggtccgagttgagttgagtttgtgtgtgtgtgttgatgggttccaattacatgtgttggaatgtgttggtgtatttttttctttcgtggatttgttgtgcgatgatgacacctacctgcaaaacaactcgcaaataaacattaattgaatttcctgttcagtaaaaaaaaaa

SEQ ID NO: 1587 - DNA, 902 bp, Triticum aestivum
  Clone ID: PAT_TA_1587
ccgcccggccctgcctccgccgcactacgcgcgcgcggccctccctccgcgatcccgacaggcggcgccggcggcgagccgcgacgaagtccctagctcccgcctctccgtccgcccccactccgcccgccccctccgtcgtcgtcgaccctgcgtgcgccgctttgatgactgcgtcacaaggatgagatggcgtcccgtacaaagctatctggtatccagaggcaggccttggcattatacagagggttccttcggacagcacggctcaagtccccagaggagcgccgcaggatcgagtccgttgtctccgcagagttccgtgagaatgccaggagtgtcgatcgcaggaactttgtgtacattgagtatttgatgagaagagggaagcggcagctcgatcagctcaagaatcctgatatcactggactttctacacttgaaataaataaggcctcttctattccagaacaacgtgtcgagcatgatcttggtgtttctactgggagacaataaaacaagaagagcttgcttttaatggtgtccaacataaaaatggccgcatacgaaagctctttatgatgtaacttctctggagcaccttcattttctgataggaatctctagatgagtctcgtagcatcttattgccctctggatattagaagtgtggttcatgtatgaattcttttggtcaccaagatcaattggaccagagtttactgtgaaagagcatttacattggagctctatactgtctaaacgactaaaccatgtggtttaaactcagcaatggtgttactttttatgcaatgtaattcacccctatcatttatttagacttatgtgctcaattgagttaactcggaaaaaaaaaaaaaaaaaaaaaaaaaaaaaaaaaa

SEQ ID NO: 1588 - DNA, 841 bp, Triticum aestivum
  unsure (1)..(841): unsure at all n locations
  Clone ID: PAT_TA_1588
aaaggcggaaagatggggcaggaggcggatgcggatgagcagctgcagcggcggctccggcgggtgttcgctgccgaggagcggtcgttccgcatggatcggcgctcgccggccgccgccgacctccgctccgccgtcgccgacgtgctcccccgattcctcggcaaccactccgacgagaccctcgcggagtacattgtaattttagtttgtaatgggaaacatcagtatcaagcacgcgatgatttggaggcctttcttggtgatgatagtgcaaaatttgttgcatggctttggggttacctaagcaaaacggctgtagcactggctgatgattctagtgtgcaacatagactggaaaatgaaagtcaggaccggaatgataagaaaaatcttctggtcacaaaaacccaacccggggaggctcatattgtaaactcaaatatcttagtaccacaagagcataatggccttcacaagcttgatttaactaagggacaaaatgtggcccagcgacgcattagttcaactgttaccatttcccctaaaatggtggctggtgacgaatgttatcgggagggccagcatcagaagaaagattggagttcaacagctggcagaagttcctccgtgcggcagtctggtgtagctgcaaagactgaacatacattgatgggcagaggaccccatgatgagcatcttggaggaaattcctcaancagacgtttggcctgtggncgtgggaactgatgatggtgaagtgccagaatccatgagaagggcccccgcatgttttgggacaggctagggaagcctgctatggaggatcaaggtttagcta

SEQ ID NO: 1589 - DNA, 1095 bp, Triticum aestivum
  unsure (1)..(1095): unsure at all n locations
  Clone ID: PAT_TA_1589
gaggctctggccnggggggagagttgtggcaaaggacgtagaggctgcggcagctgcccccaagaaagcggcgccagtggcagctgctcgaccagatgttccattgggatccactgtgccattcaccacaatgcagggcgctgtgagcaagaacatggtggagagccttgctgtgccggcgttcagggtcgggtacaccatcacaaccgatgctctcgatgcgctctacaagaaaattaaggcaaagggggtgacaatgacagcgctgctggcgaaggctacagcgatggcgctggtgcagcatcctgtggtgaactccagctgcagagatgggcagagctttacttacaacagtagccggacgcgtggggtcgcagtggccatcgatggtggattgataacccccgtgctccaggatgctgataagcttgatatttattcactgtcaaggaaatggaaggagctggttgataaggctcgtgcaaagcagctacagccccaggagtacaactctggtacctttactctttcaaacctcggtatgtttggagttgatagattcgatgcgatcttgccacctggaactggagcaatcatggctgttggctcatcacaaccgacagttgttggtacaaaagatggtagaattgggatcaagagccaaatgcaggtcaatgttactgctgatcatcgggttatttatggatctgatcttgctgcttttctgcaaactctgtccaagataattgaggatcccaaggaccttacattctagacgcaccaaatgattctttttccctgatgcgatcacataggatgcttgtcagtagatgtgtagcatgttggtggtgtgaattagttacttaagttgccagctttgttggtatcaggtaaccttgttaccgtctccccattggtttgtttctcaataatccttttaccttctgttcagataggtgtaaggcatgagtatctacctgagtgtttattaattgttgattacgttgagctcgatgtacaagtacaatggatcatgtcactgccacccttgaatacaaagaaatgaaatgaacttttatcgtcaaaaaaaaaaaa

SEQ ID NO: 1590 - DNA, 662 bp, Triticum aestivum
  Clone ID: PAT_TA_1590
atttcaactcggtaccacacaccactagccgcgagcagtaccatcactggccaaaacgtgaccccgctccagtcaacttcctcgtcgccaccacacgaccgcacctctcccatggcgtcctcctcgccgccgcacgtcgtggaggacgtgcccccgttcctgcagctcctcagcgacggcacggtgatccgcttcacggacggctacccgctcccgatcccgtcgccgccgcccggccagcccgtcgtcgactggaaggacgtcgtgtacgacgccagccacggcctcaagctccgcatctacaggccggcggcggcctcctcctccgggaacaagctcccggtgatcgtctacttccacggcggcgggtacagcatcggcagcttcgacatgcccaacttccacgcgtgctgcgtccgcctcgccggcgagctcccggctgtggtgctctctgcagactaccgcctcgcccccgagcaccggttccccgcgggcctcgacgacgcggcgaacgtcgtgtcctgggtgcgcggccaggcagcggctgttggagacaacgccgacccatggctctcggagacggcgaacttcgaccgggtgttcgtcgccggggactcggccgggcggggcgtcgtccaccacacggccgtccgcctcgcgtc

SEQ ID NO: 1591 - DNA, 920 bp, Triticum aestivum
  Clone ID: PAT_TA_1591
aaccccctcttctctgtcggtgaggaactccactagagattgcgttttggagctccctctactgtcgctcgatctggcctcccccgctcagttgttgccccatgctccggatcatgccacagcaggcctcgccctgaccaacaggctcggatccatcccttccctcctcctggcctccacatgcgtagactgtggcgccagatcaagggagcctgccaatggaggtcgccgcctctccgtctcgatcggtccgccgccggatccaccatgctgtgccatgggatgggcgccttgcagctagctcctctgccgtcgcctgatctgcctgcccccgcccgtgctccagattcggctaacagcctcgcctctgacccgattcagacatgcacccacagcctcactccgccacctgcgccccagcttgcgaggaggccaggccgcgcctcgtctagctgcggcctacctgttgtgtcagtcagcccagccgcctcgacccggccttctccgcccccagctccaggcctcaaacaactcccactttttggatctcgcgggccccccgtcgagcccggggtgccggtggtggtggtgttcgctcggtggactctgttccattttcttcgctccttcacgctttgtcgattccttttgttccctttctctgctggttttgatttctaatgtggcttgctggttctcatggcaactctcgtacacatatagattggtgagaatatatgtatatcagcgaggtgggacaatttaattgaagaacaaactctgtacaaagctcgttgtatatgaatttagccacctaaaaaggacagcggtttgaatacccaaaagcatagggccttttttgtaagaacgaaacgttttcttcgagagccacttaaaacagggaccgcggtttttattta

SEQ ID NO: 1592 - DNA, 1384 bp, Triticum aestivum
  Clone ID: PAT_TA_1592
gagttccagagttgttataagagcggtcgcggcagttggagctgtgctatcagtggaactgatgtgtttctggggttaatggctggacaaaagtttcgggaagaaagatatccatggtttcagggtggaacattgtggagggtcttatcttgttgggttccatgggtaccccccttcctccacaaaagatatccttaagaagttagagaccatggatgaggaaaatatcattggagcaggtggctttgggactgtgtataaacttgcaatggatgatggtagcgtttttgaattgaaaaggatagtgaaaacaaatgaagggcgtgacaaattctttgatagagaacttgagatattgggaagtgttaagcaccgtaatttggtcaatgctccgtgcctattgcaatcccccctcatcgaaactgttgatatatgactaccttccaggtggacacctgcatgtagtgctacttgaaaaaactgtgcggttggaaggggaggcacgcattaacataatacttggagctgcagaaggcctggcttacttgcatcttgattgctcacctcgaataatacatcgtgatattaagtcgagcaatatcttactggacggcaattttgaggcacgtgtatcagacttcggacttgcaaaactactggaggatgaagaatctcatattactacaatagttgcaggaacatttggatatcttgcgccagagtatatgcaaagtggcagggctaccgaaaagacggatgtctacagttttggagttttggtactcgaggtactgagcggaaagcgacctgccgatgcgtgagtcgttgggaaccccttgggcattgttggatggccgaccttcttggctggagagagcagagagcgggagattgtggatccggattgcgacggcgtgcagatcgagaccctggacgccctgctctctctcgccaagcaatgcgtgagctctttgccggaggagcggccgacgatgcatagggtggtacagatgctggagtcggatgtaattacaccgtgcggcagtgatttctacgattcagagtagggctacgaaaccacggctgctggcttctgcgattgtgtggtagtgatttctacggtctggattgagacgcaccacatccttctgccgctggtttccctgtggaggcacattccatttattctttgcagatttttctaaatgcatgcgttaccgaggggttgggtgggctccaacaggctggttctacggggacaacatttttgcgatttgtatgtatctatatgccacgctacagactgttatatgttgatttaataaggagacttgcctgggggaaaaaaaaaaaaaaaaaaaaaaaaaaaaaaaaaaaaaaaaaa

SEQ ID NO: 1593 - DNA, 542 bp, Triticum aestivum
  Clone ID: PAT_TA_1593
cggtcaaggactccgggtcgacgtctgtcgcatcatcagagccgtatgtatttcgcaaatattctatgtccacaatgctctgcatggagctactctagctaattgctcccactttcaatatgtatccagattgagacttagagtcatctggattggtgtaaaagcttgcatcgttgtaacttttacgacgggctcttttatcacctccataatcgagaaacatctccttagtcctcactaaggatattcttgacccatgtccagtgatctacttattagatcaaaattgtattcctttgccaaacacagagcaaggtatacaataggtctggttcacagcatagcatactttatagaacctatgactgaggcatagggaatgacttttcattctctttctattttctgccatggtcgggtcttgagtcttactcaactccacagagaacttcttctttgactgatcctatcttgaatactttcaagatcatgtccaggtatgtgctcctttgaaagtattattaagtattttgatctatcct

SEQ ID NO: 1594 - DNA, 585 bp, Triticum aestivum
  unsure (1)..(585): unsure at all n locations
  Clone ID: PAT_TA_1594
tttgaagattcagtttttgaggaggaaaaaactggaatttcttgagatgcgggaagaacttatcaaggtgatgtatatgtctcacaaatattagaaatggactgtttttacatcatctgcaaatgcaaccatgatacttgtcgtagatatgaaactcacattggtcgtacttctggtaaagctagtagtgagtggggcatgtagtcactcttcttttactaatttattgtcttggctcaaaagtcattcatattgccatgctacctcgccgttctggatcgacgccgtcccttcgggtttctggtgtggcgtcgatctggacgatggcgcgactttgtccggttgtagttcttcggtgcaggtccaatctctctgggtgatgtggtgctcntgcgtctgtgcccgtggctggccggctggtgctgggcttaagaaacattnttcccccgnggananttgcgactgtgcacnaacgggccgggctacaatttttgactggntaaccctgtttcagctccgcnctcctgtgttcggtttcggggnaatgtanaaaaaagtgatgtttataaaaaatccgggcaacaa

SEQ ID NO: 1595 - DNA, 1146 bp, Triticum aestivum
  Clone ID: PAT_TA_1595
ccggccgggccgggatctccttcgcagtcgacaatcgtcgctacaggtcggttagggtttggggcgccgcctgtccaactgtgtcggcggcgtccatcacccttcctcagatccatcgttgacctagttcctcctcaggtctgtcgttgccgacatccctccccagccgtcgccgaccgtaccctccttcagggcgccgccggtcctgctactcgtccaggccgtgaagctccgcccctcccgcgtccccgtctggatccgcgctgcaccaccccgagatggcaccactgcaagcacggctccacgatcagatcaaagatagcatggttttgatcaacatcaagccacccaaaaaagcatcagtaggaaaaaataaaaatgataaagggatttttgttatgggtactattattgttctacaaccctactttatgtatgttgtggcggatcctgcttcttttcatggagaaggtcaattgaagctcctgattgactgtcttgagggaacaaagctggaacttactagaccgcagatacatttgactgaaggtattgctgggatccgctgtcccaaccctggtgggtacaacacacaactcatgagggcagttcctttatgtcgaagtgtcattgcaaagcgccagcgcgtccatctcttcagtccggaacagatgctgctcacttctggtacagtaatgggagtcagtggcccgactttccagcataattgctctacgctcgaatcgtcgtcgcttggggcacccgttgttaatgacaatggtcatctggttgggatatgtaacgatttcagaaatgattaccttgaggctataagcactcatgcaattgcgtctgaaattgagatggcccaaggaagggaatacataggcattggccagatgttggatcatttgcaaagctagaacaggctaaagttatcaagtatcgccaagagaagatagaaatagaagtcctagtgattgtgtgtgggaacaactttcagcttcaaagcgtccatttttggttatgtttagttagaattgtggctgttactaatggtttgagttgtctaaaacatttcatactgttgaatggtgcctttgtttttagttctattgaatgataacttgtatgctaaaaaaaaaa

SEQ ID NO: 1596 - DNA, 1032 bp, Triticum aestivum
  unsure (1)..(1032): unsure at all n locations
  Clone ID: PAT_TA_1596
caccaaggcacccanaccccanacctcctcctcccgggaatcggaaccgcgtcacattcgtcgctcccctgatccatccggcgacgcggcggagcaaggaaggaaccaaggctcgagcagcgggcggccggagagatggcggagaacccgcagctgttcgggaacgggatgcccgtgcccttccacggcgagatgttcgtcctcgcccgcgacggcgtcgagttccacgtcgacaagatcccctcggcgcccggcggtcacgcaaaaacaaagggcaccatatacctttctaacatacggacgctgggggtcgccgccaagcctgttgggaacttctttgcctttgatatgcccctgctgtacgtgcacggtgagaagttcaaccaaccgatatttcactgcaacaatatttctggattcgttgagccggttgttccagagagccagaacagggctctgtactcgacccacaccttcaagatcttgttcaaggaaggtggatgtggtacctttgtgccactcttcctgaacctgatcacatcagtgcggcgctacaatcagtttgaagcccagcccgctactgtgccccgtgtggaccccatgcaggcagcgcaaactcctgtcgacgacatgatgcgccatgcgtacgtcgatccacatgatcctaccaagatcttcctccagcagcccgcagcggaatcccagctgaggaggagaaactaccacggccccgctgagaatgtgtactgatgctttggcctgattgcaaagtgcatgtgttttcggtgatctatgtggcgcacacgagcaatatatctgtttggtgtcaggatgtgatggaagtatagtagtatgattgtgtgttccactgttggattcaatccagatctaagtataataatgtacatacaaggtgatgtgctggattatatgttgctgatctcgtcgtatagagttataaaactggtctgaatgctgagtgaatctgtgtcgacatcttcagatgtgtgcgatggtttggtccattcaaaa

SEQ ID NO: 1597 - DNA, 1097 bp, Triticum aestivum
  Clone ID: PAT_TA_1597
ccgcgaccaagcccacccaaccgagacgaccgcttcgcgaggcctcgccaccacgacgcccccaccaccctcctcccgggaatcggaaccgcgtcccagccagcctcgccagcccaacccattcgccgctcccctgatccatccggcgacgcggcggagcaaggaaggaaccaaggctcgagcagcgggcggccggagagatggcggagaacccgcagctgttcgggaacgggatgcccgtgcccttccacggcgagatgttcgtcctcgcccgcgacggcgtcgagttccacgtcgacaagatcccctcggcgcccggcggtcacgcaaaaacaaagggcaccatatacctttctaacataaggatggtgtttgtcgccgccaagcctgttggcaacttctttgcctttgatatgcccctgctgtacgtgcacggtgagaagttcaaccaaccgatatttcactgcaacaatatttctgggttcgttgagccggttgttccagagagccagaacagggctctgtactcgacccacaccttcaagatcttgttcaaggaaggtggatgcggtacctttgtgccacctcttcctgaacctgaacacatgagtgcgacgctactatcagcttgaagcccagccctctactgggccccgtgtggaccccatgcaggaagcgcctgccgccgtcgtgatccgcatgccctatgccgatgcacatcatcctaccccagcccttcctccccgccggccgcagcggactccctgctgaggaggagaaactaccacggccccccccgctgtctgcgcggacgcttgcgtcggcctgcttgctgcgtgcgtgtgctgtcgtcgagctggcgctctcgtgcacttgagctgtttggctgtctggtggcgttccagtgactctcactgaagaaaatgtgatggaagtatagtagtatgatgatgatgttagacaattgtgggttcaatctggatctgtgcagaataatgtacatacaaggtgctctgctggattatatgttgctgttctcgccgtataagtttcctttggagttataaaactggtctgaatgctgagtaaaaaaaaaa

SEQ ID NO: 1598 - DNA, 802 bp, Triticum aestivum
  unsure (1)..(802): unsure at all n locations
  Clone ID: PAT_TA_1598
cacctccctccagttccttccctccgccattgcccgcccgcccgcacatggcccgccttccgcgcggagaggacgattatcccgccgcagccgccgccgccgcgtctccgctccctcgacccgccgccacgcgctcctcctaaggtaaggttaggaggttgggaattgctcagtcagccttatactgagcagtgagcactgaccgggggtttgttgtgattctggtcaaccgtttgcccagttcatgtcttccaagcctgcctcccaaagtatgccggagcaagcggcaaagccaaaggaaatgggggaagatgacaggcagcgatctgctgctgaggaggtttcaggggagccggaccagcagcaagaatctccagctcctgtgctggacaaggatgctccagatctctcaccagactctggggtcctggatgtgcctctagccccagaggcagagtctgatgagtcaaaggagaccaagaactccgattccaacgagaatcaagaaaagaagtcttcgcaaaagagtagtatcagtgatagctttatttcagctaaagtgagtgatgggacaaatagtctgggtaagaccagtggtagtgctaagaccagtggtcgagatttcaccgagagtggcaagagcagcatgtgccgtgttagtgcaagcagtgatttgagtgatgagagctcctgcagcagtatgagcagtgccaccacaaagccgcacanagggaatgattcgaggtgggaggccatccaagttgtcaaatccagggagggcgttcttggcctgaaccaattt

SEQ ID NO: 1599 - DNA, 2408 bp, Triticum aestivum
  Clone ID: PAT_TA_1599
cgcgtccggggccgccttcccaccccgcgccagcggcgctcctccccctgccccgtggacgccccactcctcggcgtgcccccgcccctccgcccggcccaccgacccgccccttccctcgtcgtcggccagcccctgcggttcccagagtccccgctagtgagcttctcggcaagggacatgataaggggactactggtcaaggacccgcagcaccggctgggccacaagcgtggggccacggagataaagcagcaccccttcttcgagggcgtgaactgggcccttataagatgcgcgagccctccggacatacccaagcccgtggagctggactgccgcccgaagcaggccccgtcggcgaacgggaaggtcgcgccggcctccaaccagaagggctcggacaactacctagagttcgagttcttctagcctctctttcgtggtggactatggatcctccggaacaacagcgcatttgagctgaggcgccacagaaagagaaaagctgtagagctcccccctcttggcctgggaaggtactctcatttgttgtagattgtatgctcttttctggagtctcctccccacgattttcttctaaagaagtcgttgcacgagagtggtctcgttgatagccttatttagtctaaagtgagtgatgggacaaatagtctgggtaagaattttggtagtgcgcagactagtggccgagatttcaccgagagtggcaagagcagcatgtgccgtgtgagtgcaagcagtgatttgagtgatgagagctcctgcagcagtatgagcagtgccaccacaaagccgcacaaaggcaatgattcgaggtgggaggccatccaagtggtcaaatccagggagggcgttcttggtctgaaccaatttaggctgcttaagaagctgggttctggtgatatcggaagtgtgtatctctctgaattgagtggtaccaagagtcactttgcaatgaaggtgatggataaaacatctctggctagtcggaagaagctgctccgggcacagaccgagcgggagatactgcagtccctggatcatccatttctgccgaccctatatactcattttgagacggacaagttttcgtgtctggttatggagttctgccctggaggggacttgcacacccttcgacaaaggcagcctggaaaacatttttcagagcaagcagcaaagttctatgtagcagaggtgctccttgcattggagtacctgcatatgcttgggattatataccgtgatctcaagccagaaaatgtcctagttcgggaggatgggcacatcatgctgactgattttgacctctctcttcgttgttcagtgagcccaaccgtgatcaggggtgcaaatcctggcttagatgcgctgcagaggaacaatgcagcgtactgcgtccaacctgcgtgcattcagccatcctgtgttgttccaaccacatgctttggtcctcgattcttctcgaaatccaagtccaagtcaaagtctaagaaggagaagccaaagccggacatcgtgaaccaggtcaacctattccctgagatgatcgccgagccaactgatgctcggtccatgtcctttgtcggcactcacgagtacctggccccagaaatagtgaaaggggaaggccacggcagtgctgtggattggtggaccttcggcatattcttgtacgagctactgttcggcaagacccctttcaagggttcaggcaaccgggcgacgcttttcaacgtcgtcggtcagcccctgcgcttcccagagtcccctctagtgagcttctcggcaagggacatgataaggggactactggtcaaggacccgcagcaccggctgggccacaagcgcggagccacggagataaagcagcaccccttctttgagggcgtgaactgggccctgataagatgcgcgagccctccagacatacccaagcccgtggagcttgactgccgcccgaagcaggccccggcggcaaacgggaaggtcgcgccggcctccaaccagaagggctcggacaactacctagagtttgagttcttctagcctctctttggtggtgcattatggatcctccggaacagcagcgcatttgagctgaggcgccacagaaagagaaggaagatgtagagctccccctcttggcctgggaaggtactctcatttgttgtagattgtatgctcttttctggagcctcctccccaagtttttcttctttcctttttcttttccgccattgaacttgttagctctctctttagtcaaatactctctctatgcatgttaattgcgattttcggaaaccgcattgtggcggtgcctcctgaacgggtttgaaggagcgcgcctgttcaggccgtcgaatgtaaccgttatttgt

SEQ ID NO: 1600 - DNA, 713 bp, Triticum aestivum
  Clone ID: PAT_TA_1600
ccggccgggccgggagatcccaccgccgtcccaatctcccaccattaaaccaccgcactcccgcccaggccgccgacctccagctccgatggcccgcacgaagcagacggcgcgcaagtccaccggcggcaaggcgccgcgaaagcagctggcgaccaaggcggcgcgcaagtccgccccggccaccggcggcgtgaagaagccgcaccgtttccgccctggaaccgtcgcgctgcgcgagatccgcaagtaccagaagagcacggagctgctcatccgcaagctccccttccagcggctggtgcgggagatcgcgcaggacttcaagacggacctgcgcttccagagctccgccgtgtccgcgctgcaggaggccgccgaggcgtacctcgtcgggctcttcgaggacaccaacctctgcgccatccacgccaagcgcgtcaccatcatgcccaaggacatccagctcgcccgccgcatccgcggggagcgcgcctagcctccgaatgcttcctgccgccatggtcccttcttggttgatcctgaggggatttatttcgtccacctgtgcgtcgagttgtttaggttctactagtcgatgatatggtcctgtgatgttgattacctgttgggaaattgcaatggatgtgaatgtgatatattttatcctcatttcagagatctggtgaattgaattctctgcttggatgcta

SEQ ID NO: 1601 - DNA, 644 bp, Triticum aestivum
  Clone ID: PAT_TA_1601
tccctcattccaatcctgccttccaacttgcatacgtccgtacgcaaaggcatgcgccgcactgggcggaagtggtgcccgctaccggcgctcgggtggtggctcgtggtggtcggcaccgtccgcctcgtcttcgcctggtccggcttcttcgacgcctgggcggtccgctccggcacctactccaacacgcacgtgactgatgtgcatgcgcgtaccgttggggtgtggacgcttctgtcgtgcaccctctgcttcctctgcgccttcaacctcgacaacaagccgctctgcgccgcaactctcttgtccttcgtctacgcctatggccatttcgtcgcggagtacctggtgtaccgtaccatcaccgcagcaagcctcggcacgctcggcttctttgcagtcccatcgatcatatggacgctagtccattggaggaacactcttggctaccgtgctacgaagcggtcatgagcttgttccactgttaccgcctcgtcaattgatggggccttcagaaattgccaatgaacagaataaatttcgctgccaatctgtttttgtttacttttgtcgggtgtacactgtattattccatccatgaaactatttaaaggaagagtacccgacacggttttatgacc

SEQ ID NO: 1602 - DNA, 403 bp, Triticum aestivum
  Clone ID: PAT_TA_1602
cggacgcgtgggcgcgacgtgttcaggctgcaggtgcacctggtggcggcgcagatggcggcgcggaagggccggcgcgacggtgccggccgggtgcgcgtggtgctgcggagcgagtgcgagccgatgatggacctgttccggtgcgacgaggccgcggggcgggagggggactggtggatgtacaccgtcgacgcgccgcgcatggaggagaagctccggctgcccgtcggctcctgcaacctcgcgctgccgctctgggggccaacaggcatccacgaggtgttcaacgcgtcagacctgacggtggtggacgccggcagccagcggcgcgaggcgtacgcgacggttctgcactcgtccgaccgatacctgtgcggtgccattatgctggctcaaagca

SEQ ID NO: 1603 - DNA, 1711 bp, Triticum aestivum
  Clone ID: PAT_TA_1603
ccacgtccgctccacctcacctccgccgccgccgccgccgcggcgatctttctcggttcccaggcgcttgcgatccatggaatcccggtcgatcaaccttcggggcttcgccggaagcgcaggaaaaaatatcatgcaggggattgggggattcgttttcggcaatgaggcgtccgagtccaaggaagatagctacgtcgagagattccttgaccgcataagcaacggcacgatgcctgatgataggagatctgccatgactgagctacagtctctcgtggcggagagccgttcggctcagatgtcttttggagctatgggcttccctgtccttctcaatgttttgaaagaagaccgtgaggatgttgagctcgtcagaggtgccctagaaacccttgtgagcgcgctgactcctattgagacatcacagggactgaaaactgcggacgcgtgggcggacgcgtgggctgatttgctttctcgagaaacagacaacatttctcttctcttgagcttactgacagaggaggatttctatgtgcgatattacacaatccagcttttaacagcgttacttacaaactcgttgaaaagattacaggaggcaattctattaattccccgtggcataacagttttaatggacatgcttatggaccgcgaggtcataaggaatgaagcactattacttcttacttatctgaccagggacgcagaggaaattcaaaaaattgttgtatttgagggtgcatttgagaagttgtttagcattattggggaggagggattttctgatggaggcgtcgttgttcaggattgccttgaacttttaaataatttaatacggaacaatgcgtccaatcagatgcttttgaaagagacaatgggctttgacccattgatatcaatactaaagattaggagaggcagtgcattcaattttacccaacaaaagacggtaaatcttctcggtgccttacatactgtcgaactgcttttgatggggggcccaccgggtgaaacaggtaaagatactagcaagatcaccaatcaaactgcactagctcagagaaacattcttgaccatcttctattattgggcgttgagagtcagtgggcccctgtagctcttcgctgtacggcattgcggtgtattggcagcttggtactaagaaatcctcaaaatctcgattctcttgcaagcaagcaagtcggggaagaacctcatgttcagcctgcactgaatgcgatcttagctataatcctgcgaacctccgtagcacaggaatttgttgctgctgattatgtcttcaagtgtttctgcgagacaaatcccaatggtcaggcattattagcatcaactattgctccacatccaaaccaaggaactgctacccatggtgcttctagtgacatgccatttggaagtgcacttctgcaagctctggtgtcaagtgatgttaatggagatatggaggcatgttgcagagcatctagtgttcttactcacataatcaaggacaacttgcaatgcaaagatcgcgtattgcaaattcagcttgaaacacctacgccatccttgggacgcaccgagcctctcttgcatcggattgttacgtgtttatcctttgcagctttagcaggagaggatgatcaaagcagtcaatcagaaggatcatatattcagcctgttattctccggctactcatc

SEQ ID NO: 1604 - DNA, 868 bp, Triticum aestivum
  unsure (1)..(868): unsure at all n locations
  Clone ID: PAT_TA_1604
ccggccgggccggggttttacggagcatggcctccagctcgagagactaccgtgcgggagctgcagcgccgcgcccgcgcatcgtcctcctcccgagcgccggcatgggccacctggcgcccttcagccgtctcgccgccgccctttcctctggccacgcctgcgacgtctccctcgtgacggtcctccccaccgtctcgtccgccgagtccggccagctcgacgcgctcttcgccgcgttcccggccgtccgcaggctcgacttccacctcccgccgctcgacgcgcccgagctctccggtgccgacccgttctacgtgcactacgaggccacgcgccgttccgcgcgtctcctcgccccgctcctcgccgccgccgacgcgtccgcgctcatcgccgacatctcgctggcctccgtgctgatccccgtggccagcgagctccgcctcccgtgctacgtcttcttcaccgcgtccgccaccatgttctccttctacgcctactaccccacctacttggacgccacgggagccggcgacgccgacgtccccggggtgtaccgcatcccgaagtcttccttcccgcaggctctgcacgaccgtaacaacctcttcatcggcattcgtcgccaacggccggagcctgtccaaagccacggctcccatcaacacgttcgacccttggagccggaggcctgacgggctgcanaaggtcggttgtcctgggttccgcggtgttacgtcggccgtaaccngtgagctccgggganggatctcgannatcggangtcaccgnacggacgtcgtggtactanctngaaccgaaggctaccggacaataanaanccccaaggctaaanagggggcgt

SEQ ID NO: 1605 - DNA, 646 bp, Triticum aestivum
  unsure (1)..(646): unsure at all n locations
  Clone ID: PAT_TA_1605
cccacgcgtccgcccacgcgtccgctttcccctcccctctcgcggaggaggcgaggaccggtcggatcgatcccattcgagctcgattttagccgccaaaaagtttagcgtgctccagacaggggctggccgtacggcccaagcttcgggcggcggagcgctcgcggcgggcggcgggatctgagacccaaaccctaggtggcggcggcgccgccgtgggggtgaaatggacgcgaggttcccgtactcgccggctgaggtggccaaggtgcagctcgtgcagttcggcatcctcagcccggatgaaatcgtaacccccggcttccccaaccctaacgccgcctctcccccctttccccgcccggcccggccacccggtctcggttgccccggcccttcgaactgcggactctccgtgacctggcttccggggtgcggctggtaccttcactcccgagttcctggcgtagcgctgngccatcctgatctgcaaatatatttgaaactgattcaatgtaactaacaaaggtctgacaccgaacaatatatcacaatgttgttggtnanncgtgtttgcaacttggaaatanttaacttnagcaaaagctgggtgaatccaaatcggntnagcanaatttaggggggn

SEQ ID NO: 1606 - DNA, 444 bp, Triticum aestivum
  unsure (1)..(444): unsure at all n locations
  Clone ID: PAT_TA_1606
tgcacgccgcggaccggccggatccggtcgaccacgcgtccgcgctgcgacatttcaaatcgaatcaaccccaacccccacaccccaccccgagtcctccccaattccaagatcccacgcttccccgctccaaattccctccccaattccaagatccctcgccgcgcggcgcgattccggagctaggcagctagggtttgcaggtcctcggaccgagctgcgcgatctcgccgtccgctcgggggctagggtttggattggggtacagccctgagcgagctctggattgagatttgggagagtggtcgcggttctggatcgagctgccccgtgtgctgcgatggtggttagtggaggaggacgccagtgacggttggtttcggtgggataaggagaaccccccgcagccatggtgcggcttctcgggctgcggngcctcagctt

SEQ ID NO: 1607 - DNA, 2158 bp, Triticum aestivum
  Clone ID: PAT_TA_1607
gcaagtagcttcaagggagtcagagagagctgaaagggccacccttgttacccaggagaagctccagcaggcaagcaacaaaacaaagcaaatgaggcttaatgatgtctggataaggcctccatttggtggtcgtgggagaaagctgacaggaactcttgaggcccatgttaatggtttcagatattccacttcacgggctgatgagcgtgtggatatcatgtacgggaatataaaacatgctttcttccagccagcagagaaagaaatgattaccctccttcatttccatctgcacaaccatatcatggttggaaacaagaagacaaaggatgtccagttttatgttgaagtgatggatgttgttcaaactgttggtggcagcaggaggtcagcccttgaccctgatgagattgaagaagagcagcgtgagagggaccggaagaacagaatcaacatggagttccagaactatatcaacaaggttaatgaccactggtcgcaaacacagttcaagggccttgatctggagtttgatatccctcttagagagcttggattccatggtgttccgtataaagcttcagctttcatcataccaaattcaacttgtttgcttgagctgattgagactcccttactggttgagaccctgggtgagatagagattgttgatcggaacaggatgggtttcggcaaggatctttatgacatggctatcgcgtttaaggaagccgacgaggcgactcggcggttagggacggccccgaaaaagccaaaggacgagaaagcagagagggacgaggcgacgcatccggcggacaacccggggaggtcgatggagaagacgaggtcgaagccggcgtctgcggcggaaacgggcccctaggtggagaagggtcacggctgagccgccggcggcttgggaccgagtgcgtctggggacacctcctcagccaccgcagcgcaaggccaccgggcgccttgatgcggcgcccgcggtggaattgcacggcaacgccagatggatagggggaggggtggaatcagacgaggatgaggaagaggattctgatgaagactctgaggaagagaagggcaagacctgggacgagctggagcgggaggcgaccaacgcggaccgggatcacggcgcagagtctgacagtgaggaagaaaggaggcgccgcaaggtcaagaccttcagcaagtccggcgcaccaccgcagcgtggtggtcctagcagcagcaagcatgctccgctgccgcagcgtggtggcagcagcagcggcaacaagtctcgcccacctcccagtagctccaagggagggccaccctcgaagaagccaaagttcaggtgattggttcgtcttggtcgcgcgccctctgactctgccctttcgagaggcatggtattcgtatggcttggtggtagcggagggcaagtccttcgccgagttggcccgctgggtacccgtcgcggaccgggatcatggcgcagagtcggacagcgaggaggaaaggaggcgccgcaaggtcaagaccttcagcaagtccggggcaccaccgcagcgtggtcctagcagcagcaagcatgctccgctgccgcagcgtggtggcagcagcagcggcaacaagtctcgcccgcctcccagtagctccaagggagggccgccctcgaagaagccgaagttcaggtgattggttcgtcttggtcgcgccctctgaatctctgctctttcggggaggcatagtatttgtatggtttggttgtagcagaagccgtctagttcgctctttaggccgtcgtggtactcgtttctgcagtagctttgctcgtactatcgttatagtcagtcaatcggaaccttggtgaattgttatgttgttattacctggcgtgtgtgacagagtctgaagacttgtttgtcgtttggataaattcatgctggttcatctgctgtgtcatggtcgatgtaatgctttattgtagattgtctgacacccagtttgtaaagaaagatgttctccgcatcgactccatcccgtcaacctcacttgacgctataaagggagtggctggacaccactgatctcaagtactatgagagcaggctgaatctgaactggcgtcctatcctgaagacatcattgatga

SEQ ID NO: 1608 - DNA, 630 bp, Triticum aestivum
  Clone ID: PAT_TA_1608
cgacacaagaaattccacccacatttatttctggtacaaactaaaaagactcaactggccgacgtagaaaaagaacacactcacaccacacacacacacacacacaagcaaataaaagcaagcaaggagcaggtgaacatcaaccgcttgaaactaacatgcaagaagcacacatattaaacgaactagaggtcttgcatgcacgaagagacatcacgcgcgtgctcactagcaggccttttccctgacgcactgcacattattctgggcagttttgccctgagccttccacttcttcttcatctcgcacatgcacgagtggcctccaaaggctatgcagcagtccacttgaaccttgatcgtacccgtcgaaataatcctgtcggcagtggcaattttcatacctcttccacagctctcgtagcacgcattcacgacgttctgatcgacaacgccgcacgtcggcgcaccgccgacggcaggtaccttctgggcggcagcaacggcgcacatcagcgcgacgagcgccgccatggcaacgagcctcgggagcattgctgctgccatgaacagatggatgcaaagatgtagctgatggaaggtcgatgcactcactcactcactgcttat

SEQ ID NO: 1609 - DNA, 625 bp, Triticum aestivum
  Clone ID: PAT_TA_1609
gaaacaagaaaatccaccgacatttatttctgattggtacaaagactcgactgagcgatcaacgctctcacacatagaagaacataacacactcacatgacacacacagaagcaaataaaagcaaacaaggaggagcaggtgaacatagaccgcttgaaaccaacatgcaagaaacatacatatccaacgaactagaggtcttgcatgcacgaagagacctcctgcgcgctctcactagcaggccttttgcttgacgcattgcacctgggcacttttgctttgagccggagccttccacgccttcttcatgttgcaaaggcacgagtggcctccaaaggctacgcagcagtccacttgaaccttactgactttacccgaaataatcctgtcggcagtggcatctttgttaccttctccgaagctcttgaagcacgcattcacaacgttctgatcgacaccgtcgcacaccggcgcaccgccgatggcaggtaccttctgggccacagcgacggcgcacatcagggcgacaagcgccgccacggcaacgaacctcgggagcactgctgctgccatgacgagatcgatgcagaatatagctaatcgaaggtggatgcactcactcac

SEQ ID NO: 1610 - DNA, 1194 bp, Triticum aestivum
  Clone ID: PAT_TA_1610
gccggccgggttcggaaaaccacagctgctactccagcatccacccatccatctctcatcttcttcttcttgcgaccaaacgagcgtctagctagctaaagattcgaacgatggccgttcttgtggcgaggcaggggcgcgagctgcagcggtacagcacgagcaccggcgggcgcatcgtggtggggtgcatcccgtaccggatgcgcgacggcggcgacagcgacggcgagggcgagctggaggtgctggtcatcagctcgcagaaggggcacggcatgatgtttcccaagggcgggtgggagctggacgagtccatggacgacgcggcacggcgcgaggccctcgaggaggccggcgtccgcggggagatgggcaaggtgctcggctgctggcactaccagagccgccgctaccagaccacctacgagggcatcatgtacccgctccgcgtcaccgacgagctccagcagtggcccgagatggcgtcccgcaagcgcacctgggtgagtacagcttcttgcttcttcaatctagctgctgcgaagtcaaattaggagccaagaacatgccttctaaacgtgtgctttccgatttgtttgaacagggctgtgcagcaggtcatggagggatgccagcactgctggatgcgggaggcgctcgaggagctcgtcgcccggcacgccaagccgcagtccgccctgtgaacgatcaagcaagcgggcgggtggggtgactggagctcgagcgcgcgcgactctcgcgagaagaggcctggagcgagcaccaacgtccgtccgtccgtcgtcctcgtcgtctctctctcctttcctcggtgcagcggcaggcctgccggcgtgtccggcgtcgtacgacgaccggaccggagcatatatttggccgcccttgccggagagacggactggggacgatggcacgcgcgcgtcaaccctttctcgaggcgtagagtcgtcgtcgtcgtcgccgcggcaaataatagggacgaacttagaaatgtgtagatcgaaagcgaacggggcacgaaaacttgacaaaacaccgcccttcctggtggtacgagcaagctcacgattctttctttaggctcttggagtaaaagatcaatcaaattgtaaattaatttaagtagccgcttttctgtggcacgctcgatcaatcaaacgattactacaa

SEQ ID NO: 1611 - DNA, 1440 bp, Triticum aestivum
  unsure (1)..(1440): unsure at all n locations
  Clone ID: PAT_TA_1611
gccggccgggtctcaaacaacagctgctactccagcatccaatccatccatctctcatcttcttcctcttgcaacgaaacgagcgtctaggttaacagctagctaaagattcggacgatggccgttcttaccacctctattctccattgttcaaacttaaaactttctattttaatatcaaaccaaacatcacgcatataaatttcatagtgacaaaaagacaaacgaaagaacaaaaagatagacggagagccacgtggacaacgagggaggagcgagagcacaagcagaaaagcgcgagcaccggcgggcgcatcgaggtacggcccatcccgaaccggccgcgcgctggcggcgacagcgccagcgaacgtgcgcgcttgagtgctggcgaacagctcagccgtttttgcacgggggcctggtgccttccagcctttcctcgggggggcaggagccgagtcggcgcggcacggcgcccggccctggaggaggccggcggccttgaggggaattaccaagtcctcacctgccctcactaccaccgtcccccgcaatcataccacctacgagcgtctagtaggcatcctccccgtcaccgacgggaccccgcggtggcccgagcggcgccccggcggcggcgaccaggcggaccagcgccagcacgtccaggagcgccagcagcgctggacccgggacgaccctcggggagcacggcacctggcatgacaagccggagtgcgcccatggctggagccaggcgggctggcggggtgactgggagctcgagcgcgcgcgactctcggcgagaagaggccgggagcgagcaccaacgtccgtccgtcgtcctcgtcgtctctctcttcttctttcctcggtgcagcggcaggcctgccggcgtgtccgggtggcggtacgacgaccggaaccgcgagcatatatttggccgcccttgccgggcagagacggactgggatccaccgatggcacgcgcgcgtcgacgctttcgtggaggcgcagagtcggtcgtcgtcgtcgtcgcggcaaataatggggacgaacttagaaatgtgtgaggtagagatcgaaagcgaacggggcaggaaaacttgtcaaaaacactgccgaacgaacatgctcacgattctttccttaggctctgggagtaaaagatcaaattgtaaattaattctagtgaaaccgcttcttggtggcacgatcgatcaatcaaacgagtactgctactactgatcaatcaaattgtaaattaaattaagtagccgcttttctgtggcacgctcaatcaatcaaaacgaggactacaatctgaaaaaaaaacatacttactgtaaagaagtcaaattnnnngccaagaacatgccttctaaacgtgtgctttccgatttgtttgaacaggcaactgtgcagcnnntcatgnnn

SEQ ID NO: 1612 - DNA, 1426 bp, Triticum aestivum
  unsure (1)..(1426): unsure at all n locations
  Clone ID: PAT_TA_1612
ctcgtcctcagctagctaacatacaggcaggccatcaggagccgccccgcgcgacgaccgccccgccccctcgtccccctcgccccctccctcccgccagcagacatgcagggaatcaggaggacgtacggcgaactagactctaggagaatgtaccccccgccgcccggacctcctgttggccgctgactcgacttgagccatcgttcaccccaactctcgtctacaagacagagcatccgcacctcccgaatctcttcatcatcatcaccgtctccgactctccgaacacgctctccatcgccatggctaggaagcagaaggaacgcgagcgtatcaacctcaacgacctgggcgagagacgggagggcttctccacatgctctacttcgacaacgcccacaagggcatgcgacgacaagcccatcgctctccctcacgcctccccgccacccgctcacctccaccacctccggccccgcgacgccgccgcaccccccctgccactgtccccgggcggccgctccctccgtgccgaccggcccaggatagaccctggcagcggacgcgcacaccgacgcggctacaggcgtggagcagtcggccggggccgtccccgctgcacccgtacggtcagtcgagggccgagtactccgatggcagcggctacggcctcgtggccaactccgtcgaccggtcccgtgccagggggcgcctcccgcggcaacgaaacgccgacgaggggttccgcggtgcccaagttcggcgactgggactccaacccggcgtcggcggacggctacacgcacatcttcaacaaggtgnagggaggagaagagcacccaggccaaggcaccggggttcggcaaggacaacgtcgcctatggcaacggccgcaggcagcacgacgacggctacgtctcctcgagtcgctggtgctttgggtggtgcaagtaggggtggttcgacagatgatgatggggaaaagtaagcgaggatctttgggaatgtaaattgtgtgaaattaagaaggtttttgccattgattcaacttcgaacttctgtaatcccattttttgggacattatttggcattgggcactcagcagagttcatattcttttgattgtgaaatatactcctactatttctttctgatgtggaatgtagagttcagccatggttgttgtaatactagaattctgttgcggggcttgtagtgcaatactgggtactgattacctttaatccaatttcggattgcagatagtttctgttttttcttcttcaagggtgaacgtgaatgtcgaacccacggaatgttctgctagtagatagtgattcaaacaagctatcattgtcattaagagttttggctttctgtaccaaataccgcaagttgtatgaagagagatcaataatgctt

SEQ ID NO: 1613 - DNA, 627 bp, Triticum aestivum
  Clone ID: PAT_TA_1613
ccacgcgtccgctctgtcctctctcccttatgtctttctcttccgatctgagcggcggcggcgacgctcgcatccggcaacggttccaccactccgtccatctcttcctcccaccactccatcaccatccccacatcgctgctgatttcccatttggaggtggtcctgtggcgccgatgctctcacccagctgccggtggcggcacattttgttcgtgcccaagcgctcggtgaggtcacctctcacctccctcctatggtgccaccgccccaacccatacgcagctccctcttccccactcccatggttgcagatctgagcgggacaaggtcccttcgaccctggtggttcgaaacgaggtgtgcggcctctgctctcttaacttctggagactaggggcgcggtggctggtgcccccatctctcttagccatccacggcgtaacatcatcaggtcaaacaaactttcataggtttggtggatgtttgggcaattactcaactactaaacaaaaggccactgtatgatttttatacctgcatcacatcaagtggatttggatagcacacaagctggcatggtcttcatcgtggattcaatctccacaggagtggagtggcccccgc

SEQ ID NO: 1614 - DNA, 744 bp, Triticum aestivum
  Clone ID: PAT_TA_1614
ctttctctctctcttcttcttcttcgttctctttctctccccggaaccggcagccccagacccagagcaactgaccaccaagttctcgggcatggacgacgacggcgactggatcacggcgatgtacctcctctcctccatcctcggccggaaccccctcgtcgtcgaccacgtcgacgaggagtccttcccggtcgaccacgcccccgccgccgccgcccgcggcgggccggcggaggcgccggcgtggcagccgccgccggccgtgttcgcggcgccgagcgtggccggcacggtgtgcgcggtgtgcacggaggagatcgcggtggcggaccccgtggtgtgcggctgccgtgcgcgcactggctaccacgccggctgcatcgcgccctggctcgggatgcggaagtacctgccctatctgccgcgccgacctgccggccagggaaggaggccggggaggccggcgccggcgtcggccgcgagaaccccccgcgcgccgagccagcgaccagcgcgtccggcgtgcggcgtgacgcgtcgtacggatacgtggcccctgggggcgtcttgtcggccggatggggggcggacgggggccgtcgcgtcgtcgtgcgcgcgccatggcttttgctttttttttttccttcgtcggaggagtcttgctcgatactttacaaacaaatgaaatggttaattattaacatgatattgattcttgaaaaaatgtcgacgcggccgcga

SEQ ID NO: 1615 - DNA, 929 bp, Triticum aestivum
  Clone ID: PAT_TA_1615
gtgaaaggccatgggatttcagagtcgctaatgacggaagtcagggatatcacacgcaaattctttcacctccctcgtgaggaaaaactgaagatcaaaatgacacctcagagtggatatagagggtatcagagagtgggagaaaatgttaccaagggtaaacctgatatgcatgaagcaattgattgctacacgcctatcgaaccgggcagatatggagatcttgctaaaccaatggaaggatctaatttgtggccagattacccatcaaattttgacgcgctgctggaaaactatataagccttctacgagatctttcaaggaagatcatgagaggcatagccttggcactgggtgcgccgttggatgccttcgaaggcggagtggcgggcgatgctttctgggttctcaggttaattggctatccaatctcagatgacatcccacaagaggagcgcactgatattggatgtggagctcatacagattatggtcttctgacattagtgaatcaggatgatgatatcttgtgctcttgaggtcagaacccagtccggtgagtggatatacgccaagccggtcccgggaaccttcgtttgcaacatcggcgacatgctgaaggtttggtcgaatgggatataccagcccacgctccacagagtcgtcaataactcccctcgctaccgtgtatctgtcgccttcttccacgagtcgaaattgcacgctgcggtggaacctgtagagttctcccgggagaaaacgggcggcgttgccaagtatgagaaggtggtgtatggggagcacctagtgcagaaagtcctcaccaacttcgtcatgtaacagtttgggggaggggaggtgaaagcctgaaagggcccaaatttctgtagctgtactgaaaatgatccatcaataaacacccttcgac

SEQ ID NO: 1616 - DNA, 1487 bp, Triticum aestivum
  Clone ID: PAT_TA_1616
cccttccgagaatcgggtctctctcgcctcgccgaacaacatgggctccgacttcaaggccatccctctgatcgatatcagcccgcccgtcgggcagaccgatcaccccaccatggccggcgtcgagggtctgctcgacgtcctccggccgcttgccgctctccggtccggcgcctccgtctctctcgccgaagaccatgggctccgacttcaaggccatccctctgatcgatatcagcccgctcgtcgagaagatcgacgaccctgccatggccggcgacgagggtctcctcgacgtcgtccggatgctggacgacgcttgcagggaggccgggttcttctatgtgaaaggccatgggatttcagagtcgctaatgacggaagtcagggatgtcacacgcaagttctttcagctccctcgcgaggaaaaactgaagatcaaaatgacacctcagaagtggatatagaggatatcaggagagtgggagaaaatgttaccaagggtaaacctgatatgcatgaagcaattgattgctacacgcctatcggaacagggaagatatggagatcttgctaaaccaatggaaggatctaatttgtggccagattatccatcaaattttgacgcgctgctggaaaactatataagccttctacgagatctttcaaggaagatcatgagaggcatagccttggcactgggtgcgccgttggatgctttcgaaggcggatgtggcgggcgatgctttctgggttctccagtctcagatgacatcccacaagaggagcgcactgatattggatgtcgcactattcagatatgtggagctcatacagattaaatcaggatgatgaaatcttactcgtgagatcagaaatgtgctcttgaggtcagaaaccagtccggtgagtggatatacgccaagccggtccctggaaccttcgtttgcaacatcggcgacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaaaacgggcggcgttgccaagtatgagaaggtggtgtatggggagcacctagtgcagaaagtcctcaccaacttcgtcatgtaacagtttgggggaggggaggtgaaagcctgaaagggaacaaatttctgtagctgtactgaaaatgatccatcaataaaacccttcgacaaatcagcctcctttctggtcggacaaagtaactgtcccggtgtatcgtgaccaggcaaggcagcacatgaggatttcctctcatctggctttctcgctttgcttgcgttctgcggatcgaaccctcacaactggttcacaatccgttgtaatttcgtgacgacaatgtaaatgcaaccaccaatatgtcttgttgttactccacttcct

SEQ ID NO: 1617 - DNA, 575 bp, Triticum aestivum
  Clone ID: PAT_TA_1617
acgccagtgccgaaacctggttcgaatgggttcttcctcgagcaacgccagggaagcgccggcggcggcgccaccgccaccacctcctgcgccgccgggccccctccacgcgatggacgcggacgaggacgacgagagcgtgaagcagctcgacgagtgcgccgccctctacctctccctccagaactgcctcgccgagtccgaccgcaactggaaggcctgccaagcacatgttcaagccttgaaagcatgtgaggcgagcagaaacaaaaatcagaaaacatgaaaaatgcgccttcgtacaggccgcatgctcaaggcatctcactcatatcatcttcgtgaagacaagagcacaacatgctgagttcgcagctgttgatgaagaatatttgcaacatcacaacttgtagtgtgctttgactgagacgtggacgatcagattgcttttatttgcaacaaccactacactagattggatgtttcaaatattacttgtcaattctaataaatgtcggctgtattgacatatttgccaaacagactattaacgcaaatcagtattattgctgcgc

SEQ ID NO: 1618 - DNA, 400 bp, Triticum aestivum
  Clone ID: PAT_TA_1618
cttctccttttcctctcccccatggttttgccaatctgggctctcttggcagagggattagctttgctggatctcatccattgtttcaggtatggcttgccctgtttgccgttgtctgggtgctccgtgcttaccagttgtggaagctcatgaagtcccagaggttttcgatgttgtagttgatgatgcttgcttcaggaggatgcagatctgctgttgttggtttggtggacgaaggagaaggtagttgccagcaagaatcgtctggagaagttagtcagaaacatcagaaggcaacaggagatctgagctttttttctcctttcatggtggcggctgtgtgggtgtcgagaaagaaagaagaggaggcaagagggaagacctagtgagctgtacgtta

SEQ ID NO: 1619 - DNA, 536 bp, Triticum aestivum
  unsure (1)..(536): unsure at all n locations
  Clone ID: PAT_TA_1619
cgtccggcggcggggaggcaaaccaagcaaaccctagccagagccagagacagaaacacctaaagcgccggtcgccggatcgccccgtcgcgtgaccgaccggccaccaccagggcagccatcgccatcgccgccgccctccctccctccctagaggctacagcaagcaagaaagcgagcaggcaaggaggggtgggggatggcggacagcggcggggtcagcgccaacaacgccgccgccggcaacgacgacgaggagggcaacaccgcccccgttcccccgagacggtccagataggaggatctcccgagtacagggtcgagaggaagctccggcaaaggncggctttgggccacgtctttgtcggccgccgcctaaccggtggcaaccgcccgccggcggcccggttgctcacnangttgcantcaaaattcgaggcacaacaccaagcaaaggggctgcaaactacnggccccnccataccgaagtggcaatgtcnattcctggctcttggggggtactcatggntgtnccn

SEQ ID NO: 1620 - DNA, 1436 bp, Triticum aestivum
  Clone ID: PAT_TA_1620
ccaagaggtgacgcccggcttgttcttcagccttcccccagcgtgcagctgccctagcaccacgggctgccggtcttcatctctgactcctccctcccgtcctcccctccatctcgccgggccatggctcgtctcctcctcgtcgtcctagcgcttcacctcaccgctgccagagccttcgccgcgtcaagcgtcggcggccgtaacggcgacttcgacccctcccgcgtcgtccagctctcgtggcaccccagagcgttcctgcacaaggggttcctctcggacgcggagtgcgaccacatgatcgagctggcgaaggacaagcttgagaagtcgatggtggcggacaatgagtcgggaaagagcgtccagagcgaagtgcggaccagctccggcatgtttcttgagaagaggcaggatgaagtagtagcaaggatagaggagaggattgctgcttggactttccttccgtcggagaatggcgagtccattcaaatattacactataagaatggtgagaagtatgagccacactatgattacttccatgacaaaaataaccaagctctcggtggtcaccgaatagcaacagtgctcatgtatctgtctaacattgagaagggtggagagaccatcttccctaacgcagaggggaagttaacacaacacaaggatgagacggcatctgagtgtgctaaaaatggatatgcagtaaagcccgtaaaaggtaacgccctgctgttcttcagcctccaccctgatgcaacgacagaccctgacagtttgcacgggagctgccccgtcatcgaaggccagaagtggtccgccacgaaatggatccatgtgaggtccttcgaaaactcgggcaagcagggaggtgggtgcgaggacgagaatgtcctctgctcgcagtgggctgccgttggggagtgcgccaagaaccccaactatatggtgggcaccaaggaagctcctggcttctgcaggaagagctgcaacgtctgcgcgcagtaagttaattcttaatccacccatccaccatcgtcacacggcatcgataaattattggcccagtagcgggcccagggtgtgtgtgactgctcatagatagcatgtgtgacctggaatggaattaaatgtaagatctatcatcttgtcgttcttacaagaaactgcagctggagaaagaaaaatacactatactcgctaagaactttgtcttttggggctgctcagaacttttcttgtttacccgttttagccgagcaatcaaattaatcaaattaatgcgggcggttccagcaatcttgttccattgggtcagtgtcgtctccttggacctcaacgttgtactatgttgttctggcgggacaagaaaacaagatggcagcacaaaatggaaaagaaaccgctgatctgaatctaaaaaaaaaaaa

SEQ ID NO: 1621 - DNA, 1168 bp, Triticum aestivum
  Clone ID: PAT_TA_1621
cggccgctcaggcggcgggcgggagacctgctccctacacgagttctttcgttttcattcgtgctgcttattacatctgcctcttcacgtttcattgaagaatctggtttctttctaatagcgctaattgaccggcttaccagtgcccgtctcaccagattgcgatcctcaaaacccttatagatcagtcagccaagtcgccgatttgtcttcttggttttgtcttattagaactcacacatatcgatatatgacatcgccattaatgtcgaaataaaagtgtttttttattgcgctctgtcgccaattcgcggcagccagcgctccgccgccgcgcgcgatccaatggaggaggtgcaggcggccgtgacggcgcacctggaccaggtgtcgggcctcgtccaggcgctctcctccgagctccgcagcgggatcggccccgccgccgacagcctgctcgccttcgtccgcgccgtcgactggacggagccatggctgatgtgcttgatggcgttccacgcgggcctgctgctgacggccgtcgggctgaggaggaatgccaacctgcagttcttcttcttgtttcttgcttattcaggggtgtatctagctgaaaagataaacatctacctagcagagcactggaagatcttcgccagccggaattactttgaccgtgctggagttttcatctccgttgtttggtctggcccccttgtcttcatatctatcgtcaccgtggttagctctcttattacactgtgtcagttaatggtgaaatggaagagagcagaactaaggcatcgggctcgtcttgctcgtgacaaggaggaatgatttaatatcctattttggaagaagggaacaaagtgttgaatgttgaccttagtcagtgcttggatcttagagggatgcgcagttaccaagtactgtaaatgcttcacctgctatcagcatagcatgtaatcttcagctgctctttcttagtagtgtatttctattattctctggggtcatcaacttcggtaatggttaggtatgcagaaaactagatagatgttgtatctggctccatcctgttttatttgtagctaacctgacgatgtaagtttgtttgatattcgctatgatacatctgcaaaacaaaaaaaaaaaaaaaaggccctag

SEQ ID NO: 1622 - DNA, 649 bp, Triticum aestivum
  Clone ID: PAT_TA_1622
gggtgcatgccgctgctggtgcggcggctggaggccaagtcgaacggcgcgcgggaggtggcggcgcaggcgacggcgacgctgatgagctgcccggcgaacgcgagggacgtgaagaaggacgagaagagcgtgccgaacctggtgcagctgctggacccgagcccggggaacacggccaagaagtacgccatctcctgcctcctggcgctgtcggcgagcaagcggtgcaagaagctgatgatcgcgcagggcgccattgggtacctgaagaagctctccgagatggacgtggccggcgccaagaagctgctcgagaagctggagcgtggcaagctgcgcaccctattcactaggaagtaaagcaaggagaagcgttccgttttgccgtgaacctgtaaaaagagccgccgtcctgtgttcatagtctctatgaaggcagtgcagactgcagagagtagtactgttgccgatttgaaccttttaacataccgcgttgtagtaccgctggttaatgtgtatgtcacctatgtcaggcagttgatgcacaatgcatttgttctttaacttaggctgaagaatgccaataaaagaatgttcagtgaagaacatttgccgattaaaaaaaaaaaaaaaaaaaaaaaaaaaa

SEQ ID NO: 1623 - DNA, 1116 bp, Triticum aestivum
  Clone ID: PAT_TA_1623
cgtccgcggacgcgtgggctcggaagtcgcgctcccaaaccctagctcccaccgcagcggcccccgccccctcccggttcgccgcccgcttccttctcccgcaccagcgatccccctcccctgcccggtcgctcgctgaatcatccgcgcgtttgatctgcaggtgcgcgcttgctgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgaaaggctgtctgcccttggcaattgcatatcctgcaatgaccatgttgcgctcacacaccctgaccttgacaaggcaactgaggagcttattgcagatgtgcttggggttgaggtgttccgtcaatccattgcaggacatatccgagtttgatgctacttcccattctctacaagtccctcacgtcgctggtaacagagaaattgggtagcgaggtcattgctgcgggcatgacggtgaacgactggaccgccttctgtggctcagacaccacggctaccgagctgtccgtcattgagagcgtcttcaagttgagagaaggccagcccacggcgatcgtcgatgacatgaggaagtcgctgattgacagctatgtctaaatgatcaaagggcatccggtgcggtgtggttggttcttgagctgtactcttggttgacagtagcaaaaaaaacgtgcctgtctaagctgttacttctgtctgtcttctgaatctggaactacacacttatatgctttgtactcgtaaagcttacggtatcggaagacgtgctcttgcgcttttgtgatattggaatcttataactgcgagtgatgttggtttt

SEQ ID NO: 1624 - DNA, 1355 bp, Triticum aestivum
  Clone ID: PAT_TA_1624
gggagcgccacgcgtccgcgggggttcccaaatctcggaagtcggcgctcccaaaccctagctcccaccgcagcggcccccgcccccccccccggtgccccccgccccctcctcccgcgccagcgaccgcgccgccgaccgcggtcccacaccgtcgcccccgccgcagtggcctccgccttgcgacccccgcccctctcccggtgcgcgcttgttgctgcagacggagaagcggctgaggagaagaggaatcgaccatggcgacccgtatccagtttgagaacaactgtgaagttggtgttttctccaagctcacaaatgcctactgtctggttgcaattggaggatcatgagaatttctacagtacatttgagtctgagcttgcaaatgttattcctgtgctcaatcacactatctccgtacctagtaagaaagatttggtcgcctctccgttggagaaagaatgcactgggccatactccttgccacacacaacccacttgatcaagacattcagcatctgaggaactgcatacctgatcaagtggttgttgagcgcatcgatgaggggctgtctgccgttggcaattgcatatcctgcaatgaccatgttgcgctcacacacccgtgaccttgacaaggcaactgaggagcttattgcagatgtgctttggggttgaggtgttccgtcagacgattgcaggaaatattcttgttggcagctactgtgcattctctaacaggggtggactggtccatcctcacacatccattgaagatcttgatgagctgtccacactcctccaagtccgctcttgtcgctggtacccgtgaaccgtggctagcgaggtctattgctgcgggcatgacggtgaacgactggatcgccttatgtggctccgaaacgacagctacggagatgtgagtcatcgggagcgtgttcgatttgagtgaatgctagaccagtacgctcgtcgatgacgtgaggaagtcgctgtttgagtgctatgtctaaatgatcaaaagcggcatgcagtggcggtgtgcttcttgagtctgtactcttggctgacaatagcaaaaaagcgtgcctgtctaagctgttactttctgtgttgtcttctgaatttgggattgcaaacttatgctttgtactggtaaagcttacggtatcgggagatgcgcaaccttatacttctagtccaaaaaaaaaaaaaaaaaaggcccctaatgtgttgatcggctagcaaatttcctagaaaaaattccagaaatttgatccgccgtttaaatatttaataaaaaacaagcgagttgcgctcaaaaaaaaaaaaaaaaaactcgagactagttc

SEQ ID NO: 1625 - DNA, 368 bp, Triticum aestivum
  Clone ID: PAT_TA_1625
aaagatctggatccattcccttcctgtagtattgttgtttgggatggccctgtgcacccgcctctctttgatttagatgcaggccggccgcatgctgctggcaatacggtagttcttactccattgaacccaacgaggtatacagtccagtctacactttctgttatattttacccaaagcaatatgacctcacacaacagtggactgctattgaatcataacctcacatgtgaatgattgacaattttttctctaatcttgattggggctagtatttataactgcaaaactttgctcactttcatgtttgttgcttggacttctcacacctgtaatttgttttaatttataaattgttttaatttgc

SEQ ID NO: 1626 - DNA, 796 bp, Triticum aestivum
  Clone ID: PAT_TA_1626
ccttccacaggccgccacttgcccttcgaatctaagagctggaaggcaactctgccctccctcctgtccctgacaagactctctgcgactgcatggtcaagagccgaagctgtgttcccgccgataacctcaaggctaaggacttcaacgagatcttcggttacatctgcggccagaacaagaagatctgcactgccatcaacgccaatgctactgctggtatctacggtgcctacagcatgtgtgacaacgagtccaagctcgcttacatcctcgatgcctactacaaggaccagaacagcaacgccgacgcctgtgacttcaagggcaaggccaccacccagaaggctcagaaccaggactcttgcaagactaagctcgagtctgccgacaagaccaacgaggaggttgccactgccaccgctgctgctggcgctgcctctactgatggatctgactctagcagcaaggacgacgatgagtccttcggtctcgagtccgctaccattgcccgtgccttctccgtcggcaactacgccgttggcgcctacatggctgtcgctggtgttgtcggtgccggtatggtcctcctgtaagccatgtttttagatggatcattcttggtatgacttggagcttcttagcggtggcctttttggaatgcgttattcccccttttgtgtgtcttttttctttttgtgtatctagcatcgccggtgtttacatggcttgtaattagaacgacattagatgtctaataccatcttgcgtggaaaaaaaaaaaaaaaaggcccct

SEQ ID NO: 1627 - DNA, 655 bp, Triticum aestivum
  Clone ID: PAT_TA_1627
tcgtccgtcacctatcctaagcctcaaacaaggccttattctcatcgccgctgccgctaccagtgccttttctccatcggcggcgccgctctcgctccattacgtactgttaccgctctcgccccctcccgatctagctgtcctctcccacccaccgccgacctcgccgtccttcttacccaccgccgccgacctcgaccctccctcccttcccgcatattacggccaccactacgcccttgcgcgcgatggcggcggcgaggtcggcgccctcatcgagaagcacgcggcactggctgcggggtctggccagcgacgccgatatctgctgcggcgcgacgccgacgcggtccaacacgaccgcctgcagattccgcacgcctagcgacggatgcacggcaaccgtgcccaggtccacgctctgctcccgccagtatcggcgacaacaagaaggcctggaagaccgaacactgcagggcactgaagataaagcttacagaaagaaataaagatggccatgttctccaatactcctggatttcatttacatcaacttctcaagagaggagtactcctttttagtagtctcagtttaaagtaaattaaatgaaaggagtactccttttcagttgtctcagtttaaagtaaatgaaag

SEQ ID NO: 1628 - DNA, 1509 bp, Triticum aestivum
  unsure (1)..(1509): unsure at all n locations
  Clone ID: PAT_TA_1628
cccccctccgatgccgccacatcctgcgccccgctgccttgcacgacggcgacgaggcagcccggccccggctggcgccggcgccccgacccccttcccgccgccgccttctctctcctgccggctcaccctccaaatcatgtcgcaggcggctcccgggggactggagccggccgagtggtcggaggtcctcgcgcgccgggatctggtgtccacgccggccgctgtctcgggcacgggcgcggcccgagactcgccggctgtggcggcgctcaaggggaacattgcagcgccattcaacgtcctgcagggtttccttttggcttgccatggaagcacgggccgtgctggtcgtaggcggcgcaggcattccgctggtactccctcgggagtgggggatgccagcttcccgttggtccagggcagccggttctgcctatggatctggccgctccgcactgggaagtcaatcctgccctccagcgccaggatgctgtggaggcagacacgtgcttggtgtagaaacgctccaggaaaccattggtgcggccttcaacctcctgcaggctcaccttttggcatgtcatggaagcatggtcggtgcggggacaacactccccattggtaattctgatgctgcaaaagccggaaaatattccaatggagatgccgccatgagcttttcagataaggatgaatccttctctgatcttgaggaagatgaaggcttcactgaggaggagatagccgtcgccaagttgattatcgctgttacagcagattcgcttgatgcggtgaaagaaacaatccgtttcatcactagtttgctcaagagctctggcaaccaaagcggtgctgctgaggacaaggtggagtcaatggagaatttgctgagccactgcagggacgttgctgaccaggttaacgagcttggggcctccgtttatgcacaagacccatctgaaatgaagtcagccataaaaagactgtacgttggcatcacagggatgtgccaggaaatagcgggcctcggtggctcgcccaagaacgcctatgcagccttcagtggatttgagaagtcgttgaaagctcttgaggaagagataggtgaggatgtcgtggacgaaatgaaaaatcttaccatcagcccatcctgattgttgaagttgaagacttcttttatgatatgccctctagtttgtagcagtgttctgatgtgtcttctagttggagttgtgaagcttgtattgttcaaccgaacggcagagtgcatagttctttccagtgaacaagagaatgcttagtgcttagtgtggtgttggaattcctggtgtgtctgggcggtttcccggtgtggcacagccagtatgactgggcgtaatatatacaaggttgttctaggtgaattttgggtgctgcccgatctaacgttagtactggcgaaatgtcaaaaaaaacacgggatcccggcccnattgttaaatgtccgaacttgtcggactcaacatc

SEQ ID NO: 1629 - DNA, 537 bp, Triticum aestivum
  Clone ID: PAT_TA_1629
ccacgcgtccgagaaaaacaagagagaagagaagagaattagggctagccatcactcatcttcatggcgatcttcaagagcaacaccgccgcgatgatcttgcccgccctcgctgtcatgcccgcggtcctctccacatgttgcctcgcagacgagggggagagatgctttccgcctatctcggggccggactgcaacctgaggcagtgccggaagctgtgcggggagaagtcgagagcacactgctacatggcgttggccgacgtgcagcccatgggggtaaccgcctgctgctgctctcccctcaagcgcgcgaagactgctcctgctgtcttgtagacttcgtcggaacgatgaagaaatcaataatcgaagaatttttttgatggtgtgcgaatgtgatgtgtgtctttaatttagcactttgagttcagggacgtgagctttctccttttcggctaattgtattctctgtgtcattcttcgtgtgaccaaaaaatcaaaatggcatgtctctaacccaaagacaaaaagaac

SEQ ID NO: 1630 - DNA, 658 bp, Triticum aestivum
  Clone ID: PAT_TA_1630
ggatcaaggcaaagcaaccaataacgttagggaacaatggctcgaggtctcgccgttgcggtgctcctgctcgtcgtcgtcgcggcagcggcacaattcgcctgcgctggcccagaggccgctcttaccgctggaggggcaactgccactccggccggtggcagcttcgataccggcctcccgctctaccgggaagccgggaaacccgcgaaggatgccgccaacgctgccgacccttccgcggtcagtggcggcctcgccaccggcctcccgctttacctcgaaaccgggtcgggagagaagaaggcttaatctgggctactccacttcaacacgggctgggtggccaggtgctcaacaacggtcaaacaacaaatatgtactgtagatcctagcatgccgcgaagctttatctttgtctgaagatctctccatacatcttggggggaaaaggaggcaggtattagctattgttagggaattcaatactagggctagtaataagttagatagttgctttgtttcctttaaaagtaaagcttcgaattatgaagctcattcacttgtcaaacactcttctttccttgatcagggtcgtcacctgtggctaatttctctgcatgacccttcttatattttcatggatatccacattgat

SEQ ID NO: 1631 - DNA, 1452 bp, Triticum aestivum
  Clone ID: PAT_TA_1631
agagagagcccccatctccttctcgccccttctctcctcccttctcaaaaaccccctccgccgagtcctactccccgtctccgagcacctccgccgagtctagggtttaaccgcccgcctcgtcggcctccgtatcgccaggggaaaggaggagcgggcggtgatggcggcgccgataccgcgtgagtgggttggtctgcagcagttcccggcggccacccagaccaagctgcacgagctcctcggcaagctcaaggaggagaatgtgagcacattgacgattctggtgatggggaagggcggtgtggggaagtcgtccactgtcaactccattgtcggggagagggtcgccaacgtcagcgcgttccagtctgagggtctgaggccaatgatgtgctcccgcacccgggcaggattcaccttgaacattatcgacactcctgggctcattgaaggtgggtatataaatgaggaaggcttcggagatcattaaagagttttttcttgggaagaagactaatgtccgtccgtcctttgagcgcgagtctacttgtagaatatatagaaaggatgaacaagttataagaaacattactaattcattagggaatcccatttggagaagaacattggttgtattgacccatgcccagctgtctcctcctgatggaattgactataatgatttccttgcaagatcctttgcgtcgcttctgcgatatatccgttctggtgcaggaatcggcaaacgagaatatgcggattttcccttgccaatagctttggcagagaacagtggaaggtgcaagactaatgagaatggggcgaagattcttcctgatggaactccatggattccaaacttgatgaaagaaattactatcgttgtctcaaatgggagccagtccattcatgttgatcagaagttaattgacggtccaaatcccaacaatcgctggaagaagtacatacctctcatccttgccgtgcagtacttttttgtggtaaaaggaatccgaagggctattcattctgacatttcgaacgggaagctggatgactgggagcaacgctatagagacttggttggaagcggcaaccctgtagaccagaaagtttcgtcatcccgcaaccctaaggcctgagctggtcaatgagagtgcatgccagtctcttgatcgtggtccattcaactccccgtgttgttctttttgtgctccttattccagtggtctgtttagggggatctatagagctctcaggaacaacttgaataaagttgcttgtgttctatgttaaagattatgtaccccatttcattacgctctcgcaattttgcaaatgttattgttgtgaactacaattatttgaatttcttgtatggcctgaatgtttggagatgaatacaatttcttcattgttcaaaaaaaaaaaaaaaaaaaaaaaaaaact

SEQ ID NO: 1632 - DNA, 2426 bp, Triticum aestivum
  unsure (1)..(2426): unsure at all n locations
  Clone ID: PAT_TA_1632
cgtccntccacgcgtccgcccacgcgtccgaggaatcaacaggcaaaggaaacatgggtgctctgaatacgcgatatatgcttcgtcaacaaggctattcaaaggcggaacgtaaaacaggtatgaaggtctcaaacttgtgtcttctcgatgaaactttggcatactcgttgagtaaagaaaggactactaccatgttgtttattgtggagtatgatcaatccatggaaggcaaccttgtagaaatgtgtctagaagaattgattagcagtatgtctggtccgcggacgcgtggggatccatttccaaaaacaacatctgtagttgaatattatcacattcttccgtataaggagattttgtttgaactcctccacaggaaatggccttctgattctccactgaacgaacaatcacatcgacatggaaaaggttcattgcactctgtaatagatgaaaatgtggaagagcaagatgtgaatagcacgtctaagatgcaaaaacgaattacaaaagtgtcaactccaaagcaaagcaaacaagcaattgctgccaatagcaaccaggactacaggaccagcaagcacaagagaaacagctaaagaaaatctgaagcctccagggccgatgtctgtgcaaagggtccagatgctgagatccacacaatagaaaatggtccacctccagttattattgatttggaaacttcaaacgccctgaccaagtcaagaaatgcaaaagctgctgcagcagcaaatcgagaaactaaaatcctacaagccgtggataagaacaaaacacagaagcagtctagacgtgacaatgtgccccaagatgtctttcctgaagaacgagtctgcgaggcgacgactgtgggggaatcgaccagatccgccgcgtgcccgtctggaggacgggaacacggtgacgggggctggttcggcgcgcacctccgccaccgagccttgcatcgccagccccaccatcccctcctctcacgcgccgccactgtcaagataaatcggtgcgcccctcctcaccgtcaggccgcaggagacgcgtgttgatcctttagtgaagaaccgtgctttggaatgccaagatatggaaatgtctgaagagtcaggtgccacgagtaagtacaacgatgatggccagatagatgattctctgcaatcaattcagaaaatacgggatgaaattcttcgcaaggaaagcatacttcaagaacgaagtgctcagtgtgatatggacatccagacactcttgagtgaaggaaagatgacacccaaagctgtatcaataataagaaaatacaaggaaacttgctcagatatgacagaagttaccaattcatcttgctctggagatggtggccaatctatcactaagaggaagaaattgaaggaggcactcctccgacaatgcaaggagcttgatgagatctgtcgtggggcccattggatactcccaagatacacagtattaccttcagtatcagatggaatgtaccacgccagtgtacgtttgagatgccctgattttgagatgagcctcactggtggtcttcgtcctaccccacacgaggcgaagtgctcggcagctgccaatatgatactggagcttcacaagaaggcggaagagcaagaacagtagggtacctgatgcaaaatcaccttgttaaactcctgaatctgggaaagtgcgggtggctggaaccagttgcttagtcattacaactttaaataagacttattgagaaaattaattgtgttgctaccttgttattagctattttaccttccggaggtagactccttgtgttgttgttgttgttcttatggtggagtatgagggtcgtccatcactcagaggaagggattgagggaggcactcctccgacacaattcatgcgaggagcttgatgagatctgccgtgggggcaattggatattcccaagatacacagtagtaccttcagtatcagatggaatgttccacgccagtgtacgtttgacatgccccgagtttgagatgagcatcactggtggccctcgtctgaccgcacacgaggcaaggtgctcagcagctgccaatatgatactggagcttcacaagaaggcggaggaggaagaacagtagggtacctggtgcaaaatcacaactcctaaatcgcggtactgcaggtggctggaacgagttgttatttagtccttacaactttgaaccaaacttcgtgtggaacataatcacgttggtaccttgcctagctattttacctacgggaggttgactccttgtgtcctgtcggtattatggttgtttgttaaggtcgtgaccaaccccggactgttatttgaaaatttctgtgacgctgcagcttcattgtctattctgttatggaagtgaacacaaaatgtctagct

SEQ ID NO: 1633 - DNA, 783 bp, Triticum aestivum
  Clone ID: PAT_TA_1633
gtaacaactccgctcattgcccatagccacgccacacgagcacctccacaccccctctactctacgtcctcgagcttgggatcgaacatgtcgtcgagagcgccgccggtggagctcgacttcctcggcctccgcgccgccgcccccagcgaacaacacggcaagagcaccggctcctcctccttgtcgtccatccgaggtccgaaaactccgaacgtcagattattctagttttatcgctacctcttgtgtgtctgtgtatgcgcgcgtgagtactgactggaactgaatggatgcgtacgtgcgggcagggatggagacgagcgctatagcgaggatagacccccagctcctgcgccgcgtcgtcgtcgcccgctcgccggcgacgacggaagaggcgccggcggctcccagtcccatgacggtcttctacaacggctccgttgccatcttcgatgtctcccaccacaaggcagaagctataatgcagatggcaagggacgtaactatggcagaaaggcgcgacctcggcaacaatacacctgttggaaattcaagcaaagacataccattggcaagaacaaaatcgtgacagcagctcctagtgaagcgtaaagagaggtagacccgcatgggtccataccatcccggcgccaccaccgtcagcaccaactctcttggtgtgaagaaggaagcggaagcagcctagctagcttctgggcttaactgattagcttgatgttcatttggtactcttgattggtgatttatgattatagctaa

SEQ ID NO: 1634 - DNA, 670 bp, Triticum aestivum
  unsure (1)..(670): unsure at all n locations
  Clone ID: PAT_TA_1634
ccgattgcgcggcccgcctctgcgatggtctctggctgctgctgttgctgactgcagcgatgaatcgaaggccgatcgtgctcgtcttcctcctgctcgtgctcatcatatcatcgcagttcgagtggaagcagcagatcggcgaggccgaggcgagcccggaagctacgcggcggaggcagcaaccgcaggttgtaagggaagatgccgttaaagagaaaataatactggcgcaggaaaagaacatccaacaactcaccgagctcatccagagcctccaggtgcagctactgcattgccgtggcagcaacagcactgctcatggcgcctcctcgaatcagtcttcagccagttacgccgaagcggacagacatcagataatcgatgactgatcgcccgtcgacatgcccaggtactttgcatcacagtacaagcggctcaaggacacacacctgaatgatatatgaaaggcaccatcgtcgcgcaccaccatgtagtgctctggagtccaaggagctgtcttagtgtactgatgtgttgtactattgacagcactatgaccaccccccttccaatacctcttcacccttggcttgtacagtgttatattgtaactgtatcatgtaaatttagcccaccttcctcattgagattgaaattttactcatna

SEQ ID NO: 1635 - DNA, 1178 bp, Triticum aestivum
  Clone ID: PAT_TA_1635
ggtttttccagccagcagcatttggctggccgactgcgccgcacgaagggggaaggaagagggctacttggaaaactgggggcggcgcggcgggacggaaagccgaggtaggagagaggaagcagtctcagttctcgatctccgaggttggtggcggcggctagggctggcagccggcggcagaagcagatctgatccgcgggtgtccggcgcggagaggaggctccccggagcttcggccgggccggccatccgattccgcagcccgcctctgcgatggtctctggctgctgactgcagtgattaattcgagtccgatcgtgctcgtcttcctcctgctcgtgctcatcatatcatcgcagttcgagtgggagcagcagatcggtgaggccgaggcgagcccggaagctacacggcggaggcagcaaccgcagatcgtaagggaagatgccgttaaagagaaaataacactggcgcaggaaaagaacctccagcagctcaccgagctcatccagtgcctgcaggtgcagctactgcattgccgtggcagcaacagcactgctcatggcgcctcctcgaatcagtgttcggccagttacacctcagcggacagacatcagataacagatgactgatcgcgcgtggacatgcccaggtcgtttgcgtcagagtacaaccggatcaaggacatgctctgcagtgtactgatgtgctgtactattgacagcactatgaccacccccttctactacatgcttcaccctcggcttgtacaggattatattgtaactgtatgcatgtaaatcactgctcatggcccctcctcgaatcagtcttcagccagttacgccgaagcggacagacatcagataatcgatgactgatgacccgtcaacatgcccaggtactttgcatcacagtacaaccggctcaagggcacacacctgaatgatatatgatagacaccatcgttgcggaccactatgtagtgccctggagtctagggagcttgtcttagtttcctgttgtgctgtgctattgacaacagtatgaccacccccttctaatacatgttcaccctcggcctgtacagtgttatattgtaacagtatcatgtaaatttagcccaccttcctcattgagattgaaatttgaggggggggaaaaaaaaaaaaaaa

SEQ ID NO: 1636 - DNA, 390 bp, Triticum aestivum
  Clone ID: PAT_TA_1636
ggagcgtgggcctctagtccaatcccctcgcccacacgctgaacccctccctccctcgatttctctccctcgtcagccgtcacagcagaggccacgaaccctagccccctcccactcaccgcctctcctcccgcttccccaccattgccgcgaattctctaaaggctaccacggatccatgtctatttggagggtacaaggcagggaaggacgccatcgtcggcccatcgcttaggctggcggcgcccggatcgggaagcagcagggttggtgcagcggcaaatgcgagcggagtcggccgtggagggaggtttgccggctagagcagcaggagcaaggaggcgtggtcagccgtgaaggatggtcggagcggcaggaccaacttcagcc

SEQ ID NO: 1637 - DNA, 910 bp, Triticum aestivum
  Clone ID: PAT_TA_1637
gtgatatgcaaaataaaattggtaaaggtatcaaccataggtagattaacaaagtataatgacgataccactatatatatttaactcaacagacaggcttcacaaagaaatgatttgactggaagtatagtatattgcaaatagcaacacatgaactcaaaaccatgtacaaagcaagaacatatgtaatcactaaaggtattgttactccaaatcttcaaaatatatcactttagaaatatgaaccatagaatacatggttataaaagtagatagtgcctaagttatttgattctcatcctgtcgtccccactgccgcggcctccgcctgttccccggcgctctgcctctcacaccacgtcccatctccccaattaaacggtcagcatgtgctttgcttatattcacaaattcatgttgcagaaactgcaaaagatttggctttgtagtgtctgtaattaagcgctttatcagcagcaaatcgacagcagatggatgatgctttgtcagaagtgggacaggaggcataacatctgtccttcgcgcaaattttatcgtcaaatttttttctgctgcatctgagagaaatctaaataggaattgagcatatggagtacatgacagccatctgtcgctcgtgccgtagtctccttgaacgatgagttgtccaatttccctcaataataacttgaatctctgccccatgccagtgatcattgttctcacgtttctcatgtaaatgaatgtgagggacatttttatgaatatctatgtcaagtcgacagaacgtgatataatcttggcctttcatcgatgacttaatatcaataggaaggcccgtactcatctttgaccaaataagtgccattttagcaccaagcccaaatttccacgcgtctgcctcaaacca

SEQ ID NO: 1638 - DNA, 1004 bp, Triticum aestivum
  unsure (1)..(1004): unsure at all n locations
  Clone ID: PAT_TA_1638
aagaggcacccccagcgcctccaccacagccacacaccacaggtaggggagggaggagagaagaggaagccgagaggcgccggcgggtatggtttccctcaagctgctgaagcggctggcctcgagcgtcctcaagtgcggaacacacaaggtctggctcttccggtgggggctcagatggtgtcgctgaagctgctcaagcgactcgccgcgagcgttctcaagtgtgggaaaggcaaagtgtggcttgacccaaatgaagtcagtgagctctccatggcgaactcccgccacaaaatccggaagttggtaaaggatgggtttatcatcaaggaagcctcaggaagctacactccacgatcacagtgcaaggaaggggacaatacgcgaagcaagaagggaccgcactcaatgatatggaaagcgtaggggtaccaaggagattaagctccccaccaagttgctgtggatgaggaaggatgccagtactgaggcgcctcctccgcaagtaccgcgaaggcaagaagatgaacaagcaaaagtgacaagacatgcacatgaagttcaaggctaagcggttcaagaacaagacaatccttgaaaagaatatccacaagtccaaggctgagagcgcaagggagaagacactactccgtaagcgcagcgccagccgctcctacacaacgagaagcggtaaaagaaaaagcaaagaggtgaagacatgacgtttaagagttctgtttacacgggcaagcaactgtgttcttaccagctgtttgaactgtgaactgttagaaagaatctttaagaatctttatcccaaagccccactttttcgtactatataacatgactttgagcanctgaatatttgccggtaaaaattcggtccaatatcgatcctgtacccnacgttcgttggtatcatccgtanattgttatgacttgttgtaaagaccctaaaagttgttacganttggatntgcagttataaaaaaaaaaaa

SEQ ID NO: 1639 - DNA, 1049 bp, Triticum aestivum
  unsure (1)..(1049): unsure at all n locations
  Clone ID: PAT_TA_1639
caccccttctcctcgttgctttcagccggcttgccctcctccctccccagtctcccctcgtcgccaaccccgccaccgccgccgcagttgccgaaacccgccgcccagtccgccaccccgagagaaggaggttctctccttcatcgcccctccgtcctctcctccgccgggctcgcggggagcgaagatccgcccggacacggctcctcttgctgatttcgggggttgttctcttgccgcggcgagttttgaggatgatgagctaagaaggtatagcgcctggcagccgctgctcctttgatatttctgatgaacccgagagtaggcgagagtcttgcttgaggtggtagtgagagatggatgcagtgtccgaggttgcggatgccatgggtgcatggggcgttgacgatggggcgagccagaaatttctgcccaaagacagtccagacagcgaagagttggccgatgtggcgctttctggcgagagtgaggtgatcaatccacctgaagaggtgggtggggaagccacctcgccatcggaggacataaaatcgcaaccggaggacatacaggccagcggtcccccgcggagccggagccgttcccctgcggtgaccaaatcacagcgccagagcccgcggagcgcccctatggctcgagcttctgatcccgctccgggtgatagctcttcaagcaatggtgatgctgatgttaagaaaaaggcggagaagagcaattctcgaccagttgctaaggagagcttgtcgctcgaggattcaaaggagaagaggaaaactcaagaaagcatctaaccaacgtgttgtcaaaaacgatgaaggtctcttgtggtgaatcccccaagccgcccgcccccccggcacacccttccatatgggtttgcattccaaatgccaatgagagagcttgaaaagagaaaggantctactcccnactcccangagaaattccatgccccaggatttggagaaaaacacatgccaggcaaatccaaaggaatgggaagaactgactccaagcaactacggaaa

SEQ ID NO: 1640 - DNA, 774 bp, Triticum aestivum
  Clone ID: PAT_TA_1640
gtactggccgagcgaagcgaagaggggattggattgcctcggtaaaaagaaaggatttccttggctgcgtggaaggagcgagaagaggcgagctctcgaatctgcggcgcctcgtttcttcgccgactcgatctgccggcggcatggatgggaagaacttgggcagtgggcaactagctcagcaagctaagccagatgccttgacagacgatcaggggaccctgaagcacactgcggattctcacaccgaaaatccgacttcagtgaatggtcagagttctgtagatatgaacatggaagctgcgatctcagccgatgatgtcatgcgagccggcggcttcggcgccaaagacgacatcggcagcctcctaccaacggcgatggactccaccgacttcgaggcctcgctgcgggacgcccgcgactttgaaggcgagcaggagcaaccggcgcgccctgggctgggttacagggcatcggaagctgacgcgggaatcaagccgtcggacacgccacagcagtgatcctgcctccttgtgcaactaatatttcagaaagacaaagcacgccatccatgtttctgtagttttccagcttctgttgtgcttcagttggtagccctgacatccttgttgttttggtgctggatgaatatgagcttatgaacacacgagttctgcgaaaaaaaaaattcagttggtagcccttgttgttttggtgctggatgaatatgagcttatgaacacacgagttatgcgaaagtatggttttatt

SEQ ID NO: 1641 - DNA, 852 bp, Triticum aestivum
  Clone ID: PAT_TA_1641
aaagaagaagaacaacaaaccaaaacgaccaaccatcaaatcattatttgagtgtgctgaaagtgacgatcagcctgaaggcagttttttgggtccattgccgcctcagttagagttgcctgagagcccctcacctcactccagtatctcctccgaagattcccaagcacaacacagataacaggtgtgtgttttctggtacccgtctcctgtaaacggaagcagaaaagcataggtggatgtcagtctgctcaagtggctattttaaagggcaaatcttaagagcatctataagtccgtggaatttgctctcgagcagccgtttgaggtgctccaagccattgtgtatgttggagctccaggtcatcctgtacattgttacctcatttgtttcctgacgaatccatagtcctcatacagagagccaggctatctgctgtaaattcatggacggatcctgtgcaggggatgaggttcgtttctttcgctggaacatgtcatggtatgctgccaggtttttttggcgcagaaatctgcatttccgcattcgcgtcgtgagatttgcgacaacgtaaagaagttctgaggaacgagcaacttgtaccatcaaggatactctgtaagaggatgctcactttgccatctatatagctaaactgttcttcagtctatatatgcagtaacattttcatgtcaatgcactgttaacgcatgcatggttatgtcattgagcaagcggcttgtgtacctgaaaccggttgcttgtaccatcaaggatactctgtaaaaggatgctcactttgccatctacatatagctaagctgttgttcagtctataaaaaaaaaaaaaa

SEQ ID NO: 1642 - DNA, 820 bp, Triticum aestivum
  unsure (1)..(820): unsure at all n locations
  Clone ID: PAT_TA_1642
atctctcactacacaggcaacacaaacaacatcgacgaccatggcatcttcacttaccctcatccttgctcttctcctcgcaatcgctgccaccaccgacgctatcactgtccacctactcaacaagtgcccctacacggtgtggccaggagcctacccggtcggcggcgggagcaggctcgacacgggtcaggcggcgaccattcaagtccccccgggcacggcggctggaaggatttggggccgcaccggctgcaacttcgatgctagtggccgcgggtcatgcaccacgggcgactgtggcggcgtgctagcctgcgctgccggcgggaggccacccgcgacgctcgccgagtacacgctgggtaagggcggcagccccgacttctatgacatctccctcgttgacggattcaacgtgccgatgagctttgggcctgccggcggcggctttcacgcgataagctgtgccgcggacatcaacgcaaattgcccgtcggagctgaaggtggacggaggatgcgtgagtgcctgcgtcaagttcggcgccccccagtactgctgcatgccgccgctcacgccgtcgacctgcgggccgacggactactcgcgcttcttcaaggggcactgcccggacgcctacagctacgcctacgacgacaagagcagcaccttcacctgccccgtcggatcagactaccaagtcaccttctgcccatagaggcgattgggattcaatttacttcaatatataagtctctatctataatgtaatgggaaatatgattacacatgantccacaaaaattatactggaaaa

SEQ ID NO: 1643 - DNA, 798 bp, Triticum aestivum
  Clone ID: PAT_TA_1643
cccacgcgtccgcgcaacaaacagagcccagcaaggaaagcaaaaccaaaccggcgagaaacccccgacatccggcgatggcttcgcaggcgatcgaggagcaccggtcgggcgcggatgtgcacacggagctgtgcgaggccagggcccgcgagttcctggtggagctgggcctccccgacgggctcctcccgctgccgtccctcgtggaggtgggctacaaccgcgccacggggttcgtgtggctccgccagggccagtccggcggcctcacccacaccttcaacgccatcggcaagcaggtctggtacgcccccgaggtgacggccgtggtggagcgcggccggatgcacagcatgaccggggtcaagagcaaggagctgctcatctgggtcaccatctccgagatcgtcatcagcccctccggctccaagatcgtcttccgcacccctgccggcctcggccgcgccttccccgtctccgccttccagctcagcccgccggcgacggagggcgacgccaaggccgccgaggaggccgccgccaactgatcgatctgcgcgcaagtcaagtcaacggtaagcagtttaggtcgccagatccggtggtcatcgcggtgtcgctgtgcctgccaacttgtcagtccatggctttcctcttgtatcactatcagttcagtggccggtgtggtgccaatggttggcgcagaaataagccttgtgctcttgtatgatttgagatctgagttggttgtttcaattcgatgcatttctgccgctaaagaaactagatctgttt

SEQ ID NO: 1644 - DNA, 1001 bp, Triticum aestivum
  unsure (1)..(1001): unsure at all n locations
  Clone ID: PAT_TA_1644
gacaacgcgtcgcacacgcttacaaaaaacagcccacagcaaggaaaagcaaaaccaaccccggcgagagagaaaaccaagaagaaacccccgacatccggcgatggcttcgcaggcgatcgaggagcaccggtcgggcgcggatgtgcacacggagctgtgcgaggccagggcccgcgagttcctggtggaactgggcctccccgacgggctcctccctctgccgtccctcgtggaggtgggctacaaccgcgccaccggcttcgtgtggctccgccagggccagtccggcggcctcacccacaccttcgacgccatcggcaagcaggtctggtacgcccccgaggtgacggccgtggtggagcgcggccggatgcacagcatgaccggggtcaagagcaaggagctgctcatctgggtcaccatctccgagatcgtcatcagcccctccggctccaagatcgtcttccgcacccccgccggcctcggtcgggccttccccgtctccgccttccagctcagcccgccggcgcccgagggcgaggccaaggccgccgaggaggccgccgccaactgatcgatctgctcgcgagtcaagtcagcggtaagctgttagatttggtcgccagatccggtggtcatcgcggtgtcgctgtgccaacttgtgcctgtccgtggctttcttcttgtgtatcactatcggttcagtggccggtgtggtgccgacggatggcgcagaaataagccttgtgctcttgtatgatttgagatctgagttggttgttactgtctgctactagtattcttgtttcagttcgatgcatttctgccgcttttcaaactagatctgttaactgctgctgctgtgcgacctgtaatgtcatcatctttctattatgtcatcatcttaaggtgtgaaaacaagtttgatctcaaaaagaaaaaaaaatacccgggtggccccgtctcaagtgcgacctcggcggatcactgaccgccgn

SEQ ID NO: 1645 - DNA, 698 bp, Triticum aestivum
  unsure (1)..(698): unsure at all n locations
  Clone ID: PAT_TA_1645
gggacccccaatcccaccgcgccattctcgaaccttccaagctcctcccggcctcccctcgcttccaccgagtccctccgatggcccgcaccaagcagacggcgcgcaagtccaccggcgggaaggcgccgcggaagcagctggcgacgaaggcagcgcgcaagtcggcgccggccaccggcggcgtgaagaagccgcacaggttccgcccgggaaccgtcgccctgcgcgagatccgcaagtaccagaagagcacggagctgctgatcaggaagctgccgttccagcggctggtgcgggagatcgcgcaggacttcaagacggacctccggttccagtcgtctgctgtgtccgcgctgcaggaggccgcggaggcgtacctggtggggctcttcgaggacaccaacctctgcgccatccacgccaagagggtcaccatcatgcccaaggacatccagctcgcgcgccgcatcaggggcgagagggcctgatgaacgagctctctgtctctgttctcggccggctttgatgttctcggtgttgtcgtgtgttaggatttagaaaatgttgggctgtcgcctgttgcttgctatcttgtagggatggttcgcctctggattgttcaatggaatgatactactgcttcattgctcaaaaaaaaaaatgttaactccgtgcctttaaanaaaaaaaaaaaa

SEQ ID NO: 1646 - DNA, 726 bp, Triticum aestivum
  Clone ID: PAT_TA_1646
aagttcctactgtacttcgtagttcctaccccgtaacccaaacctcgccggcgatggcggcggaagcgtcgagctcatcggctttcagcgaggacgattcgctcctgcggcccctcgccgcgcgtgggtggcgcttccgtgacgccgcggacgagtccatccaggccctcctccacgctcccccctccccgtcgccggaggccctggaagccgacctcctcgacacggacctgaggctcttcggcgggaagtccctccccgaccgcgccgccgccaccgccacgaagcggctcttctacctccacggccccatcgtcctgcaggtagtttctgtaagggatatatatagcagcagagtcgatgcttcctttaagaacccacagccacggcgccttctgcggtttggtctcactgatggtatttctgaagcagtggccattgagttttcccctatcccgttcatcacagaagagatagccccaggtacaaagattcgtcttgagaacaagattccagtaaatcatggcatattgtgcctgggtgcaaaaaatgtgagcatcatcgggggaagtgtccaatctttgtatgaagaatggaaaatgaaccagaaattctcgggcttatcattgcctgtattgaggctgtcacaagatgacgatggagttgggcctccaccatttgagaaattagatatggaagcacgtccaaacaggacattccagttgc

SEQ ID NO: 1647 - DNA, 671 bp, Triticum aestivum
  unsure (1)..(671): unsure at all n locations
  Clone ID: PAT_TA_1647
agaccacgtccgtgctgctcacctggacgctggtcgtcctgggaatgcaccccgagtggcaggatcgggccagggaagaagtcctcagcgtcttcggcaaggacaagcccaacttcgacggcctgggtcgactcaaaacggtgaccatgatactgtatgaagtgctcaggctgtacccaccggcggtcacgctgaaccggaagacatccagacagatgcagattggaggcatcacctaccctgcgggcgtgctgctggagctgccaataatcatggttcaccacaacccggatgtatgggggaaggacgtgctggagttcaagccggagaggtttgcggaggggatttccaaggcaactaaggaccagccggtcttcttcccattcggctggggcccgaggatttgcatcggccagaacttcgcgatgctggaaccaagatggcgctgagcatgatccttcagcgtttcgagttccagctctcacttcctacacgcatgcgccgtacacggtcatcacactgcatctcagcatngagcgcagattatactcaagagtctctgatcgtatcttgtcttgcggcttttcgactgtcgtcggtaattgtaagtgaagagtaattgaataagngaactagacctttatttatctaaactggnattgacatgttaa

SEQ ID NO: 1648 - DNA, 1054 bp, Triticum aestivum
  Clone ID: PAT_TA_1648
ggttcagcatacagcaaccgacagaaaatatggcaggcgacgacggggagcacacaagattcccgtgccttggatgggtgcgcacatcggttgccatcgtggttaccgtgctcgtccttgtgctggtggtgatggcgatcaccgatgtgggtcgccctgagaagatcagcctctcgagctacggctatgtccagacacagcagcggtggtggaatgacagtatgacgacgacgacgggcaggacgacgaccacgaagtcacgacggcttccagcagaaggtccagaaccagaactaatgccagcgacgttgttgacgattttggtcattgtgttcgcctacaaccccagcggccgcggcagcatcctctgcaacatcaccacgatcagcatcatcgacatgccatatgatgacttcacggggatggttgaggtccacagagtgtactccccaaagatgcctttaaaattctccgttcctccgcagacctggcacagagataggaggtcggtgaacatcaccgagaagaacgacaacggcgtgctgtcgtatctcttcgcagagcaccgacagcaggagaaattccgcgtaatggtgcaggtgaacaccacctacaaggcacagcattcggcggcgagcgtcaacgtcagccactattgctggccggtgttcttcgtctacctctctccgtacgtcgacggcgaccagatcccatgcaagacgagccaagagatgggttactcgttctcttggcagccgctaccggacggcgctgacgggtgatacgtactgattaattgcttccctctgcggtgtgtgctcaggattgcgtcatcttttatttagttttcctgctgttcgtggagatcgcttgttcgcctcccctttctttttcgggattgtttgcctgctttcaacttctccgtgcgccttttggccaccttgttccaacagtatacatcggtaattaaatttgtatccaagaacaatttattactactgtaagtctgcagggtgcaccccgcgtggtgtgtaatcagggaatttaaatttcg

SEQ ID NO: 1649 - DNA, 834 bp, Triticum aestivum
  unsure (1)..(834): unsure at all n locations
  Clone ID: PAT_TA_1649
tggncgggatcccgccccaaaccccccaccttcttccagnacccgnaaatcccccactctcccgaagcagcgagcgatggcccccaagcggagaagaagccggcggcgaagaagcccgcggaggaggagccggcgacggagaaggccccggcggcgaagaagcccaaggccgagaagcggctgccggcgggcaagacggcgtccaaggagggggccggcggcgaggcgaagacgaggggccggaagaagggcagcaaggcgaagaagggcgtcgagacgtacaagatctacatcttcaaggtgctgaagcaggtgcaccccgacgtcggcatctcctccaaggccatgtccatcatgaactccttcatcaacgacatcttcgagaagctcgccgccgaggccgccaagctcgcgcgctacaacaagaagcccaccatcacctcccgggagatccagacctccgtccgcctcgtcctccccggggagctcgccaagcacgccgtctccgagggcaccaaggccgtcaccaagttcacctcctcctagattgcaattgcatctgcattgcctgtatctatctagtattagctggttctgttactttactttgtgcttgtcgactctggttatctggaactacaagtgctgttagtgcgggatggggagttgattgatggatgattgccgatgctctgttgcctcttggttgtaacaactgaatttgtgcttctttggcaaaaaataattttaaaagagtattgtttctaaaaaaaaaaaaaaaaatggcccctatgggccccgtggggggcgcacctacggggaacccttccccct

SEQ ID NO: 1650 - DNA, 1138 bp, Triticum aestivum
  Clone ID: PAT_TA_1650
cgcaaactagcaagcatgaaagcaggctacacacaaaaaactgcttcacctttcgctgacatgctggcttttcgcaaggtcaaggcaaggctcggtggccgtcttcgcctactaatctccggtggtgcacccttaagtactgaaattgaagagttcatgagagtgaccagctgtgcatactttatccaaggctatggtttaacagaaacattgggacctagcacagtcggttaccctgatgatatgtccctggttggaactgccggtgttgccgccatcttcactgaactgcgactggaagaagtacctgagatgggttatgatccacttggtgttccttctcgtggtgaaatcctcattagagggtccactgtcttcactgggtactacaaaaatcctgagctcacaaatgaggtcatggttgatggatggtttcatacaggagatattggagagatgaccccagatggaatcctgaaggttattgaccgaaagaagaacatatttaagctatcgcaaggggagtatgtcgcagttgagtatctggagaaagtatatgtcttccctccaattattgaagatatctgggtgtacggggacagctacaaatcaatgttagtcgcagtagttaacccacatgaagaaaacaccatgaagtgggcagggtcaaatggctacaaaggttctttcagtgaaatatgcaaatctgaaggccttaaagagcatgtccttaaagagctcgcagcggctgcacagaagaacaagctacgaggttttgagtacatcaaaggcgtagtgttggatcctgtaccttttgacattgaaagggatttggtcactgcaacaatgaagaagagaagaaactacatgctaaaatattatcagcctgagattgacaaagtatacaaaacattggagggtcagagggctgcgaacaaagcaaagtaaagctatgtgttttgctaggtcacatgccggaatactattgtaaatctactattgaacgttggtaatcaagactacataaagcaataaaatgcatattgtgtggtgcataaaaaaatgtgtatgtatacccccccatcaatatttatttttttattacatttttttttttttatcatattctttagttatt

SEQ ID NO: 1651 - DNA, 2394 bp, Triticum aestivum
  Clone ID: PAT_TA_1651
ccacgcgcgccccccctcaatccccccccgctgcgcccaaatcccccaaaaccctagccccgaggaggaggaggaggcggcggctaccatggctgccgcagcggcgaacctggcgggccggccgggcgtgcgcgtcgtcgtcatcggcgaccccggcaccggcaagtccagcctcgtcgtcgccgtcgccaccgagcagttccccgagaacgtccccaaggtcatgccccacacccgcctccccgccgactacttccccgaccgcgtccccatcaccatcgtcgacacctcctccagccccgagcagaagccgaagctgatcgccgagtgccaggcggcggacgcggtggtgctcacctacgcctgcgacaggctctccacgctcgaccggctcagctcctactggctcccggagctcatccgcatccagttgaaggcgcctgtcatcgtggttgggtgtaagctggacctgagggacgaccagcagaacagccttgagcagacgatggcgcccatcatgcaggcgttccgtgaggatcgagacctgcatcgagtgctccgcgcttcgccagatccaggtgcctgaggtcttctactatgcccagaaggcagtgcttcaccccacagctcctctattcgaccaagaggcgccggctcgagagccacgctgtgtgagggctttgaagcggatattcattctatgtgaccacgacagggatggagctctcagtgatgtggagctcaatgactttcaggtcagatgtttcagtgctcctctccagcctactgaaatttcaggcgtgaagagagttgttcaagagaagatgcccgaaggcgtaaatgatagtggccttacattgactgggttccttttccttcatgctctttttattgagaaaggtcgtttggaaactacatggacagtattgaggaaatttggttatgataatgaaatcaaacttagagatgacttcattccaacgtcagtcaagcgagctcctgatcaaacggtggaattgacaaatgaagtgattgattacttgaaaggaatattcaacatgtttgacatagataatgacgaagctttgctaccttctgagttggatgatcttttttcaactgcacctgaaaacccttggacttctgatctatataaagactgtgctgaaaggaatgtcttgggtgggctatcacttgaaggatttctttctaagtgggctcttatgacacttctagatccagcaaatagtttcgcgaaccttgtatatgtcggctattcgggtgattttaattcagcattcaccatcacgaggaaaagacgagtggaccgtaaaaagcagcagactcaaagaaatgtgttccagtgctatgtttttggtcccaaaggttccggaaagactgcattgctacaatcattccttggaaggcaaccttctgatgctctgccaactaacagcgaccggtttgcggcaaatactgttgaaccatctgatgggactagaaaaacacttgtgctgcgagagattcctgaaggtgatgtcagatcattgctaaacaacaaggaatccttggcaccctgtgatgcggcagtctttgtttacgatagctgtgatgaattttcttggcaaagagcaagagatttgcttgtgcaagtggcttcacatggagaaaacacaggctatgaagtcccttgtctgatagttgctgctaaggacgatcttgatcaatctccagtggctctacaggaatcaaccagagtgagccaagacatgggaattgaaacaccaattcccatcagtgtgaaattgaaagacttgaacagcattttctgccgaatagttcacgcagcacagcggccccatttgagcatcccagagactgaagctggtaaatcacgcaggcaataccgtcaacttctgaaccgttccctcatggttgtttcagttggagctgctataggtgttgtgggggtagccgcgtacagggtttatgcggctaggaggaactcgtcgtcatgaagcccccctccctcccgggcagtcgccgggaaataacgtgcaacaggcaggttcatcgtcgatgaagtggatcgtctagcttgatgtttatgtacagttgcgtcatcaaagataacttgtactagtgcgtgtttgagtttcggatggtataatgtacggcagtcatcaggctctgttagattctttagctgataaaagactgtcatgacttgatttgctctgttagaatttcatcactgtcctaaatttttgtccacatttttctttttcatttcctccgaacattttaaatgtctttatttattttggtgtaaggatgcagttggaagtttttgttttgtccgtgctttaattgatttcatagttctattcaaaa

SEQ ID NO: 1652 - DNA, 815 bp, Triticum aestivum
  Clone ID: PAT_TA_1652
catctccaagaggctgactgttgtattggttcacgacagacttctatatagcaaacaaacatgtcggacacacctgcagcacctgcagagtccgtcagcccctcttcggagtctcccgccgtgccgagacgcgatgtctcacctgaaactccgcaggtcacgcagaatgagtttattgctgtagataatgagcataatgcggctgatgatgatgatgctgattcggcactgggttcggatactgagagctcaactgcttcggtgtcggcgagtattcttgagtaccgccgcagccaaggccgtacataccatagtgacaagtttacgacaaactactttctgcccaacgatgatcagcagttggagcctgttgacttgacacatcattacttgatgattctactggatgatcagttgtttctccctccattgaatacagagaaattaaagaaagtattggatgttggtactggaactggtatctgggcgattgaattcgccgaccgtttccccaacgtcgaaatcgttggcaccgacctctctccctgccaacccgagtgggttcccccaaacgttcgcttcgaaatcgatgatgcagttctgagctggacctgggagcccaatgagtttgactttatccacatccgctacctctttggcgccatcaaagactggtcagctctcttcaaggaagcttgtcgctgcgtcatacccggaggctgggtccaatcagccgaggcagatgttgagttccgttgcgatgacggtagcattgaattggagcccaacttgaagatgtataagaagctctttga

SEQ ID NO: 1653 - DNA, 1304 bp, Triticum aestivum
  Clone ID: PAT_TA_1653
ggaatccttccctgcactgcagcctaccctttcccctgcccgccctgccccgacacccccacccctcttcaccctctctcttgctagttccttccctgcttctcccttccgcccgccccgccccgatgctcacctccggaggccgcgcgggcggcttccattgccgcgctgagaagcattggggacgctgctgctgagttgctcggtgcgcggggtggtcgcggcgagtgggttggataggagatggggaaggaggggacgcggcggggccaggatgtgaggcggcggaaggggaaggaggcggcaaaggacgaggacgacgaggcgcctccgactggttgctggatccggctaccacgactgggcggcggatgcatgtcgtcgggctccaaggtcgactcctccaccagcggcgcctgcgccaacggcggcgagagcaaaaaggtaaatcatagttgtcgggatcaatcagctccaccagccgcatctggttcgacaacatccagcaacacgggaagcatctcgccttcttccatagttggagaagaacttaaactagcagcccaactgcgtggatttacgttcaatgaacttaagtgcgccaccagaaactttcgacctgagagtcttcttggcgagggaggttttggttgtgtctttaaaggttggattgaagagaatggaactgctccgatgaaacctggcacaggattaactgttgctgtcaagacactcaaccatgatgggcttcaggggcataaggagtgggtggcagaagttgatttccttggaaaccttcaacattcacacctagtgaaattggttggttactgcattgaagatgaccaacggttgctagtatacgaatttatgccccgcggaagtttggagaaccatcttttcaggaggtcatttccgctcccatgggctatcagaatgaaaattgcactttgtgctgcaaaaggccttgcatttcttcatgaagaagctgaaaggccagtgatatatcgggatttcaaaacttcaaatattcttttggatgcggaatacaatgcaaaactctctgattttggacttgcgaaagatggccctgagggtgataagacacatgtctctactcgggtcatgggaacatacggatatgcagctcctgagtatgttatgacaggtcacctgacatcaaagagcgatgtatacagttttggagtggtgctactagagatgatgtcgggcagaaggtcaatggacaagaacaggccaaatggggagcacaatctggttgaatgggcacgcccttatcttgg

SEQ ID NO: 1654 - DNA, 599 bp, Triticum aestivum
  Clone ID: PAT_TA_1654
caccgcgtcatcccaaatcccaatttttcgtggcctccccgtcgctccgatcctcgccggccgggcggcagccccagtcccagatccgaacccctgcggcgccccgccattgtcgccgtccccgaccttctccccggcagggaatggtgcactgtgggcggcggtaggcagacacgagcacggccgcgggggcaagaagcggcggcggcgagatggccggcgcggagagggagaggagaaagatgccgctgccgccggcgctgcccctggccacgctgatcgggcgcgagctccgcgcggggggctccgagcgcccggcgctgcgctacggccacgccggcttcgccaagcgcggggaggactacttcctcgtcaagcccgactgcctccgcgtccccggcgacccctccaccgccttctccgtcttcgccgtgttcgacggccacaacggggtgtcggcggcggtgttcagcaaggagcacctgctggagcacgtgatgagcgcgctcccgcccgacatcggcagccgcgaggactggctgcaggcgctgccccgcgcgctcgtcgccggcttcgtcaaggccgacatcgacttccag

SEQ ID NO: 1655 - DNA, 869 bp, Triticum aestivum
  Clone ID: PAT_TA_1655
aattcaaaaaggagtcctgtgcgccgccacttcccacactccattgctgcttctcacaaagtggtcgccgacgtgcctccttcttcctcggacgaggagatgtagacgacgccggcagggacgccgttcggcagatcggaggcaaggccggagtggctgctttcacggcggtcgatggcggtgatggcgcgactgaagaggcggcggcgtccctccatgcttgcggagtcctggaggcgcggtcgggcgaccgcgcgcggggatgacggtgcctcgtccagcacggaggtggaggcgtgcgggtgctcggtggcgctgcgactcgggccggcgtccacgtcttcaggctgcgcgaccggcgtcgggccagcggcttggatcgtccctccggcgccgttcgggaacggcacaaagacgaagaagccgggctcgtcagtcggcgctggaggcggaggcggaatccgcgttggagccgcgagcatgggcccggggatctcttctcctgcatgtgcgggaggcgcgctggggctggccaccgttggggcgtggtcaccgggagcagcggcgcgatggccgtgtctaggggcgcggaggccacgtcgagggccgcgtatagcggcatggtggccttgtccagcgccacggcgtccgaatcggcggcgacggcgcccgcctactccataatggccacgggctgtgaaacggcgacggcggccgtcctcacggatgaggcggaggaagaaagagatgagtccaggcatctcaccgtcggcgaggccttcctgtgctctcggcagagcgtgcgtgataacgtgtttgaatgaaaagatcaacttgttttgattgatagaaaacccaaaaaagacgcc

SEQ ID NO: 1656 - DNA, 874 bp, Triticum aestivum
  Clone ID: PAT_TA_1656
ctcctgtgcgccgccacccccacacactccattgctgcttctacaaagtggttgccgacgtgcctccttcttcctcggacgaggagatgtagacgacgccggcagggacgccgttcggcagatcggaggcaaggccggagcgacgacttgcgcggcggtcgatggcggtgatagcgcggccgaagaggcggcggcgaccgtccatgctcgcggagtccaggaggcgtggtcgggcgaccgtacgcgggggcggcggtgcctcgtccgggacggtgttgtcggcgcccggaggctcgacagcgacgcgactcgggccggcgtcctcgtctgcaggcggcgccaccagcgtcggtccagcgccttggctcgccactgaagcgccgttggggaacggcacgaagacgaagaatcccggctcatcagccggcgccggaggcggaggcggaatccgaaagggagccgcgagcctgggctcggggttaccatctcctacgcaggcggagccggccaccgttggggcgtggtcgccgcgagcagcagcgcgatggccgtgtccaggtgcgcggaggccacgtccagggccgcgtagagcagcatggtggccttttccagcgccacgacgtccaaaacggcgggggcggtgcacagcccggcgaagtcagcgacgcccgcctacttgatgatggcgacgggcggcgaaacggcgacggcggccgtcctcacggatgaggcggaggaagaaagagatgagtccaggcatctcaccgttggcgaggccttcgtgtgctctcggcagagcgtgcgtgataacgtgtttgaatgaaaagattaacttgtcttgattgatagaaatagtacagcttatatagtttgg

SEQ ID NO: 1657 - DNA, 804 bp, Triticum aestivum
  Clone ID: PAT_TA_1657
cccgccgaggctggcgggccgggaaaaaaaaaaaacgaaaaaaaatcccccctcacctgcgtcggtgactcagccacgtcgccgcccttctcctcaggcgttgccgcctcgccttctcgtccgcgctgcctctccctctcgcccgcatcctctccgccacgctcgagccaaagttggttgttttagcgaggtcgagtaggagcgtgaggaacgtgtgcacggcggccttgtcctgctcgacgacggcggcgacggacgctagcgctcctcgtcgccatcgacctgcaaggaggagcgccatcttggacgctgctggtattccgtcgctgttacgtgttcgccgtcacctgctcccaggtcaccccggaagtcgagctccccacgctcgacctgccagatgtactgtggccaagaactgctctaccgcaggagtagattggaaaggctgttgttgctcctgaacgatgcggctgctgctgccactacctctcatcgattcgggcatggcaaagaccactcagttgcactacaccatgtgtagctcactaaacttggattattctttttatcatgccaggatgccttgattgatctactcggctcaaaccaaactgatttttagcacgacctcctcgaacctccagagtacagcacattcttgcaatgcttctgcatttcaaaatgtttactgctgtaatcatggggtacttatatggtgcaaatcgagccggagtaatggcatgctccgtgatgatgccgccgtcacctacgacttcctcgaccaccaccaccaccaccaagact

SEQ ID NO: 1658 - DNA, 1274 bp, Triticum aestivum
  Clone ID: PAT_TA_1658
cgtccggtgcactccccagtctctacagtgctattcagcaatgcacttctctgaatagtttatcaggcttttgggattctccacgttggattactccaataatacattatatttgcaagaccctaacatgcttgaaccttagctatgctccaatgtttcggacagttgatcttattggaactattcaccaatgtcagaatctccgacacttgtgggtactagatcacattggcgatgcaggattgaaggttgtagcctcttcttgcctggagctgcaagagttgaggatatttcctgcgaatgcaaatgtgttagcaagcactggtgtgacagaggaagggctggttgcagtatcttcaggctgtcggaagctaaactctgtgctctattcctgcagtcgaatgactaattctgctctgattacagtggcaaagaactgctcgcgaatcacttcgttcagactgcatatctgcctgcatgggtcagtagatgccgtgacaggccagccactggacgagggttttggggcaatcgtccggtcatgcaagggcctcaggcgtctatctatgtctggccttctcacggacagcgtgttcctgtacatcggcatgtacgccgagaggctggagacgctctctgtcgcgtttgcaggagatagtgatgatggcatgatctatgtgctcaacggctgcaagaatctcaggaagctggagatcaggaactgcccatttggcaacagcgcgcttcttgcaggcacgcacaggtacgaggcgatgcgctcgctttggatgtcgtcgtgcgacatcaccctgggtggctgcaggtccctcgcggcagccatgccaggcctcaacgtcgaggtcatcagccaggcggatggaggcgccaacgatgcaaaggtggagaagctgtatgtctacaggacactcgccggcccgagagatgatgcccctggattcgtctcggcactgtaaattacatatactgtcgtagttagtgggtttctatagaccttgtaattttgtaccgtgtaattaccggctgaaaatctgcacttgctaagactatactctgaagcgggcaccagtcttgtgaatttggttagtcttccgaagcgctatttgtgggccaacacagcataatatatggatctaggccttatttccaaggttgcactgcggtatagctgaactgtttgagacgcaacgagctgatctgttctggtactgtgtgcttgtttactgaaccaagtggaacggaatgctatttttatt

SEQ ID NO: 1659 - DNA, 780 bp, Triticum aestivum
  Clone ID: PAT_TA_1659
caggcagcccctttttgaagctcgggtgagagatcgacatatacccgcctgccgccggccggccacgaagcgggtagagagagactagctagctagctgcagagtgagccttgaggaggtagcagcgatggcggcggcgaaccagagcctggccgtagaggacggcacgggcaccggcagcggcgccggcgggcaggagtacacgcaggacgggtcggtggacctccggggcaaccccgtgctccgctccaagaggggcggctggaccgcctgcaccttcatcgtcgtgtacgagctgttcgagcggatggcctactacggcatcgcggcgaacctcttcatctacctcacggacaagatgcaccagggcacggtggaggcgtccaacaacgtcaccaactggtccggcaccgtcttcctcacgcccctgctcggcgcctacgtcgccgacgcatacctcggccgctactggaccttcgtcgtcggctccgccatatacctcatggtagcaataccttcctataatcctcctatacttcatgttcatggtaacacagatacgtagcatcatggtaacaacacgttcctatactcctcctatacttcatgttcatggtaacacagatacgtagcgcatgcgccgcgcgtccgaaggcgtcgctgtggtctgccctgataacatcatggatgatgtggcagcgagcgattaaggcggagtctttgagagttggacgactatttgtatcatatatacagtatatacttttggtaccctatatt

SEQ ID NO: 1660 - DNA, 886 bp, Triticum aestivum
  Clone ID: PAT_TA_1660
cctttcccttccccttctccttcctctccacggaccggaacgcgccatgacgagctcctccacgccgtcccgcaaggcgctgagcaagatcgcctgcaaccggctgcagaaggagctcgccgagtggcaggtcggcccgcccgccggcttcaagtacaaggtctccgacaacctccagagatgggtgatcgaggtgggcggggcggagggcacgctctacgccggcgagacgtaccagctgcaggtcgacttccccgagcattaccccatggaggcacctcaggtcattttcctcaacccggcgccgatgcacccgcacatttacagcaacgggcacatctgcttagatatactgtatgactcgtggtcgcctgcgatgactgtaagttcagtctgtatcagcatcttgtcgatgctgtctagctcgccagcaaagcaacgcccggcggacaatgatcgctacgttaggaactgccgcaacgggaggtcgcccaaggagacccgatggtggtttcacgacgacaaagtatgagggggcatcgaatcgattggctcttctggccaccccatactcgccagccagccttccttactgtgaaagaaatctcttccaaggggagatgagatgagatgagatgatttaggcttaaaaatttaagctaagcaacccctctatcgtactgcggatcttaacatgctgtggtggtttgtacatgagctcaacacatgttgtcgaaacgtgaatacatcatcgctaccgacgatgagagatatatatagaataagcaagtgtaacctgtcgatgcgcgcaaaaggaatgcagatttatctatatgatttgctacattgtttaatcgtaaaaaaaaaaaaaaaaaaaactcgagac

SEQ ID NO: 1661 - DNA, 378 bp, Triticum aestivum
  Clone ID: PAT_TA_1661
ccttctacatgcgtgccaagctcttgggcagcgctggggaccgccaagtcgcgagttcatacctcgaaggcatcattctggcaaacccagataagaataacttccttgtgccttaatttcccgagtaattcatcccctaaccgccccgtaacatatgatttcttagatttcgatcgttcttttttctaacatttcgtgttctgtgcagtgacacacattgcacactcatcctcttaagcccgaaatattccatggccacgtatttcgacccgaaccgtgactccaagatagactacacaaatatcaagaaagttcttgatgatgttctccccggctacgccaaatctggaggcaccttcaccaggccagttcgtaggt

SEQ ID NO: 1662 - DNA, 637 bp, Triticum aestivum
  Clone ID: PAT_TA_1662
ggacaccaacccacagacaagaccgccagtcgtgccagcgccaagccatggcaagaacgccgcaacgctactggacatgccggacatccctatggcacaggatccggacatgcatatggcacaggatccggacgatgacgacaacgacgacggtacatttaccaatgtcgataagtactttgccgaacatggatacggtgacgagttctgcgggcctccttctcaagaacccaaccctgaaaaagacgaccgcgatctagctggtaccgcggagaaacccaattgcaacaggcgtcgtctggcattcagttctcaggagatgcctccagctgccgccttcaccgagcctcagatagctgaggtgcgaaatattatcagccccaacacactcaagagggtggtctctgagcagaactcgatcccattacatcagaagaagaagggatggaaaagaaagaataacaagggtgcgagccagccggcaccgagtacgatccgtgctcaggacgggccaccttcatctaaggatatctcgaggagggtgcatgtggcgggtaggccgatgctaccgactaatcttctcaatgctgcaaccggtgctatgcggagtctgcatgacagtgttctttttttggag

SEQ ID NO: 1663 - DNA, 712 bp, Triticum aestivum
  Clone ID: PAT_TA_1663
ccgggtcgactcgccgacttagaaagagcaaacctagtcacgctacaacacatacacgtggtcgatccttgggtggtagagcacaagacctttattaagaaggcgtacaatgaccgatgccaagcagaggacggacgttctgctgcgtcaagcagccacctggcggtcagaagggtgcctactacgccatccatcacatgctggcgatcgtacgggaccatcatcaacttctgctaccgagtacactcacagattgggccgcgagcgtgttggaaaccaggacgcggacctcagacaagaattctttcgcatccagtcggagtttgcggacatcatccatcaagatgtccttcataccttggggcagttctacctcagatatcaaccgtccaacaatgagatagatggaacgctacaaatgcagggtgacaacgactgtgatttcatgaccatcacgacagacggcggcttcatccacgctcctgtccgatgagtcgagtcgaaagtagtgatgtgtagttctgaaacattgattggctcatgttgtaattaaagtttaatgaattcgtatgtctctttggtttggacagtcattcaacttagatgtaattgatgctatttattagtaggagcatgaatcgtgctattaatgtctttcttttctcttctgatccttttgttgcatacttacatattccttatgtaatttctg

SEQ ID NO: 1664 - DNA, 493 bp, Triticum aestivum
  Clone ID: PAT_TA_1664
cggctgcgagtatgtcacagacaagggtaaggttcccggagtctacgatgactgggaggagtgtcggagacaggttcaccgattcagcggtaacagttacaaagggtacaccactagggccgaggccgaatctagatacgcccgctatctagcgggagaggggagggagcgttggaggaaccggatgaagacgagtttcatcgtgatgatgctcatcgtgatgaccgcagctctcttctatgtgatggtagtttagatgatcgatatcgacttgtaatgtgaagacaaactcgctactcgcggtctcgagacttgtaatataatgttctatctttgttcggtcttttcaattcggagactaatatgatgaattgtattcggagactaatatgatgaattgtattcagagactaatcttctattgtattcgatgaatctgttgttggtgtgtgctgtctatattttgtccaattatacattttgtaacctgtac

SEQ ID NO: 1665 - DNA, 446 bp, Triticum aestivum
  Clone ID: PAT_TA_1665
gaagacacgcaaaggaaagactaagaagggtgcgagccagccggcaccgagtacgatccgtgctcaggacgggccaccttcaccgcaggatatctcgaggagggtgcatgtggcgggtagggcgatgctaccaccaaatatgctcaatgctgcaaccggtgctatgcggagtctgcacgacagtgttctttctttggagaagcggcgtctcagagagaaggatgtggcatacccggttttcgtggccaaggtgccagagggcaagggctttgtggatggcgacatcgggggtacgatcgtcctgcggtttgatgacgtctttgctatgtttaaccttcatccgctgcactacatcttcgttcggctattttcgctgagtatggagatgcggatcattcgcgacaagaccccggacatcgtgatagtcggcccgggatttcttgacc

SEQ ID NO: 1666 - DNA, 798 bp, Triticum aestivum
  Clone ID: PAT_TA_1666
ctcgcgggccaaccccttctacatgcatgccaagatcttgggcagcgctagggaccggcaagtcgcgagttcttacctcgaaggcatcattctggcaaaccaagataaggataacttcctcgtgccttactttcccgagtaagtcctcccctcaaccggcccgtaacatatgaattcttagatttcgatcgttgttcttttaacattccgtgttttctgcagtgacacacattgcacgctcatcctcctaagccccaaatattccatggccacgtatttcgacccggaccgtcagtcgaacgtagactacacaaatgtcaagaaggttcttgatgatgttctccccggctacgccaaatctggaggcaccttcaccaagcctaatcctaagtacggcacgcacatggtctcgcgccatacgactatgcgattcgtgctcaggatgggccacgttcaccgcaggatatctcgaggagggtgcatgtggcgggtaggctgatgctactgagaaatatgctcaatgctgcaaccggtgctatgcggagtctgcatgacagtgttctttctttggagaagcggcgtctcggagagaaggatgtggcatacccggttttcgcggccaaggtgccatagggcaagggctttgtggataactccatcgggggtacgatcgtcctgcggtttgatgacatccacgctatgttgaaccttcatccgctgcactacaacttcgttcggctattttcgctgagtatggagatgcggatcattcgcgacaagaccccggacatcgtgata

SEQ ID NO: 1667 - DNA, 1089 bp, Triticum aestivum
  Clone ID: PAT_TA_1667
cccacgcgtccggcacattgattgacactaaatggatactggtggcagctgagctgagctgagatgtgcagctgagcagctgagctgtggcttctgctccgtggccgtgacctcgatccgccccaattaaaccgcccacgcgcagccgcagctataaccccgcatcgtccaagatccggccggcggcacaagaagcggcagcagcggagacaatggcggcggtgaagcgcgcctacctcgccgtctacaactgggccgtcttcttcggatgggcgcaggtgctctacttcgccgtggaggcgctgctccggtcggggcacgaggacgtgtacgccgccgtcgagaggccgctccagctcgcgcagaccgccgccgtcctcgagatcctccacggcctcgtcggcctggtgaggtcgccggtgtcggccacgctgccgcagatcgggtcgcgcctcttcgtcacctggggcatcctctggagcttccccgagaccaggacacacatcctggtgagctccttggtcatcagctggtccatcaccgagattattaggtactcttttttcggcacaaaagagctgtttggatctgccccatcatcgcttctatggcttaggtatagctctttcctagtcatgtacccaaccggcatcagcagcgaggttggcttgatatacattgcgctgcagttcatcaaggcatcggagaagtactgcattagaatgcccaacaaatggaactattcatttgactacttctatgcatcaatcctggtactcctagtctatgttccaggaagcccgcatatgtacacgtacatgcttgggcagcgcaagaaggcgcttgcaaagtcgaagactgcgtaatcttattgatgcctcttacaagatttgttggcatatcattgtgtttctcatttacatcagaaaataaaaaatatgttcttgttcggcaccagctatgtttaggatcatcgaactcttgtgtcatgtggatgtggttgtttttgaattagcatttggttgctacatacaacgtctaaacagtaatgaccagcaatatattttagccgtaaaccttgctgaatgc

SEQ ID NO: 1668 - DNA, 1008 bp, Triticum aestivum
  Clone ID: PAT_TA_1668
cctcgatccgccccaattaaaccgccgcggacccgcccacgggcagccgcagctatctataaccccgcgtcgtctcctccgcaccaccagagatccggccggcggcccaagaagaagaagcagcggagacgatggcggcggtgaagcgcgcctacctcgccgcctacaactgggccgtcttcttcggatgggcgcaggtgctctacttcgccgtggaggcgctgctccggtcggggcacgaggccgtgtacgccgccgtcgagcggccgctacagctcgcgcagaccgccgccgtcctcgaggtccttcacgggctcgtcgggctggtgaggtcgccggtgtcggccacgctgccgcagatcgggtcgcgcctcttcgtcacctggggcatcctctggagcttccccgagacgaggacacacatcctggtgagctccttggtcatcagctggtccgtcaccgagattattaggtactctttttttggcacgaaagagttgtttggatctgcaccatcatcgcttctatggcttaggtatagctcattcctagtcatgtacccaaccggcatcagcagcgaggttggcttgatatacattgcgttgcagttcatcaaggcatcagagaagtactgcatcagaatgcccaacaaatggaactattcatttgattacttctatgcatcaatcctggtactcctagtctacgttccaggaagcccacatatgtacacctacatgcttgggcagcgtaagaaggcgcttgcaaagtcaaagaccgcgtaaatcttatcgatatgtcttacaaaattcggtgtcacatcactgtgtttctcatttacgtcagcaaatcaaaagtctgttcttgttgggcactagattattaaactctctgtcatgtgaatgtggttgttgctgaatttgcatttggttgctagatacaatgtcaaacagtaaagacaaacatttcgtttgacgtagaccttgctgaatataagctttacctact

SEQ ID NO: 1669 - DNA, 1170 bp, Triticum aestivum
  unsure (1)..(1170): unsure at all n locations
  Clone ID: PAT_TA_1669
gggtcgaccccttctacatgcgtgccaagatcttgggcagcgctggggaccggcaagtcgcgagttcttacctcgaaggcgtcattctggcaaaccaagataaggacaacttcctcgtgccttactttcccgagtaagtcctcccctcaaccgccccgtaacatatgaattcttagatttcgatcgtttttcttttaacattccgtgttttctgcagtgacacacattgcacgctcatcctcctaagccccaaatattccatggccacgtatttcgacccggaccgtcagtcgaacgtagactacacaaatgtcaagaaggttcttgatgatgttctccccggctacgtcaaatctggaggcaccttcaccaggcctattcgtaagtacggcaagcacgtgttctcccacaatacgacgttctgctgcgtcaagcagccgcctggcggtcagaagggtgcctactacgccatccatcacatgcgggcgatcgtacgggaccatcatcaacttctgctaccgagtaaactcaaagattgggccgcgagcgtgtcggcagtccaggacgcggacatcagacaagaattctttcgcatccagtcggagtttgcggaaatcatccatcaagatgtccttcgtacctcggggcagttctgcctcagaaatcaaccgtccaacagtgacatcgacacaatgctacaaatgcagcctgacaacgcccgttatttcatgactcccacgatagacggcggcttcatccacgctccggtcccatgagtcgagtcgaaagtagtgatgctatgtgtagttctgaaacattgattagctcatgttgtaattatactttaatgaacttgtatgtctctttggtttggacagtcgttcaatttagatgtaatcgatgctatttattagtaggaccatgaatcgtgctattaatttcttgcttttctcttccgatccttttgttgcatacttatatattgcttatgtattgtctgttgttcggctagtgcatagagatgccgtcgtatgtcgtgtacaagggtaaggttcccggagtctacgacgactgggaggagtgtcggagacaggttcaccgtttcagcggtaacagttacaaagggtacaccactanggcggaggcagaatctagatacacgcgctatct

SEQ ID NO: 1670 - DNA, 2219 bp, Triticum aestivum
  Clone ID: PAT_TA_1670
aacttctacatgcgtgccaagatcttgggcagcgctggggaccggcaagtcgcgagttcttacctcgaaggcgtcattctggcaaaccaagataaggataacttcctcgtgccttactttcccgagtaagtcctcccctcaaccggcccgtaacatatgaattcttacatttcgatcgtttttcttttaacattccgtgttttctgcagtgacacacgttgcacgctcatcctcctaagccccaaatattccatggccacgtatttcgacccggaccgttagtcgaacatagactacacaaatgtcaagaaggttcttgatgatgttctccccggctacgccaaatctggaggcaccttcaccaggcctattcgtaagtacggcaagcacgtgttctcccacatatgacattctgctgcgtcaagcagccgcctggcggtcagaagggtgcctactacgccatccatcacatgcgggcgatcgtacgggaccatcatcaacttctgctaccgagtaaactcaaagattgggccgcgagcgtgtcggcaatccaggacgcggacatcagacaagaattctttcgcatccagtcggagtttgcagaaatcatccatcaagatgtccttcgtacctcggggcagttctacctcagaaatcaaccgtccaacagtgacatcgacacaatgctacaaacgcaggctgacaacgaccgttatttcatgactcccacgatagacggcggcttcatccacgctccggtcccttgagtcgagtcgaaagcagtgatgctgtgtctagttctgaaacatcgattggctcatgttgtaattaatctttaatgaatttgtagtacgtctctttggtttcgagagtcgttcaacttagatgtaatcgatgctattaatgtcttgcttttcttttccgatcgttctgttgcatacttatatattgcttatgtattgtctgtgaattggtactaacgtttcgttttgctggtgcatagcgatgccgacgtgtgtcgtgtacaagggtacggtttccggagtctacgatgactgggaggagtgtcggagacaggttcaccgattcagcgggtaacagttacaaagggtacgccactaaggccgaagccgaatctagacaccaccgccatctaacgggagaggggacggagcgttggaggaaccggatgacgacgagtttcatcgtgatgaccgcagctctcttctatgtgatggtactttatatgatcgatatctacttgtaatgtgaagacaaactcgcggtctcgagacttgtaatataatgttctatcattgttcggtcttttcaattccgagactaatatgatatagtacgggaccatcatcaactactgctaccgagtagactcaaagattgggccgcgagcgtgtcggcaatccaggacgcggacatcagactagaattctttcgcatccagtcggagtttgcggaaatcatccatcaagatgtccttcgtacctcggggtcgttctacctcagaaatcaacagtccaacagtgacatcgacacaatcctacaaatgcaggctgacaacgcccgttgtttcatgactcccacgatagacggcggcttcatccacgctccggtcccttgagtcgagtcgaaagcagtgatgctgtgtctagttctgaaacatcgattggctcatgttgtaattaaactttaatgaacttgtagtatgtctctttggtttcgagagtcgttcaacttagatgtaatcgatgctattaatgtcttgcttttctcttccgatcgttctgttgcatacttatatattgcttatgtattgtctgtgaattggtactaacgtttcgtttggctactgcatagcgatgccgtggtatgtcgtgtacaagggtaaggttcccggagtctacgacgactgggaggagtgtcggagacaggttcaccgattcagcggtaacagttacaaagggtacgccactagggccgaggccgaatctagatgcgcccgctatctagcgggagaggggagggagcgttggaggaactggatgaagacgagtttcatcgtgatgatgctcatcgtgatgactgcagctctcttctatgtgatggtagtttagatgaccgatatcgacttgtaatgtgaagacaaactcgcggtctcgagacttgtaataaaatgttctatctttgtttggtcttttcaa

SEQ ID NO: 1671 - DNA, 2003 bp, Triticum aestivum
  Clone ID: PAT_TA_1671
ccgggtccacgggtttaatgaacttgtagtatgtatctttggtttcgagagtcgttcaacttagatgtaatcaatgctattaatgtcttccttttctcttccgatcgttctgttgcataattatatattgcttatgtattgtctgtgaattggtactaacgtttcgtttggctagtgcatagcgatgccgacgtatgtcgtgtacaaggttaaggttcccggagtctacgatgactgggaggagtgtcggagacaggttcaccgattcagcggtaacagttacaaagggtacaccactagggccgaggccgaatctagatacacccgctatctagcgggagaggggagggagcgttggaggaaccggatgaagacgagtttcatcgtgatgatgctcatcgtgatgaccgcagctctcttctatgtgatggaagtttagatgatcaatatcaactggtaatgtgaagaccaggacatttcgcgggtcgaccccttctacatgcgtgccaagatcttgggcagcgctggggaccggcaagtcgcgagttcttacctcgaaggcgtcattctggcaaaccaagataaggataacttcctcgtgccttactttcccgagtaagtcctcccctcaaccggcccgtaacatatgaattcttacatttcgatcgtttttcttttaacattccgtgttttctgcagtgacacacgttgcacgctcatcctcctaagccccaaatattccatggccacgtatttcgacccggaccgtcagtcgaacgtagactacacaaatgtcaagaaggttcttgatgatgttctccccggctacgccaaatctggaggcaccttcaccaggcctattcgtaagtacggcaagcacgtgttctcccacaatacgacgttctgctgcgtcaagcagccgcctggcggtcagaagggtgcctactacgccatccatcacatgcgggcgatcgtacgggaccatcatcaacttctgctaccgagtaaactccaagattgggccgcgagcgtgtcggcaatccaggacgcggacctccgacaagaattctttcgcatccagtcggagtttgcggaaatcatccatcaagatgtccttcgtacctcggggcagttctacctcagaaatcaaccgtccaacagtgacatcgacacaatgctacaaatgcaggatgacaacgcccgttctttcattactcccacgatagacggcggcttcatccacgctccggtcccttgagtcgagttgtctagttctgaaacatcgattggctcatgttgtaattaaactttaatgaacttgtagtatgtctctttggttttgagagtcgttcaacttagatgtaatcgatgctattaatgtcttgcttttctcttccgatcgttctgttacatacttatatattgcttatgtattgtctgtgaattggtactaacgtttcgtttggctagtgcatagcgatgccgacgtatgtcgtgtacaagggtaaggttcccggagtctacgatgactgggaggagtgtcggagacaggttcaccgattcaacggtaacagttacaaagggtacaccactagggccgaggccgaatctagatacgcccgctatctagcgggagaggggagggagcgttggaggaaccggatgaagacgagtttcatcgtgatgatgctcatcgtgatgaccgcagctctcttctatgtgatggtagtttagatgatcgatatcgacttgtaatgcgaagacaaactcgctactcgcggtctcgagacttgtaatataatgttctatctttgttcggtctttttaattcggagactaatatgatgaattgtattcggagactaatatgatgaattgtattcaaagactaatcttctattgtatttgatgaatctattgttgatgtgtgctgtctatattttgtcaaattatacattttgtaacctgtgcaaaaaaaaacggcattaacaaaaacaaatgaa

SEQ ID NO: 1672 - DNA, 2242 bp, Triticum aestivum
  unsure (1)..(2242): unsure at all n locations
  Clone ID: PAT_TA_1672
gaccgtccgccgcattccgcggccgtcactcgcccacgagaggggccatcgcgtgccccccttcgccgccgcctccgccgccccccccctctccccaacccccgcgcctgccactcgccccccggtccggtcctccctccccccctcggcctgcgccgtccgctcgcttccagccgcgttgcgcggccccgccccaaccgcggcgccgagggcggcctcacgggccccccgcatctcagctgccgagttggctgccgtgtcggcgcagtccggccagctcctagtctacaccacttcccgcgccaagagatccgaagctgagccttgtcttgcgctggagggcgagcggcatgtcgtcgacgacatggttgtagttgccgtcgatgaaaatcagcttgtacttactagggtacgaggaattgtcggcagcccccgctgatcctgtccaggggtcgggttgggtagttttggggtcaaagaggctacgacagggctaactcaccatttaggtgcacgagaaagtggtccttcaactcaaaagatgaacaataattctggatctgcacaatcgtagttgggttggggcacaattaagaggttaacaggggatggatttttcttaacataggcatgctagcgtttcggaaagtcattggggctaggagttttgttggaagaaacccagatgatgggaaaatgaaaggcatcgcattcatcaaggatcctgatggtttactaggattgaaatatttgatctgaagaaaattgggaaggggattgctgcggagttacctttaagttgagaagtacaatactaagttcgatggcttctccatgacggaaattgcaagacctcagcaagtcgaagtgtttctttcttggagtacagatcatagccgcgacagggtgaagatgtgtcaagcagctaacttccgggttcaaggttgcatagtacgccatccttcataaaaggtcgatggtacgggattcgcatcaacttcttccaccgagtaaactcaaagattgggtcgcgagcatgtcggcaatccaggacgcggacatccgacaagaattctttcgcatccagtcggagtttgcggaaatcatccatcaagatgtccttcgtacctcggggcagttctacctcagaaatcaaccgtccaacagtgacatcgacacaatgctacaaatgcaggctgacaacgaccgttatttcatgactcccacgatagacggcggcttcatccacgctccggtcccttgagtcgagtcgaaagcagtgatgctgtgtctagttctgaaacatcgattggctcatgttgtaattaaactttaatgaacttgtagtatgtctctttggtttcgagagtcgttcaacttagatgtaatcgatgctattaatgtcttgcttttctcttccgatcgttctgttgcatacttatatattgcttatgtattgtctgtgaattggtactaacgtttcgtttggctagtgcatagcgatgccgacgtatgtcgtgtacaagggtaaggttcccggagtctacgatgactgggaggagtgtcggagacaggttcaccgattcagcggtaacagttacaaagggtacaccactagggccgaggccgaatctagatacgcccgctatctagcgggagaggggagggagcattggaggaaccggatgaagacgagtttcatcgtgatgaacctcatcgttatgactttggttctaaatgatcgtacgactataaggagtggagtccctacctcgcttgcaggggggccggtcccctccgccgacgacctctgccgcgtctcgccgtcactggtcccccgctgcagccctggcacctccaacgcgtcccccactagggccgaggccgaatctagatacgcccgctatcaccccggnangagggganggagcgtnggnggaaccggatgaagacgantttcccggtgagaccggctgcggtgagacgacagaagggcttctatgtgatggtagtttagatgatcgatatcgacttgtaatgtgaagacaaactcgctactcacggtctcgagacttgtaatataatgttctatctttgttcggtcttttcaattcggagactaatatgatgaattgtattcggagactaatatgatgaattgtattcttctattgtattcgatgaatctgttgttgatgtgtgctgtctattttttgtcaaactatacattttgtaacctgtg

SEQ ID NO: 1673 - DNA, 726 bp, Triticum aestivum
  Clone ID: PAT_TA_1673
gccgccccctcccggcgtcacgcgcacagtatcagagaagaacggccacttagcagtagccaagccacccacgaccacgcccacgccgacgccgacggaaccgccactgcaaaactgccagaacgtccgcagcgccgatggcgtgttggcggaagaaggtcgtgttccgggcgcgccgtgcgtgggccgccgtctccggccgcctcctccgcggcagcaagtcgggcagcggcgggatactgaagctccacgaggacgtgcagacctgcgggtaccaggacgtgcaggtcatgttcgacatgctcacctctgagctggaggcggcgcacgcccgcaaccgcaagcagcctgcatcaccgctgccggcgtggtccagccgcttgtcgttgtcctccgcctgaccgagggcagcacagtagagaagaaggaccattcgttgaagtgcagggcactcacgaaggacgtcaccatgttagttttacaagttactgcctgtgcatcaggcgtccatccccctgctcttcttctacccggccaaagagcgaaagaccgccctgttgatggtgtgtaaatagaggcggtgtctgaagtttttgccgcccgggaggaagagggaggcaagaggggtttcatttctattgctgtcattttcttgtcagattttgcgcggttttcacatgttgtgcgttcgtggcttggttgttcgcaaaaaaaaaaaaaaaaaaa

SEQ ID NO: 1674 - DNA, 1426 bp, Triticum aestivum
  Clone ID: PAT_TA_1674
gctccacccaccccagccggcctcaccgcgcgccaggcagccgctccaccgtgcgtgccaatggcgcccgtccgagcagccctcctcgccttcctcgtggccgcgctgctcccgctcgccctgtcccgcgggcaggggcgtggcccgcacctgccggggcacggcctggtgcatcgccacgggcctggcatcggtcaccacgcccaaccccgcggcggcgggggcggctgggccccagagcgcgctaccttctacggcggcggtcgcgcctccggcaccatgggtggggagtgcggccgcgggaacctatacatcacggggtacggctccaacactgcgcccctcaacccggcgctcttcaacaacggcctcagcctcgggccctgctgcgtggtgcggtgcgacccgcgcggaacccagcccggcgcaccccgtgcctgcctcccccgcgcccccctggtgacggccaccaacttctgcccgcccaacttcggcgagtcctccgacgcccgcggctggtgtcaccctccccgcgcccacttccacatatctcggcccgtcctccagcgcatcgcgccctagcgggctgcaagtgttcccgtctcctaccgcagggtggcgtgccaaaagaagggcggcatccggttcaccatcaacggccactcctacttcaacctggtgctcgtcaccaacgtgggcggccccggcgacgtgcacgcggtgtccgtcaagtccacacgctcggcgcggtggcagtcgctctcccgcaactgggggcagaactggcagagcaacgcgctcctgcccgggcagggcctctccttccgcgtgacggccggcaacgtacagtccgtgatctccaacaacgccgtcccgcgcggctggtccttcggccagaccttcagcggcgcccagttccactgatcgccagcgtcatccatccgccgaagcagtactatcttgtagtagtagtggtcagtagtgttcgtcgtcaacctcccgattggagcgtgctgggaagcgccatggttttatgatggttcttccacaagcatccgacgctctttggggattggaagcagtagcaggtagttaggcctagtattatcatgggcttttaattgtctggttagcgcgcgtgagtgagtgagtggtagctgaagcctaaagcatttgaacgaggttttggctaggatggcagcggtggtaaaggccggcttgattaaccgacgccgccttgtatcacccgcctgtttagcgagtgggcctcttgggtggtggcctttgtctcgtggatgttttggtgtggtactcttctgtctgtgtggtgtgtgtgcttggctgtgatgtaacctcagaccgagttaatttaagcctctggcttttgcatgttttaaaaaaaaaaaaaaaaggttctagatcgcga

SEQ ID NO: 1675 - DNA, 891 bp, Triticum aestivum
  unsure (1)..(891): unsure at all n locations
  Clone ID: PAT_TA_1675
gagggacttatttcttttcttttattccctttttatgctgcttcctttgtttattgttatttaattatcttttctttatttttctgctaggtttcttaccttgaccgtgtgcactctgggttgaattctcttcctgacagcaagcctagaattctggtatggagaggtaacaaagttaaggatttctcggaattacataagagcaacagtcgttcgtatggcaagaggccgttgaagcgtttatcaccatcagtttacgcaccagaagtcttgtgaaaagttttcatgttcagtaacctatagtatcccctttgccaataagatttcaacatcagaagttcatgctccagctgttgataatgtctcttttgcctgtaaagctgaaacggcttatgcttcacggtttggaaatgatgttgtgcaacaaatagttggacttgttcagtcttcaaatgccgctaagcctcagacttttcaagattggtcggagtcccttgtttcaagatttatactggatttacagtgtccagtgtaattctaagtggatttacactgtaattcctactggatttacactgtaattctatgtgaatttacagtgtaattcttactggatttacactgtaattcctactggatttgtagtgtcttagtggatttgaactaaaatgcttggtgtaatatttagtgaattttacaatgttttacggtggattcatattggatttacagtgtttttcttagtggatttacagcggtacttatagtgtaaatcttattaggaatatgcaacttgtattctcatgaggccataggtcgatatatatgcatgtacaggtgggaacatatgcaggaaactctttatacaanggataaatacaaaggggtaca

SEQ ID NO: 1676 - DNA, 653 bp, Triticum aestivum
  unsure (1)..(653): unsure at all n locations
  Clone ID: PAT_TA_1676
ctccccggaccccggccccggccccggcccgatgaaccgctggcccggacgcgtgggcggacgcgtgggggccttcatggcctccgccgacatgccggccttcccctggggcgctgcggccaccccgccgccgccggccgccgtgccgcagcagccggccttcaaccaggacacgctgcagcagcgcctgcaggccatcatcgagggctccagggagacctggacctacgccatcttctggcagtcctccaccgacgccggcgcctcgctcctcggctggggcgacggctactacaagggctgcgacgacgccgacaagcgccggcagcagcccaccccggcctccgccgccgagcaggagcaccgcaagcgcgtcctccgggagctcaactcgctcatagccgggggaggcgccgccgcgcccgacgacgccgtcgcgcaggtccccccggaccccggggggggccccctccgcccgacgaccccgccctcccaacggggtcgccgggcgcccaaggggcttgcccgcctccccactggacaatcctttccaaacnggattgggcttncccgggggaagggctnttttccgggaaaccaacttngtttccanagggggtcnccaanncgccctgtgaangggcaaagaaagn

SEQ ID NO: 1677 - DNA, 1098 bp, Triticum aestivum
  unsure (1)..(1098): unsure at all n locations
  Clone ID: PAT_TA_1677
tacccacgcgtccgatttcttgttgtcctgcatatatgagtaggaaagcttgcagacttgcagtgacataatactggtgaccaatcatagtaccagggtgtactccagttccagtgtatacataaacacatgtgcatcacaatctatttctgttcaaaagttgtttctgtcacatgtctaacacgtcactgactaatgtactttaagtcgattatattattcatgaactcgtcaaacgatgtgactttctttcaggtatgccaaagcctgcggcctctcctcaattgttgacaaggacaaatcacaaagtgcacttgaaaagatatatactttcaacgtaatgaagttcaaggatggtaacaggggagcaatcaatgggatgtggccagatggtacattggacatgtccacaatgcaatctagggagatatggccaggcgtgacatacgcgcttgctgcatctatgattcaagaaggcatggttgaggagggtttcaaaacagctgaaggagtctatcatgctgcctggtcttcagaaggacttggatacgcattccaaactcctgaatcttggaacaatgacgatgagtaccggtccttgtgctacatgcgcccactcgccatatgggcgatacagtgggcactctcaaacccaaagctccacaaggagcctcagacagacataacacaagattcttttccgaagaaccagttctcatatgcacgaatagcgaagctcctgcagttacctgaagatgagtcgtccaagagcgtccctcgggttatctatgagatagttcggaacaggtttacttcatgatatatgggccgcgacatgcctgaatgttgaatgcactattggagcaacattgttcaatttggttgttgattgcggaaacatgttattggtcagcacacattagtatggagttaatggtaataaaagatgagatccatgtatgtagcccagtagaaaatagtatgtcacgttgttcttcggagcgttcttgtacggttgtgcttcttgagtacaacaaaaggggggaatcatttcttaccagctgagaaatatttcaaggntccgtcaaaaaaaaaaaa

SEQ ID NO: 1678 - DNA, 396 bp, Triticum aestivum
  Clone ID: PAT_TA_1678
cggacgcgtgacgagtccgtcccagcgggtgacggtttggtatgtctctggcgttttattaggcgactctgtgggaggccgccgccgtcctggttcgtgcgccgccgccgccgcccaccaccgccgacctcctccctcagcagccccacccctcgcagctgagctccgccccttcccccctccctcccaccaccataggccgtgggggtgcggctggggcgcgccgtcgtctcagcaccgacgaaccctaggtcccaagtctctggatctcttggtctagtttgttttctggttcgaggttccaatggagagggtgtcggggttgatggagaagctacggttgtcagaggcagagaagaaaggggtgcgaatcgggtggtcggagggattgaagag

SEQ ID NO: 1679 - DNA, 864 bp, Triticum aestivum
  Clone ID: PAT_TA_1679
gatgaggaactttaagacattctaagacttcctgagatgcacaaataaatctcacgacaggtgcttgccacttgtcacaagttcttcagagtgctgccgcttaactctttcttctccaatcctttctcaagtggaaacattacagtattgccaaaagcaaagatgggcgcagcagagtcatcttccaagcttggtggctccgtccatgacttcgttgttaaggatgtgagaggaagtgatgtggagctcagcagatacaaggggaaagtcctgcttattgtgaatgtcgcatctcgatgtggtctggcaaattccaactacacggagctgggccaactctatgagaaatacagggagaaaggattggagatattggcgttcccttgcaatcagtttgccgggcaggaaccagatagtgatgagaagattgtggagtttgcttgcaatcgcttccaagcagagtttcctatttttcgcaaggtcgacgtgaatggcaacaatgctgccctgctgtacaagttcttgaaatcagagagaggcggtctatttggagagcgtatcaaatggaacttcaccaagtttctagttgacaaagaggggcacgtcatgaaccgatacgcaccgacctggtccccactcggcattgagaatgacatcaagaagctgttggcaggtttgaggtatctccagggaagatcatgcggcggcgtgtcatgtgtatgtgtcatttgttcttttcgctactgtatgtgtgtgcacacttgctctatcaagagtaaccccagtctgctgtatgctactctgatttctacacggtgaaataatttcccctcaattacgaactacaagaaacaaagaccaggg

SEQ ID NO: 1680 - DNA, 475 bp, Triticum aestivum
  Clone ID: PAT_TA_1680
gccggccgggttgggtgcttaaacacaccgcaatatgtatgatttcctgggctgggccgcagccaacctcgaatggaagctgctgcacaaagtggcaaaggataaagaaggctttttacagcgagaaatcgtgaggggcgccttcgatggcagcctgttcgagcgcctgcaggagagcaagaaatctacctgaatgcggcagtgagccgtgcgcagtccagaccgagcgtcgtcaatgaaacatctgcacttgaaatttgaaaagcctccctgcattgtagtttgagttctgcacgtcaaataagaagtgtttggcccgtctacggcggcctaaacattttcatttgtattgttattttgaactggaatttgtactgttattggtagcgcacacaaggtgtacagtggaactttgtaatgtgcactcgtgaaccatcagtacctcgctcaaaaaaaaaaaaaaaaaaggccccta

SEQ ID NO: 1681 - DNA, 1552 bp, Triticum aestivum
  unsure (1)..(1552): unsure at all n locations
  Clone ID: PAT_TA_1681
gcccccgcgccccgctgcatcgggcttgggtcgccttcggccttcggcacatccatgctcctccacctcgtcctcacttatcctactcaaccgggatggatgccttcccctctgctctcgatccatataaagaacatccactggggcaagcgcgcgagcgactctgagtcgtctgacggtaaaggcgccatggcgccagcggaattggccgtggcatcccgcacgctcggcaaaaccccgccgaacgcgttctcacacaacgccttcctccccaggccttgcaacaaccgctatttgcgagtaaccgtggggtcggcggcgtcgaaccacccgtggcaggtgatggacacggtcccgaagggcatcaacggcgtgctccagctcgacagcgtcctggacgactacgacgacaggctcttccagccccgggcaatggcgccgggttccccgagaatccgggagggcaccaagcggagccacgccaaagccatgagcctgctccagctgcacgcggccttttacgacccccactgcatcggggtcatctatctatgggagaccttccagagcctgcgagcaatcgggcttgggtcgccttcagccttcggaacatccatactcctccacctcgtcctcacttatcctactcaaccgggatggatgccttcccctctgctgtcgatccatataaagaacatccacaggggcaagcacgggagcgattctgagacgtatgacacagaagggaggtttgaaccagcgaaattcgatgctatattcagcaagtttggcaaaactcggccaaatgctttgtcagaagatgagattaacgccatgcttaaatacaaccgcaatatgtatgatttcctgggctgggccgcggccaacctcgaatggaagttgctgcacaaggtggcaaaggataacgaaggctttttgcagcgagaaatcgtgcggggcgccttcgatggcagcctgttcgagcgtctgcaggaaagcaagaaatctacctgaatgtggcagtgagcctcgtctctaaaatatctgcacttgaaatttgaaaagcctccctgcattgtagtttgagttgtgtacgtcaaataagaagtgtttggcccgtctgcggcggcctaaacattttcatttgcattgttattttgaactggaatttgtatttttattggtagcgcacagaaggtgtacagtggaacttgtaatgtgcactcgtgaatcatcattacctcgcataatataggcgtgtctctttctgagcgcctgcaggagagcaagaaatctacctgaatgtggcagtgagccgcgtggagtcgtctataaaacatctgcactggaaatttggaaagcctccctgcattgcagtttgaattgtgtacgtgaaataagaagtgtttggcctgtctacggcggcctaaacatcttcatttgtattgtcattttgaactggaatttgtactgttattggtagcagacggaaggtgtacagtgggactttgtaatgtgcactctnaatcatcattacctgcataatataggc

SEQ ID NO: 1682 - DNA, 568 bp, Triticum aestivum
  Clone ID: PAT_TA_1682
gcacgaggcaatccccaagccttcgtcctcactcctcacagacgcatttccccagagtccgactgcatccacagtccgcgctggtgctgcgcccacgtccgggggacccaccaccggccccgcctccgcctccataactccattaactaccttgaagtcgagcttgccttcaagagttgagccatcgcggacgcgtgggcggacgcgtggggtcgtcacactcccccgccttctccgcataccataactagtaatagctccaccgcttgttctgctcctcgtccctttcttgcttgctcgatgcaacggcaggaattgacgacgtggtaagggtctgcgcgtgagctgagctgagctcgtcggaagaatgggagaatttgcggcggcgggcgaggcggggagccaagaagcggagcaagacgagcaggggatgctcgcgacggcgctggacgccataaactctctcatctctgcttccttctccgcgtccctcttcccgctcaagtggcagctcatcacggacaagttcaaccggctccacgccggccttgcggacattaccgtcatg

SEQ ID NO: 1683 - DNA, 458 bp, Triticum aestivum
  Clone ID: PAT_TA_1683
cccacgcgtacgattttcccaaccagcagctaatcggcgcacgtgaagcctgagctgagctgagctgtagagcgagcgaccagagcgtagaagaagccatgaggatccagtgcgacgcgtgcgagggcgcggcggcgacggtggtgtgctgcgcggacgaggcggcgctgtgcgcgcgctgcgacgtgcagatccacgccgccaacaagctggccagcaagcaccagcgcctcccgctcgaggacgccgccgccgccgccggcctcccgcgctgcgacgtctgccaggacaagccggccttcgtcttctgcgtggacgacagggcgctcttctgccgcgactgcgacgactccatccacgtccagggcacgctctccgccaaccaccagcgctacatcgccaccggcatccgcgtcggcttcagctccgtctgcagcgcccacgcccgacacccaccc

SEQ ID NO: 1684 - DNA, 1061 bp, Triticum aestivum
  Clone ID: PAT_TA_1684
ctcgtctttcccacctccccttcttcctcgcagcagccttatctcttctccggctcagcctagcaaaagcgctctccggccagcgagaaagcaagaaggcggaggcatgaagatccagtgcgactcgtgcggcgtcgcggcggccacggtggtgtgctgcgcggacgaggcggcgctgtgcgcgcgctgcgacgtggagatccactccgctaacaagctcgccagcaagcaccagaggctcccgctcgacgcgctcggcgccaagctcccgcgctgcgacatctgccaggagaaggccgccttcatcttctgcgtcgaggaccgggcgctcttctgccgcgactgcgacgagcccatccacgtccccggcacgctctccgggaaccaccagcgctacctcgccaccggcatccgcgtcggcctcggccccgcctccgcctgcgccgccggggaccacggcgccggccacgacgccgaccaccacgccccgcccaaaggcgcctgcgagccctacccgccggcccagcccgccgcccgcgcgcagcaggtcccctcgccgccgcagttcctgccgcaggactgggccgtcgacgagctcctgcagttctcggactacgagtccaacgacaagctgcacaaggactcgcctctggccttcaaggagctggagtggttcaccgcggacatggagctcttccacgaccacgcgcccaagggcggcagggcgaccatggaggtgcccgagttcttcgcctcccaggcggcagacgacgccgcctactacaggccgagcagagtggccgccaccgccggcttgcgccagagcaagaaggcccgcgtcgagatccccgacgacgaggacttcttcatcgtgcctgatcttggctaagcgatgctcctagattctagtactccctcgtgtgattttgcagtgctgttgtatacagagaggagctgtgtacaaaagctagtgttctgtcgaactgtgccctgtgcatcttgacgtagcatcgctgaactgtgacatataataatcatcgtaagatatgagctttgcaaaa

SEQ ID NO: 1685 - DNA, 1176 bp, Triticum aestivum
  Clone ID: PAT_TA_1685
cccgggcccaaccggacccctcttcctccttcccacctacccttcttcctcgcagcagccttatctcttctccggctcaccctagcaaagccttctccggcaagcgagagagaaaggaagtggaggcagcaagatccagtcggacgcgtggggcgtcgcggcggccacgggggtgtgccccgcggacgagggggcgcggatcgggcgctagggcgtggagtgcgaggccgcgacgaagctggccggcaggcacgagggggtcccgcccgagtgccccggcgccaagctcccgcgctgcgacatctgccagcagaaggccccattcatcttctgcgtccggtcgagggcgccgccgccgccgccggccgcccgggctgcgcaggttcccgggacactctccgccttcgtcttccggcatggagcgaccagggtcgctcttctgccgcggactgcgacgactccgtccacgtccacgggcacgctctccgcccaacccaccaagcggctcccaccgccacccggcatccgcgtcccgcctgccgctccgtactgccacgcgcccaccgccagacagtcccaccccgccgcccctccaagcccaagggcggccgcaggccggccgaccgacgctccgtcgcgcgtcctgcggccccagcgggcccaacggaggtgccggcgccgccgtccctgccgtcgcccggctcggccgtcgagggcctcatgccggtctccgaccacgagtccggcgacaagtccaaggctcgcacgccgctcgcgtacaggcccccggcgtgcccccccgagacggcggacgaccccgcctactacaggccgagcagacccgccgcccaaccccggcttgcgcccagagcaacatggcccggcgtcgagatcccgcacgacgcggacttcttcatcgtgcctgatctgggctaagcgatgctcctagatgctagtaccccctcgtgtgattttgcagtgccgttgtatacagagaggagctgtgtacaaaagctagtgttctgtcgaactgtgccctgtgcatcttgacgtagcatcgctgaactgtgacgtttttcaatggccgtgagtccctagcgttccatattcgaagcctttgatctgcctccgtgcttttgcgctagttaaaaagatcacaactacagaatagaaaag

SEQ ID NO: 1686 - DNA, 589 bp, Triticum aestivum
  Clone ID: PAT_TA_1686
acgcttctaacctccttaattagtgatctagctagttaaacaatctccctcgagaaaaagtttagccaacaatggccatcgggctccggccgtcctacctctgcctatgcacctccttcctcctggtggtcgccttagccggcacacggccggcggctgcccaatgtgagaagacggtggcggcggtgccggactggtgcacaaagcagttcttcaacgcggcctcctcgggcgccaagggggacgaattcatcacccatgaatgttgcctgctgctcggttgtgtccatgagtcaaactgcgacagcatcctccgcagcttctgcccggctccggacgccgatgagtgcccggtgccacccgtcgcaccagctgtgtcgacaggagcggctagctagctagacgtacatattttacagtgtcctacatgaataatcggctcgtgtacttgttcggcgtgcatgtgttcaatggatattcttttccggtgtgatccatttgattcacatctgcatcgttgtgttgatgccatctgtcttcgctgctttccctggagtagtcaaagaagctgccatcagttgttttaaaa

SEQ ID NO: 1687 - DNA, 953 bp, Triticum aestivum
  Clone ID: PAT_TA_1687
ccggaaaaacccgtcgactcagcgtccgggttgttttgttgttttaacaagcaggactcttgcgggtgaggatggtgagttcaacgcggagcaccgggaggaagttcggggcctgctgcggctgttccccatctgggcgacgtgcatcatctacgccgtcatcttctcccagtcgtcgaccttcttcacgaagcaggccgcgacgctggaccggcggatcggcgccaccttccgcgtgccgccggcggcgctgcagacgttcatcagcctgaccatcatcaccttcatccctgtctacgaccgtctcttcgtgcccgccgcccggcggttcacgcgcctgtcctcgggaatcaccatgctgcagaggatcggcacggggctggtcctcgccctcgtggccatggtggtggcggcgctggtggaggcgaggcggctgggcgtggcgagggacgccgggctcgtggacgaccccctcggggcgctgccgatgagcctgtggtggatggtgcagcttcacgtgctgctcgggctgtcggacgtgttcgccatgatcgggctgcaggagttcttctacgaccaggtccccgacgcgctgcgcagcctggggctggccttcttcctcagcatcttcggggtgggccacttcctcagcagcttcctcatctccgccatcgacggcgccaccaagaagggcggcgccagctggttctccaacaacctcaaccgcgcgcacctcgactacttctactggctgctcgccgggctctgcgcggcggagctggccgcgttcgtggtcgtctcgcgcgtctatgtgtacaagaagagggtggctcaccatgaccatggcgacggtggtgctgtcatgtaatcactcacttgtaaggtggtttcctttcttgcgaatgtacagatgtatagtgttataagccaaaaaaaaaaaaaaaaaaaaaaaa

SEQ ID NO: 1688 - DNA, 1557 bp, Triticum aestivum
  Clone ID: PAT_TA_1688
cccacgcgtccgaatcttcagaacttggagtgctgcctttttgttctcttcccatacttctccagaaggacttggcttgtcaggaattgtttctatactattcacagggatggttatgaagcactatacgtactctaatctgtcagataactcgcagcgctttgtttccgccttctttcacttgctatcatctttggctgaaacatttgtcttcatttatatgggctttgatattgccatggaagagcatagctggtcacacgttgggttcatcatcttctcgattatatttataattgttgcaagggcagcaaatgtcttttcttgtgcctacttggttaatatatcgcgtccagaacatcggcgtatacctctaaatcaccagaaagctctttgttttagtgggcttagaggagccatggcttttgcgcttgctctccattctgtgcatgaacttcctgaaggacatggaaagacgatattaacagctaccacagccattgtcgttttaacggttcttcttattggagggtcgacaggcaccatgttagaagctttggatgtcattggtgatgaaaatacatcaatagaaacttacgaggaaatcaatggttacattcccccaactttgtaggaatgtcggtacatcgtactggagggaggattgaaatgaaactcgaaggagttccacaaaagcacaacatcatataccgcacttgacaagtactagtataatcaatatttcaccagtcagacagatgaggagctggtgatttcggttgtcagccgcaaaccgagaagagtgtttgtgatcaacagcagagtttgagcgttcaccgcccttgacaagaactatctaactccatttttcaccagtcagactgatgatgatgctgatgattttggtgatcaaccccaaaaccagagacgaggattctatgatcaatagcagagtttgggcatgactagctatacacggtgccaagtgccaatggacttaatgatatcgtagaacgtgggatccagattggagccatcaaacgatataaacatacacctttgcctttgttgagtaacatatatggcagagcatattgtaggatagaaatcataagcctgatcaggacagcatgcctcctgtatatatttacaaggctcaaatggtacatggtggggctccagttgaaaaggcaaaagttctgtgacgaactttgttgacccaagcccttgtcttacaccagatcatttgtttccaacagctcatcgctgatcattgccaactgcattggctcggaaaacccttgttgtgaagtgaacttaccgcgattgaacattactgtgatgtattccagtgaaatctaaaactgttcggggcatatagctgtcccggtgttcctcctttattgcactcccgctgtaccccatcttctcgcggtccggtgggcttgccgtcccgtgttttgctgtgacgcgcggccgcaagtctaacttcacccactacaaagttgaaagcatgttttgtttagatctcacaactgtgtcctgcactgtttgagc

SEQ ID NO: 1689 - DNA, 1002 bp, Triticum aestivum
  Clone ID: PAT_TA_1689
aaaacctcgacagccagcaaggaagtaccgaaagtacccttctctctcctccggacgcgtgggtgttctccacccaaatccagccaaaaaacccacccccctcctctcggttcggcgatcggcggcggcggcggcgatgagcgcggtgaacttaacgaacgtggcggtgctgaacaaccctacctctttcgtcaatcccttccagttcgagatctcgtacgagtgcctcgtcgccctcgaggacgatctggagtggaagcttatatatgttggatcagctgaagatgagaactatgatcagcaacttgagagtgtgcttgttggccctgtgaatgttgggacataccgttttgttctggaggccgacccccctgatccctcaaagatccgtgaggaggacataatcggtgttacggtgcttttgttgacctgttcatacatggggcaggagttcatcagagtaggctactacgtgaacaatgattatgatgatgagcaacttagggaagaacccccagcgaagctgctgattgaccgggtgcagagaaatattttgaccgacaagccccgggtcaccaagttccccatcaatttccatcctgaaacaagcggaggacagcagcaagatcagccacaatcagctgtacctgaaaaccatacaagcaaagggagcaaggccaagcgcagatctttgaccgggtctggaaacttgggaatgccaaaattttgatctgcatgccttctaggtgagattgcaatatcagatggcttcctgggatgctgctgctacctgaaccgtctgttctggtgcgccactaaactagactatagccaaaaactcacattggttagccatgtgcctgtggtgggtaggcaaggttctgacacactgcgtccttttgctagtgatgaactgtaagctggatgttcatccagtagtgttccggtgcaaccgtggttgtcttgtctctggattatgcgcaatcgcaaggggttcgttag

SEQ ID NO: 1690 - DNA, 1044 bp, Triticum aestivum
  unsure (1)..(1044): unsure at all n locations
  Clone ID: PAT_TA_1690
tggaaacgcgtcccccagatactgcttgcccggcttcttctccgctcgatccaagccatttgtgccttctccaagctccacttcttctcttggaggatggaagggacaaagaagcaggttttcacgatccaggtggaggatggaaagcctgggaaggatggccagccggcggtggggccagtgttccggaacatactggccaaggatgggttcccgccgctcgatcctgacatgagaaccggacgcgtgggctgcttccccggcttcttctccactcgatccaagccatttgtgccttctccaagctccacttcttctcttggaggatggagggggcaaagaagcaggttttcacgatcaaggtggaggatgggaagcccgggaaggacggccggccggcggtggggccggtgttccggaacatactggccaaggatgggttcccgccgcttgatcctgacatgaggacctcatgggatgtgttcagaacggcagcaggcaagtatccagacaaccggatgcttggatggcgtccatttaaagacggagtgccagggccctacttatggaaatcatacaaggaggtctatgaggaagtcctgcaaattggatctgcgctgcagcagctgggggtgcaaccaggttccagggttggaatttatggatccaactgccctcaatgggtggtagcaatgcaggcttgcaatggttacagcataatatgtgtcccactgtacgatactttaggtgctggagctgttgattacattattgaccatgctgagattgatgttgtcttcatacaagacaagaaaataaaagaaatactgtccccaaattgcacatctgcgactaggctaaaagcattggtggcattcacctcggcaactaatgaacaaatcaaagccgccgagcggattgggatgctcgggtactcctggaaaaagggaaggtaaccnttanctnnctcgnancaangtcntcccntntncccangggacaaggggnnccaaggntttntnncctnaanccnggnnntnnaag

SEQ ID NO: 1691 - DNA, 1236 bp, Triticum aestivum
  Clone ID: PAT_TA_1691
ggaagagtgggtggaggcggtggcggtggcggtggcggtggatgggatgattgggacgacgaggtccgtccggatatgcgtaggaaccaatcggccggatcgtttgctggccctggagcggattcggggagacagccgacgaggtccaagtccactcaggacatatacaccaagcaggagctggaggcgtcggcggccagcaaggaggattttttcgctaggagaatggcggagaacgggtccaagcctcagagggttcctccctctcacagcggcaaatacgtcggcttcggatccaccccgctgccgtcggcgagaaggaagagcaacccaagacaagagggagaagccatccaggtcgtttcccaggaatttggacgcgtttcgcttgttgcaggatatagtgcccaatctgcagctactgttgtccaagttgacccaaaagaaattcagtcaaagatgagggaggggggttatgatcagaaggtgaacgaaactgtcaatgttgtgcccaataaaactgcagagataggaagcagaacctgggggattatgaaaggagtgatggatttcgccacacaagaggtagaggggttttccatggaatggggagtgggcagtggctggggtgatgattggcaacaaagggagcagcagaacaacagcaacgcgccttaccgcaggtatgagcaggagaccagcaacggcaacggctggaattctccgcaagatggatcagctaagaaccagaaccgtaattccaattcttgggatgattgggatgaccaagacaagaaggatgagcctgccaagacaagccagagcagcgactcgtgggccggctgggacgattcgaaagatgacggttttgatagttacagccatcacagccccgccaacaagggtgggagcaatcagaatggaaccgctggcgggtcatattgggccgacggcggcttccgctgatgttggtctctttgcgagagccatatacttgcagagttgttttatgccagaaaaatgtgagcgtgcggttgtggttcttatttcaggatataccgaagtgttgaagagtaaaagagttttgtttttttgtaagttgtctacaattgttatgcctagcggcatgttcatatggccaaggctcatttgaaactgccatccagctattaagaaatgtcgaattgaaattgtaatctacacattacatagtacatccctgcagattctttattc

SEQ ID NO: 1692 - DNA, 528 bp, Triticum aestivum
  Clone ID: PAT_TA_1692
gcatgctcaagaccctctcatggttgccgttgtgttgctgcgagcttcgtgctcttggtgttgcctcggtcatctttgctcaatgacgcgcaagtagcctccccaacttgctaatcgtcccgaacttcactagcgaagctcgtagtcaaggttcgtgcgtggcacacgttgactgtggtgctcctgtgttgcgccgtgggttcggtatgcacgccagtgcggtgcgttaggttccttgcaaagtcttggtattgtgtccctcgacatcaccccacacctacttgtgtcttttatggtgttggtcttgttagtctgctagctatgtcctgcctttggtgggcgccctactcttctcatcttcttgtaaccttgttacttgtacggttttcggcccggttttccttataaacgggttcaaattgtttaggttttcgatctggtttcccttataaaccggatcactctctggcataatggccacttcgagtaatatattcaggtggagagactcctcccccggtgattccc

SEQ ID NO: 1693 - DNA, 780 bp, Triticum aestivum
  unsure (1)..(780): unsure at all n locations
  Clone ID: PAT_TA_1693
ctcgtgccgaattcggcaggaccaacaaatccctaccagaaacggaaccaacaaatccccagccaatctcgtctccgatcgactccaggctcgtcggatcctcctcccccaccgcctcaagatgcagatcttcgtgaagaccctcaccggcaagaccatcacccttgaggttgagagctccgacaccactgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggaggttgagagctccgacaccatcgacaatgtcaaggccaagatccaggacaaggagggcattcccccggaccagcagcgcctgatctttgctggcaagcagcttggaggatggtcgcacccttagcagactacaacattcagnaaggagtncaccct

SEQ ID NO: 1694 - DNA, 377 bp, Triticum aestivum
  Clone ID: PAT_TA_1694
gagcactggagcagagaacagagcgagcgagtgagagcagagagcatgggctcaatggcggccagcgtggaggagatcggtgcggcggcggcgccacaggcggtggagcgccgcctgggcgagctgcgggcgaccttcgagagcggcaggacccggcccctgtcgtggcggcagtcccagctgcgcggcctcctccggctcctcgccgacaaggaggaggaggcgttccgcgcgctccacgacgacctcggcaagcaccgcgccgaggcctacagagacgaggtcggcgtgctcaccaagtcggccaacgccgcgctgcgggagatcgggaaatgggcggcgccggagaaggtctgggtgccgctggtggcgttccc

SEQ ID NO: 1695 - DNA, 967 bp, Triticum aestivum
  Clone ID: PAT_TA_1695
tccattcatagcttctttaagagaatacatagcatgtgatggtttttggcaaatcttgagcaggagtccaaattcgaagtgtaactttgcggccagaacatgtaacaaatgagtcctcccggcactccaaactgaccaagcaactagcgcaaacaagtagcatggtttcttgaatgggtcctcccatagtgcgtaatgctttccaccctcaagatcacccctgttcgataagattgccgttagaccaccaccccccggatacagagttttatcaccttcaatacgacaagtatattttgccatcacgtccgggcgatcctgaaagtaggtaattttccggaatcccttctgcttcacattgggtgcaaaaattaccagtcgacctgtacagacccctccaaagatgtgttgagctgaggataaatctccgtaacaatttcccatgttgaatacaccagcaggtggtgtcaaaatcgtcagatggcgtggatcaactgtatacttgtcactcttcagctctgtgccgttgattttgattgatatcagctttagatcacatccgtgaagagcgagtggagatgagttgccttcattgcctggagatacagctattttagaagtaaccatggtcttttcatcaccaagttgaaattctaaatccaccgtgtcaaacaagtagtcaggttttttgtagtctttcaagaatatctcctttggaaggtccatctctggttcttcagttgcagcaggagatggccctgttgcaatcaaacaagctgtcctcttgctgacaaactttgaactatgtaacgacaacaaaggattggaccttgttcctgtccagtgtgaaccctcctttgttaaattagcgaggcagccagagtacttattccctggggaacctctctttgaagaggagtaaggcaatctttgatactcctgatcaggttgtgggttctgtcggacg

SEQ ID NO: 1696 - DNA, 3015 bp, Triticum aestivum
  Clone ID: PAT_TA_1696
cttgccgtgattgttccaactaacgttgaaagaaggactaactgtccaatgacacccaaaattgcagcataatcaccatcagtggcagcttctggtgatgctagcacaagtctagattgaaatacgttcaagctcttgttttccattgctcccatattgaaatcaggaacaacaacaatgttgaacaaatcaagatcatattcaagaccaaaaacctcctcatcccatttcatagcttctttaagagaatacatagcttgttatctattttgccagaataggagggcctgacctggacttcatccggttggctccatatgatttgccactgattttgacatgtggctcctgtactcaaaagcgccctgagtagactgccctaaccggtggcaccgtctttcaggaaaacatgattcaacaccacattaaaacaataatgccataattcaaatgtattgccactacagtagcctgttattttacatatgccagatacagtagtagaatatattcagttaagtacactttcagtgccctggtaatggtgaagtgtcgaaccgactggcagagtcaaattgtttctttgcatcaggaaactaagctgccaaacttttcaaagctatctcatagacattttcagagagtccattggctgagatgatcatctccagctgggccttagcaagagcttgtctggtctcatcatatctcctccatcgagagaacgctgacaccatgcgggatgccacctgaggatttattttgtcgagctgtaagacaacttcacccaagaacttgtagccagaaccatctttcgcatgaaaactcacaggtgacccacaaaatcctccaattaaagagtataccttgttcggattccgcatgtcaaaagcaggatgagccagtaacttttgaacattggctacatttccaggaatgtccgaggtagcttgaagagcaaaccacttgcttacaacccaaactaatcttgctgcccatttgttatagcaagtccaaaagggcatcctcatcggacttgacctggattttgagacaatgctgctaatgcagcaaactgctcggtcatgttagtagcagacttgtattcttttaatgcaagttcagtgaacatctggctcattcaagggcatgcaagataagcaagacatgtatttttcaacggcacggcgagtccacgctatcaatggtttaaaatgcataagcttcagagtcttctgttgctttgttaacagctgcgagcaagatcgtccttggagttggaaaggcgagttctttcctaataaaaggtccggacagcatcgaactgcatcgcggatctgcaacttgacatcatcatccataaatctcacctttgaccaggcagagttattgcttttgcaatgaattctttatccaagcttgtgcttcgcaggattgctctaagtccatcaacaaattttgtatttagcgccagtgttttctgttgttggaagtcagccacaagactgaacatcaatttgcgtgccaatatttgacctgcttcccatcttgttaaattcatctgaatcattggcaagtaagaaatataagtcactctcagtcagatcagaatcaagacggatgggagcactgtatcccctcaacaaggaaggaactggtctctcaggcacattattgaatataaactcttcctccttcttcttaaactgaagcactgtggtgaagattggatgaccatcattagagagtgtttggacccttccgtcactgtagatggaagtcaggggcatatcttttccggtcgaatcaacaagtccaacagcaacaggtatgaacattggctctttcatcggttggccaggggtagggggcacttcttgacttaatttcaaagagaatgcctgggaaccttcatcatatgatgaagttacctttacagtaggtgtacctgcttgagagtaccattgtaaaaagttcggcaagtgtgcattatttgcatcacacatggctgcgtaaaagtcttcacaagtcacggcttgtccatcatgcctttggaagtaaagatccatgccctttcgaaaccctgaagctccaaacattgtcttgtacatcctgacgacttcagcacccttttcgtaaaccgtgactgaccatgtcatccacattcaaggtgtaactttgcggccgaaacatgtaacaatgcagtctacccggcatcccactgaccagccaactggcgcaaacaggtagcatgatttcttgaatggatcctcccatcgtgcgtaatgctttccaccctcaagatcaccgtgttcgataagattgccgttagacaacaacaccggatacagagttttatcaccttcaatacggcaagtatattttgccatcacatccgggcgatcctgaaagtaggtaattttccggaatccttctgcttcacattgggtgcaaaaattaccagtcgacctgtacagacccctccaaagatgtgttgagctgaggataaatctccggtaacaatttccatgttgaatacaccagcaggtggtgtcaaaatcgtcagatggcgtggatcaactggtatacttgtcactcttcagctctgtgccattgattttgattgataacagctttagatcacatccatgaagagcgagtggagatgaggtgccttcattgcctggggatacagctattttagaagtaaccatggtcttttcatcaccaagttgaaattctaaatccaccgtgtcaaacaagtagtcaggttttttgtagtctttcaagaatatctcctttggaaggtccatctctggttcttcagttgcagcaggagatggccctgttgcaatcaaacaagctgtcctcttgctgacaaactttgaactctccttttttaaattagcgaggcagccagagtacttattccctggggaacctctctttgaagaggagtaaggcaatctttgatacagggcgccgccgcctcctctctcgctaagctacttgcac

SEQ ID NO: 1697 - DNA, 1452 bp, Triticum aestivum
  unsure (1)..(1452): unsure at all n locations
  Clone ID: PAT_TA_1697
gcacgagggctgaccgaggcgcttctgcccctcttccggcgatcgccggccaccagccggatcctcaacatcagctctcagcttggccttcttaacaaggtgcgcaacccgtcgctgaggaggctgctcctggacgaggaggccctgacggagggcaagatcgaggcgatggtgtcgcagttcctgcgcgcattcttgtttctgcctgcgccaccggcggcgatggctgacgcgggcggtggcgcgtgcagggcgtggtggtcgagggacacggtggccgtggtgacgggcgccaaccggggcatcggccactcgctggccgcgcggctcgcggagcacggcctcaccgtcgtgctcaccgcgcgggacggcgagcgcggggaggccgccgccgcgccgctccgcgaccgcgggctccccgtcgccccccgccgccccgacgtctccgaccccgcctccgtcgccgccttcgccgcctggctccgcgacaccgtcggcggcctcgacatcctggtgaacaatgccgccgtgtccttcaacgagatcgacaccaactcggtggagcacgcggagacggtcctcaacaccaacttctacgggaccaagctgctgaccgaggcgctcctgcccctcttccggcgatcgccggccaccagccggatcctcaacatcagctcgcagcttggccttcttaacaaggtgcgcaacccgtcgctgaggaggctgctcctggacgaggaggccctgacggagggcaagatcgaggcgatggtgtcgcagttcctggcgcaggtcaaggacgggacgtggggtgagcacgggtggcccaaggtgtggacggactacgccgtctccaagctggccctcaacgcctacacccgcgtcctggcgcggcggctgcagtccggcggcgagcgcgtcagggtcaactgcttctgccccgggttcacgcggaccgacatgaccaagggctggggcaagcgcaccgccgaggaggtggccgacttcggcgcccggctcgcgctgctcccgcccggcgagctccccaccggcaccttcttcaagtggcgcacgccgcagctctactccaagctctgagacacggagccgcgcgcgtgcccctgggcgttcgtctgtacgtcccgtgcgtggtcgatggttgctggaatcctaagcgccttgctgtactcccgttgnggagtaaatacncgtttaatttagccatccgttgttgccaattcgctgctgctcctactaagngtacaatagctgataaaccctggggttctgctctcccattgcttggatctaanncgcatggtcantnacgtctcattgctaaccgtaanccgtaccaaatggttagaanatgtaaccctnttatgcatnngnaactccnggaataagcanaaaccgganttntcnggaagtccncttgcaaatggaaaattg

SEQ ID NO: 1698 - DNA, 858 bp, Triticum aestivum
  Clone ID: PAT_TA_1698
ggaagcacaatgggctactgcacatttttcactccatggccttcatttttctccgagccggcctcccatacactgttcaacgacaagagcagctaccgcgagctctctgagatcgctgagcaagcaaagagaacagctgagattgcaaggtatattatctttccgcttccaggttgctaatagatcagacgagtcaggctagtcgttgatttgctaatgcccttttcctgatgattatgtgcaggctgagggagctcaacacactcaagggccacgttgaatccgcggtgaagctcaagggccttgacatcgacaccatcaaccagaactacaccgtgtgaggagtatcgacattggaccaacaaacatgacatccgtattggagcgagattggaatggagctcccctttaagattttcccggggaatgaatgaaacaaacatggctgatctgacaagcccctagttgtaaagtgctaccaaatatatggtttcggttgtccgtcttctagagaggttttaatgttctagtggagttataccgtgtttggagcacggcgtggttgtaattgttttcgcgttttacccagtttcccctaactagtcggtgatcttgcggaagcaagacgagaaataatcactgcaaattttctgccccaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaagggggggccgttttaaaggacccaattttacttccccgggctggcaaggtattattttttttttggggcccccaaatttaatttcctgggccgggt

SEQ ID NO: 1699 - DNA, 882 bp, Triticum aestivum
  Clone ID: PAT_TA_1699
gctacttaaagtttcgaacgtgcaaatacggtgattctacaacttggcgcaacagctagcaggcaccagaatggcatgccgttgcgttacatagctggagattttcacccatgcatggatacttctgagttactagtaaaaggactactactactctctcagttgatctctttcgtcgccggctgtgccggggcaggaggggccgggaggacgcccttctcctggaagctgacgacggtgtcgtagaggcactgcgccaccggcgtgaactccaggcccagctcacggagccgctggttcgacatcttgtacggctgcttcctcgggttcacctcgtccgagcacctgctggggatggggtactcggggaagaacttgcggaggatggtgacgacgtcctcccggtggagcacggcgccgtcggccacgcagaggtagcgcccggcggcggcgggggactcgaagacgaggacgtgcgcggcggcggtgtcgcggacgtgcacgtacgcctgcacggcgttcgcgtacgtcttggcggagccgtccaggtacttgagcacgtgcgtgaggctggcgttcaccgccggctgcagcgccgggccctgcaccagcaccgggttcaccaccaccaggtccaccccgcgcgccgccgctgcctcccacgcctcccgctccgccaccgtcttcccgtagcagtaccagttcttggtcttcttgcagaactcgaggtcgctccagcacgactcgtcgacgacggcgtccgggccgcggctggggtccatggcgacggcgccgatggacgacgtcagcacgacgcggcggaccgtgccggactccgccgcggcgtcgatgacgtagcgcgtgcccctcaccgccggctcc

SEQ ID NO: 1700 - DNA, 1711 bp, Triticum aestivum
  Clone ID: PAT_TA_1700
gcttttagttttaggagcgttctcgttctttagggtcttttttttttttttttttttttttttttttttttttttagcagaatgacatgtcattcatggatgcttctgagttagtgctaccaaggagcacagcgtcccacattacaagtttcctttaatttggagagtagccacacctttccgaactgcatgctagttaaagttcaaactgtttgagcaacagctagctgacaccagaatggcatgccgatacatagctgcagattttcacccatccatggatatacagtactgcatgcatggatgcttctgagttactaaaaggactactactactgtctcagttgatctctttcatcgccggctgtgccggggcaggaggggccgggaggacgcccttctcctggaagctgacgacggtgtcgtagaggcactgcgccaccggcgtgaactcgaggcccagctcacggagccgctggttcgacatcttgtacggctgcttcctcgggttcacctcgtcagagcacctgcgatacagttaactgttaacaacagcttgtattttgttgactgtccatgtcaccaaatgactcaaaattctacacttcaacgcgacaccattactccattagcacgtgtgttgacatggttgcaagttgcaacgcaacagagacagggatgggcctagctcagctagctcgtcgctcgctgcgatggctgattactagtactactgacctgctggggatggggtactcggggaagaacttgcggaggatggtgacgacgtcctcccggtggagcacagcgccgtcggccacgcagaggtagcgcccggcggcggcgggggactcgaagacgaggacgtgcgcggcggcagtgtcacggacgtgcacgtacgcctgcacggcgttggcgtacgtcttggcggagccgtccaggtacttgagcacgtgcgtcaggctggcgttcaccgccggctgcagcgccgggccctgcaccagcaccgggttcaccaccaccaggtccaccccgcgcgccgccgccgcctcccacgcctcccgctccgccaccgtcttcccgtagcagtaccagttcttggtcttcttgcagaactcgaggtcgctccagcacgactcgtcgacgacggcgtccggggcgcggctggggtccatggcgacggcgccgatggacgacgtcagcacgacgcggccgaccgtgctggactccgccgcggcgtcgatgacgtagcgcgtgcctctcaccgccggctccaccatctcctcgggatcgtcggtaaccggcgaggcggtgtggaagacgccgtggcagccggcgatggcggcgcgcagcgcgtcgccgtcgagcaggtccgccttgcacagcaccagccgctccgccgcgccggcgaggcccctcaggtgcgcgttcttcgcgtcatctgggttcctgacggtgcctcgtacggcgtaccccttctcgagcaggagcttgacgatccacgacccgatgtagccgccggcgccggtcacgcacaccgtctgcccgtgccccgtggcctcgccgccgacggtcatgctggctcctgtccggcgcggcgcggtgcggcacaaagatctcccctccggtcggttaggtgaatgaatagatgtgttggcgatatcaactagtcaggcagatgagaacaacgtatgcgtggctggcgcgtggg

SEQ ID NO: 1701 - DNA, 1807 bp, Triticum aestivum
  unsure (1)..(1807): unsure at all n locations
  Clone ID: PAT_TA_1701
cggacgcgtgggctgaccagcaggtgcattttccagaggatgaagaactacacgatctatgcagtttccatcaccatccgtattgtgcttggcttcatgcttattaatgtgatcttctccgcccttgacatcttcaggttcgtcctccgggttgcgcaatgtggtacggcatagggcacactcctcggcctccaagctcctgagcgggcctatgacaaccggttcaaccaggaaatttgctaccgctaccttcatggtccttatcattgccattctagatgatggtagtatcatgacaagatccaaggacagcgttctgacatcgccatttcccatcagctggaagctcaatgacatcttcgccactggtgttgtgctcggaacctacattgccctgatgactgtcgtcttcttctcgtttatccacaagatcggcttcttcataaatgaattcggtggcaggtcagttagggccagcgactttgagattatgtctgcactgtacctccaaggcagtatcgtgagccaggcccttatattcgtgactcgttcacgccgctcgtccttggttgagcgctctgggttcctctcggctctggccttccttctcgcacaattggttgcaacactgaatctctgtctatgctaactgggactttgcaaggttcaagggaatcagggtggggctgggctggtgttatctggctcttcagcattgtgttctacttcccacttgacattttcaagttcttcatccgatttggtgctaaagtggagagggcctcgggacaacctcctgcagaacaagactgctttcaccaccaagagagaactaccgttaaaggggagacgggatagcaccaatgggctactgcacaggagaacactccatggccttcaagcacccgagccggcctcccacacactgttcaacgaacaagagcagctaccgtgagctctctgagatcgctgagcaaggccaagagaagagctggagattgcaaggttgcagggagctcaacacactcaagggccacgttgaatccgtggtgaagctcgaagggccttgacatcgacaccatcaaccagaactacaccgtgtgaggagtatcgacattcgaacacaacgaagcatgacctccgtgacttgggagatgagacttggtaacggagctccagctttacagactttttcctggtggaatgaagaaaataaaaatggctaatgttgaccacccccttatgtggtcacggtaatactaatgaatggtatgggtcttcacctcgtcaccacatccggaagttaaatcgtagtgaggaaattcgacattgaatcaacgaacatcacatcgttgttgtgagccaggcattggaatggagctccgctttaagctttttccggtgaatgaatgaaacaaacatggctgatctgaccagcccctagttgtaaagtgctaccaaataatggtttccggttgtccgtctttttagagaggttttaatgttctagtggagttataccgtgtttggagcacggcgtggttgtaatcgttttcgcgttttacccagtttcccctaactagtcggtgatcttgcggaagcaagacgagaaataatcactgcaaattttctgccccatgcttgctatcccttcacttgggtttatacaaagacaattctcgtctataaatatcatagctggcttttctgcaaaaaaaaaaaaaaaaaaaaaaaaaaaaaaaaaaaaaaaaaaaaaaaaaaaaaaaaaaanaaaaaaaaaaaaanaaaaaaaaaaagggcgggggcc

SEQ ID NO: 1702 - DNA, 984 bp, Triticum aestivum
  unsure (1)..(984): unsure at all n locations
  Clone ID: PAT_TA_1702
gccgccctggtcttgttccccgttccgtcccctgtttccccggccgccgcgccgccgtcgtcctccgccctcccgtctccgccgcgacgccaccccgtcagattcgttcgcttatgcgtccgtagctgctgctgatttgcggtcgcctgactgaggtgtactggaggtctggagctgaagcacagctccaagtccggcaccggcgagacatggctgccgcggcggggaaggaggtggacatgaagaagatggagcttatgaaggaggtaagggcgcaccaagtggcgatcggcgagctcaacaaccttcctccatccagggctgcttaccagaagacctgcaacatcttcttccgcaaggacatcaagtcggccgtggcgtcccaacagaagcaacttgatatcgccaaaggcaaagctgcactacgctggattcaggcatcatggaagctcccctgcagactgaaatttgcaattgcaacttttgctgcttcatccattcacctcgttgaattctctctcaatctagtgtcttccggcgtgctaattgatttggaagcaacttatataggtatctgtggaataatggtgtgtttaatatttactatgtgcgagactaatcatttctttctgaatatggggtagcctggtatacgggactgtcgtcacaatagacatattatgaaggtgatgcgatgatttgattgagctaaacaattatatgaaggtgatatgatgatttgaataaaaaaaaacccagcgacaggattatggttcaagggtattgtcaacgaagatctgtgcatcagtttatangcaatcaantgttgatatttgttaaangcnagcaattgttgagtanttgttaaaagcaaatatgcaattgttgacatcancttatagcnatcaatnaanaccgttacntttcctgggttggttcggcaanataataccttgaaaaaancanttgttnaaaaaaaaaaaa

SEQ ID NO: 1703 - DNA, 567 bp, Triticum aestivum
  Clone ID: PAT_TA_1703
gagccgccgatccgtctcgcgttcgccatctcgctcccgctctcgatcgttcgtccccgcgacgccgaaacggcgaaaccctagggcggctaggcatggccaaggacgagaacggctcggccctggatggtgccggcaaggaggagggggagatagcggcggcgcgcagccgcagccgcagcaaatccctagaagccgcggaggaggaggaggggcgttcgaaggggaggcgacaccggggccaccacggcaagtcaaagaggcgtgacgagggggaggagagcgagagctccgacgaggactcgggggagcggcgtaagcggcggaggaaggagaaggagcggcggcggcggcggaggaggagccgcagcgagagctcggggtcggagtcggagccagagtctgagtcgtcctactcgggttccagcgcggagtcggaaagcgagtcggagtcggaggaggagaggcgaaggaggcggcggcggaggaggaaggagaaggaagaggaggagaggaggaggaggaggaaggagaaggagaagaggaagaggaaggagagggagaggg

SEQ ID NO: 1704 - DNA, 1465 bp, Triticum aestivum
  Clone ID: PAT_TA_1704
attcccctcctcctcccccccgcctccggtcgagctcccctccccgttgacccaccaacgacctcctcctccgccgcccgcccgcccgccatgtccgacagcacccaccggtacaacggcagcgccggcgccgtggccgtgaagcaaatacggagcgccgggaaggtggacgagaagctggagcgcgagttcgagtcggaggccggaatcctcggcggcgtccggcacaagaacatcgtcaggctgctgtgctgcctctcgcgcgacgactctgccggcaagctcctcgtgtacgactacatggacaacggcagcctcgacgggtggctccacggccacgctctcaccgacggcgccaggcactccgtgtcgtccgtggcgagggcccgatcgggtccgcgcgacgctggtttggactggcccgcgaggatagagtcgccgtggccgccgcgcaggggctctgctacatgcaccacgagtgctccccgcccatcgttcaccgggacgtcaagaccagcaacatcttgctggactccgaatttcgggccaaggtcgcggacttcgggctggccaggatgctggtgcaggccggcacgccggacaccatgtctgccgtcgccggatcgttcggctacatggctcctgagtgcggctacacgaggaaggtgacggagaaggtggacgtgtacagcttcggcgtggtgctcctggagctcaccaccgggcgggcggccaacgacggcggcgaggacgggtcgctggcggaatgggcgcggcacctgtaccaatcaggaggaagcatcggcgaagccacggatagtcgcatcagatacgcggggtgctcggaggagatcgaggtcgtgttcaggctaggggtgatgtgcacgagcgcgtcgccgtcgtcgcggacgaccatgaaggacgtgctgcagatcctgctcaggtgctgcgagcagacgcaccagaagggcaaggcggagcctggccgggagtacgaggcggctccgctcttgctgccgcagcgcggcagccggcggaagcagctctcaaactccaaggggtccgacagcgaggagaagagcgacttcgacggcattgtctgaattatggagccaaccactgcatcttgattgcactggcatactgctccctctgtaaaatataagagcgtttagatcactgagttagttagtgatctaaatgtttttatatttttctttacggatggagtacttaggacaacagctggaagcagggaaattatgaagcagtatatttgtattcaaatagtactgtgcaagtttgcatactgtaggagagggttacaagtctaaactagctgttcatggtggaggaaccattttcagtttagaaaaactgaacagctatattacataacatatatatgcactgtatgaaatttttagaaaaagacatatatgggcgtatcaaacagaagaaatca

SEQ ID NO: 1705 - DNA, 1889 bp, Triticum aestivum
  unsure (1)..(1889): unsure at all n locations
  Clone ID: PAT_TA_1705
tcgagcggccgccccggacgcgtggggtgaaggcctatgagttgttggctcgtgttgaagagcttcaatgcttggcaaagcgcatcgcacgttacaaagatccagttagacaataccggatccaatcaccttacaaaaagccacagtggtcagcaagctgtggatggattgaaactgatgatgcaagattgctgcttggaattcactggtatggttatggaaactgggagaagatacgattggatgcaaagcttggtcggacaacaaaaattgcaccagcaacacttggtgagagagaaacatttttaccacgcgcaccaaatttggataatcgtgctagtgctctcctgcaaaaggaatatgccaatctgagtggaaagagctcaaaagccaaaggaggtgctagccaaaaagtcaataatgaaaatggtggtgctcgatcgtttaaaggccggcaaaaagatgcaaaaccacaagaggatattaagtcaaacaaagatgacattaagaaacgcaaggtagtggaagaagctgaagcaagagaagagggtgaaatttcagagtctgaagaacagattaaatatcgtttggaaaaggaggaaaagtggctggaatggtgctctgaagctttggatgaagagcaggacatattgaaacgcctcgataggttacagaatacaagtttaaatcttccgaaggaaaaggttctttcaagaattcgccggtacctgcccgggcggccgctcgagattggaaaagtcgctgcccaacatgtagaatcgtacaagcagtcccgtatgaccacaagattatggaattatgtggcaagattttcaaatatgtctggggagcaattgtgtgatctctatttaaaagtttgtcaggaccaaatggaagctggagtcggcccctcacatggtggcaattttgcacccgctcctaacagaggttcttcaaatcagcctcatcctcctagaaaccaaaggtcaacaaggtctttccagcacactcccgagcctcttaataatggtgaaaacactgggaattcggaagcctggaagcgccggaggagagctgatcaggataatcagtttgacacccaaacgatgtatcaacctcctccatttatggcaaatggtaacaggtcccaggaatctagcagttctgctggtattcttggttggggtccagtcgaaatgagacgatatggcactgaaagatcaaagagaggtgttcatcccagtcgtttccctgccgggcatgggcctttgctttagctgaagtagtcagctttgtcaattcctaggagtcttcagcttctacgcaggtagaagtggagaattgaaattctttttaggcaagacaaaagaataagctgtcaatatcttgtctggatcacagcttggagtctgtgcctcgaagaaacggctgatgtgcacagaagattcctgacactgaaacaaatacatgggtcttgtaaaccgccaagaggaagagtctcgaaaattttgtcggtccagttttgtggtctaatagaagaagaaaatttccgttggggtctttaagaaggttcatctcaaacaaatgatctatagttcagcctcaatacatgtacggtcttttacagtgcattatatataatgaaaatttggtttagttggaaaaaaaaaaaaaaaaaaaaaacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannaaaaaaaaaaaaaaaaaaaaaaaaaaaaagggggggcccctttaagagacccaatttttacgcccgcgtggggcaaagtaaaatttttttttttggggcccccaaatt

SEQ ID NO: 1706 - DNA, 1088 bp, Triticum aestivum
  unsure (1)..(1088): unsure at all n locations
  Clone ID: PAT_TA_1706
gcaggcagtttactggaaaagaagaagagccaagtgagcttgagcttctttgcatgnaggcaaggaagtgggtcgaggacagagagctatttcttccagaagccggagttgaagacgacgatgatgacttcacccagttctctcttgacggcgaggatgattcagatgcatttgaatcaccctcattcagcaggtttggtcccatgaaggcaagccacaggaatccactgtcaaagctagccgagtgtgacgaggaggaggatgatgacaaggagatggtcaaggatgactctgaccccttgaacggtatgtttcctaagctggtccctcctgtctcaaagctgtccgcgtcgctgaaggggtttggtttccatgggaaagctaaaccctaccgcggaggcattccgaagacgaagagcaaggtggctgctaaaactaactatagtggcgaaggtagtatgtatcagtctggaagcaggagcgcgaacgagatgctccctcccagcgccagttttgtgaagctgtcggacatgggctccgaggagtggaccgcgttcctcgacaagttccaggagctcctcccgagcgccttccgagcacggaagcacgcggctggctccggcccgcgcccactgcagaggctgggaacttcttgccagttttgaaggtaatgtagatgcaacccaggtgtgcaggtgttttcttcgcggcagccggaacggaagcagccctacgcgcctgtaggtgtgtgtttggactacggaccgtggagaggagaagattagaggtggttcgataaaaataaagaccgtcccctttggcatgtgatcttccccgcagagtgtgtcttcgtgtctgtgcatagctttagcttttgacatatggaatggtttgttctttctttcgtctgtatatataccaagtactcctactcctacctcgcaacgccgggcgccatcacggctggtggtgccccggcggtggtggtcgtgttgagtgttgtcggcgccgccgctgttcggctttgccactgtaccattcncgagacagacgcttaccataataataatatagtattatgaataaaa

SEQ ID NO: 1707 - DNA, 778 bp, Triticum aestivum
  Clone ID: PAT_TA_1707
gagctggaagagagtttttgttcaaactgataatggttctgtcctgggcattgaactggagaggggagaaaatgcgcactctgtgaaaaaaaagctgcagatagctttgaatgtttccacagaggagagctcactgacctttggtgatcttgttctgaacaatgatctcagcaatgtccgcaatgactcgccgttgctcctcacaaggaatcagatgcaccggagcagctcaacaccttgtctctctcctactggaaacggcgtgcaacagcgagaccgtagtggacccattgctatccttggatgttcaagcccttcccctcagatgaaacagcttgctaaggatattgtcaaagccataaggaatgatgttgacccagtagctgttaacagtgggatgggtggtgcctactacttcaagaacatttggggtgatcatgttgcaattgtaaagccaactgatgaggaaccatttgctccaaataatcctaaaggctttgtagggaagacccttggacagccaggcctcaaaaggtctgtacgagttggtgagacagggttcagagaggttgctgcttacctccttgaccatggcaactttgcaaatgttcctccaaccatgctggtcaagatcacacacagtgtgttcaatgtgaatgccactgttggctgcaatcataagatgttccacaacaaatcacaggctgtgagcaagattgcatcattgcagcagttcatccctcatgattttgatgccagcgaccatgggacatcaagc

SEQ ID NO: 1708 - DNA, 2825 bp, Triticum aestivum
  Clone ID: PAT_TA_1708
atgggacatcaagcttccctgtatctgctgcaggaccggaaccattctcggctgtgacatgcccagaatctgcaacactgacaggaggcctttgagccggaggagggcattcgggcaatcttctggtcaggaaagttggtcctgggcaacggagtggggaggaacagaccgaactcattcctatcggcccccgattgcgtcgacccggtcgactggggcgccctcactgtccgtgggtgatcttgccgtgaccacgtatcgccgcctctctcgcagtgactcgatacatcgcctccttggatatcatacacgatggtgtcacgcaacgcctggtcattcccatgatgcgaacggcgtgcaagcgggtgatggtagtgtgacccatttctctccatgcgagttcagcctcttccctccggttgtaccaaataggtgagatcataggcaggcagtttactagcaaggtaatctagctacgtggacttggactgtcctgctccgacccaggtggatgctgctggcctggacagcagttttcggaaagaggaccctcctggaacaaaaccgggggggagaccctcgggctgggattgactttgtgtacaaaccgattacggttgagtcatccccattcagcaggacaggggggatgatggaccttacgagagaggcgacggcgtatggctcagtctggttccacgggcgcgagcgcgctgccctctcccagcgccagttttgtgaagctgtcggacatgggctccgaggagtggaatgcgttcctcgacaagttccaggagctcctcccgagcgccttcgaagcacggaagcacgctgctggcgccggcccgcgcccagaccagaggcgaggcacttcttgccactgatgatagtggccgtccccgcacatagcacacctggatcaggagcgcgtccgagccgctccctctcagggccaccctggtgatgctgacggtcgtgggcgccgaggagtggaccgcgttcctcgacaagttccaggagctcctcccgagcgccttccgaacacggaaccacgcgcctggctccggcccgcgcccactgcagaggctgggaacgtcttgccagttttgaaggttatgtaggtgcaaccaaggtgtgcgaggtgcttcttcgcggcccccggaactgagaaatgttcacgcgcctgtaggtgtgtgtttggcatacggatcgtggagaggagaagattagaggtggttcgataaaaataaagaccgtccccgttggcatttgatcttccctgcagagtgtgtgttcgtgtctgtgcatagctttagcttttgacatatggaatggtttagcctttctttcgtctgtatatataccagtgcattcttgacatccgaatctcccccgccgcctcgcggctggtggtgcccgtggtggtcgtgttgagtgttgtcggcgccgccgctgtttcggcttcgccactgtaccatttccgagtctttgtctgcccgaatgtctagaagacccttactttgaatggattcactggccacaagcatccatccctttctctgaggaggaacttgaatacattgcaaatttggatcctttaaaagatgctgagatgctacgcatggagcttcccatgatccgcaaggcatgtctgcgggtgctggtgctgtcaacaatatttctcaaggaaggtgcagcatttggcctctgcttgtccgaaataggagagatgatgagcaggcagtttactgggaaagaagaagagccaagtgagcttgagcttctttgcatggaggcaaggaagtgggtcgaggacagagagctatttcttccagaagccggagttgaagacgacgatgatgacttcacccagttctctcttgacggcgaggatgattcagatgcatttgaatcaccctcattcagcaggtttggtcccatgaaggcaagccacaggaatccactgtcaaagctagccgagtgtgatgaggaggaggatgatgacaaggagatggtcaaggatgactctgaccccttgaacggtatgtttcctaagctggtccctcctgtctcaaagctgtccgcgtcgctgaaggggtttggtttccatgggaaagctaagccctaccacggaggcattccgaagacgaagagcaaggtggctgctaaaactaactatagtggcgaaggtagtatgtatcagtctggaagcaggagcgcgaatgagatgctccctcccagcgccagttttgtgaagctgtcggacatgggctccgaggagtggactgcgttcctcgacaagttccaggagctcctcccgagcgccttccaggcacggaagcacgcggctggcgccggcccgcgcccgctgcagaggctgggaacttcgtgccagttttgaaggtagcagttcgtacccaaaggtaatgtagatgcaacccaggtgtgcaggtgttttcttcgcggcagccggaagcagccctatgctatgcgcctgtaggtgtgtgtttggactacggatcgtggagaggagaagatagaggtggttcgataaaaataaagaccgtccccttgacatgcgatcttcccgcagagtgatgtgtcttcgtgtctgtgcatagctttagtttttgacatatggaatggtttgttctttctttcgtctgtatatatacgaagtactcctcctacctcgcaacgccgggctccatcacggctggtggtgcccggcggtggtcgtgttgagtgttgtcggcgccgccgctgtttcggctttgccactgtaccatttccgagacgcttaccataataataatatagtatta

SEQ ID NO: 1709 - DNA, 801 bp, Triticum aestivum
  Clone ID: PAT_TA_1709
cggccgctcaggcggcgggtgggactcccaagacaagacaaaatggcagaaacagttctgaacaaccagcagccggctcagagacatggacagtagagaaagttctcagcggtaataagctggttcagtcatcgaactcacccatttcgtttttccatcttctcgggggtctaaagacaaccaagcgcgagggctggaagagacatggaattgaccccgagtcagtcgccgaccactcttatcggatgggtatgatagcaatgttcgctcctcaaggtctcaaccaggtcaagtgcatgaaaatgtgtcttgttcacgacatcgccgaatctgttgtgggtgacatcaccccgtttagtggagtgtcaagggatgagaagggcagaagagaggctgcaactatcgagtacatagccaaccgctggtctggaccgtacactgctgagataaaggagctctgggacgagttcgaggccgcagagagcccagaagctcagttttctcaagacatagacaagatcgagcttctgctgcaggcagtggagtacgaaaggaacagcgaaaacaaaaaggacctgggcgagttcatgggggtcgcacgtaagctacgatctgaagccggtaaggcatgggcggatgagatcctggctgatagagagaaattctgggaggggacgcagcatctaaggggagaacatgctgagaagggaggtctcacagaggagatgaccaaggcacacgatgcatactatggataattattggtaacgggtcacagatattcaaaacgtttgaccgatt

SEQ ID NO: 1710 - DNA, 894 bp, Triticum aestivum
  Clone ID: PAT_TA_1710
gcacgagggattcctcctccttcccctgccactctgccacccctgctccctctttcgtttgttccctccctgccttcaatccaaatctttccctcccgcctttaccactggtaccagcggacgacgaccattctccagatcacgcacgggcctccgctctccaggtgaccggccatgagcgtgcggggcgacccggcggcggcggctgctcccggggaggatacggcggaggagctgctggcgcgcgtgaggggcatggtgcaggcggcggtgggcgccgccacggccgcggaggggttcccgggccggtggaaggcgatcgcggccaagctgggcgcgctcccggcgcgcctgtccgacctgtccagccacccctgcttcgcccggaacgcgctctgccgcgagctgctgcactccgtggccgccacgctcgccgacgcggcggagctcgcggcgcggtgccggggcccgcccagggacggcaagctgcagacgcagagcgccatcgacgccctcggcgcccggctcgatgtcaacctccgcgactgcgcgctgctcgtccggaccggcgtgctctccgactccgacgcctccgccgtcgccgccccggccacggcgcaggcggacgtgcgggagctgctcgcgcggctgcagatcgggcacgccgacgccaagacccgcgcggtggacgggctgctcgacgcgctcaaccgggacgagaagagtgtcgtgtcgctgctcggccgcgccaacgtgtccgcgctggtccagctgctcacggcgccggcgcccaggcgcgggagaaggccgccatggtgatttgcggctcgccgagtcgggaggcggcgcctgcgaggggctgctggtgtcggagggcgcgctgccgccgctcat

SEQ ID NO: 1711 - DNA, 1015 bp, Triticum aestivum
  Clone ID: PAT_TA_1711
aactaaaaaataaatcccaccccatcttatcctctcgtcacccacccacctctctctccctgtgctcctcaatcaagtctacacgcctcccgttctagcccgccgccgcaccatctcctccccggcaccaccgcactactccctccccgcgccgtggcaccaacccctccccgtgccgccgcaccatcttctcccctgcactaccacaccacctcactccccgtgccgtggcaacaccccctccccgcgccgccgcaccatcttctcccaagcaccaccgcaccacctcactctccgcgccgtggcaccaccacctccccgcgccgccacaccctctccaaccacctccctccttgggccacctgcccccgcgtcagccagccatcgaatctgccccatcaccatcctccacgactacccgatgacagatccggttgtagccgtcctgggggcgttagcaatggccgactccaaggattggaggggttacgttgagcttgggggtcgccggagacccacccctccacccctgcccagatccatcaggtctggcagcactcccgcatcgatgcagctcacttcgtccatatgggtgtttttttggatcgaaatgcagctcacttcgcccagtttccggaacagcatgagcgtgcgggcgtccctgccctgcagccaggcgacagcacccgtgcagtccacaaacgaggccgtgaagttgaagagcgaccggtgaggtggccctttccagcgagaaaatcatgcagtgctgtcgagtgtggcgtgcagtgcaactcgcctcggcgtgcagtctacggctctcacctgcagctctctcctacacttcttgtttgcacgcggcgggagacaagtgcactgcactatggtggccggccgcataattatttctttagtagttcatctttgctgtttgttttagtttcaccatgtttgtggttcccttatggcatctcgtagtacgtattgcatatacatgcagttttttctaatgcgaaga

SEQ ID NO: 1712 - DNA, 764 bp, Triticum aestivum
  Clone ID: PAT_TA_1712
ctatagccttgcctgctcctccatcgtgccgtgccgccgccatgtccgcccccggccctatcgccggatcggccgtcttccccgcgcatcggctccaggtaagcaccagcggcagccgccggagcgcggcgtgcttcttgaggcggcagagcttcccgtccatctcgatccggtcggctccaacgaagaagcgcttcctccacctgccttgctcggccaagcaggacaccgtcgacaaggtctgcgggatcgtcaagaagcagctggccgtcgccgaggacaccgtcgtgagcggggagaccaagttcgcggacctcggcgccgattcgctcgacaaggttgaaatcgtgatgggtctggaggaggcattcagcatcacggtggacgaatcgagcgcccaggagatcaggaccgtggaggacgccgcgtctctcatcgacaagctcgtcacagacaaggattcttagaacaaatccgcctccatgcccctgcctgaatagctttttgggtgctcgccttgttgttgttgtactctaaatacagatatggaatgatgtactggctgaaactagctagccaggaagaggcttctatgcagagcttgtttttgtgtatgctatgctatcccatattgaataaatgaggggggtagcacttcttccccgaggcaaagattgctgttatgtatcctatcagtgtcactcagcactgctgagatgtttactctaacataagaaaatactccctccgttccaaaaaaaaaa

SEQ ID NO: 1713 - DNA, 1340 bp, Triticum aestivum
  Clone ID: PAT_TA_1713
cgtccgcccacgggcccgcggaggcgtgggcacggcgcacggcgagctcagtacagtacagcgaggggaaggagcactggggggacagtagctagcgttgcgagttccccggccaatggcaatggcgtggtggaagaacggcgccttggtcgccgcggcgaccctcgccgtggccgcggtggtctgcgccggcgtggcggcggcggcgagcaagttcgacgacgtggtgcagcccagctgggccaacgaccacgtcctctacgaggatgacctcctcaagctccgcctcgacagctcctccggcgggggattcgcgtccaagaacaagttcttgtacggcaaggccaccgccgacctgaagctcgtgccgggggactccgccggcgtcgtcacggctttctatctgtcgtcggcgggggacaagcacaacgagttcgacttcgagttcctgggcaacgtcaccggcgagccgtacctggtgcagaccaacctgtacatcgacggcgtgggcaaccgggagcagcgcatcgacctctggttcgaccccaccgccgacttccacacctacgccgtgctctggaaccccagccaggtcgtcttcctcgtcgacgacacccccatccgcgtctacgacaacaagaacgcctccgccaccaagcccaagggccaccaccgccaccccaacaacgccaccaccgccgccacccagacggcgtccgcgttcccgtcgccgcagcccatggccgtgtacagctccatctggaacgcggacgactgggccacgcgcggcgggctggtcaagacggactggtcgcacgcgccgttcgtggccaccttccgggacgtgcgcgtggagggctgcgcctgggccgccaacgcctccgactcggacgccggcgaggtggcgcgctgcagcggcagctcgtggggcaaggagggccgctactggtggaaggagaaggacatgcaggagctgtccgtgcaccagagccaccagctggtgtgggcgcgcgcgcaccacctcgtctacgactactgcgtcgacaccgatcgcttccccgtccagccgcccgagtgcgccggccgctgatccgccgcgtcgtcgccggccacctccgtcggaatcttaattagtagaatggatccatgacatcgatggatcgtcgcagctgctcgttttcagtttcgatttaggtccgcacgtctctccgatgaacttcgaccgtgtttgttatctctgccttgtagttccgttgttatgtggaggtgtcttttgtataaattcgtccgtggaaatgatgtcttttctctgttccccaatgcaatatctgttcgtccgt

SEQ ID NO: 1714 - DNA, 660 bp, Triticum aestivum
  Clone ID: PAT_TA_1714
caagagaaccaaacacaaactagcagccaggcacgcacgccgatccaggccagctgggagagatggccgcgttccacccacagcaccctctagcaacatgctactacagcgaggcgtcgaacttccactgcgccgcatgcgagcgcagagtcaccggcgatggctaccgctgcagcaagcgcgagtgtgccttccacatccacgaggcgtgcgccaagctcccgttccagaccttcttacaccagcaccccgagcactggctcactctcaccgacaccgaagcggccgtcagccgccggtgctacgtctgccggcagaacacgcggcgctatgtgtaccgctgcctgctgtgccaattcgacgtgcacctcgggtgcgtgcccgggccccagccgaatccgcagccgaactggccccagccctggcgccggaatccggagccgaaccgggacggggctcgccgcgctgtgcggattgcgggtacgattgcccacattgggctccatgcggcccacggcgtgcacggcttgcacggcgtggcgaatgcgatcggcagttggtttacgggcggcaactagcaactaccattaataatactagtaaacatgcacgtgcaacgcacgcattatgatctacaataaaacatctattttgaatccc

SEQ ID NO: 1715 - DNA, 1293 bp, Triticum aestivum
  Clone ID: PAT_TA_1715
gggcgcacgcgtccgcccacgcgaaacccctctccaatctgagatcccctcacgagcgcgacccggagccgaaaccctagagtagagcaggggcggcggccatggccatcatctcggacatccaggaggaggaggcgccgccgcagcagccgcaagcggccccggccccggcggcggtcgacgtggacctggaggtcctcgaggcggtgctcgagcgcaagggcggcgcgctcccgttcctccacgcggccatcgacgtcgcgcaccggcgctccgacctcttccgcgacccctccgcggtcggcaagatcaccgcgatggcctcggcgtgcagggcgcaggtggaggcggaggagaggaaggccagggatgccaagaggaaggcggcggagctggagaaggcagcggcggccgagaaggagagggtggtcaaggccgcggccgagaaggagaagcgggagagctcggtggtgacggaggagcggggtgcagggagctcggcggagaaggatggcagcacggaggtggagaagaaggagagcaaggcgaacaaaccaaatgctggcaatggtcttgatatggagaagtattcctggactcagcagttaccagaggttaatgtcaatgttcctgttcctgaaggaacaaagtcaaggttttgttgtctgttgagatcaagaggaggatcatctgaaggttgggcttgaagggccagcctcctatcattgatggtgagcttcacaagccagttaaaggtggatgactgcttctggagcatagaggatgggaaagcactgtctatactgctgacaaagcacaatcaaatggagtggtggaaatctgtgatcaaaggtgacccccaaagtcgacacccagaaggtggaaccagagactagcaagctttctgatctggatcctgagactaggcaaactgtggagaagatgatgtttgaccagcgccagaagcagatgggcctgccaacaagtgatgaaatgcagaagcaagacatgctcaagaagttcatgtctcagcacccggagatggacttctcaagggcgaagatagcttgagattggttggatccaaggggatgagaagtttttgatggataaatcgcatctatcctagttcttttcagtttcgggtgccttgtggttaagtgtctgattaaggtcgcgaaggacatggttttcgtgatgctttggaaatataagtgaactatgttttctgttgttggaacagatcgattgcctaagttgtctgtagtttgtgtttaaaaaaaaaaaagcccg

SEQ ID NO: 1716 - DNA, 1066 bp, Triticum aestivum
  Clone ID: PAT_TA_1716
actgtacaccccagcaggcagcagctgctcacctctttgctcacgcagtcacgctccagcctccaatggcctccgcttgcgatcgcctccgttacctcaaggccttcgacgacaccaaggctggcgtcaaaggactcatcgacgcaggcatcaccaccgtcccggccatcttccgccacccgccggacaccctggcgcgggcccacgacgaagaccgcttcgcgatcccagtaatcgaccttgctggagtgacgacggcgccgtccaggcgggccgagctggtggccgaggtgaaggcagccgcggagaccgtggggttcttccaggtgttgtttcacggcgcgccgccgccggtcatgtcggagatgctcgctgcgctgcggagcttcaacgaggagccggcggaggcaaggcgcccctactactcgagggacgggcagagccgcgtgaggtaccacagcaacttcgacctgttccggtcgccggcggccaactggcgagacacgctgtacctggacatggcgccgacggggccgtcgcccggggagatcccggcggcgtgcagaggcatcgcggtggagttcacgagggaggtgcagaggctcggcggcacgctcttcgagctgctgtcggaggccatgggcctccaccgtgggttcctggagcagcacgaagccggctgcctcgaggggctgagcgtcgtcggccactactacccggcgtcgccgcagccgcacctcaccatgggcacgtccaggcacaccgacccgtctttcctgacggtgctcctccaggatagcgttggcggcctccaggtgctccaccggctccggcgggatgatcagccggtctgggtcgacgtgcccgccgagcccggcgcgttcaccgtcaacgtcggcgacttccttcagctgctctccaacgacaggttcaggagcgtggagcaccgtgtcctctccaagagcgtggggcctcgagtctccgtggcctgctttttccggccgcatggcgcggctgcagctgccagggtgtgcgcccccatcctcgtcggcgacggcgccgcgag

SEQ ID NO: 1717 - DNA, 599 bp, Triticum aestivum
  Clone ID: PAT_TA_1717
ccacgcgtccggggagatgcagaggggggggtcgtcaacaaatcaaaggcctcgtgttggactcgacgtgtcaggattggcaacgcgccagaagagagggatgccaacccaagcagagtccctgccctcgaggcttcaatgagagcttatgcagacaacaaggttggcacggttgttaacccggcaatcggaactagctttgacacggttgaagaagcgtatgagttttacaacctatattcctgggagacagggtttggcgttcggtatgccaaaagcaggttaacgtccatcggaaaaagtgcatgcaggagtttgtatgcgcgtgtgcgggcaagccattgcagtcgaacagccgctcgtcgaggtgtggatgccctgcgttgatgcgggtgcttagatcagatgataaagggtggtacatatgcgaacacaaagcagagcacaaccattctgtatcggttaactgtatggagaagttgcactggaaatcacacaggcacatagatagatacactagagacttggtgaaacagctaagagaaaacaatataagcctgagcaaggtttatagtgtggttggcagtttttttggatct

SEQ ID NO: 1718 - DNA, 1208 bp, Triticum aestivum
  Clone ID: PAT_TA_1718
gctgctgcaaccatatccgctcatgaattctctgatgctcgcattgcatgtgcgaaagctattgcactcgtacttgttactgatgacttctttgatgttggagcatccaaggaagaacaagaaaacctcatagcattagtagagaagtgggatcaccatcacgaagttgagttctgctctgagcaagtagaaatagtattttctgctttttatagtacagttaagcacattggagaaatggcttccgcagtgcaaaagcgcgatgttacaaaacacctgaatgaaacatggctacattacttgaggtctgcagcgactgaggcagaatggcaacggaatcaatatgtgccaacagttgaggaatacatgatagaagcggttaactcattcgcagaggggcccattatgctaacatcactatattttgtccaacaaaaactcgaggagtacataatcaaagacccggagtacgatgagttgcttagaataaaggggaactgtggccgtctcctgaatgatactaggggcttcgagagggagtccagtgagggaaaactgaacatcatctcactgcttgttcttcagagtggaggttccatgtccatagaagctgctcaagaggcggtacaggagtctatagcctcatgtcggagagacctgctaaggatggttgttagagaagaccgtgtagttcctagggtatgcaaggaggtgttctggaggttttgcaggacagttcacttgttctactgtcagactgacggattttcctcgcccaaggaaatgctccgcacgatgaacgcaatattccgagagccactcaaactccaacataccagtcctttggatgctcagtcagaacaataatcaagcattccttatggtgttgtcaggattctcacaccgagatctgattgctacgcatgtcgctaggtaaaagggcatgcaactcatgaaaggatctccgtcatgtggtttgaacctttttggtcaatcaaatcgatacctcacctgcaaaaacaaaatggcatacatacttggaggtgtcgttttgagtgctattaaaaaatgtttgtttatgtgtttagacctaagtcccttagggaaggacctcttctaaacgcaatggcattgctatcgctctgttataccgcgctatttaaaacccacggtttaaatggaaaaaaagttgaaaaaaaaaaaaaaaa

SEQ ID NO: 1719 - DNA, 1332 bp, Triticum aestivum
  Clone ID: PAT_TA_1719
gaattcggcacgtgtggagtaaaaaggcagacgagagagattggttgcgctcgtcacaatctggcctaagtgatgctcgtgacttagcttcgaggagccggctccaatctcggtgtcctctctcactgtccctgaatcctacagcttcaattgtggccatccgttgcggatgatggtgctcgcagccgcagcgagcgcaccgtccctccaaggttggaaacgccagatctcagctgttacctgccagcatccacattcagtcccactcccacgcactgtgttcagagtatctgcaacaaagaataatgagaggaaacggagacgctcccggaatctgtccaaaggcccagcattaatcgccgaagaagcttccccgagcaacggcgaaaaccccaccaccatccttgatctcaatgtcgatgataatgctactagcgatgagaaagctgcgggtgccccaaggagtgctgttcttcagtcttgcaccctcacatccggcttgctgcttgcattaggtctccttcttcgtgaggcatcacacgttgcatcttcaaatggactgccgtttgctgaccctacggccgtatcattcaattttgaaacctggcatctcgagttggtcgccggactagtaatattgatatcgtctaccagatacattctgctacagatatggcccgatttcagagattccagtgaagccgcaaatacacagatccttacttccctggagtctctggattacattgtagttgcttgtctccctgggataagtgaagagttcctgtttcgaggggcattgatgccaatttttggattgaattggataagtgctctagcaactggtgtatttttcggcgttcttcacttgggcaacggcaggagatattcatttgcagtctgggcaacatttgtaggccttgcctatggtttagcaaccatagcttcctcaagcatcatagtcccaatggcttctcattccataaacaatattattggaggcttactttggcgcttcagggacagctcagaaagaagaaatgtagtttgggacacactacttgatactctaggcagcttcagggcacagtacttccccttcgaacagagttttcatttgcaacttctacttgtagcactagcgtagaatgtttagttcttactggactcgttcttaaatcagttaatgcatgtattatccgtgggtaagtagtcttcaaatcatttggtggtgaagtaagctaactagcgatgactgttttacttgtgtcatgttatcttccatgctttgtgagctgctgatactctggcgtataccgaatctaaaatcgt

SEQ ID NO: 1720 - DNA, 817 bp, Triticum aestivum
  Clone ID: PAT_TA_1720
cgacccacgcgtccggtctttgttcatgtatgctggtaaccgtggtggtgcatatgccaagaacagctttggaaatatctacactgctgtgggcgtttttgttttgggtcgcttgtttcgtgaagcttgggggagagaagctcctaaaatgcaagcggaattcaatgattgtctcgagaaaaaccgaataagcatttcaatggaacttgtcacggctgtattaggagaccatgggcaaaggcctaaggatgattatgctgtgattacagctgtgacagaattgggtcatggcaagcctcaattctattctactccaaagttgattgaattttgtcggaaatggcgcctaccaacaaaccatgtctggctattctccacgaggaaatccgccacttcattctttgctgcctacgatgctttgtgtgaagaggggacggcatacacctgttgcaaagcccttgatgaaatagctgatatatctgtgccagggtcaaaggatcatgtaatggtgcagggtgagattcttgaaggtctggttgcccgtattgtcagtcgtgaaagttcagttcaaatggaagaggttttgaggaactttccaataccttcattagatggaggtgactctgatttaggaccaagtttacgagacatatgtgctgctaatagcaaattaaagcactttttgaaaatgttggatcttcaatgtgtccagaccaccgtgattggtttggatacagtggtcttgagccccagtctcgaaatgctgataaatcagttgtcactcatttttttgcaagcacattccacggactatgca

SEQ ID NO: 1721 - DNA, 404 bp, Triticum aestivum
  Clone ID: PAT_TA_1721
agaagctaacactccgactccaaatatactcaagatgaaggtgttgccggtctagctcttgtgtcaaccaactcctacgacatatttgactcaccaaatgaaggaattggaagatgcttcatggccaaaggtcctaaggtaacacaccccgagtatgttgatttcaatagtgatgaagatgacttgttaggtgatgatttgcttggtgacaactctagtgatgaatactatgatgaaagatcaattaatcatgctaaaacgagtgacaatgataaggagaagattgaggctctaactaaagaacttaaaactcttaagttagctcatgacactatcttcgaagatcatcgagaacttttaagagctcatgagaaactacgctttgaaaagctcaatcttgagca

SEQ ID NO: 1722 - DNA, 812 bp, Triticum aestivum
  Clone ID: PAT_TA_1722
gtcgagagagagcgaggaggaatcgcctgccctaacacgatgggcgccaccggccagcgtcggatgtcatctctgcccgcggcggcggccgcgcctctcctgcttctgctcgccgtgtcctcctggagccaggcggcggcggctccggcctggacgacggacctggagaagcacgtggcgttcttcgacaccgacaacgacggcatcgtcaccttctccgaaaccgagcaagggcttcgtgccatcggtctcggagttctcgaggcgacggccagcgcgaccctgatcaacggagccatcggacccaagaccagacctgaaaatgctacgacatcgcggtttgacatctacatagcgaacatccagaaggggatccacgggagcgacagcggttcgtacgatgctcaaggaaggtttgttccggccaagttcaacgagatattcaccaagtacgccatggtcaagccgaacgccctgaacgaggacgagctggatgcgatgcgcactgccaacaggaagggagggtgacttcaaaggatgggcggcgtcgaaggcggagtggggcatgctctacagcctcgccaaggacaaggacggcttccttcagaaggacaccgcgcgcagcgtctacgacggcagcctcttcgctaagctggccaagaaggctgcttcgtctggaaattaaccgaccccgaccgtgatttgtaccccgtgttttttcttcgagatggaatttgtactccgtattattcgtgtcttgttcgttgaacatgtgctgtcgctgtacaattaaaaatgaaacctgttaatgc

SEQ ID NO: 1723 - DNA, 896 bp, Triticum aestivum
  unsure (1)..(896): unsure at all n locations
  Clone ID: PAT_TA_1723
aacaaggatggctgtgagcgattcacccagatctgacatctccttctcctccccgaagccatccatctccaccgtccgcgccaaggcatctcaaccccactcactctacttcgcgccttcaccatcacctcgcgcgccctaccagacgcggtggtctggtgcctcgcgcgacctctccctccagcctgcgcgcctctccctgctgtttccccgtttcttcttccctttgctgctcctccacctctcctcgtcccccaaactgtttgctgcttctccttctatgaacccttgctgctactccttcctctcaccttctccctccagttgctcttcctctcccgactttttcctattccttctcttcccttaccgctgctctctgcctaatctccccacgactctgttggccttctttccttaaacatgctgttactccttatctggccctactattgctactccgctctgccggctcttctctcctgcttctttgcgctgcaccctttactttaccctactcttgttcctctcctctcatccccaactgctgctctccttctcaacccccccgccggctctctctcttctcgaacctgctctcgctctctctctctttgatgctcctgtatcatgactggtaaaactttgcaatggcctcattcgctgcgcacttcctatctgatatttaaaacgttgacgtaaatcatctgctgctgcttcccttctctcttacgtctcgctgtgatcccccatgtgctaagtgaccgcctggcgctcggttagttcacggcgnggcgctgttcctgagcacttcntgtaacccctggtcgtatacatgtgtggtaagtgtatatgtatccccggtgttaacaagtgcatgtganaaaaaaaaaaaa

SEQ ID NO: 1724 - DNA, 836 bp, Triticum aestivum
  Clone ID: PAT_TA_1724
attcatcttcgcctcgggcccccaaacccactccctctctctcgcttcctcggcaacaagacgaacaactctggtttgagcacacacgccaatgggtatcttcagtggaacgcctcctccgagctgcccatcagctccgcattgcgcggaatgggctaaagtctatctgaagtactgcctgtgcagtactaaggatggtgttgccctgggtcttggactggctagtgtcctcagttggggtatcgccgaggtgccgcagatcataacaaattacaaacagaagtcaacagaaggcctttctattgcctttctgatgacctggatagttggggatttgtttaaccttgtcggctgtttcctggaacctgctactctgccgacacagttttacatggcattgctatataccatcacaactgtgattctcactggacagacaatatactatagccacatctaccatcttaaagtaaagaaaactggggtaactgccaagtctcagaaacatcaacgaggggatgcttcattacgtgaaaagcttttgggacatagggacgaggcattcaaaaataatattcagtcaggtccgactattcctatcccgagctcaccaatccaggtgaacacagaagtattccggcaacgtcatggttcagtcagccccggctcagactactactatgcgtcagcaagatctctatcgaggagcccggtgcctacaggtacatggttggggaataatcaccagacaacaaaagttcctccacaaatgagcgatgaaggtgaacctttatttggcgagtttgttccaacgcagtctgcaccagctgctatta

SEQ ID NO: 1725 - DNA, 825 bp, Triticum aestivum
  Clone ID: PAT_TA_1725
atcctttcacctcaccatccatcactcgctttctactcaatcttatacattcttttcttctctacttgattcaggaatcaaaaatctttcgccaaaatggttcgcatcacttccatcttcgctgggctgtcgctcgtagctggttctatcgctgccccctctcctgaaggcatgttctccacgcttgccaagcgaggtggtacccccaacagctcgggcatgaacaatggcttcttctactcttggtggtctgatggtggtgccgaggccacttatgagaacggcgctggcggctcttacagcatgtcttggcagactggtggcaacgtcgtcggtggaaagggttggagccctggaaaggctcgaaccatctcttacgagggagagtacaagcctaacggcaacagctacctttccgtctatggatggacccgaaaccccttgatcgagtactacatcgtcgaggatttcggcacctacgatccctctagcggagctcagagcaagggaactgtcgaggtcgatggcagcacctacgaaatcttcacccgtacccgtaccaacgctccttctatcgacggtacccagacctttgagcagtactggtccgttcgcaagaaccaccgatccactggcagcatcgatgttggtgctcacttcaaggcttgggagcagcacggcatgaagcttggtaccatgactaccagatcctcgccactgagggctacttcagcagcggatcttcccacatgaccgtctccgagggtgcttcttccgctggtggtgccgccactaatggcgacagtgctgctaagcctgatgctg

SEQ ID NO: 1726 - DNA, 743 bp, Triticum aestivum
  Clone ID: PAT_TA_1726
ctcgtcccccccgccccccaccgcggcctgatccacctcctgccctgcctggccgcgccgcccacccagcttcttccacctcaaggcgacggatccgggcccctgcgcggccacgaccagccccaaccgcgacatccagcggtgacgacccgatccatggcggcgtgctaggagctggatctcgacgggacggcggccgtccatgacgcagcgacgcggggtcgtgctcctcctgaagatcagcccggccggcagcgacgccaaacctcccctaaccccggatccacaccgcccccggcgggaatcaggtggacgcagtctaggtcgatccgctctgtccacggatccggcatctcctgcctcacatccggccgctacggggtcgccgctcctcccagtggacttgtccacttcctgcagtccacggcgcgggtgacggaccacctcgggttggtggtggacgtcggcgaccatcagtaaacgaagccacgccatggtcctggacatggacgacgcccggagggcaagcttcttccctatcggatccggccggaggtggtgccccaagcccaccattttgcacgcgaagtcactgcgatggatgggttctcttcatcctctccagcaagttctgcggcgagcagctgtcaccgcccactatcctacccacaacacaatgctgcaccgcggcgcatgcattgcggcagggcggcgcttgtactacggcgctcacagccgtgcgt

SEQ ID NO: 1727 - DNA, 645 bp, Triticum aestivum
  Clone ID: PAT_TA_1727
tcgacaccgcctcccccttctccccccaccgccgcgcgatcccatctgacgccgccccggccgacgacccccgcacgccggccgccatggcgcacggcgaccgcatgaccaccttcgaggagggcgagcgcgagagcgagtacggctacgtccgcaaggtctctggacccgtggtcgtggccgatggcatgggcggtgccgccatgtacgagctcgtccgtgtcggccacgacagcctcatcggggaaatcatccgtctcgagggcgattcagctacaatccaagtttacgaggaaacagctgggctaacggtcaacgatcccgtgttgagaacgaaaaagcctctttcatgtgagttgggacctggtattcttggaaacatctttgatggaatccagcgccctctgaaaactattgctattaagtccgagatgtctacattccacgtggtgtttcagtccctgctcttgataaagatcagcagtgggagttccagccaaataagctaggtgttggagataatatcacaaatggagatctatacgctaccgtatttgagaacacattgatgaagcaccatattgcgctccctcctggtgctatgggaaagataagttacattgcccctgcgggtcagtacagtct

SEQ ID NO: 1728 - DNA, 3139 bp, Triticum aestivum
  Clone ID: PAT_TA_1728
cgtccgggttcttggaggaacatgtgctattcctggagctttcggttgtggaaaaactgtcattagtcaggcgctctcaaagtattccaattccgacactgtggtgtatgtgggctgtggagaaagaggaaatgagatggctgaggtcctcatggacttcccccaattgacaatgacgttgcctgatggacgtgaagagtcagtcatgaaaagaacaacgatgtggtcccccctacaccacctcttcggggctccaggcagcgtctccagcccagatggaccgcggctcctcgccccccttctccccccaccgctgcgcgatcccatctgacgccgccccggccgacatctgcagcacgccggccggcatagcgcacggcgaccgcccgacaaccttcaaggaggccgcgtgagagagctcgagcggctaggtcggcaaggtcaccgcggctaggtgttgtagccgactggaccggtggtcgggcctgaaggcatcgggcgtgccgcgattcaccaagctagaagcttccgccggcgaaatcattatgtgcgcaatgatcgattccgaggtacaatccaacgtctattaaaatacagctggactaaggtgggctatctgttaacgataaccgtataggagctcccatgagccttgggtcatgttgttgttggcaccctgttatcctggataaaacgcgctgtgtagtagatccccacagcgccctgtgagaatcacaattgcttgttaagtcactccgtcctcttgataacattcagatgttgttgtccctgcaattcacagtattgtgcagggctactggcaactagataagaagctggctcaaagaaagcatttcccatctgttaattggctcatttcttactcaaaatactccacggctttggaaggatactatgaaaagttcgaccctggctttattgacatgagaacaaaagctcgtgaagtgttgcagagagaggatgatctaaacgaaattgtccagcttgttggtaaagatgcactgggagaatctgacaagattacgttggagacagccaagcttctgagggaagattatttggcacagaatgcttttaccccatatgacaagtattgtccattctacaaatctgtctggatgatgcgcaacattattcatttcaatacattagcgaatcaggctgtggagcgagcagccaatgctgatggacataagataacctacgctgtcgtaaagagtcgcatgggcgatctattttaccgccttgtatcccaaaagtttgaagaccccgccgaaggcgaaagacgtcctaatcgcgaaattcaagaagttgtacgacgacctcacccaccgggttccgcaacccagaagtgcagcgtctagttaaaaaggaatgacgaatgctggatgctacggtgacatgggctaaaatgttagtatgatggctaatttcacggccaggtgggccgaagcattgcgtttaatttccggacgtttggttgaaattcatgcggaaagtactttccatgcgtctttggcttcacgtttgttgtccttatacgaacaggctgggaaggttcaatctcttggcagtccagatcggacaggcagtgtcccaattgttggcgccgtatctcttcctggaggagatttttctgatcctgttacctctgcaaccgtcagtattgtgcaggtcttctggggactggataagaagctggctcaaagaaagcatttcccatctgttaattggctcatttcttactcaaaatactccacggctttggaaggatactatgaaaagtttgatcctggctttattgacatgagaacaaaagctcgtgaagtgttgcagagagaggatgatctaaacgaaattgtccagcttgttggtaaagatgcactgggagaatctgacaagattactttggagacagccaagcttctgagggaagattatttggcacagaatgcttttaccccatatgacaagtattgtccattctacaaatctgtctggatgatgcgcaacattattcatttcaatacattagcgaatcaggctgtggagcgagcagccaatgctgatggacataagataacgtacgctgtcataaagagtcgcatgggcgatctattttaccgccttgtatcccaaaagttcgaagaccccgccgaaggcgaagacgccctaatcgcgaaattccagaagttgtacgacgacctcaccaccgggttccgcaacctagaagacgaggctaggtaaaaaaggagagaagaaacattgtgtatggccaccgtgtaaacaataaggagcaccaaatgctgtgaacgacttgcgagcaatttgctttttgcttcaccggagtttgtgtagatgcgaattacgtttcaggaccccctcccccctttttttttgcgacagacagacagacagccttgttttttccccaggatttttacattgtttggtctccagcgccaggatgcacgccattattttttcaccatgtgtaccattatttgttgtataagaagactgagcaccggtggacatgttcataggaggaataagcacgatgtccatctacttgaacatcaataatgtatatattaatatttatgtccgtggagcgagcagccaaggctgatggacacaagataacctacgccgtcgtaaagagtcccatgggcgatctattttaccgccttgtatcccaaaagttcgaacaccccgcaaaaagctccgacgccccaaacgcaagataccagaccttgtccgcaaaattcagtacctggaccgagaacctaccacccgggtccagaaacaaagaggaaagggtaagtatagaaaacgaacaaggaataatgagtaaggaccaccgtgtaccaattacgagcaaccagctcttggctcccccttccccgcattttgttttgcttcgactgaggtttccgtaccccctatttccttttacggaccccccccccccttttttttggatccacaaattgtactgtttttcgcggcatgtttccagtgtttggtcttcagcgccaggatgcacgccatgttgtttgtcaccttgggtgcctgtactccggtggacatgttcatagaggaataagcacgatgt

SEQ ID NO: 1729 - DNA, 804 bp, Triticum aestivum
  Clone ID: PAT_TA_1729
gccctcccccttccccggcggccccccgccgcgacgacccccccgctgggcccctcccgcgccgcaccggccgcctcgagctgaccgggcacccccccccccgcccatcccccccccctcctcgtcccctccagcctcctcgagcaggcggcggccaagggtcaacccccatcggcgtatggccacgggcgcgaggagcaccgcggtgggcgcatccggcggcgcagcgcccgcgtccagaggcgtggtgacctccacgcgcgcccctcccagcgccatggtggccgcgtccatccttggcggatgaggatgaggcgaaaggaaaaagaagacgaggcctggcatctcaccggcggcgagtcctcctttcctttctcactttctctgttctcttttcttctccctggtatgaacaattgatgtgtgcaatgttataaaatcgggaagagaacaccgttttttctcgcggcagtcagatcggtcattgaatcgacgacgctgacaccccttgttcttcgtgggcttcttgtgcaaatcagagaagaaagagcgcctgattctttggccatcttgtactgcaggacagcgagatgtacctgttgggcggagttgaagctcgccggagttgctgtctagtccgtgccgggaacggtgtcgtcagccttgatttcttttccttgaggccttttcgctctcggcggagcaaagtgcatgataacgtgttagaagaaatcgagagacaacaagagacaaacaaaatgattcaactctcttctttgttgatgatacaattacacaatatat

SEQ ID NO: 1730 - DNA, 617 bp, Triticum aestivum
  Clone ID: PAT_TA_1730
cgcgccggtggtcgatggcgacggcgacggcgacggcgagctcttcgactgcgccatctgcatggagacggtgcccggcgtccgcaagttcagcgtcggctcgtgcggccacgccttctgctcgggctgcgtcgcccagtacgtcgctgctaagctgggcgagaacgtcgctcgcgtcaaatgccctgaccccagctgcaagaacggcgccgtcgagccggagagctgcttcggcatcatctcctcggacctgctcgacaagtggggtttcctgctgtgcgagtccgcgctcggcggcaagaagatgtactgcccgttcagagaatggtaggcgcctcttctcgccgacggcgagggcggggcggcggcgatcgcggaggcggagtgcccgcactgccacaggctgttctgcgcccggtgcgcggcgccgtggcacgccggcgtcgggtgcaaggagtttcaggagctcggccaggacgagcgcggccgggaggacttcctgctgaggcggctcgccggacggcagaagtggcagcggtgcccccaaggcaagatgtacgtggagaaaatcgaagggttccactacattaaaaatgcagttgtggatgcaactttct

SEQ ID NO: 1731 - DNA, 1611 bp, Triticum aestivum
  Clone ID: PAT_TA_1731
ccacgcggcccgggcccaccccaccccccccgaggagcgacacgaacaacccgccggccgacgggaaggacggccgcccgcagccacgcggacgccgcagcggccaccggcggtggggggcgggggccggcggtcggccggcccgccgccgcccccggcgccgccggcggggcggcggcgcgccgggcccgcggcgccggccgccgccacccccgcccgcccctccgcctccgccccctccccctcccgcggccggctgccgatccatgcgcgcgcgctgatcgaccaccagccaaacatttacgatgttgtccacgtgaagtacttcgacgacgagcctcttaagttggacttcgtcgtaagctttccggcgcacggctttcacttgcgcttccgagccctgggtcggcacgaggcttcggtctcttcggagttttgtgacggtaatggcactgcaagtgcgttttcgcgacggctttaaagtggcgggccatctgacgctagctactttcgctatctgtttatgctttccctgggaatatatgatacagaggaagggacatgtataccctggggtattgagatttatcattcgcattccctatccccagtcaatatacaaatttcttcaacaatggggtaagtggcagatttgcccctggaatttcctgatggaacaactccggttacgtgccgtgtttctatatatgatagctcaacagatagcaaagttggtgttggctcattgatggataaggcagttgttcctgccttacctgcgggcagcctatatatggaggaagtacatgcaaagcttggtgaagaactttggctcactactggggggcagcatattcctttcggagcatcgccccaggatatctggaccgaattgggtcgtccatgtggtatccaccaaaagcaggtggaccaaatggttatacactccgcatccgatctccgtcctcggactactctttgtggagactacttctacaactacttctcgcgtggtatagatatcttatttgatggtcagacacacaagataaagaagtttgttttacatacaaacttccctggtcattctgatttcaattcatacatgaaatgcaactttgttatctatgacgctgaagctgaaggggcacagcagccgggtaacacttccaagaattgcataacacatcgatcaaaatgggaacaagtcaaggagatccttggttgactgcggtcgagcagcaatccagacgcagggctcgatgaataacccatttggatcaactttcgtctatggataccaaaatattgcttttgaggtgatgaaaaacggatatatcgccaccgttactctcttcaagtcatgagtagcatatactcgcacccgcacccgcacccgcacctgatgtccgcggtatgcaaaatctgtgaaccgtgccccttgccccttctttacgttatcaattatctcgtatttcccactcagtgtacaggatccgcgttcctcgggtctcacagtaaatatccttccatcactattgttttaagaactaattaatcaggatgtcggcgtgattccgctgcaccctgaaaaaaaaaaaaaaaaaaaaa

SEQ ID NO: 1732 - DNA, 1377 bp, Triticum aestivum
  unsure (1)..(1377): unsure at all n locations
  Clone ID: PAT_TA_1732
atatcccggagcgaacgaacagaggagagttcgtaggctctcgtagcctccgccgcggcgccgcccatccggccggagcctccagcagcgacgcctcctgcctccccggagcatcctcgcccgcccagcagcgactccctccccggaacagccgcccccgcccaaatccgccgcccggagccacgccgacgcgcgctccctcccacctccctcttctcggggacgggattggggccgaggaggagcctgcccttgtcgccctgcagctcccgctccaacgggctcgcccacgagtctagcagcaccagccgctcctcccccctccgctcaaccaaacacaaccttcgcctccccagcaagagcttctcgagatgcccgccgcggtgatgcgctgccccttcctcctcgggcggcacccagcggccgccctccgacactcctcctcctcccgcatgcgtcgtgtgcgcagagctgcggggagtgggggccagggacggtcaccggcgtatggtgggctgctgctcgacgccggtggcacgctgctgcagttagcgcagccggtcgccgagacgtacgccaccctcggccgtccatatggtgtgatgaagtccgaaaagtacatcatgaagggattcaagcgggctttctcggcgccatggcccaagacgctcaggtaccatggtgatgggcgaccgttctggaagattgtcgtggcggaagcaactgactgcacaaacaataattatttcgaagaagtatatcagtactatgcacatggagatgcatggtgtctgcctgatggagcttacagaacactgcatgatttaaaagatgctggagttaagctagccgttgtatctaacttcgacacacggttaaggaagttgctcaaggatctcaaacgtctcagatatgtttgatgccatcgtggtatcatcggaggttggatatgagaaacctgctctagagatcttcaaaatagcattagaacaaattggcgtggaagccagaaatgcagtacacgtaggagatgatgaaactgcagacaaggcgggtgctaacgctattggactcgagtgctggctgtggggagaagatctgaaggaattttctgagatacaacaccggatcgtagcaaaacgcttacgatgagcgagcacagggcatcgtctctgtttgcctgattcgttcatttgattgctaaggggccctaataacagttgcgattttgccaagtaaatctgtttctccacnacggtctgttgacgtccttgtaataagcgccgagaagaatggtactactcngtggtacatgtgcaaatacttttcggctttcggccctaatgatctcttcatcgccgccttggcgtgtgtcgc

SEQ ID NO: 1733 - DNA, 358 bp, Triticum aestivum
  Clone ID: PAT_TA_1733
cggacgcgtgggccaagtacatccattggccacccacccacccacacacgacctacacccccactccacccgacgagtagctagctagccagcaagagagtcccagggggcgaccagctgccactgctcctcccctagaggcactcaggcgagctaggctgcctgcggcggcctgccggtacgcggggagaaggccaagaggctcgtgaggacaatgcatggcatgtgttaacatgtacaacccggtgcaccaccagtcgtccttcatggcgccgcggatgtccttctccagcgacttcgcgctggagccgccgcccgcgtaggtgctgacagcgcgcgggcccggtgacgccaactt

SEQ ID NO: 1734 - DNA, 693 bp, Triticum aestivum
  unsure (1)..(693): unsure at all n locations
  Clone ID: PAT_TA_1734
gctcgaggcaaattcggcaggagcacttcctcttcttccaatctcgcacacctctcggagctaggcggagcggcgatgtcggggcgcggcaagggcggcaaggggctgggcaagggcggcgccaagcgccaccggaaggtgctccgcgacaacatccagggcatcaccaagccggcgatccggaggctggccaggaggggcggcgtgaagcgcatctccggcctcatctacgaggagacacgcggcgtgctcaagatcttcctcgagaacgtcatccgcgacgccgtcacctacacagagcacgcccgccgcaagaccgtcaccgccatggacgtcgtctacgcgctcaagcgccagggccgcaccctctacggcttcggaggctagatccgtgggttccgcgggtggcggtagcggtagttgggactgtgtctgtcgtgtgtcctctgtgatgtgtgctgtgggagatgggatttgctaccgctttggcgtgcgtcgttgtgttccgtgtcttgtgttcataggctgtaataccttgttgcggtcaattttggcgtgcgtcgttgtgttccgtgtcttgtgttcagtaggctgtaatatcttgttgcggtcaatgaaactagttctgttctgaaaaaaaaaaaaaaatgcaaaaaaaaaannnnnnnnnnnnnnnnnnnnnnnnnnnnnnnn

SEQ ID NO: 1735 - DNA, 406 bp, Triticum aestivum
  Clone ID: PAT_TA_1735
cggacgcgtgggcttctctgttttcggagtactggggctaacgacagcaatgccgacagccaagggaggaattggaaggattcagttcactatagcaccgctgccatcattgttgtgatgagcgccttggcgctgctgcttccgtgtggtggcgctgttcaacgtccgctacaaaaccaaccaggatgagctcctctccttgcctccggttctaacatacatgcagcaatcaaaataaatggctatgaatgagaaagataaacttgcaaagataattcatttgtttagaactcaagaagaaatagaaaacttgaggagttgaagttccttctcgtttgctcattttcggtggttcaggcacgtgtcgttgatgttggtcaagccagtgccctcctcttgaactaat

SEQ ID NO: 1736 - DNA, 700 bp, Triticum aestivum
  Clone ID: PAT_TA_1736
cttcgcaaaccccgtcctacccgcccatccagctcatccccgccaagcgccgccgccgcaacaaccgccgcacccaccgcggcgccaacggcgcggagccagggtggtacaactacgacgcggcggacattgccaaggtcttcgaggtcctcaacgacgagcagctgctgaaggaggtcgtcggcgacgacggtgcggcgcccctcgccgtggtggcgacgccgtcccccgcgctttggtcgagcttcggccgcagcccggcgccggtgaggcagctgcggatcaccgactcgccgttcccggtgagggacgacgcggcggatctggagggcgcgctggtggaccgcgaggcggacgagttcatcaagaagttctacgaccagctgcgcaggcagcagaacctcgccgccgccaccccggagtacggctacgcgggtccggctgccggcgtcgcgtactaggagcttatattagctgcctacgtgccgatcaaagcttccctataggtgttagctacttcccgcatgcatgtcttttgttccaagtgtgaagtgtgaacctactttggctccagtacatatgtgtttgtgatcttgtgcatagatcaagcatatgtttgtacgtagagagcttaattacagtactgctctaataagtttcttggacctgtgagatttttcgtgtttaatcagttagatcg

SEQ ID NO: 1737 - DNA, 2227 bp, Triticum aestivum
  Clone ID: PAT_TA_1737
ccacgcgtccgggccaggagaccgaacacgcccgattctcctaaccctaaacggctaaaccctctcgtccctccccatggcgtcaccgccgccgccgccgccgaagcttccgatccccggtcgccgcaacatactcatcaccagcgctttgccctatgtcaacaacgtcccgcacctggggaacatcatcggctgcgtgctcagcgccgacgtcttcgcgcggtactgccggctgcgagggtacaacgccatctacatatgcggcaccgacgagtacgggacggccaccgagaccaaggccttggaggagaagtgctcgcccaaggagatctgcgacaagtaccatgttatccatgacgaggtctacaagtggttcgacataaagtttgacaagtttgggcggacgtccgctcctgaacagacagaagtctgccaggcaattttccataaactgatggaaaacaaatggctcacagagaacaccatgcagcagctttattgtgacacgtgtgagcgattcttagccgataggcttgtggaggggaaatgtccgacagaaggctgtaactatgaagcagcaaggggtgatcaatgtgaaaactgcagcaaattgttgaacccaactgagttaattgatccaaagtgtaaggtctgtaagaatgctccacgtattcgtgacacagatcacttattcctggagcttcctctattgagtgataagttggtaaactatattaacaacacttcagtagctggtatgtggagtcaaaatgctattcaagcaacaaacgcatggttgaaggaagggttaaagcaacgctgtatcaccagagatcttaaatggggagttcctgttccacatgagaagtataaagacaaggtgttctatgtctggtttgatgcaccaattgggtacatatctatcacagcatcatatacgcctgattgggagaagtggtggaaggatcctgataatgtagagttgttccagttcatgggtaaagataatgtgccatttcacacggtcatgttcccttcaacactactgggaactggtgaaaactggacaatgatgaagaccataagcgttactgaatatttgaactatgaagcaggaaaattttccaagagtcatggtattggtgtctttggcaatgatgcgaaggctactaatattccgtctgaagtatggcgatactacttgcttatgaaccgccctgaggtatcagatacactgttcacttgggctgatttacaagctaaattgaacagcgagttgctgaacaacctgggaaacttcatcaaccgtgtgttaagctttgttgcaaaaccagctggagccggatacgactccatcatacctgatgctcctaatgcggagtcacatccattgaccaatgcacttgctgaaaaaactaataaatgggttgaacaatatcttgaagcaatggagaaggttaaactgaaacaaggccggaacagtgcgatggcggtttctcgccttcgaaatgcatatttgcaagagagccagttttggaggctttataaggaagatccagcaacctcggccgccgcgacgaaaacttcagttggtgttgtttatctccttgcctgtctgctggagccttttatgccttccttttctagagaagtgctgcaccaattaaatatgtccccagatgaagatctgtcattctgtgatgataaaggagaaactgccaaggcaaaaagaccctgggattttgtatcagcgggacataaaatagggaagccagtccctctatttaaggaactgaaagacgaacaagtcgaggcgtttaggattaaattcgctggcagccaagctgaaaggatcttgaaggaacaagctgatgccgaggccaagaaagttgctgaaaagctcaagggcacaaaattatctgagggaagttcaaagaagaaacaatctggtggttcgaaatcaaagacagcagaggaagtctcagttgccaagctggatattcgtgtagggcttatcagaaaagcagagaagcatccagatgctgattcactttacatagaagagatcgatgttggagaagaggcaccaagaacagtggttagcgggcttgtcaaattcatccctcttgaagaaatgcagaaccggaaagtttgtgtgctctgcaatcttaaaccggtggcaatgcgcggtataaaatcacatgctatggttttggccgcatcgaat

SEQ ID NO: 1738 - DNA, 711 bp, Triticum aestivum
  Clone ID: PAT_TA_1738
ccggccgggccggggtccccaccaggagacacgcccgtgcgaaacggcctcgcctcgtgccagcaccggcaccggcgcctcggacaatcgccgacatggccccggagatcctcctccgcctccctccagacgaccccgcgcgccttatgcgcgcctccctcgtctgctggcgctggcgccgcctcctcaccgacccggcgtacctccgccgctaccgcgcattccatcgaacacctcccatgctcggcttcgtcctcaacctgaagcagcactaccaaggcatggcccagctcgtccccacctcctctttctgccccgccgcctctgaccgccccggcctgaatgtgctggacgcccgccacggccgcgtgctcctccacaccgctcagggccagcgcctcgtcgtctgggaccccgtcacgggtgaagagtgcaagatccctcgcgtgccggcctacgcgctcggcttcaacgcggccgtgctctgcgccgcggtcggctgcgaccacctcgactgtcatggcggacccttccgtgtcgccttcgtgggatgcggcgaacgcggcatcacgttcgcctgcacctactcgtcggaggccggtgcctggagcccgcgaattgagggcgagcagccggcgtttgttgacaggcgaacgaccgtccttgtggggaacatgctccacttcacctggagaccatacctcaatttca

SEQ ID NO: 1739 - DNA, 1071 bp, Triticum aestivum
  unsure (1)..(1071): unsure at all n locations
  Clone ID: PAT_TA_1739
ccgggacccgcggtggggccgcggccaggagacgcccgggggggacccgctgctggccagcaagtacgccgtcggatacgtcacggggctccaggacgccggcgcggcgggcgtcgtcgacggcgcgctcaaggtcgccgcctgctgcaagcactacaccgcctacgacgtcgacaactggaagggcgtcgagcgctacaccttcgacgcaaaggtgtcgcagcaggatctggacgacacgttccagccgccgttcaagagctgcgtgctggacggcaatgtggccagtgtcatgtgctcctacaacaaggtgaacgggaagcccacctgcgccgacaaggacctcctcgccggagtcatcagaggagactggaagctcaacggatacatcgtgtccgactgcgactccgtcgacgtgctctacacccagcagcactacaccaagacgcccgaggaggccgccgccatcaccatcaaatcagggctggacctcaactgcggcaacttcctggcggagcacacggtggcggcggtgcaggccggcgagctgtcggaggaggacgtcgaccgggccatcaccaacaacttcatcatgctcatgcgcctgggcttcttcgacggcgacccccgggagctcgccttcggcagcctcggccccaaggacgtgtgcacgtcttccaaccaggagctggcacgcgagacggcgcgccagggcatcgtgctgctcaagaacaacggcgcgctgccgctctcggcgaagtccatcaagtccatggccgtcattgggcccaacgccaatgccagcttcaccatgatcggcaactacgaaggcacgccgtgcaagtacacgacgccgctccagggcctgggcgccaacgtcaacaccgtgtaccagccggggtgcaccaacgtcgggtgcagcgggaacagcctccagctcagcaccgcggtggcggccgcggccagtgccgacgtgaccgtgctcgtcgtcggcgccgaccaagtccattgaacgcgagaagcctggacaggacgaagcctcctcttgcctggccagcanacgcagctcgt

SEQ ID NO: 1740 - DNA, 1481 bp, Triticum aestivum
  unsure (1)..(1481): unsure at all n locations
  Clone ID: PAT_TA_1740
cttttacccaagcgcgatctgacccaacggcgaacgcggctctagacccagccgccgacaccaccgcagccccctacagtttccgccgtgccgcatcctacgacaccaccgacgcctcaccagccacccccaacactccgcctcccacgcgcgtcacccccgtcgccgtccccgttccacctcctcgccccccctgccgccccccaccccgtccgcgatcttggacggcattggttcctgagttattatcatggcagcaatgaatagtgatctgggtggcttaggtcctaggcctgcaaatgcaccaccaaatccttttgaaagtgccatgtatggtgctggacctggacttatccgtactggacttggagcatatggagagaagcatttcttggttcgagttctgagttcatgcagagcaatattactcaatatttgtccgaccctcaatactattttcaagtcaacagccagtatgtgaggaacaaactgaaggtcgtcttgttccctttctttcacaggggccattggacgagaataactgaacctgtaggaggaaggctatcgtacaaacctccaattcaggatatcaatgcaccagacctgtacatccctttgatggcgtttggcacctacattgtcattgctggatacgcattgggagtccttggaaggtttacccctgaggcactgaccctacaattcacgagaggtctagttggctggtttctgcaagtcgtcctcatcaaaggtttgctgtactccctgggcagtggtgaagcgccattgctagacattgtggcgtatgctgggtatggatttgctggcacatctcttgcgatgctggcccgcatcttctggagctacttatactacttcatcatgccatggttctgtctctgcactggcgtgttcctcgtgaagaccatgaagagggttcttctgggtggaccaaggagttacgagcggcatccgagtcgaaaccactactttctgctcttcctggcggttgttcagttcccgatgctgttttggctcggcaacatcagtggttgatcttcccgtcttatggtcgagcttggtaacgtgaatcgaactttaggaggatgctgtgcaggatacactcgtggttaacttctcctggtgaacttggtaatagctcacctaattgcttaagactcttgtgaagctagtagagatgtctggataaacagatgaaagcgcatgtaactagctttctcctggaggcgagtgaaatatggtcacttgggataggatggagatgaattgctacacgtatgcattttgattcctaccttactgcctcggatttgtttttttgttttttggtccctcttgtattcctggaactgtttcacttgaattatgaagattacgttcctgtctcccaaccaaaaaaaaaaaaaaaaacaaaagaataaaaaaaaagaaaaanagaaaaaaaaaaaaaaaaaaaaaac

SEQ ID NO: 1741 - DNA, 1733 bp, Triticum aestivum
  unsure (1)..(1733): unsure at all n locations
  Clone ID: PAT_TA_1741
aactgacgctccgacccgcgccaccgcacagctcccaggcaccgagaactcctgtgctgcccatctccccctcccccccccctctctctccctccactgagtctcctgtgctgcccccgctgacctgcggccaccgacggcgagtggaggttcccgccgcttaaccgactcgcgggctctcctgcggcgccgcgtcagggctcacgcgggctggtgctgatttgggagagattcggggcgggccggagccggcgcggcctctggggatggggtggtctttcctgctgcaagcggtcgccttgctcgcaaccaggtccgggccagacagaagcaagtaaagtaagaaggacaggacatggcgcatcttctcactaaaggagcttcagttggcgaccaacaatttcaactatgataacaagcttggtgaaagtggtttcggtagtgtctactggggccggctctgggacggatcacagattgcggtgaaaaggctcaagagttggagcaacaaggctgaaaaggagtttgctgtcgaggtcgaggttttggcacgagtgcggcataagagcctcttgagcttacgtggatattgcgctgaaggccaggagcgtctgatagtctacgactatatgcagaacctgagcttgcactctcacctgcacggacagcatgcagctgaatgccatcttggttgggagcgaagaatgaacatcgccattgattcggctgagttcttcgcttatcttcatcaccatgcgatcccacataacatccatagagacaaaaagacaagcaacgttctcttggatgcgaatttccaagcgcgggtcgccgatttcgggtttgcgaaactgtatgcgatgcttggcaaggctaaagaaagctgcgatatctacagcttcggagtgctcttgctagagcttgccagcggaaagaagccagtcgagaagataaaccctacgacaaagctcaccatcaccgagtgggcgcttccactcagcacgcgagcagaagttcaaggagatggctgacccgaagctgggggcatagctttgtcgacgccgcacccgtgagcaggggtgctcggtcagggcttgcttgcactcaggggatagccatgccgaggcccaggtgaagcggatggtgctcgtcgggcttgcttgcactcagaccaagccagaacagaggccggtgatgtccgaggttgtggagatgctcaagggggaatctgccgagaagttctccatcttggagaatgacgatctgttcaagcctcaacagacgaccagctccgtccagggcacctctggcccctgcagctcggacgccatcaccgaagagaaggaatcgaaagaggatacgatcgaggaggcgactgattcgagcgagacggttccctcagctaggtagtgtgatgcacaaaggtgtgtatatcccttcctgggatgtgtgatttgtgtatgtctgtgcgtatggttgtttcttgttggcaagttacttgggcccttcaccagtctagagatgtacttgtggttccgtgtattgttgatttcttttggcaatggttgtgatgtggcttgtaagactcttattggactggttccgacaataacaagctgttcatgagttcctgtactcactcaatttccgtacaatccccnaatgatctatannggtcangcctctttaactcgacngaaacccgggtacaantancctgagaancccttccn

SEQ ID NO: 1742 - DNA, 968 bp, Triticum aestivum
  Clone ID: PAT_TA_1742
gtccgcacccgcttcaatccctcgcaagtacccactcccacgccggcggcggcggcggcggcggagacggaggctagcgaccacaacagagaggagctccgaccggcaacgtctcagctcataaatggacagcggaagcgactccgacggcgcccccgaggagctcaccgccgtccagggtgtggagaaacatgaagaaatcagcaaagtagagaaggacagtgctgtcagagcaacccaggaggagaaagaccggaggaaacgctgggcccaacggaaaacatcctcaaaaccgaataaaaagaagcctctgaaagtagaagataaagatacagaagtggatgaggagacacatgctatgcctgggacacttcccccaagagcgtaattgaaatgcttgcagcacgtgagaagcaaaccttctcatcagattctgaggaagaaaatgtaaaccagaacgtccaaaagaagaagaaaagattgaaaactgcaactactggacctgaaacaattctgctgaaagatgttcggtcaacggagcacattaaaaaggtcgtcgaattcctgagtcgcaggaaaaaccaggtgccaagatccaatgcagttttgaagaatcctaatgctatgcgtctctttaataaacataatttcacgagttgagtgtggacctcggaggcagtttctgaattctgtgttgagtgtcttgtggactactgatatgggagacaggttgagttaccaatgtctttaagcgtttggatgaaaactaatcatatatgctttgcaacgccgactgggtgtgatgatgtataatgttcatcctcgttcgaaatcctatgagctatggtttggtacggataatgtatcacctgtgacctgtgagctgaatgcgcataatgttcacctctccatgctccggcattactgtaaacaagtcttcaaaccctcccaaaaaaaaaaaaaaaaaa

SEQ ID NO: 1743 - DNA, 1308 bp, Triticum aestivum
  Clone ID: PAT_TA_1743
cccacgcgtccgcccacgcgtccgatcatctctacctgcttatgcattagagcccccggagttgccttcgatttgcagctaagtcctgctttctttctcccttcccgttcttacgtttcagtccctgtagcttcttttttccttacagtgtactccccgttccgttgcaaataaggccctgagctctgtcacattctagcctcgactccttggtcttaggaggagttcgtcgcagatccgatctagagagcctccccgcaccacccatgtttaccttccccttcctctgacggccgccgtcccccgatgaagctgcgcgtccgctgccgctcccactccttctccgtcgccttcctctactggttctacgacttctcatgaactcctcgcccctcgacaacgccgcatccatcctgcctctagttgattagatccagctccgtttcttcccctttcctgtcttcttccttcccgccatcaaagaaaagagatctttttcctggttcttggatcgagaacccgaccgaccatgtcgtcgccatcgcgccggagctccagtcccgagagcaacatcgacggcggcagcggcagcggctccgccggtgacgagcgcaagcgcaagaggatgctgtccaacagggagtcggcgaggcggtcccgcgcgcgcaagcagcagcggatggaggagctcatcgccgaggccagccgcctccaggccgagaacgcgcgcgtggaggcccagatcggcgcctacacgaccgagctgaccaaggttgacggcgagaacgccgtgctccgcgcgcgccacggcgagctcgccgggcggctgcaggcgctcggcggcgtcctggagatcttccatgtggccggtgcgcccgttgacatcccagagatcccggacccgctgctccgcccatggcagtccccgtttgcgccccagctggccgccgccggtggcatgccggacgcgttccagttctgagccaagacaagtcatgccactgcgacattgcgccaccatggataagaagttgctgattactgctgcactactgctgctgaatagtattagtgctactagtttgtttggttcatgtttaattatggtttgattcgtgtcgcttatggtaatcctagaccattattagtacttattttgtgattgtaatcttgcctatcgtgtcctgtgctcctacccagtggatatggataagaacaatgtaattgatgtggtggagcacagcggattgtgcctatctttgtgttgatttgtaataccatcttgacatggaacctatatatgtttgc

SEQ ID NO: 1744 - DNA, 2481 bp, Triticum aestivum
  unsure (1)..(2481): unsure at all n locations
  Clone ID: PAT_TA_1744
cccacgcgtccgcccacgcgtccgcccacgcgtccggcattagagcccccggtgttgacttcgatttgcagctgacgtggcttccctcggtatttaagtccttcttgctttctttctcccttccctttcctacctgtcagtccctgtagctttcttttttccttccagtctactccccgttccgttgcaaacaagcccctgagttctgtcacatcctagcctcgacgggccttggtcttgggaggagttcgtcgcagtatccgatctagagagcctccccgcaccacccatgtttaccttccccttcctctgccggccgccgtcccccgatcactcccggtctcagccgccccccctcgccttctctccactcctttcctacatcgtttctatgaactctcagaaactcctcgcccccccacacgaccacgccgctcccgtctctagagtcagcctcggattcttccaactttacttccccttttctgccatacttccaatgccatccgatctttcttctggagctcagacgaagaacctgaccctccatgtcgtcaacctcgcggagaaagcccgagccgcggggacatcgtcctcggccggagccccaggacccccgcggcagaggcccggcagccgcaggcggacctcgccttcctgggaggctgctagaggatggcttctccatcactggtcggggtgcagttgccactggccgtatcgagcgtggcaccgtcgcggttggggacccagtcgacctcgtcggcatcagggagacccgcaatgccacggtcactggtgttgagatgttccagaagaccatggatgatgccattgctggggacaatgttgggcttctgctccgtggtatgcagaaggaagacattgagagaggcatggtgttggcaaagcccggttccatcacgccacacaccaagtttgaggctgttgtgtatgtgctcaagaaggaggagggtggccggcactccccatttttccctggttaccgtccgcaattctacatgcggactactgatgtcacggggaatgtgacaaacattatgaatgacaaggatgaggaggcgaagatgtgcatgccgggtgaccgtatcaagatggttgtggagctcatccagcctgtggcttgtgagcagggaatgaggtttgccatccgtgaaggtggcaagaccgtcggtgccggtgtcatcaataatatcattcagtaatgtggatggaggatatccaccgtgagaattttcctcatttactcttttgcgaaatgctatgtagttgttattatgcgtttagggaaggctcttgtgaaattgtagtatggcacatttttcttcaagtgaaattgcatactttgtagtattcacgacaaagatacatcttgatctgccgaagctgcgcgttcgctgccgctcccactccttctccgtcgccttcctctactggttctacgacttctcatgaactcctcgcccctcgacaacgccgcatccatccagcctctagttgattagatccagccccgtttcttcccctttcttgccttcttccttcccgccatcaaagaaaagagatcttctttcctggttcttggatcgagaacccgaccgaccatgtcgtcgccatcgcgccggagctccagtcccgagagcaacatcgacggcggcagcggcagcggctccgccggtgacgagcgcaagcgcaagaggatgctgtccaacagggagtcggcgaggcggtcccgcgcgcgcaagcagcagcggatggaggagctcatcgccgaggccagccgcctccaggccgagaacgcgcgcgtggaggcccagatcggcgcctacacgaccgagctgaccaaggtggacggcgagaacgccgtgctccgcgcgcgccacggcgagctcgccggccggctgcaggcgctcggcggcgtcctggagatcttccaggtggccggcgcgcccgtggacatcccggagatccctgacccgctgctccgcccatggcagtccccgttcgcgccccagctggccaccgccggcggcatgcctgacgcgttccagttctgagccaagacaagtcatgccacggcgacattgcgccaccgtggataaggttgatgattactgctgctgctgctgaagaatgctagtactactagtttgtttgcttcatgtttaattatggtaatcctagaccatcattagtacttattttgtgattgtaatcttcctattgtcctagccagtggatatggataagaacaatgtcattgatgtgtgcggagcacaaatggattgtgcctatctttgggttgatttgtaataacatcttgacatggaacctatatatgtttgcagtaaggttatcaaattatttagctatacggtgctttggcaagggctttgttgaattttnnnaaaaaaaaaaaaaaaaaaaaaaaaaggggcggccgcttctaaaggatccaag

SEQ ID NO: 1745 - DNA, 883 bp, Triticum aestivum
  unsure (1)..(883): unsure at all n locations
  Clone ID: PAT_TA_1745
gtgctgcaaccgtgggagtgcagatactggattcatggtgctcagatgatgaaaccatcggtggaagatgctggaagacgcaactgccagtggtgaccacaccggcgggtgctagaagcaggcatcagcggtgctacaaccagccacgaaaattgctggaactggcggagcccgatgctacgtcgaggcggcaattttttggtgcggcgaagtttttgctggaaccgggcatcaatggtgctacaaccagccatggaattcgctggaaccggctttatcgatgatagccatggcgtttctctatcttttgttacaactgtagggttcaaagctgcaacccgtgttgcgcggagctgaaaagatgcagcgaaggtgaacaggggaggtgaccacggcgaacgggcgccaacattgacaagggagctgagctgcaagaggggggcaacggcagagctgcatatggccgacggcggagctgcatctgctgccacgggagttatagcttttttttccaggagagctcgtgccctaaggtgatgcggtcattggggacgagctggggatggcgctggaggtcccctcatcggtcggttgtgcagtagatgcgcgctgcgcgccgatggaaggcggatgtcgactgaacatcgcgttctaagcaaagcgggccagatcggatgcctgaattcgcgtcagtcgggcgttgcacgtgcgaccggccgaaagttttagaacagccaactgaccaccgtcattaaggttagctacttaaaaacccatggatcaacaagtagctgttaacacaccttaaaacaatatttgtttctgaaatcttcaaaaggnnaaatcaagcacttnttctaaaaggttnaaaaatttaattncn

SEQ ID NO: 1746 - DNA, 698 bp, Triticum aestivum
  unsure (1)..(698): unsure at all n locations
  Clone ID: PAT_TA_1746
cgggcgcagggagtttgaagatgaattccacaaaagcttgagacatgacaggccatttacactttcaatggctcgcgcggccccaattcctatgggtccccattccttttcccccccggggccaccccctggcctggttaccaaccttccggggttgggtggggtggggaaggggtgggtggtggtccgccaattggggagggccaggccggccaaaatggccagcccttcccgggtggggaggtcctggatggttccggtccccaggccttagctcccatttaatcaattgggttgctacatcacgggctgtatgatgatttgctgacctgttttacgataaatgcgctctcctcaattctcccagaagaggagaggtgttgttttctgctgtggtgcttggagtttggccttgttcaccagagggagcaggaccaagtcttgggtaatgtctgcagtaggagtgagcctttgaacgagaagcatggatcaaaagcaaaccataacatttttctctgtcgacagaattctctcccaaagttagtaggggaaagctaacagatgtttccaattttttcacgggttaaaccttgtaacttgatgagaatggttagtggaaaatgtttgatactacctctgtttcagtttacaagtcctgcgcgtatatctaggttgtcaattttatcatccnaatataa

SEQ ID NO: 1747 - DNA, 676 bp, Triticum aestivum
  unsure (1)..(676): unsure at all n locations
  Clone ID: PAT_TA_1747
ctgtgcggcgctcgaggccggccggatcggagntgcaccccaggtcccttgtaccgcacacacacagccagggctagctcgaataatccctgtagtagacgcacagcagctcgggtaggaagctatggcgacgaaagcggcggtgatcgccacggtgctggccctgaacctgctcttcttcaccttggccgacgactgcggctgcaagctgcctagcccgccgccgccggccgggggaggaggaggagggggcggcggcggtggaggcaagggtggaggaggagggaccggtggctgcccgatcgacgcgctaaagctgggggcgtgcgcgaacgtgctgggcgggctgatcaacctgcggccggtgacgacgccgaagcagacgtgctgctcgctgctccaggggctggcggacctggatgcggccgtgtgcctgtgcacggctctcaaggccaacatcctgggcatccacctcaacgtgcccgtcgacctcaacctcctcgtcaactactgcggcaagaacgtcccctccggcttccagtgcccctagaagaccccggaagatccatccactgcaaaatctccggcatgcatatatgtcattgactagtatactactcacgtagctaattgtatacctatactgcttgcttgataaatcaatcgatgatttgct

SEQ ID NO: 1748 - DNA, 1155 bp, Triticum aestivum
  unsure (1)..(1155): unsure at all n locations
  Clone ID: PAT_TA_1748
gccggcggcacccacgcgacacggcagaggcagtctaaaccctgtacacgcacagcaggaagagaggccaggtagctagctagcttggtagcttggtaaccatggcgaagaaggcggcggtgatcgccacgctgctggccctgaacctgctcttcttcaccttcgccgacgcctgcggctgccactgcggatcctgccctagtccgggcggcggcggcggcggtgggggtggcggtggaggtgggagcggtggcgggggtggtggagggagcggtggaggcggatctggaggaggcggcagcggcggaggtgggtcaggaggaggtggcagcggcggcggcgggtccggcggtggcggatcgggaggaggcggatcaggcgggcgcgcgcggtgccccatcgacacgctgaagctgggggtgtgcgccaacgtgctcaacgggctgatcaacctgcagctggggacgccgccgaagcagccgtgctgctcgctaatccaggggctcgccgacctggaggcggcggtgtgcctctgcacggcgctcaaggccaacatcctgggcatcaacctcaacgtgcccatcgacctcagcctcctcgtcaactactgcggcaagaacgtcccctccggcttccagtgcccccgctagaagagaagacccgagagatccatcgtccactgcatgcaggcatccactatacgtacgtacgtgcatgcacgcacgcatgatctacaatccatccattgactagtgctctatagctagtcgtatacgttatttgcttcataatttatcatcgctcttgctagttgctaaacttgcatatttctctctgtgtgtgtggtagtaccgtttgtaccacgtactgcttgtcatcgaactggttacggtactctatggaccatggatccagttctcagccacatatgatctcatgcgtgtaccgctggctgctattatatttccttcaaaaagaggttgctcctccacaattgtagtaaagtaattaatatcgaatatgacaacacatgataagttatattaaaaaatagtcaactaattcgggttaaaaacggaatccaaaaaaaccccgtgtccccgctcgttttagaagcgccccactggggcggtcgtttntaaacntnggggantg

SEQ ID NO: 1749 - DNA, 1288 bp, Triticum aestivum
  Clone ID: PAT_TA_1749
agctcacgccacctctcctccacttcactcccgactgaagcagctccgactgaagggcgggaagaagaagaagctagaggacatgggggcgcagagagctctcctcgcgagcttcctgctcgccgcgttggtcacccaggccttcgtctccgtctcggccaggaccggcccgacggacaaggcaagccaagatgacgtgaagaagccggactgcgtgccgtcgctcgacccgcacaacttccccggccacgggggcaccaccgtgccgcttccctcgcacggaggctcctccggcacgccgccctaccacggaggctccggcacgacgccgtcgcacggcggctccggctcgactccgtcgcacagcggctccgggtcgccggtgcctgacccgtccgcatggcgggtacgggacgccgccttcgcacggcgggctctggttcgttgccttgacccgtcgcacagcggaggaggttacggatccactccggacgcgccgtcccacggcggaggcgcgtacgggagctccccgacgccttccactggcggtgcctacggcagctcacccacgccgtcccacgacgggggcgcctacgggagctccccgacggccggcccacgacggcctacaccgcagcggaactccggctgcaccgtcgcacagcagccacgggtctatcacaccgacgccgctcatcccagtcgaccccaacagcctcgggacatgcgactactggaggacgcaccccatgcagatctggtcggcgctggggagctggccgagctcggtgagccacttcttcggcgccgccggtggcgcggtcgccggcgggccgagcatgagcatccaggacgcgctggcgaacacgaggaccgacggcgccggcgcgctgctgcgcgagggcaccgccgccctgctcaactccatgacccgcccggggttcgcctacaccacccagcaggtgagggacgcgttcgcggcggccgtggccggcggctctgacagtgccgcggcggcgcaggcggcggcgttcaagaaggccaacgaggggaagaaggtgtagatcgaccggatcgccatcgagtgggctttagctatagctggttacctatatctgtggcatgcgttcatgcatgcatgcgtttaggccggacggacgtgtgcttgcgttttggttgttccgtttgagttgatggtttggttgtgtaagttggtgtcttcgtgggctagcttggatctatcgtactacgtgttgtaatgaatctccatttaagttttttgcagttc

SEQ ID NO: 1750 - DNA, 1108 bp, Triticum aestivum
  unsure (1)..(1108): unsure at all n locations
  Clone ID: PAT_TA_1750
aaatcgatcgatcccccacccctcaaatccctagctctctcctgtctccttctctcccccacccctcaaatcacaagctcaatccggcgcggaagggatggataggctgaaggaagggcaggtttttttttcccggaagagatgtggaggcgcggcgacccggagctccggctagagcatgggcggtgcttgctgacgcgcacgcgcgacatgtacgctctggaggggaagctgcgaggccatgccctcttcacgacggtgcaaggtggtcggctgccggtgtctccggcaatgctgttggcggcgctggaatcgcagtgcagtgtccgttctggtgatgtcaaggttgaggtaacctcgccgccggctgatttctttgtccgattccgccgcaacgaagactgcactcgcgtggttgtcaattactcccatgtgcttgaagttggtggcgagacgatccagtttaggcgttggcatcgcggctcgttttgcgagcagtcctcgctgccattttttacgaagctgagcttcgatggcctcccccaagaggcatgggacagagcatttttggggatgcttgtgaaccagctaggcggcgagctcataaagtgtttgaagcctgatgatcgctggtgcattagtgtggaagcatggatgaaggatcctaacaaagtgcctaagcgctacgacgtcgagctgtcggagccggatgagccaatgttctgtttctgtccggaatccgacgatgaaatatcgccacccacaccaagagagcgtactgagaagcggactgtagtccattcaattatcatccatgttgattgggtgttgataacagtccaatcataccagagtttccggcattgcgcgactaccacgacgaggacactactcggcttcacacatatgccacctgtaatggtacagttgatggcactactccgccagttgatcaagatggtggccgtgggttcgctgggccaagctcccaggcgcgtgcaggagcattgttctactagtttcatgtgttgtgctgatcaatgatgtactcgtcacttgtgtaccagtatgaactgtttgttgtgctaaattatnatgtactagatat

SEQ ID NO: 1751 - DNA, 370 bp, Triticum aestivum
  Clone ID: PAT_TA_1751
gtttagagcttttgtttggcgtttctctcggccggataatagagaaaaagagacttacgcagggtatgttttctctctctaacaataattaaattttgtactaagaaaactcgttagatgttcttactgcttgatctcacatcatatttacgtgctaagaaatgagttgtaactgaaacaataatgttaatttatgtaattatatactgtgttggatattagttttttataaaattaattccgagttcaattggtttttctttttgtgtgtcaagaatttttttacaatctgtaacatgagtaatttttttgacatacataaatatatatatttttgtatacgttttttatattacaagatccatcataa

SEQ ID NO: 1752 - DNA, 896 bp, Triticum aestivum
  Clone ID: PAT_TA_1752
agataatgcgaccctcggatctaggcccctcgaactgtgggctgccccaccgcttcctcccggcagcaggcgtggcctcccctggacgaaaccctactcctcgcccttctacacccccctttccccgctcctgcggcggcggcagcgggattctagggcggcggcgcggcagctaaaataatcaacccaggcaatggcaatgtcttggacacgagcattgaagcgtggagttattccaagggaatgcagctcaattggtcgggataagaggctttgcagctcaggccaagggaaagaagggcgggaaaggtggtgcggctgatgctaaaccttgtgctcagcaaagaaatgaagagtacaactgtgtttggggcaaatatcctgaaggagggttctgacccgaagatccaaccagattcggagtaccctgactggctgtggcacctggttgacaagcgtcctgttgctgagcgagctgcggaggaaagatgccaagacactgccttatgaagacctgaagcgtttcgtcaagttggacaaccgggctaggatcaaggaaaacaatgctctcactgctaagaactgatcaggagaatcacatctcatgtagtggtcaaagtaagcatattggtcctgtcttttgttacaaggtttattagttacttttggtaataatggagtgacttatttgcttggctcagtacaatgtaggctatgtgaccaacatgctgtttgtcatatccgcggtttgtcgtgttcttgtctagatgtaacttctgtatcttgcagcaaatcctgtaggaagtttcccatgctcttgcttggcttcgtacactgttttgcaacaggagttttaagcctatcaatagaaagacagagatatttgaaaaaaaaaa

SEQ ID NO: 1753 - DNA, 1478 bp, Triticum aestivum
  Clone ID: PAT_TA_1753
gactgctctttgtgcctagcgtggtcgcggccgaggtttaatgaaggtattgtcttggggcataaaatttctgaaagaggtattgaagttgataaagctaaagtaggtactattgaaaagaagtcgtgtcctaaagatatcagaggtataagaagtttccttggtcatactggtttctataggaggtttattaaagacttgtctaaaatttctaggcctcctactaatctcttgcaaaaataatgttccttttgtttttgatgatgattgtgtagaagcttttgaaatacttaagaaagccttgatttctgctcccattgttcaaccacctgattggaatttaccctttgaaattatgtgtgatgctagtgattatgctgttgtgatgttctagggcaaagagttgataagaaactatgagatagcaagatatatgacaagaacatatggatatcacaaattaagtgcttaagtatacgctcggttagaagaacgacgacccgggacacattaccgagtcaacctgcggtgccatctcttgaattgggaaaagtgccactctatggttaatgaaggtattgtcttggggcataaagtttctgaaagaggtattgaagttgataaagccaaggttgatgctaatgaaaagatgccatgtcccaaggacatcaaaggtataagaagtttccttggtcacgccggattttataggaggttcattaaggacttctcaaaaatctctcggcctttgactaatttattgcaaaaatatataccatttgtctttgatgatgattgtgtagaagcatttgaaatacttaagaaagcattagtctctgcacctattgttcagccacccgattggaatttaccttttgaaattatgtgtgatgctagtgattatgctgtaggtgttgttctagggcaaagagttgacgcgaaattaaatgttattcaatatgctagtaagactctagacaatgcccaaagaaattatgctactactgaaaaagaattcctagctgttgtatttgcttgtgataagttcagaccttatattgttgattctaaagtaactattcacactgatcatgctactattaaatatcttatggaaaagaaagatgctaaacctagacttattagatgggttctcttgctacaagaatttgatttgcatattactgatagaaagggagttgagaaccccgttgtagataacttgtctaggttagaaaatgttcttgatgacccactacctattgatgatagctttcctgatgaacaattaaatgtcataaatggttctcatactgctccatggtatgctaattatgctaattacattgttgctaaatttataccagcaaaagaagaagtttttctatgatttaaggcattacttttgggatggcccacatccctataaagaaggagtagatggtgttattaggcgttggactagttctagatcgcga

SEQ ID NO: 1754 - DNA, 404 bp, Triticum aestivum
  Clone ID: PAT_TA_1754
ggttgaaccaagtcaagtcaggaaggaacccattgttcctggagatgtcgtcgcataacttgcatgttccgaaggcaaattaagatgcttctttctgcgtgccttggggcgctggaagtttcatcacctaaacctcccgatcaggggggttacctccgtgttgtagacctgcatgccttgcaatgagctggctatgtgtttcatatgtactacttactagttatgtactaagtattaagtgtcttgtgctatgcattgtcttgtgtcatttaaaactcgtttgattggaagcccccgagatgatgagaacatttgaatctgggatcgtcccgtgtgtcttgtgcatttcaacggaagaccaagaagaacgactcagtgtgctgtttgtataataataagaaaca

SEQ ID NO: 1755 - DNA, 561 bp, Triticum aestivum
  Clone ID: PAT_TA_1755
aattatcacatcctccgacctccgcaacccacgtcgcggtgcccgtctcctgcccgcgcgccatggcagctctccaccacctcgtcctcccgcctcggctcctctccggccacggaccccctcccgtcctccgcttctccaggaggccgaggcccctcctccacctgctcccgcgcgcggccgccgcagccacaagggcatcggcggcagcggcgacggcggtgtccgcgccctcggacgccgcgctgcagaacttccgtcgctggctctcttcccagggtgcagacacgggctcggtggctccggcggtcgtgccggagggcctcggcctcgtggcggcgcgggacctgccccgcggcgaggtcgtcgccgaggcacccaagaagctctggttggacgcggacgccgtcgccgcctccgacctcggccgcgtctgcggcagcgccggggacctccgcccgtgggtaagcgcctcgctgctcatcctcagggaggctgcgcgcgaaggggactccctgtggacgacatactcgccatcctcccgcgacagaaagactccac

SEQ ID NO: 1756 - DNA, 835 bp, Triticum aestivum
  Clone ID: PAT_TA_1756
gaaaagaacagtggggtcgggaccgacgtccaacagtcgctgaataacagcttttacatatccacccccaacccatagcgacaaaatataagatgggaggaaatgattcttggaggctattctgtttactgtccaatacaacgttgtatagctccaacattttcgtcatcttctgtagaaagaaaaaagaatggttacatcaaatggctccaatatacaacttctcacgatgctatgaccaaaaccgggcaaaaaatatatgtaaatgaagagacattctgtatactaaagcttcattttcgctagtggagtttgctggtgcgacgctttggccctccagggaagagcttcattatccagccaagcaccctttcaacaacctcgtccccttcatcagcatacattgttgcatcattgaagtgtgtgcggacgcgtggggaaaggatggccaacgagaacgtccttgcagaagtcaatagctcaagtctgtgtgtctgagtctccagcttttgtgttagatccctgttcagctccttcagcttggagcagttggatgactcgattctcagtgctcgcattaactcttctctctccactgctaactccgacatcaaggagttgatgttgtcaatcattctgagctgatcttctggaatgctagaagatgcgtctccgaaggaagggaaatcagacatattattcaactgtgcaccagatggtcccacgtcttgtgatggggcactggtactgggcagtgtgtgggaagagctgctctcccctcaatctaaatccttcgttacagttgatgcatcttttttgtggactgatggtattt

SEQ ID NO: 1757 - DNA, 2344 bp, Triticum aestivum
  unsure (1)..(2344): unsure at all n locations
  Clone ID: PAT_TA_1757
cgcctgcaggtatctcggtccggnnaattcccgggnnntcgacccacgcccgtccgcgtccgccggggcgggctccgctcccctatactccctccttgcctctacgccgccagcggtcgatcgggcaagaaaagcaagaagtccgcggcccctactgtcgtggcgccggcggccgtccttaccaaggggaaggccgggaagaagcgcgaagccgatgacgagatcaagaaggctgtaagcgcaaagaaacagaaggctgcgccggcaaaggcggtgcccgggcccaaagaggccgccaagaaggccaagaagcagccgccgcccaagaaggttgagagcagcagctctgaggagcagtcatccgagtccgaggaggaggaggttcctaagaagactgcaaagcctgtcaaacacgagtcttcagatgatagcagcgacgattcctcctctgacgaggaacctgcaaagaagccttctgctaaacctgtgaccccagctgccagcaacggctcaaagaaaggcaagcctgagagcagctcttctagttctgaggatgagtccgatgatgacgagaaacctgctgctctggtaaagaaaacaccagtcatcgaatctgacagctccgaaagtgactcagatgatagctcagatgaggatgttcctgccaagactcctgctgctgctgccaagaaggtagattcttcagacagttctgagtcggagagtgaatctgaggatgaggagaagtcaaagaaagccgcacaggccaccaagatagctcctgcagctgctaaaagaaaggaggagcccagtgattcctcagacagtgatgagagtgatgaagagcctccccagaaaaagctgaaggatgctgcgaaggttactcctaagtctgccaaaaaggacagcaccagtgatgatgacagttctgatgaaagctctgatgatgagcctaaaaagaaagttacaactgcctcaaaatcacagaaggaagagcctaaaactcctgctagcaacaaaggtcaggcaacagggtcgaagaccctttggatggggaacctttccttcaatattgagtatgatcaagtgaagcaattttttgcacaaattggagaggtcgttgatgttcgcctggctacccatgaagatggccatcccaagggatttggtcatgttgagtttgctacggctgaagatgctcagaaagcgcttgattcactgaatggtggagatctaatgggccgtccggtgagacttgacatggctgctgaaagaggtgcaactcctcgcaccagggatggtggatcgtttggaaaaccaagtggaggtcccagcctctcagtatttgtcaagggttttgattcatctcaacaggaggatgctattcggagctctcttcaagaacacttctctaaatgtggagaaatcacacgtgtctcagttccgatggattatgagaatggtgcaagcaaagggatagcttacatggattttactgatgagagttccttttcgaaagcacttgagcttagtggatctgacctagcttggctgcaacttgtatgttgctgaagctaagcctaagggtcaatttggtggcgtcgggtgggcgatctggtggcagagatggtggccgctctggtggtggcaggtttggccggtctggtggccgtgatggcggcggcaggtttggccggtctggtggccgtgatggtggcggcaggtttggccggtcctggtggccgtggatggcggcagaggaggcggccgaggctttcatttcagacagagtgctggcacaggctagcgcagggaagaagacaagatttggtgacgattagaaactatttgagccacaaaatggtctgatgcaactgccgcgtgtctagacgactgtatccccgtgtttcccattatcctatgtggacctaggtatcatttgtctgtagtattttcttgccgctatatgttgtaatgccagaattctactatatatgttacacctaagtgtttttataaaacttactctaaccaagaaaccaagacaagaagtggtcaggcatctcctataaaatggccaatcattagttctccctcgggccggctcatcctggccgcaagcttcatctttaattagagggagagattaactgaggctcttctcttatagcccgagcctaatctacacgagccatgtcgtgatttcttcctcctgattctattttttctttctttctggattctagctccatccatctcagcttcctgtttcctcaatcttcctctttcctaggtccgatgaagcaatataatttnaaccatacctttacaaancgaggaccca

SEQ ID NO: 1758 - DNA, 788 bp, Triticum aestivum
  Clone ID: PAT_TA_1758
cgcctcgccccgtcgtgcagtgcacccaccgctaaatccaggtttcttcggccctcaccgtcgctgccccagcccgcttcccccatcggccgatgctcccccgttccccacctcccccttccgttcgggccgtagccaccgcaccgcccccgatggcctcctccgccgccggcgccggcaagtcactgatccagacattccgcaaattcttcaagaagccgtgggagatcaccggcccgtgctcctcgcccgagtaccgcagcgcggtcccgggcgcgctcgagtaccgtcaaacctgcccggccacccttcgcgaggactcccccagggccatcatccccacctccgacccggagaccgtgttcgacatcaagtactacccgcgcgactgccgccgcaaccgcccgcccgtccgccgcactctcctccgcaagcccgacctcgagcgctacatggccgccaagcagttcgaccccgccaaggacttccctgtcccctacgtcaattctgccgtcgaggaggactacagcgccgtcggcggcggactacacccagtgatccaggtcttgtggtcacgctgcagccgaagctgcactcacttcatttccgctcttccttggaagtcccttcctcttttgtttcggagaaatttttctggttgtaaaagatgatggtggcaataatatggctcttgcggagtaaaccggatgcacctaccttgtaagttgtgttccaaagtcagccagcctaatgctgattgtggttaatgaatttataaaaactcaaaa

SEQ ID NO: 1759 - DNA, 1219 bp, Triticum aestivum
  Clone ID: PAT_TA_1759
gatggcgagggtgcttggccgggaggagtcgcagcgggagttctgggatctggtgcaggagatgaaggccggcgagctgcacatcgacatcgatacctacatgaagctgtcccggcagttccagaagcgccacatgatgaccgaggccgtggagctctacgagctcatgatggacggcccctacaagcccgcgcagcaggacgggccgctgctcctccggcgcatcgccatggggccagagcctgacctcgagctggtgtatcgagtggtgaggaagttcgaggccgtctacgagttcaagacaaagaatgtgtttgacgggatccacagggcgctcacaagcaatggcaggttcgacgaggccgcggagatcgtggaaaggatgagaggcgctggccaccagccggacaacatcacgtatagccagctggtctttgggctgtgcaaggccgccaagtgcgatgaagctcgccaggtgctcgatgaaatggaggctgagggttgcacgccggacttgaagacctggaccatgttgatccaagggcactgtgccgctggggaggtggacaaggctctgcagtacttgacagagatgatcgagaaggacttggaggcagacgccgatttgctggatgtgatggtgaaaggtctgtgcaaacaggaaaagattgacgcggcttacactttgtttgttgagatggtggacactgccaagttgaacccttggcaaggcacttacaagcatatcattgccgagttgctgagggtgaagaaactcgaggaggcactgggccttcttaaatcaatgaaagcccagaagttcccaccttttgcagaccccttcccttcaaacatcgctgaatacgggacgcttgaagatgccagggactttctcaaggccttgaaaggatcgtctaataactatccgcagccccctatctatgtgcagatgttcaaggcattctttgcggaggggagatactcagaagctcaggatttactctacaaatgccccatccatatccgcaggcatcatgacatcaccgagctgtttgaaccaaaaaaagttcaggctactgcttgactgaagcacaataaattgttggtgagattatggtgaactcctgctttttgcatactagctagctcttgtttagtaatcctggtcatgagttgttacatggtaataattgtaatgcgaatattttgttgagttgcc

SEQ ID NO: 1760 - DNA, 1364 bp, Triticum aestivum
  Clone ID: PAT_TA_1760
cccacgcgttcgcggacacgctataagtctgggttgggtccatccaaatcagaatttggacaacccagaaaaagtcggggatttttgtattttcatcggagcaaagaagaacaggtgcgaagaaacggtggcgatgtcaaactcatttggattcggtgggcataactcatcaattctggttgcctcgttcaagtgaacatctctttcagagcggaacagttacccaacgaaagattcccggccctggcatatgcaccgtgatggttttgttatgggagaaggggcctgtgtgccagctttgaataaacttgagcatgctaagcaaagaggggcaacaatatatgttgaagttgagctaggagagcctacatgcgaccagtcccgtatgtatgtgtcgccttcgcatcgcacgcggatcccttgttaaagggtcaagtcatcctttgctgcaagggaagaaatcatggggtgtaacttagggcctacgtttattgtaattcaagtacagtacggtttggaggaacattcattgacccttcgtggggtctgccactatccaacgcgcagtctgaccttaacgggtgctctttccgaggattgttgacgagcaaccgttgcaagagatgctgcttcttgggatcagctgctgtatccatgttcgagtaatcgtggtttgtgtatgcacccctcaactgggctggtccgttcctccgttgttgattgaccctagaagtagtcgccgcggctgaaatttgctgttgcaaagatattcaaataacggtggttcgtctcagcatgtctgttcgcccccgccctgctccccccggtcggtgatgcttacttcctggttgtccgattatggaatggaactggaactggaactgcatatacaagactagtggagtagctaggcggcttctttgaatattacatggaggtctgagctgagaagatcatcgtattacttacagtcgagctaagaaagcgagctccgagcccccagccatgttcatatttgtcgccatcgcatcgcaggcacatcccctgtcaagggtccagtcttcctttcgcaagtgaagaatcatgtggtgtagcctatggcctatgtttattgttattcagtacagtaatgttggataaaccataactcgccctttctgggcccgctatttttcaactcgccgtctgcccctcatgggtgctctttcctagatttggtgatgagagacccttgcagaggtgctgctgctgggatttgctgttgtattcatgttctagtaaccgtggttcgtgtaagcatgtctgaacttggcagcactgctcctcccttcgttgatttatagtatacttattctccatgtgag

SEQ ID NO: 1761 - DNA, 873 bp, Triticum aestivum
  Clone ID: PAT_TA_1761
gggccggcgtcggcggctaatgctacgctcaccaccgcccgctaagcctaagcccagcaccaccctccgcgtggccgccttcggcggctccctccgcaagggctcgtcgaacggcggcctcatccgcgcggacgaggagctgtgcgaggagtccatcccggagctgcaaatcgaccacgtcgacatctccggcctgcccatgtccaacccggacctggacacggacgacggcgacggcttcccgccggacgtcgaggcgttccgggacagggtccgcgccgccgactgctttctcttcgcctcgcccgagtacaactactccgtgaccgccacgctgaagaacgcgctggactgggcgccgaggggcacgcacaagtgctgggcggacaaggccgcggccatcgtctccgcgggcggcagctgcggcgggggcagggcggcgttccacctccgccagatcggggtgttcctggacatccacttcatcaacaagccggagctccaggtcagggcgtacgaggacccgcccaagtttgacgccgacgggaacctcgtcgacgccgagacgagggagcggctcaagcaggtgctcctctcgctgcaggccttcgcgctccggctccagcactaactagcaggagcggaggactgagcgaagaagaaacttggcaccgtgcgattacctaaacgttaatctgcattttcctttgcgtgttggatatgtaggtacttttgactatttcactttcttttaggggttattttcacttttgttgggcggaatacattttgctctgtattcgtgcaccagtctttatgtggttctgtaagaaagagtaagctgctgtaaacagtgtgtttgtaagaaatcac

SEQ ID NO: 1762 - DNA, 1610 bp, Triticum aestivum
  Clone ID: PAT_TA_1762
gaagcgggcgcggaccccctgttgctccgcggcggctgcggtggtccagggagaagagcaccggccacggggaccccaaagccgcctccggttgcaacgcccgggtcccccgcatccgcaggcttgatagggacctcaacctggcggatgctaacccggagcactgccatggtggggaggtcatccgccacccgcctctggcgccccgcacccacgtggaccccaagtggccggcaggcttcccggaggccgcggtcaatgtcgacatcgcactcgtcccccgggagaacggggcagcgcaagcactacccaggcctctcgtacccccggtgcacccacgcgcttacggtggcgtgatcgccgaatctagtggggatcacagttgcggcccggaggaggtgggcggagctcacggggagagcgcccaatttctccatcccccaggaggccagctatttcgggatatgcaggaccttgccagcctcagagtttgagctggagtggccacacacacatcctgccaggaagagcaatactaataatgttcagcagcaaccccccaagaagacgcttaatggatcaggcttgaatttgtcatcgccatccaagcattcacgaggggactgaatggatctctcccctgtccgcagcaagcgaaggaaggaggcatttccacatgccactggatgatggagtgctgcttaccatttgtcgatcacacgagggtaaaggttccatagaagaacacccccactcacggcatgcttaaaatcttctgtgttagcacggcccggatgccatacataaggagacatgacagggtcttcaagctcaccgacgccatgccggagcactgccctcccggggagttcatccgcgaaatacctctagccacccgtatccccgaagacgccaagcttgaggcatgctttgacgaggccgctgcggttcttgagatcatggtccccaaacgggggaacgagccggaagaacatgaagtcagggtctccatgcgccctcctcacctgggagtgaacgacctgcttatgacataggtaatggaaggcctatctttcttgtctgtgatcaccagatcgtgggtatgctcgaaggggctactgttagcatcttgttccgggactgttactgttgattactgtgctaggcctcttcagcaacaagcttttgctcaagattagttggttctagcttgtatgtgacgggtgtctttttaaccctcgtgttctcttctcctagcgtcatattgtgggtggcctgtttgtccttgaatctgtaccaagttcagttaacagaataaaatttataattggtgggttacctcttgcttactgtgcctggcctcttcagcaacaagcttttgctgaagattagttcgttctagcttgtatgtgacgggtgtctttttaaccctcgtgttctcttctcctagcatcatattgtgggcctgtttgtccttgaatctgtaccagttaacagaataaaaatttatatttggtgggttactgctcaatttttcgatctggattatagtaacaattcttatgttagtaccagtctgtacttcccaaatttacaatgttctttgcagt

SEQ ID NO: 1763 - DNA, 738 bp, Triticum aestivum
  Clone ID: PAT_TA_1763
cagcgacgcaccaaagcagcgacggcagcgctcgaaggccccacccgccaccaccgaccggcggcgacgcgcagacggacccgacgaagcaagggcacgagtcgatcgagagcagcaccggcagccgcggaagggaagccaagagacgaccgagcgccggcagcatggaccggaacatgacggggctcttgctcgggtgcgtgggcgccgccatgacggtgctggcgtaccagcagacggcggtgtccagcacgcagtgcatcggcgccggcctcgccgtcctcgtctgcgctctctgcatcaaggaaggcttcttctccttctgatgcccgccgcccgcctagcacccagcttctttcggcttcagtttccatattcctttgcacgcttaattcgtttccttcactcgtgcttccatatatgtttctcatccatagttggatcgtctgatccgcataatcaaagtggttgtatcctgtattcagaaatatcctcccttttcttatactccctccgttcggaaatacttgccatcaaaatgaataaaaggagatgtatctagatgtattttagttttagatacatccttttttgttcattttgatgacaagtattttcagacggagggagtacatatatagtagttctttgtctgtcttgaagcgtggctgattgcgtctttttgtttttgttgttgttgctgatgtgctctttgctgattacatctcttttaccact

SEQ ID NO: 1764 - DNA, 835 bp, Triticum aestivum
  unsure (1)..(835): unsure at all n locations
  Clone ID: PAT_TA_1764
cccacgcgtccgagccaggacatccgctacgcgatgaagctcgccgccccgaccctcaccaagctcacccgcgccctcgtccagcggggcatcctcaaggaggtcacggatgtccgccaccgcgggaagaaggtcttcatggacgcccgcatcgagccctcccccgagatcaccggcggaacctggtatcacaacggccagctcgataccgacgccgtggcggccgtgcgccgcaggtgcctcgaccagattgacaggctcggcgctgccaccccggacatggtccacaagggcgtcgagagggaagaccccagggcagggtacgctatcgaccagatcagggacatcctgcagaccatggcgctcgacagggtgctggaggagtgcaggagcaccggggagggggagttcagcgcggtcagagccgggagggtgtgctaccggcggggtggcgcgccgcagggcggcatgatagaagggattccatgtggggtttgtcccaggatcgacgagtgctcgccggatggggtcatctcgccaaccacttgtgtctactacaagaaatggctgcagatggacttctaggcagcgagccctctgaatcgtgctgggatggaatggtgaattgtgctgggatggatcggtgaatcgtcgtcagtatgcacttgtgggattgctgcgcttccgatcatatggtgttgtgtttgtggtctaggatgtggccgcctgcccaggtgcataccttatttgagtatttgtactgataatcagttacagagcntattgtgtaatgtttgcactttgcagttaaaaaaaaaaaaaaaaactcgtgccg

SEQ ID NO: 1765 - DNA, 687 bp, Triticum aestivum
  Clone ID: PAT_TA_1765
tccccctgctttccacgcaactgcccccggactcctcttccgcgaccccactctccttcctcgccccgccaggtcgtcgtcgtcgtcgtcgctcccaatatttcctcctgctccccccacttggatcagccggtcgcgaggaggaaaaaagtatcccgaaagctcccggtttgacgcggcggcgggcgggcggctgccgagatctgggctcgaggaattcgccgtcccttctccgctgcgtttaggcggggggtgacgtgggggagtttccgtgccgacgcggatctgcgtggtgccaaacaacggacgcgtgggcggacgcgtgcggccgggcgtgggcaaaaggcagcctcccccctttgccttcccacacatggtggtccggctctagggccctttcgcctcgtgcttggcggcggtgatggagccgtcgtcgtccatcacggtcgcctcctcgtcgtcctacctgtccaacggctctagcccctgctccggcgctctggcgccgctgcccgcggcggacgggtggggcggggctgggggagggggagggagcagcagcagcgtcgaggctgtgagtctgagtcgcctcagcagcaacctcgagcgcctcctcctcgattctgaactcgactgcagcgacgccgacgtcgacgtggcggacggcgggccgtccatccccatcca

SEQ ID NO: 1766 - DNA, 804 bp, Triticum aestivum
  unsure (1)..(804): unsure at all n locations
  Clone ID: PAT_TA_1766
atacanattccccggttccgttccgaccccctcggctggaaggcgcgagagcttccggaagcacccaccgaatcggcggcgcgcgatcggggagtgtcgccgctgctggggtcgcgctcgccggcgccggagatggagatggacgcgacggagaggctgcggtggcgcttctcggacggcggcctcaccgatctgctcgacgcccgcagcctccacggttcccccgacattggaaagagaatgcagttccattcttctctagtacaaaggcttgctttagaaaaggagattgagggtcacgtaggttgcgtgaatgctattgcatggaactcaagtggctcacttctgatatcaggatcagatgacactagagtcaacatctggaattatgctaatcaagagctgttgcatgaaattgatactggacattcagcaaatgtattttgcacaaaatttgtaccggaaacatgtgatgaagtagtagtttcaggagcaggagatgccgaggttcgtgttttcaatttgtctcgtttaagtggcataaggcctagggaggtttccatggagccagctgcagtttaccaatgtcactcaaggagggtcaagaaactagctgtcgaaggtggcaaccctaatgtagtgtggagtgcaagtgaggatggtactgtaagacagcatgattttagggaatgcagttcctgtcctcgtgcaggattggttaatcaggaatgccgtaacgtgcttctagatctacgatctggaggaaagaattctttagctgatccccccagacaaccgctgtcg

SEQ ID NO: 1767 - DNA, 799 bp, Triticum aestivum
  Clone ID: PAT_TA_1767
ctctatacgaaaatctggcgtgttaagtgttggtggatcaagtttgaaatggtcacgatctcttgagaagcgttctcaaaaggttaacgaggaggctacattggcagttgctgacgttgaaaaaaagagaggagaaaaacggaaacggcaatatctccattatactggaagaaatgatcaatactctttatctgttgccggcaatcagttaagaaacaacaatcaagcatcttcagatttgaggaggtcatcaacttgcaatggatatgtgcgtgttagcaaaggtaaccaactggttagaaaccccaaaaaagtaactcgcatgctagcaaatgagaaagttcgatggagtttgcacactgttagatcacgcctggcaaagaaacgacagtactgtcaattcttcactcggtttggcgagtgcaagaagcctaagggcgagtgtcgctatattcatgaccctgctaaagtgactatttgcactaaatttcttaaaggcctgtgttctgatactagctgtaaactcactcacaaggtcctcccggaaagaatgcaagattgttcttattttctgaaaggtctctgtaccaacacagcttgtccctataggcatgtgaaagtgaactctaaggctcctgcctgtgaagattttctaaagggatactgtgcagatggtgatgagtgtcgtaaaagcacagctacgcatgcccagtcctttgaggcaacaggagagttgccacaacaatctacgtgcaaacttcctcaccccaccaagaagacatccaatctaagagaagca

SEQ ID NO: 1768 - DNA, 1297 bp, Triticum aestivum
  Clone ID: PAT_TA_1768
cggccgggcttcggcacgagcagaaatacatacacgcatagagccgcggctgcctcctgcgtgcaggatcgagctccgtcgatcgatcggactagcgagttgccatggcagcagccagtgctcttctcatggcggctctcgcggtcttcgccacggccgcggcggcggcgctggacacgtcgccggtgccgttcgatgccgggtacgcgccgctctttgggggcgacaacctcgtgcggtcggtggacggccggagcgtcacgctcaagctggaccgatacaccgggtctgggttcatatccaagtcggcctaccgccatggcttcttcggcgcttccattaagctgccggccgactacaccgccggcgtcgtcgtcgccttctacctgtcgaactgggacgagtaccccaagaaccacgacgagctggacttcgaactgctgggcaaccggcgcggccacggctggcgtgtccagaccaacatgtacggcaacggcagcaccgcccgcggccgagaggagcgttaccatctccccgtcgaacctaccgtcgccggcgtccaccgctatgccatagcctggacccccaacaacatcgtcttctacctcgacggcgtccccatccgcgaggtggtcggcgttccctccatgggcggcgacttcccctccaagcccatgtccgtctacgccaccatctgggacggctccgcctgggccaccgatggcggcaagtacaaggtcgactacgcctacgcgccattcgccgccgagttctccgacctcgtcctgagcggctgcgacgccagcagcgtcgccgaccccgaggggtgccaggtcgacctgctcacgcacgacgtcgccgtcatggcccctgccaagcgcgccgccatgagggggttccgcgagcagtacctgacctacacggcttgccgcgaccgggtgcgatacaagaccacggtcttccccgagtgtgacgacctcgccgacggcgactccagcttccacctctggggggagtccaagaagaggcgccgccggtcgtcgtcgccgctgcagtactcttccagcatgcagtaggttatgggttccgatcgaatgagtccagtccatcgatgcatggcatcctcaagatagttttctcggtcgaggttggtgcatctgtcggatatgtacacagtacacaggaggattacagatagggaaaacgtaaaaaacgtaattttatcaatagtacatacagtagtacgtccccttgcttatatagtttaaattttccaaaccattttccggccggattc

SEQ ID NO: 1769 - DNA, 1760 bp, Triticum aestivum
  Clone ID: PAT_TA_1769
cacggaggccgccgcctccgcgctctagctcgctctcgctcccagcctccctcgctgctcctcagtcttcttgccccttccgcccgccaggaggctcccgctctcgggtcaacccgcgcccgcgcgcgccttgacctttcctcgggccctagccttcttgacggtcgccccccccgagagggagcgcccggaggctctcgctctccgcgcccgcgcgcgcgccgcgccggcatggcggcgagggagggggcaatgcggatgggcaccagcgccctggggcggacgctcgcggaggggcacttgcgcagggggcaatgcggatgggcacgtacgaaatggccgcgacgctgggggaaagatccttcgccgccagcgcatccggcgcgtgaagatcgacgagcagataaagacggagatcgcgacgctgaagctgctcaagcaccccaacatgaacctcctctacgaggttgccgcaagcaagaccaagatatacatggtcctcgagtacgtaaacggaggagagctatttgagaaaatcgcactaaagggcaagctctcagagaaagaagggaggaaactgttccagcaactaatggatgctgtaagctattgccacgagaggggtgtttatcatagggaccttaagcccgagaatgtcctggttgatgcaaaagggaacataaaggtctctgattttggactaagtgcccttccacagcatcaacggcggacgcgtgggactgcataccacgtgtggcagccctaactacatagcccctgaggtccttctcaacaaaggttatgatggctccatgtcagatgtatggtcctgtggcgttatcctctatgtgatgcttacagggaatcttccgttcgatgacgaaaatatggttgtcctttatcaaaagattctaaaaggggattatcgtattcctaaatggctttcgccaggagcccaagatatactgcgaaaactcctggatccaaaccccattacccgccttggcatggacggactaagggaacacgattggttcaatcaaagttatactccagcagtgccttttgatgatgatgacgataattacgttggtgatgacaactcccacatgaccaagcacaatggcattccagacaaccccgcaatcaaccagatgaatgcttttcaactcatcggaatgtcctcgtgccttgatttatctgggttttttgagaaagaagatgtctcagaaagaaaaaccagatttgcatcaaactatccccctacttatctatttgagaagatagagagcaatgtcataaatatgggcttccaagtacagaagaacaatggcaagctaaaagtgatccaagagcgcaagggaccaacaaatccaagagggcatggatcattattaatttctgctgaggtgtttgagatcaatgaatctctttatgttgttgagctaaaaaggtcatgtggagactgctccctatacagacagctgtgtgcaacgctctcagacgacttgggaatatgcaaaagccagcaacttctgaagaacgactccataagacaagagctttatcgatttaatagtagcttttgataaaacggccccctacctttttctagcaaaagagcctactaggtaaaaggatcctcccttttaaacaagaggacccaccaggccaccactaggtaccatgtatgacacatttttgtaaaaccaagttgtagatatacaagttacaccattcaaataccaaatatgaccagc

SEQ ID NO: 1770 - DNA, 732 bp, Triticum aestivum
  Clone ID: PAT_TA_1770
ggattatggagcccgaggcctccccgggggccgggtagcacccggccgctgcggcggccgcaccgccggccgagccccgcgcccgcgtgcccggcgccggtgagatagactactccgtggagcctgagttctacgaccccgccgtagacgatgtcgatgagcgctgggcgcacaagcagaggaaaggacggacctctgacgccgtgctcagctgccccgcgtgtttcactaccttgtgcctggattcccagaggcacgaaaagtatgttaaccagtaccgtgcaatgtttgtgtgcaactgcaaggtcaagactgatcagattctacgggaggggaaaggaaaaaggaagaatcggaaagtaacggctgttgattctactacaccagaagttgaaaacaaggggccagtttatcaccctgtttgttgtgagatctgctcaactgaggttggagtgtttgatgaagatgaagtttaccacttctttaatgtcattcctagtaactcatgaaccttctgatgttgtgagaatagttctcgtagtgccgtttttgtcgatccagagctgatgtggtagtatgcgagttattgttttcttttcatgatatcaagttaaacctgccatccttcatgaaaattatattctggcatcatggagaatttggatcatctgaaatgacagaattttcagaggggaagaatcaatcttgcaaaatcgaagcaagggataaaca

SEQ ID NO: 1771 - DNA, 2157 bp, Triticum aestivum
  Clone ID: PAT_TA_1771
gtcccggtaccggcacgcgggtccgggccggaccccacgcgtccgtcctcatccctttctccccgcacccgacgacatcgcgggagaaggaaggaagcatcatggccggagcagcagccgccgccgccgccgtggcctccggcatctcgatccggccggtcgccgctcctaagatctcgcgcgcgcctcgctctcggtcggtggtgagggcggccgtttccttaggcgagaaggcttacacggttcagaaatctgaggagatcttcaacgctgccaaggaattgatgcctggaggtgttaattcaccagtccgtgccttcaaatcagtcggcgggcagcccatagtttttgattctgtgaagggctctcatatgtgggatgtcgatggaaatgaatatattgattatgttggttcctggggtcctgcaatcattggtcacgcagatgacaaggtgaatgctgcacttattgaaactctgaagaagggaactagctttggtgctccatgtgcgttggagaatgtgttggctcaaatggtcatctccgctgtgccgagtatcgaaatggttcgttttgtaaattcagggaacagaagaccttgcatgggagcactcccgctcttgtgcgtgcattcactgggaggggaaaagatcctcaagtttgaaggctgttaccatggccatgcagattccttcctcgttaaagcaggcagtggtgttgccaccctcggcctcccagactcccctggagtgcctaaaggagccaccgttgggactctaacagcaccttataatgatgctgaggcggttaaaaagctgtttgaggataacaaaggggagattgctgcagtcttccttgagccggttgtcggcaatgctggcttcattcctccgcagcctgctttcctaaatgctctccgtgaggtgaccaaacaagacggtgcacttctggtctttgatgaagtgatgactggtttccgtttagcttaaggtggggcacaagagtactttggaatcacccctgacgtgacaaccttgctggttaatgttggcagtggtgttgccaccctcggcctcccagactcccctggagtgcctaagggagccactgttgggactctaacagcaccttataatgatgctgaggcagttaaaaagctgtttgaggataacaaaggggaaattgctgcagtcttccttgagccggttgtcggcaatgctggcttcattcctccgcagcctgctttcctaaatgctctccgtgaggtgaccaaacaagacggtgcacttctggtctttgatgaagtgatgactggtttccgtttagcttatggtggggcacaagagtactttggaatcacccctgacgtgacaaccttggggaaaattattggcggtggtcttccagttggtgcttatggtgggcggaaggatatcatggagatggttgctccagcaggaccaatgtaccaggcaggaaccctgagtggaaaccctctagctatgactgccggaatccacactctcaagcgtctgatggagcctggcacctatgaatacttagacaaggtcaccggtgaacttgtccagggtatattggatgcgggtgctaaaacagggcacgagatgtgtggaggacacatcagaggcatgttcggattcttcttcgcaggtggcccagtgcacaactttgatgacgccaagaagagcaacaccgcaaagtttgggaggttccaccgtggaatgctggaagaaggcgtgtatttggcaccatcccagttcgaggcaggttttacaagcttggcacacacaaccctagacattgagaaaaccgtggaggctgccgagaaggttcttcgtcggatatagatgattcggattgcaaaccttttggagctcttccttctgttgtactctgttagtttgtacgtggctgaagtttagtttcgtattgtattttgttgtgcagcagcagcagcagtatattgtctctagcccatttctcttcttcggaattagcatttggggtgattttgtcttggcaataaaactttggctacgacctcaaaattcttctccaaaaaaaaaaaaaaaaaaaaaaaaaaaaaaaaaaaaaaaaaaaaactcgagggggggcccggtacccaattcgccctat

SEQ ID NO: 1772 - DNA, 544 bp, Triticum aestivum
  Clone ID: PAT_TA_1772
gccgggccattccagcttgccagctccatcaaacttgctatcaagattcgagaagcgtagaaatggctgccaagtttctacttctgcttgttgccgtattggctaccctcctgctcgtctccatggatgtagcccacgcacaaggttcaggaggacaaaacccacagggatatggtgcaggaaattacaatggtgggaccggcggtgcctacaaaggcaaaagatgttatggcgtccactgtcaaaatggtgggaccggcggtgcctacactggcagaggatgttatggcgtccactgtcaaaatggtggttgtcactgttgacaataaatatggtatatatctatataaaataaggcttgtatttgatcagcttcagcacgggctgactaaaaggaagtttcttcgctagcaatacatatattaaggtgcaaatatattatctcgtgtatgcacgatatatgctggattccagatgatgtgacaacggttgtgtacttgtttacgaacttatatgcataaatttccaagtcagctttgcaagt

SEQ ID NO: 1773 - DNA, 676 bp, Triticum aestivum
  Clone ID: PAT_TA_1773
aaattcgctcgcattcatataacacataccctacacattagcggtgcgtgttacaaggtcgactagcgaagtgtcaagagcaatggcgggacgtagcagggcgcctgcatttctcctccttgggctcttcctcggcctcgccggatccagcccgccgccggagccggtggagtgcgcccgcggcacgtccgactgcaccgtcaccaacgtgtacggctccttcccggaccgcaccatctgccgcgcggccaacgccacgttcccgcgcaccgagaaggagctcgtggccgccgtggctgccgccgccgcgtccaagcgcaaggttaaggtggccaccaggcactcccacagcttcaccaacctggcctgccccggcggccgcgacggcacgatcatcagcacggagcggctcaacaagacggtgagcgtcgacgctgccaaggggctcatgacggtggagagcggcatggtgctcaaggacctaatccaggcggccgccgcggcggggctcgcgctgccgcactcgccctactggtacggactcaccatcgggggcctcctcgccacgggtgcccacggcagctcgctgtggggcaagggcagcgccgtgcacgagtacgtggtagggatgaggatcgtcacgcccgcaccggccagccagggctttgccgtggtc

SEQ ID NO: 1774 - DNA, 562 bp, Triticum aestivum
  Clone ID: PAT_TA_1774
aggttgatcattcttcttatgagtggatctaattttgacaaggactacgattatttatgcggtgcttcctgatttccaagcatctccttactcgctgcagatggttcctttgcttcgatgggagcactccatgcatcactggtttgagggagatcctgcctctcttacgcgactgccacaacactgccatgtgaacctcaagagcgagaagatcattggtttcttcccccaaaatagcatgattgagctgccatggcatcttctccagaatgcaacgtcacttgagtcactgacagtgcatgctagtcctgctaagtaccggtgttctggcaagggcaggaaatgctgtcccctgaaagctacagctatagtgaaggcacgtaaatcaatcttggctgtgaaaaaatacatcaaggggaatgttccctctacagtcaagttaaatgttccgaagccttgccaacgatgccatcgcttttagtaattcaggtgtcaaatcactgtagctatctgatactattgaatggtgatatgttttagttgtcttgtgctaaaaaaaaaa

SEQ ID NO: 1775 - DNA, 804 bp, Triticum aestivum
  unsure (1)..(804): unsure at all n locations
  Clone ID: PAT_TA_1775
ccctccctttatggtcaaggcccggtagcagcgcccacccggccgcggaccttccacagctttgaccgctccaccccgaacccgaagcaaagcgcaaacaagacgcttcttctagccggcccgctctacacggcgagcacggggcggagaggtagcgtggggcagctcgatcatggagaaacaaccgagcagctggcgggggagcaacggcggccacgaggagaggctgcccctgcgcggcggcggcggaggcctggagacggaggcaagggcgccgcacccccacgcccacgccgcggatcagcaggaggcggggcggggcaggcaccggcgcaagtgcctgtgcgccgcgctgctgctctgcctgctcacgctcccggcctgcgtcctccgtcgtcgggaacctgcgggccgaatcctcgccgcggtgctcttcgacgtcgacgactcccaaantacgacgacgacgaccaagatataagagatgatatcctgatattatctccatccgcacaattattatnacaacttctgggtggcttctgatccaaggatttgatnaaatcnttcccaacaagtacattttcacntttcacaggatgcacaaatactctcatactcatanaaattaagggacaagacattcaaaaatgtggccaagcacaatcatcaananctgtaaanataagtcatcaggcanaanganatcgntgaatacctcctganaccatccggatggaaccgatcttnatattantccttacanttnnagaggtttcccngtttaaaaattcanantttcan

SEQ ID NO: 1776 - DNA, 1223 bp, Triticum aestivum
  Clone ID: PAT_TA_1776
cgtccgcgcacgcggctgatacagagcatcctagacaagaagaggagagacccaccacccgagagcagcggcaatggcgtccttcggttctatggcggtggcgctcgtggtgtgcgcaatgctgctgcagacctgcgtcgccacgaggaggctccaggcgctggtgcaggagcagcccatcaccatgaagtaccacaagggagcgctcctctccggccgcatcgccatcaacctcgtctggtacggcaacttctccgcgccgcagcgcgccatcgtcaccgacttcgtctcctcgctcgcctccgcgcccgcgtccccggcgccgcagccggagccgtccgtggccacctggttcaagacggcgcagaagtactacggcaggctccaaggcccgcttcccggccctggccctcggctcccacgtcttcgaccggtcctactccctcggccggcggctccgggaagcgtgacctcgtcaggctggccgcgcgcggcgggccccgccgcgccatcaacgtggtgctcacggccgacgtcgtggccgtcgacggcgccggcgtcggccgctgcggctcccacggcgcctccccgcggtcccgcgccgggcggttcgcgtacgtgtgggtgggcaacccggcgacgcagtgcgccgggcagtgtgcgtggccgttccaccagccgcagtacggcccgcagatggcacccctcgcgccgcccaacgccgacgtcggcgtcgacggcatggtggtgtccctcgcgtccatggtcgtcggcaccgtcaccaaccccttcggcaacggcttcttccagggccccgccgaggcaccgctggaggccgccacggcgtgcgccggggtgtacggcaagggggcgtaccccggctacgccggctcactgctcgtggacccggccaccggcgccagcttcaacgcgaacggagcccacggccggaagtacctggtcccggcgcgggtcgaccccgacacgtccgcctgctccaccttggggtaggctcgtacgtgtaggaccatgatggtgtgtgtgtagttatagttgcggtggcgttgttgctgtgtggagagtgttccaccttccacgcgcgtgctgatgttaatctgtgtgcctgtagaggcgttgagatgaaattctttcatttgttgaatgaaaaaagtttactattaatgtaaaaaaaaaaacaaaaaaaagaaggtaaaaaaaataaa

SEQ ID NO: 1777 - DNA, 415 bp, Triticum aestivum
  Clone ID: PAT_TA_1777
aagagttttagagttagaaataggtttcaggctggtccatttgaagtggaacctatccgcgtaactcattcaattcctgactgctgtggattagtgcttcgttgtggtgatggcacaatcttccatactggtgactggaaaattgatgaatcaccagtggatgggagaatattcgaccgagaagcattggaggagctctcgaaagaaggtgttactctgatgatgagcgactcaacaaatattctgtcccctggaagatccacgagtgaatctgttgtcgctagttcattgttgcgtcatgtttcagaagcaaaagggagaagagtaattacaacacaatttgcttcaaatatacatcgcattgggagcatcaaagccgctgcagacttaactggtcgaaggctggtctttgttg

SEQ ID NO: 1778 - DNA, 1351 bp, Triticum aestivum
  Clone ID: PAT_TA_1778
gttttctgcaattggcgggcgggtgggggcgccatggcgctccaccccgtgtccttctatccaaaagcgacggagagactcccggcggcgagcaggttgtcctgttgttctatccgattttgcactgctggttgtcctgctcttccagctgattgcagtggtgttcttctcgcagtttgaagatggatttgaaggacagcctctccagatttaagcagcaacaggagaggtgccagtcatctttggccagcatagctgcaagccaagcttcaaccacaaaaccaaagcacagggcccaaccgattaatgctccatctgctccagcaaggcctgcacaacctattaaattttcaaacgatacagaaaggctgcaacatattaattcgattaggaaatctcctgttggggcacagatcaaacttgtcattgaactgctttacaagacaagacaagcttttacggcagagcagataaatgatgcaacttacgttgatatcaatgctaataaggctgtctttgacagtctgaggaataacctcaaagtacagtatgatgggaggcgtttctcgtacaagtccaagcatgatctggaggggaaagatcaactacttgatttgataaggtgtcaccaggagggtcttgctgttgtggaagtgaaggatgcatacccaagtgtgttggaagatttgcaggctctgatggctgcccctgatgctccgctgggggctatcctgggtgctctcgtggtcatcggtttcccgaacgctccctttgtgatgttccacgcggccgtgcacccgtgggagctcttccgtgggattgagttaccgcgtgatatgtttgatatcgaaaaggagctccagaagaacggcatgaagccgatgaccgacaccacgaaacgacgagcagcagcccagatccatggcgtgaaaccaaaggctaagcctaagaagaagcaacgcgagataactaaacggaccaagctcacgaatgcccatctgcctgagctgttccaacatcttaaatcttgattgtgccgttatcagcaactccgatgtatttcgtttcatcctacctctagttaatgtcatcacaattttatgtgtgcctgcaaccctagtttgtggttatgtgagctccaagatcttgatccgagagccctgttgtatgtagcataatctgacttgaagagtttgagattgttcttgatgatcataatcctctcaaaactgtcatggtgtagcatgccccatggaacgggttgtttcgttccggtggaatgtttggctgctagtggtagggcgtgcatgtgtttgttaaccggaatgagtgtatgtatgtgtagtatggt

SEQ ID NO: 1779 - DNA, 1206 bp, Triticum aestivum
  unsure (1)..(1206): unsure at all n locations
  Clone ID: PAT_TA_1779
cccgggccgacttctccatgagctccggccggaggcgccacgggccccctgctcgttcagataagctccaaactcgtccagatataccagccggtatactgccaattcgtgttgagctgctgaagatggtgtgcaccgacctggatgtcttttgcctatttgtgcaagtcgcaccccttcaggttgctcttaattgaatattctatgatttccgtaatggcttgtgcaggatcctggtgtggctagagatttatataaaaggaatagatccccaggctgataaggttgtatttaattttgattaccccaagaccgctgaaacctatctccacagggttggtagatcatgggagatttggccaccttggcctgggctgacgaatctgatcacctacaagtatcggtttaacttgtatcaggattgagcaggagcttggaatctgagataaaacccatacctcctcaggatagaccggaacgatattactgccaatagttatctggcagattaatcttgtatgccccaccctggaagttataagacaacttgtgtaaatagcagctcatcaggtttcatttacgtgatctttatggtgtatcttaagttgttttggggcgctctgggacaggtgaaagtgtagctagctcgtctaatttccatcggaccaggtgggtggatgtatcatggctaagctaaaacttgccgtcactgacaatagttaatgttgctaaccaggtgcctgttctgagactgttttccctaaaactgaaagacctctttttcttttgacaaatgtattggctggctagctttttgtacagggcatttttacactggtatttctttgagttgcgtgaccttggcatgcgcagatggatcattccacctgggccaagctgtcacgacgtatctgtgccctggcctcgggccttgtaccacgcgtcccttgtggctttgggtcgtgaactggatattggtctgtcaataatgtgcattcagctgcattgtgctacgcagtctagctcttgcatcatgcctaggcaatgtgcatgtatgtcattgtcctcgcttaaattctgctggatatttccaagttgacaatgtattgctgaataaacagagtttatctgctggtatctgtgctggacaagggatgccagtagacactgaactgttatttgctgcctcanaaaaaaaaaaannna

SEQ ID NO: 1780 - DNA, 536 bp, Triticum aestivum
  Clone ID: PAT_TA_1780
tttctatgccttccttcgcacccgaacgcaagaaagacagacagcaacgcggcgtggggaaaagcaggagcgaagcgagggatcgggaggaacaccggcgaggccatggcgcggcggggcacggaggcgttcccggacctgggcgcgcactgcgacagggaggactgcaaccagctcgacttcctgcccttcgactgcgacggctgcggcaaggtgttctgcacggagcaccgcgcgtacgttgagcacggctgcccgcgcgcggccgaccagggccgcaccgtcgtcgtctgcgaggcctgcggcgactccatcgagcgcgacggggcggacaagacggatgcggagatcctcgagacgcacgcgcggtcgcgccggggctgcgacccggccaggaaactcaagccgcgctgccccgcgcggcggtgcaaggagacgctcaccttctccacaacgagccactgcaaggggtgcgggcagaagctgcgcctcaagcaccggttccccgaggaccacgagtgctcgcgcgtgtcacc

SEQ ID NO: 1781 - DNA, 696 bp, Triticum aestivum
  Clone ID: PAT_TA_1781
actaaactcacggaagccttcgcacccgaacgcaagaaagagagagagagagagagagagagcacacgcggcgggggaaaagcaggagcgaagcgagggatcgggaggaacatcggcgaggccatggcgcggcggggcacggaggcgttcccggacctgggcgcgcactgcgacagggaggactgcaaccagctcgacttcctgcccttcgactgcaacggctgcggcaaggtgttctgcacggagcaccgcgcgtacgttgaccacggctgcccgctcgcggccgacaacggccgcaccgtcgtcgtctgcgaggcctgcggcgactccatcgagcgcgccgggtcggacgagacggatgcgcagatcctcgagaagcacgcgcggtcgcgccggggctgcgacccggccaggaagctcaagccgcgatgccccgcgcggcgctgcaaggagacactcaccttctccaacacgagccactgcaaggagtgcgggcagaagctgtgcctcaagcaccggttccccgaggaccacgggtgctcgcgcatgtcgccggtgggggccgccgccgccgcgaggagggccggcgactgcggccgcgacgcgcagaagacaaaggacggcggtgggtgcgcgctgccgccgttgatccggaatttcaattgattaccctgaagctgaaaatggggctgggat

SEQ ID NO: 1782 - DNA, 713 bp, Triticum aestivum
  Clone ID: PAT_TA_1782
catctctcactcactatcacatacaaacaaagcacctcttcattcattcctattgcaggtcaattgcttactatcattcttttacctttacacaaacaacagtcaccatgaagttctcttccctcctctttaccgcctcgctggtcgcggccatgcctgcctctatcgagcctcgccaggcccaggagagcatcaacaagctgatcaaggctaagggcaagctctactatggcaccatcaccgaccccaaccttctccagagccagcagaacaacgccgtcatcaaggccgacttcggtcaggtcacccccgagaactccatgaagtgggatgccaccgagcctcagcagggcaagttcaactttggcggcggtgaccaggtcgtcaactttgcctcccagaacggcctcaaggtccgaggccacgctcttgtctggcactctcagcttcctcagtgggtccacaacatcaaggacaagacccagatgaagaacgccatcgagaaccacatcaagaacgttgctggtcacttcaagggcaaggtctacgcctgggatgtcctcaacgagatcttcgactgggatggttcccctcgcaaggactctcccttcactcaggttctgggtgaggaattcgttggcattgccttccgcgctgcccgcgctgctgaccccatggcaagctgtacatccacgattacagcattgacgacc

SEQ ID NO: 1783 - DNA, 1203 bp, Triticum aestivum
  Clone ID: PAT_TA_1783
actgctgtaggtagcttggaatatgatgaatggtcaagtcatgttcaagcttggaaattagagtctgctgccatcattgagcctcaatgcaactttattgttccatttcatgctcagggcaaaaagaggcctagatgggcgcttgtcgataaagcacacttgcataatacgtggagatgttcacaatcatcataccacagataccgtacagatgccaatgtatctccatctagcctcatggttaatttggtgaaggatctcctagatctctcattacacaactacgaaactgttcgctcgtatgctggaagatcgcggacgcgtgggctgaagcactggccttctctaatttctgattgtgttcttaccctgactgagaatttgcgtgattcgaaagccctggaacatgtggtgcttggttcttgcagcattcttgcatcacagactgttttgagacacttgacaactgattctgcttccctctcttcatttatcatgggaattttgggaagctctcatcatgaatcgataaagtgtcagaaagctattaccgagctctttgtgaaatacaacatacgtttctctggaatatcaaggtcttttttcaagaattctcaaagtctggctgacaggccaggatttcttggattattttctcaaattaatgctttgggctttgagactaacagtctacattggaggtacaacctgatggctaatagagtacttctgttgctaattttggcatctagaagtgagcctgacatttattcacaaatcctggcagagactgctggtcatttcttaagaaatttgaagagtcaactcccccactcaaggatgcttgcaatatctgctctgaacacactattagaaggatcacctcacaaggcatctgtggaagatccacaacaatcattagatcaccctgaagaatgcaacattttgtccacaggaaagcttctgaatgacataatccaggaggaaggattcatgaatgacacactaaacagtctctcacatgtacatattatttctgatagtgatggttcatcaaaagcaagttatggcgcttcatcgtttcaaagcggatctgataaagcaatcacttacttctattttgatttctctgcctcgtggccatgtacccctagttggatttctttagtgggcgggggcacattctattccagctttgctaag

SEQ ID NO: 1784 - DNA, 590 bp, Triticum aestivum
  Clone ID: PAT_TA_1784
tccatcccgctccgttctatccattcccttcatcttcatagcagcagaacctcttttcctcatcctcctctactgttcttgatcgcttcagaaagacacatcaagtaattcgatcatgagctaccagcagggctacccacagcagggcgccacggcctaccctccgcccggccagcagcaggcctacgtcgcgccgccgccggctgcgtaccagcagggccaacagtaccctcctgccggcgccgacaccaccagccgcggcgggcacggccacggcggcgatggcttcttgaaaggatgctgcgcggcgctctgctgctgctgcctcctcgacgcctgcttctgatcgacttcatcccatgttgttggacccacactatcaggcgcggcatatagattatagagtatcgtcatattttgcttctttctcgtaacgtggtacatgtgttgagtactgtctcagaacaatatttcttgtgtaatggtgtgcgtttttttcattcgtatgatccagatatatagatagacatgtcagattgatctgatggccttaccgaatgcatattttctcggggttcccttttttggat

SEQ ID NO: 1785 - DNA, 1318 bp, Triticum aestivum
  Clone ID: PAT_TA_1785
ctcccccccaggcccaccccacaggcaccactggttcgtcctccccctcggtcgcctgtgcccgccccgctcggccgccccgccccccccctggggctgacccccgccccacccgtgcctggcccgccgccgctgggcacctgccgaacgtgcgactgctccacctccacgcgcccccaggcgccggccatcatcctctccttcctccaggacgccgtccgccagcacgtcggcccgtccgcggcgctgctccgctccccctcccccgcctccatcgcgtggggatgcggcggctctgtcctcctcgacaacaccacaagcgccggccgggttcgacaaggattcctccgtcgccacgctccgtccggcagcgtcccttcgcctccgccccggacctgcactccgacgccagggcctaagcccgtggtgtagtcaggtgcgccctcgcccagcccgccttcttcgacccgtccgtccagtccaatggggaaaatggggcagatgcaaggtgctcagctgggaaccacggtcagatccgcacggactgctccatgcccaacgccgcccgcagtgccggcgacgagctgccgtggtccgtcgtcgagaccgccgtggagagcttggtgttgtaggtagtagtagggtttagtccatggatctcaagcttgttttatgttttggcaaggtttggactttggaagtcagagtgcatggcgtgtttagtttgttgagcaagaccgaaccagttaaataaagagaccttctcttgactcaaggtggacaactccaccgccaacgacatccgcacgccggacgtgttcgacaacaagtactacgtggacctgctcaaccggcagggcctcttcacctccgaccaggacctgcacaccgacgccgggacaaagcccgtggtcaccaggttcgccgtcgaccagggcgccttcttcgaccagttcgtcaagtccatggtgaagatggggcagatcaacgtgctcaccggcaaccagggtcagatccgctcggactgctccctgcccaacgccgcccgcagcagcgccggcgacgagctgccctggtctgtcgtcgaggccgccgagagcttcgtgttgtagttagtgggctttagtcggttcatctctagctgtttgtttcctccgcaatggtttggactctggatgtgagagtgatcgcgtgtgtaagtttgtcaagcaacgagaaatattactgtggccctcgtgtaatcggattcaagaaatacatggtttgctaacttgggagaaggaaaaaaaatgagaagatttctcttgtcacctttgtt

SEQ ID NO: 1786 - DNA, 407 bp, Triticum aestivum
  Clone ID: PAT_TA_1786
gcggaccacagcggcagttctttcgccttcatggaggatgccgttgcgccagacaccagagccccgtcttccaagatcaacgcgacgcactcggtgaacattgtggccgagagcgtcgcgagcacaaaggcggggccggtgggccggtcgtcgaggaggtcgtcccgagacttcgaccacgccttcctgaatgaggccatggcgtcggagacaaaagcaccgtcgtccaggatgaacgcgacgcacacggtgagcatcgtgtcggagagcgttgccagccagaaggccgggccggcaggccggtcgtcgaggcggtcatcccgcgacttcgaccacaacggcaactcctatgcctccctgctcctcgaagacattcagagctaccaccagcagaacgccagcgacac

SEQ ID NO: 1787 - DNA, 472 bp, Triticum aestivum
  Clone ID: PAT_TA_1787
atccgtcacaggctggacctcagctacaacaacctctgcgggccgctccccaagctgcacggcgtcatgcggcacggctgcaaggcctacgagcacaacctctgccaccgcggggcgggcggacacgtgggctgccaccagctctgagctcgccgccggcgcccggcaggcgtacgttatatgagtggtgtgttggcgttctcgtgcgcatacggacgcacgaaggacggtgctttggggcttagtaaactcactagtggagtggagcaccgcggtggtggcaatgcctgacacgcgcggtccttgagcttgtgtacgaaacgatagagatgtgtgtgcgtgccgtgtcctgtgtgtgtaccgtctggagatgcgcccgagagtgtgtgtgtgcccgtgttcgggatggatggatcatcccagttacctgatgtatcaactgttaaatggtaattatgtttggcttactttt

SEQ ID NO: 1788 - DNA, 827 bp, Triticum aestivum
  unsure (1)..(827): unsure at all n locations
  Clone ID: PAT_TA_1788
cgtccgcccacgcggccgcccacgcgtccgctcaacacttccgccaccttgggctcctccacagctagtagaaggtaggcacccacagccacagccacagccacagggccacgatggcgtcgaccgcctccttccttccgctgctcgcgctcctgctcgtggcgacggcgcattgctcgccgctgccccagcggtgcccgcaggccgaccggcaggcgctgttccgggtgaagcaggcgctgggcagcccgttgacgctgaagacgtggtcgccggcgtcggcggactgctgcgcgtgggaccacctcacgtgcaacgaggccgggcgcgtgaacaacgtcttcatcgacggcgccgacgacgtgcgcggccagatcccgtccgcgctggcggggctgacggcgctcatgtcgctctcgctcttccgcctcccgggcctccagggctccatcccggcctgcctcacctccctctctaagctcgagttcctcaccgtctcccacaccaacgtgtccggctccatcccggagtccctggcgcgcctccacagcctcgactccgtggacctctccaacaacaagctcacggggtccatccccaactccttcgccgacatgcccaacctccggtcgctggacctccgccggaaccagctcaccgggcgcatcccggccagcctcgtgcaggggcagttccggtcgctggtgctgtcctacaaccagctgacgggcccgatcccgcgcgacgacgcgcaggacgagatcaacnacggtggatctgtcgcacaaccagctgagcggcgacgcttccttcctcttctccgaggg

SEQ ID NO: 1789 - DNA, 1508 bp, Triticum aestivum
  Clone ID: PAT_TA_1789
gcacgaggccttcggccccactccgccccgagcaaaacttccgccaccttgggctcccccaccgcttccgccaccttggcctcctcctccatagctagctagcaaagctgagctaggagaaggtagcacccacccacagccacagggccacgatggcgtcgaccgcctccttcctcccgctgctggcgctcctgctggtggcgacggcgcattgctcgccgctgccccagcggtgcccgcaggcggaccggcaggcgctgctccgggtgaagcaggcgctgggcagcccggcgacgctgaagacgtggtcgccggcgtcggcggactgctgcgcgtgggaccacctcacgtgcaacgaggccggccgcgtgaacaacgtcttcatcgacggcgccgacgacgtgcgcggccagatcccgtccgcgctggcggggctgacggcgctcatgtcgctctcgctcttccgcctcccgggcctccatgggctccatcccggcctgcctcacctccctctccaagctcgagttcctcaccgtctcccacaccaacgtctccggctccatcccggaagtccctggcgcgcctccacagcctcgactccgtggacctctcccacaacaagctcacgggctccatccccaactccttcgccgacatgcccaacctccggtcgctggacctccgccggaaccagctcaccggccgcatcccggccagcctcgtgcaggggcagttccggtcgctggtgctgtcctacaaccagctgacgggcccgatcccgcgcgacgacgcgcatggacgagatcaacacggtggatctgtcgcacaaccagctgagcggcgacgcgtccttcctctttctccgaggggcggcccatcgggcaaggtggacctgtcctacaacaacctcgagttcgacctgagcaagctcaagttcccccaggagctcacgtacctggacctgagccacaaccgcatcagcggcaccgtgcccaggtcgctggaggcgctgtccacgctgcagacgctggacctcagctacaacaacctctgcgggccgctccccaagctgcacggcgtcatgcggcacggctgcaagccctacgagcacaacatgtgccaccgtggggcgccgctggagagcagctgccaccagctctgagctcgtgagctcgctcgccgccggcaggcgtacgttatatgagtggtgtgttggcgttctcgtgcgcgtgcgtacgtacgtggttatgtgtacgaactacgaaggacggtgctttggggcttagcaaactagtggagtggagcaccgcgctggtggtaatgcctgacacgcgcggtccttgagctctgtgtacgaaacgatagagatgtgtgcgtgctgtgtgtgtgccgtctggagatgcgccagagagtgtgtgttgccgtgtttgggatggatggatcatcccagttacctgatgtatcaagtgttaaatggtaattatgtttggcttacttttacaaaaacc

SEQ ID NO: 1790 - DNA, 624 bp, Triticum aestivum
  Clone ID: PAT_TA_1790
cagctcaaatcccacgcaggcgaagcacccactcaaaccctagcctcctccccactccatctccgatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatagcgcaggacttcaagaccgacctcaggttccagtcctccgccgtctccgccctgcaggaggccgccgaggcgtatctggtggggctcttcgaggacaccaacctgtgcgccatccacgccaagcgcgtcaccatcatgcccaaggacatccagctcgcccgccgcatccgtggggagcgcgcctaggtttggccgtagcagttcgtgtcttgcgatctggttgtactaaggaaatgtgctgggtttctctgtagtgttgataagctttccagatgttctgacgctgaaatgaaatggtaatgaaaagttcagttatcttttgatgcaattttgt

SEQ ID NO: 1791 - DNA, 652 bp, Triticum aestivum
  Clone ID: PAT_TA_1791
accaaagctcctctacccccaccggcgaagcatccaaaccctagactcctccccccaccagctccgatggcccgcacgaagcagacggcgcgcaagtccaccggcggcaaggcgccgcggaagcagctggcgaccaaggcggcgcgcaagtcggccccggccaccggcggcgtgaagaagccccaccgcttccgcccgggaaccgtggcgctccgggagatccgcaagtaccagaagagcacggagctgctcatccgcaagctccccttccagcgcctcgtccgtgagatcgcgcaggacttcaagaccgacctccgcttccagtcctccgccgtctccgccctgcaggaggccgccgaggcgtacctggtggggctcttcgaggacaccaacctgtgcgccatccacgccaagcgcgtcaccatcatgcccaaggacatccagctcgcccgccgcatccgcggggagcgcgcctaggtttggctgtagcagttcgtgtcttgcgatctggttgtaaggaaatgtgctggctgggttcccatgtagtgttgatatgatctttcttctcgtctctggtgatctttcctgatgtagtgtgatgctgaaacgaaatggcaatgaaaagtgcagttatcttcggatgcaaaattgt

SEQ ID NO: 1792 - DNA, 681 bp, Triticum aestivum
  Clone ID: PAT_TA_1792
ttaggggcctttttttttttttttttcgataactgaactttccattgcaatttcattcgaccatcaccatacataggaccagatgacacatcatatcgacaccgacaaacagaagcaccagacacacaccaggatcacacgacaagaacagctagcaagcattaccggcgaccaggacgaacctaggcgcgctccccacggatgcggcgggcgagctggatgtccttgggcatgatggtgacgcgcttggcgtggatggcgcacaggttggtgtcctcgaacagccccaccaggtacgcctcggcggcctcctgcagcgcagagacggcggaggactggaagcggaggtcggtcttgaagtcctgcgcgatctcccgcaccagacgctggaaggggagcttgcggatgagcagctccgtgctcttctggtacttgcggatctcacggagggcgacggttcccggcctgaagcggtggggcttcttcacgccgccggtcgccggcgccgacttgcgagcagccttggtggcgagctgcttcctgggcgccttgccgccggtggacttgcgggccgtctgcttcgtgcgggccatcggggattgggggtcggcggctctggtggtggtgtgttcttgggagatcgggtgcggcggcgatctgagttgccccggcccggccggc

SEQ ID NO: 1793 - DNA, 2084 bp, Triticum aestivum
  Clone ID: PAT_TA_1793
cgaaaattcccgatcccccgcccacgccccgctcccctacttaacccccgccgcctcctccgtcccatcacacccaaactcaaatccctcaccggcgaagcatccacacccaagccccctccagctccgatggcccgcacgaagcagacggcgcgcaagtccaccggcggcaaggcgccgcggaagcagctggccaccaaggcggcgcgcaagtcggccccggccaccggcggcgtgaagaagccccaccgcttccgcccggggaccgtcgcgctccgggagatccgcaagtaccagaagagcacggagctgctcatccgcaagctccccttccagcgcctcgtcagggagatcgcgcaggacttcaagaccgacctcaggttccagagctccgccgtctccgccctgcaggaggccgccgaggcgtacctggtggggctgttcgaggacaccaacctgtgcgccatccacgccaagcgcgtcaccatcatgcccaaggacatccagctcgcccgccgcatccgcggggagcgcgcctaggttttcggtcgccgccggtgaaactgggtagtagctgctcgtgtctggtgtcttctgtctgttggtgttgatatgatgtgtcgtcttgtcctatgtagcctgggaatgaaatggcaatgaaaagttcagttatcatctggtgctgcgctcgaggggccgggcccagatcccccatcccatcccatgagacgcgaaaacagcaccgaccattccaagagcaagcggccatcaccatacatacgaccgggccgcagcggctttacctaccgagaagaagagaaaaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccagggtgccaggctttgcaggaatggtgacttgtacgtcttctgaatcacgtgctatttgcaagtagtgcgcttgccgcaataaaacaagccagagcctgttgtaagggagggccgacatcaaaggagtcagcaatggtggatggtgtggctcgaggtggaggcccatcagtacacccggccggctctgagccccatttctcttcgagtgccttatccatccttatgcttcgggggaagccactgaccaggaacggtcattgacgacaacccttgttgaagatcaaggaacgtgctgggcagtgtacgagggcgcacctgagcaagtccaagtacctggctggaagactccctcagtcttgcggaccttaaccatgtgtctgtcaccctgtgcttggcggctacaccctacgcatctctgttcgacgcgtacccgcatgtgaaggcctggtggactgacctgttggcgaggccgtccgtccagaaggtcgctgcgctgatgaagccatgatcttagtttctggcgctcgttcgtcgcgaaataagccgaggtgtgtcccccctgatgtgtgcctgtacgagtgtgtgttcttgtgatgtctcctcgtgttgattgttcaggcttgtgcttgcgatcctgtctaatcttgtactgaaatgagcattcctgtgctctggtttaataataaattgtgcctaggtataaagattatctcagcttcaaaaaaaaaaaaaagatagggtcaaatacagaaaatacaacaccataatcctgcccatgacccggaattccgtttcttctgttcaatgagttgggtcttattggccgtgtaatgttgcttctgaattcagtggtagtagaggcctagaggccggaggccgatgatcaggcgtattggctttgggttaaggctgctggattaagagccttcttttgtagttctaagcgctgttttggagctgtcatggttggatgtaatgctgtgtttgttggagtttgtcttggtttcagtcttctagtgttgaacttaagttcattttggatgatgaaaactcgtcttatttgggc

SEQ ID NO: 1794 - DNA, 994 bp, Triticum aestivum
  unsure (1)..(994): unsure at all n locations
  Clone ID: PAT_TA_1794
gggctgcagnattcggcacgaggcggngcgggcaggcggaagaggtggccgacgtgatcgaggagctggagcagacgttggccacgccgacgccgctgctgcgcggcatcgcggacgccatggtggaggagatggagcgcgggctgcgcgccgacccccacgccccgctcaagatgctcatcagctacgtcgacaatctgcccaccggggatgagcatgggctgttttatgcactggatcttggtgggaccaactttcgtgttctacgggttcagcttggaggaaaggagaaacgtgctgtccaacaatatgaagaggttcccattccacctcatctgatggttgggacttccaccgaactatttgatttcattgcggctgagctcggaagcgtgggtgagactgaaggagacgatttccacttgcctgagggcagacatagggaactgggtttcaccttttctttcccagtacaccaaacatcgatatcgtcaggcaccctcgttaagtggacaaagggattttgcatcaatggcacggttgggaaagatgtggtggctgaactgagcagtgctatggagaggcaggggcttgatatgaaagttacagctttggttaatgatactgtaggcacattggctggcgggatctatgctgataatgatgtcgttgctgctgtaatattgggcactgggacaaatgcagcgtatgttgagcatgtagatgcaattccaaaatggaacggaccactacctagatcaggaaacatggtaatcaacatggaatggggaaactttaagtcagacaagcttccccgttctgactacgatattgnccttggattttgaaagtttgaaccccggcgngcagatgtatgagaantcatnccgggcatgtatcttggagaggttgtgcgaaggatcttgcttaggctggctcatgatgcttccttatttggtgatgttgttccatcaaaattggagaanctatttgt

SEQ ID NO: 1795 - DNA, 429 bp, Triticum aestivum
  Clone ID: PAT_TA_1795
cggacgcgtgggattctgacggtagcttcatcccaaaacctgattactggggtggctacagattgacaccaaatctttttgagttctggcaaggccaacagtctcgtctgcatgaccggctacagtattcacagcgagaaataggtgggggtacagaatggcacatccaaaggttgtccccttgatcagtaagctccttaaagctctcgcctcttggtaataaaagggggtgtcgttttggcacctgcgcacactttttcctggtacctaatggactgcaatttcttgattggagatgtgcgctagatgtatttttgtgatatatatgtgaatgcagagaagcaggatacgtgaggtgtatgagccgatttaatgcagcgggcccaaactcgcgaggcaagctgtgaagattgctgctatgttgcttgt

SEQ ID NO: 1796 - DNA, 1569 bp, Triticum aestivum
  unsure (1)..(1569): unsure at all n locations
  Clone ID: PAT_TA_1796
gccgccgcggnagtgacgcacctctcgcagcgcgatgccgcggatatcgacgagcaactcatgggccccctcggtttcagcgtcgaccagctcatggagctcgctgggctaagcgtcgctacggccgtcgcggaggtttataagttgagtgaacatacaagggttcttatcatctgtggtccgggaaataatggtggtgatggtctggttgctgctcggcatctttatcattttggatacaagccctttgtttgttatccaaaacgtacggcaaaacctctgtattctggtcttgttactcagcttgaatcgctggctatcccgtttgtgcctgttgaagacctacctcaggatttatcagggcagtatgacattgttattgatgcgatgtttggtttctcatttcatggagcaccccggccaccctttgatgatcttatccaaatgcttgtttcattgagtgttattggtgattcagcgaaaagaccgccaattgtttctgttgatatcccttctgggtggcatgtagaggagggagatgtcagtggaggaggaattaagcctgatatgctggtatcattgaccgcaccaaagctctgtgccaaaaaatttactggaccccaccatttcctagggggtaggtttgttccgcctcccatttcaagcaaatatgggcttgaacttcctccatatcctggaacctctatgtgtgtgagaattggaaaagtgccgtcagttgacatttcatctctcagggagcgtccgatttccccggaacttcttgagaatcaagtgatgcctaatccgtttgaccagtttcgtacttggtttgatgaagcagttactgctggcctgcgcgaacctaatgccatggctttaacaactgtcaataaagcgggaaagccttcttcaagaatggttcttttaaaaggcgttgataagcagggattcgtttggtacacaaattacggtagccaaaaagcacatgatttatcggaaaattcaaatgcggcacttcttttctactggaatgagatgaaccgacaggttagagtagaagggtcggttcagaaggtctcagaagaagaatctgagaagtatttccacagccgcccacgtggaagtcagcttggtgcaattgttagcaagcagagcactgtcatttctggaagagaagttctccaacaagcgtacaaggaattggagcaaaaatattctgacggtagcttcatcccaaaacccgattactggggtggctacaggttgacatcaaatcttgctgccttcgggcttggccagctggctccgcggctgggccggctaccgtagtctctgcgtgacgtacgtgggaggacagatcggcacatccttctggtggcccctcgttcatggaccctccctagcgcgcgccccccttggtagttggagggggtgcctgtcccgcacgtgcgcatttccccacctcgatccaaagggtccgcttctacttatttgctgtactgaactagcatttttcccggccgccgctgattcgatcaaagaacgtgctactttgttgaaaaaaaaaaa

SEQ ID NO: 1797 - DNA, 1271 bp, Triticum aestivum
  Clone ID: PAT_TA_1797
cgaggctttttatcttcgaaaatatgaggtacctccgagtgcttgacttagaggacacactggggttaagagatcatcatcttgataaaatcgggcagctccatcaactcaagtacctttctctacgaggatgtcacaacattttatgcctgccgtccggtttggggaatttgaggcacctccaaacactggatgttagaggtacccgtatatttgagttgccaacaacaatcaccaatctccgggagctgcagtaccttcatgcagatagtggtcagaatgcaggaggcaatgtcaagggagatgacatagttcaaatgtatgatgctgatggtttttccgaaggtgggacatgtgccaattgtgtgttcagctctcatgttttcttgagaccacaagttttagatgctggtttgaacaggtatgatatattcaatctatactgcttccaggagaggcagctagatggtgttgtgcttcctagagggattgataaattgaaggttcttcacacatttaggttttgtcaatgtttctcatagcaatggaaagaccactctaaaacccacgcggccgcttacctcaggtgcgtaagcttagagttgctggtattagtagcggaaacactaaggagttatggtctgccattgctggtcacaatcaacttggatctctatcagtggcaagtgaaatatttcatggttctttggatggttgtttgggtgaaggtttgttgccaccaagcagcctggagagcctcactctggaaggtaggctagccaatgtaacaaaatggatccatatgcttcagaatctctccaagctggtactacgggagagctacttgagtcaagatggtgatgccatacaagcccttgggttcctaccaaatattgcagtcctacgcctctgggaggcgttcacggggatagatctccaattccagagctcatctttccctagtctcgtggagctacaactctcacgattatacaacctcgagtcggtgttgtttgaagaaggcacaatgcctaagctcgagctgctacaagttgatttttgcgtccgcctgaatggattctccgggctgccagcggtcctcacaagcctcaaggaaattcggttgtctaatagcaaactcaagaaagacatggagaggcaggtggagcatatgaagcacgtgagagttgttagatgtgtatagccccttttcggtttattctcattgtataaggggtctcttgtactttaccatacgcatgtatatgtat

SEQ ID NO: 1798 - DNA, 2060 bp, Triticum aestivum
  Clone ID: PAT_TA_1798
ttctctctggttgccgcggccaagctgagtcgccacggatctcgcggcggagaagggggagcgctggaggggcccatgagcctcgccgtctccgccctggaggcggccctgcaggcggtgggccgcgcccgcgacgccgccggcgaccaccgcctgctctactgcaagggcgccgggaggctcgtcacgctcgacgaggcccgcgcgcgggacctgcccatcggcggcggcgtcctctgcggcgtgccccccgacgtcgaggtagaggcctaccgcggcaaccccgagcgcagccgcccgcccccccctggtgccgcccccgacgagcccttcgtctgcagcttcgataagatggcggagcatttcaacaggaaggcgagcttgctggaaacagtcccgctgggttccttcaactcgctcttcagctttactggttcttggaagaatgatgcagccgcgacaaaggcccttgcagttgatggctactctgttccgctatatagagttaaaataactagtgatgaactgattctgcaagagagtgtaaagctcgcaattccatatacttgggatccaccagcattggctgcccgtggcgagaattacggcacacatattattacttctgtaatggttggcggtaaggatgaagtatacataaagcagcattcctcatcccaattgtctgaaatggagttcagaaattatgtcagagaaattgggaacgagaggttctcagatgtggagaacaagtcaaatgcaccccccatcaattatagcgaaaaggacatgacagtaatcttcagaaggaggggaggttgcgatcttgttcagaattctgttgagtggataaaaactgtttcctcagcgccagatgtcataggcatgacatttctccctattgtttcactcgtcgatgatatacctgggaagaagcacattgctcgtgccattgatctatacttgacatacaaacctccaattgaagagttacaatacttcttagatttccaagttccactagtttgggctccggtaccactgggtattgctggacaaaatagaaaagagcctgtgtgcccgtcacttcagttcagcttgatgggcccaaagctatttgttagcacagaacaggtatctgttgggcgtcgaccaatcactggcctgaggctgtgcttggaaggaacaaaacagaaccgtctggctattcatttgcagcaccttggctcgttaccaaagatatttctacctcactgggactcgcatatcacgatcgggccaccaaaatggcaagggcctgaagagcaggatagccgatggttcgaaccaatcaagtggaagaattttgctcatgtcagcactgcgcccatagagtacaccgaaacaaatatcacggatctgtctggcgtttatattgtcacgggagcacaattaggagtgtgggattttggtgcaaagagcgtgctccaccttaaacttttgttctccagagttcctgggtgcacaatcaggagatcagtgtgggaccacagtccaagttctgcgatgcatagaacagatgaagcttcatcgtcctcaagtgacaatgctaaacttgtgaagattgtcgacatgacagagacgttgaagggtccgcaagacgcacctgcccactggctggtgacaggagcaaaattaggcgtggagaagggcaggattattgtgcgtgcaaaatactccttattgaactattgaccaaagtgttgagagcattcattcattcgctctgctatggagcaccatgtttaaagatagcattgttcttttgttcatgtatggtactgtatgtaacatgtctggaatcatgcttcttgcgttgatgctatgagcgaagtagcatggacaacgttttttttgtccagttcaaaaatatttgatctggccctggtcatttccttccgaatcatcatagcccgccaatggaatttaatgtattgtgtgttttctgcatcagcgatattgttgcttgctttgtggtgatctgatttcaatgttgtgtttaaaagagtaaaaaaaaaaaa

SEQ ID NO: 1799 - DNA, 850 bp, Triticum aestivum
  unsure (1)..(850): unsure at all n locations
  Clone ID: PAT_TA_1799
tcccagtcttggcctctctctccccgtctcccgtctcccttcccagccgcctcgtgcctcgccctctcccatctccgactgcgccgccgccccctgtgccagcgttgcttgctccggccccgttatcgccgactgctcagctccagtactcagagatggcggcgaggagagccagcgcccgcgcgcggcccaacgtgctggtgacggggacgccggggacggggaagacgacgacgtgctccctcctcgccgacgccgcgggcgtggcgcacgtcaacatcggcgacctggtccgcgagaagggcctccacgacggctgggacgaggacctcgactgccacgtcatcaacgaggacctggtttgcgatgagctcgaggacaggatggaagaaggcggtgtactagtagattatcacggatgtgatttctttccagaacgttggtttgaccttgtggtcgtgcttcagaccgacaactcaattctgcatgatcgcttgacgagcagaggctacatgggtgccaagctcacaaacaacatagagtgtgagatcttccaggtgctcctggaggaagcgagggagagctacaaggaggatatagtgatgccgctgcgaagcgacagcgtcgaggatatcagcaggaacgttagcacgttgacggagtggataaacaactggagaccatcccagtgagctaccagttcgccgtatgctttcagtgtcgagttagattgtcgggggattgtgttgtggatggagcccgtgggggcaagctgactgtaaattagctggtctggtcgagttntttcttattacaagtgcgatgcgtgatttgaatttgtaccgatgaa

SEQ ID NO: 1800 - DNA, 903 bp, Triticum aestivum
  Clone ID: PAT_TA_1800
gccgcctcgtgccctcgccctctccctcctatctgcgactgcgccgccgccccctgtcccagcgactgcgccgccggcatccacctgaccgtcgctcgctccggcctcgttatcgccgactgcccagctgagatggcggcagatggcggggaggagagcgagcgcccgcgcgcggcccaacgtgctggtgaccgggacgccggggacggggaagacgacgacgtgctccctcctcgccgacgccgcggccgtcgcccacgtcaacatcggcgacctggtccgcgagaagggcctccacgacggctgggacgaggacctcgactgccacgtcatcaacgaggacctggtttgtgatgagctggaggacaggatggaagaaggcggtgtactagtagattatcatggatgtgatttctttccagaacgttggtttgaccttgtggtcgtgcttcagaccgacaattcaattctgcatgatcgcttgactagcaggggctacatgggggccaagctcacaaacaacatagagtgcgagatcttccaggtgctcctggaggaggcgagggagagttacaaggaggatatagtgatgccgctgcgaagcgacggcgtcgaggatatcaccaggaacgtgagcacgttgacggagtggataaacaactggagaccatcccagtgaggtaccgatccgtcgtatgctttccgtgttgagttagattgttattggattgtgttgtggatggagcccatgggggcatgctgactgtaaattagctggtctggttgggttttttctcaattaaacggtcatgcgtgatttgaatttgtaccgatagaaagatgggcgttgctgcatgagttaaatttgtatttgttcgctactagtgtatttttcttctccaa

SEQ ID NO: 1801 - DNA, 1151 bp, Triticum aestivum
  unsure (1)..(1151): unsure at all n locations
  Clone ID: PAT_TA_1801
accccacgcgtccgcccacgcgtccgcggacgcgtggggccatgctcacgtttgaatcacttgctgaaactgcggaatttgcaaggagatgggttccattttgcaagaagttctccattgagccacgaacccctgagttctacttctcacagaagattgactacttgaaggacaaaatacacccgtctttcgtcaaggagcgtagggctatgaagagagattatgaagagttcaaggtgaggataaatgctttggttgccaaggctcagaagacacctgaggaaggctgggtcatgcaggatgggacaccatggcctgggaacaactctcgtgaccaccccggcatgattcaggttttccttggtgagactggtgctcgcgactacgatggaaatgagcttcctcggctagtatatgtttcaagagagaaaagaccagggtatcaacaccacaagaaggcaggggctatgaatgctctggtccgagtgtctgctgttctgacaaatgctccctacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgtcgtgttctttgatgttaacatgaaagggcttgatggcatccaaggcccagtttatgtgggaactggttgttgtttctataggcaagcactctatggttatgggcctccatctctgcccgcacttccaaaatcttcgatttgttcattctgttgctgctgctgtcctaagaaaaaggttgaaaaaactgagaaggaaatccacagagacctcggaagagaagaccttgagtctgccattttcaatctacgggaaatcgacaactacgacgagtatgagcgtcatgcttatcctcagatgagccttgagaagtcgtttggactgcctcgtccgtattcattgaatcaactcttatggagaatgggggtgttcctgatcttcgacccttctacactgataaggancatcaagnatactgggtataaagaaacnatnggaaaaaatggtggttaggtaattcnagaatctacnggt

SEQ ID NO: 1802 - DNA, 939 bp, Triticum aestivum
  unsure (1)..(939): unsure at all n locations
  Clone ID: PAT_TA_1802
gcggccgcccgggcaggtactgtggtggatgtagatccagtgtggaagggccttctcatgcacaaacacaggatagggtggttcaccgtggagatagtaacatgaacaccgccgatagcagttctggttcgttgggcagatctacaccaagtggagtgttccatagaccaccaccaataaacgttcagccttctttgcaaggatttgatctgaatctctctccaatagaaacccctgaggaagataagcgagccgagtcacatctctcagctgaacctgtatcaactcctactgggaggcatgcaactcttgatagaaggcgtgccttgaaccgacgcattcgtattcttctatttagacctaggactgcaactaatgcttggcagaatagcattcagcaagacagaagcgcaccagcaacagaacaaaatcaacggaacgcctgcacctctacagatgtgagcccatcatgttccagggctgattttatgcagagccagcagagtagctcacattttgtacagtctgcaagtaatcttaatcaatgcactgatgagggtggaagcaatttccgagaagttgcaaatgccaaggaccagctgattcctattgtcaagaagagcatcaagcacatttgtgcccggtccccattgggtacgtatagcggtctgagcaaactgttttatcgtatcaatttttcgagcacccacaagttaacatttgggtgtaatagtttgattttatccttagcatattagattacctagagattgagtagccttgtattttcatatttaaaatggttgttagagaaaattaattcagtttatgctagggcatcatcccattgtagcaggtgtggtcccaaaataaattatctaaactggaaatgtctcaggtttgtgggcgtcgcatcttgaattatnacctggaaataac

SEQ ID NO: 1803 - DNA, 928 bp, Triticum aestivum
  unsure (1)..(928): unsure at all n locations
  Clone ID: PAT_TA_1803
ctcgtgccnaattcggcacgagctcgtgccatagcaacgatggncggcgccgggaggaggaggacgacgacggcgtgcgtgaccggcgcgggcggattcgtggcctcgtggctcgtcaagctgctcctctcccgcggcggcggccgctacgccgtccacggcaccgtccgtgaccccggcgacgccaagaacgcgcacctggcggcgctggacggcgccgcggagaggctgcggctgttcaaggccgacctgctggactacggcagcatggcggcggccattgccggctgcgacgccgtcttccacgtcgcctgccccgtcctcgccaaccacacccccaaccccgaggctgatttaattgcccctgctgtgactggcacgatgaacgtcctgaaagcttgctccgaagctaaggtcaagagggttgtgatggtgtcctccgtcgctgccgtcatggtgaaccccagctggccggaaggcaagcccatggatgaagactgctggtctgacgtcgactactgcagaaccacagagaattggtactacctttccaaaacactagcagagcttcaggccttcgattacgcaaagagaagcgggttagatgttgtgaccgtctgtccgtcgctgggtgatcgggcccttgctgcaacctacggtgaatgcgagcattcggtcatagttgattccttgaaaggtgataatgaggtaaaagagcaaatcaagaatccgnggatttccagacgttnccgatctctcancttgggntatgaaacccagangctcccggacctatgtttgcattcacatgcaangaaatcnctgattcaaaaactgatgaaaggattacccgcttanacatttccaacaagtgtccaaatggntganaactccttaatnaaggaactnaaagctggctgggaaacaa

SEQ ID NO: 1804 - DNA, 674 bp, Triticum aestivum
  Clone ID: PAT_TA_1804
gccgggctcgcttctggtctatataacgaggccctccccgcacgcttcctcctcacatcgcacataattttagagacattttacaagagagcacatcgagagaaaatagaagagaagagaagagaacatatcctgatccccatggagagagttgcatcgcgctgcgtcagccttctcgcacaaaggaggggctactccgcggccgcggccatggtgaagggagctaggaggagcgcccccgccgccgaggagaagaccgctgtcgcggcgaagagcgcaatggcggccaggaaggaagtgggcgctagcgcggagaaggcggcgtgggtgccggacccggtgaccgggtactaccggccgtcgggggcccccaaggaggtggacgcggccgacttgcgcgccaaactgtgctgctaagcaaagcaagcgaactcattgacggccgcccactagaacatttcttcccttaagcctaagcataaaactgaagattgtgaggcgtttccacagctctgatcgagcatggccactttctcctagcgcgacgtgtctaggagaattcgcactcgtaattctctttctcaatgttctcttgatacaagaatataattttgtactgattgattaaataaattttttttcaaaacggaagcaaaagatttgcctcatcgagt

SEQ ID NO: 1805 - DNA, 1438 bp, Triticum aestivum
  Clone ID: PAT_TA_1805
cgcccggcccgccgagtcccacgccgcgccgcccgccgccccccccccctgccgcccctgccccgcgccgccgtgccccccccccagctccctggccgccacgggccccccctccgggggccgcggcctcgcccctgccgccccgcccccgcccccccccccgctcccccccccgccacgccccggccgcccgcggcggcccgccccgccgccgccccggcggcgacggcgccccgccgccccgcagctgccgccgcggcgccagaagcgctacgtcgaggagctggaggagaaggtcaagtcaatgaactcggtcataaacgacctcaattccaagatctccttcattgtggccgagaatgcaacactgcggcagcaactcggtagcggcggcgggaattgcgcaccgcctgggatgtatccaccgggagcagtgcccggcatgcatttcccttgggtgcctgggtatgccatgcggcctcatggttcccatgtccctcttgtaccaattcctcggctaaagccgcagcagcaggtgaccgcaaccaaggccacaaagaaaccagagaacaagaaggccgtggacagcaagagcaagagcaagaccaagaccaagaaggtggcaagtgttagccttctcggtttgatgcttgttatgctcgtctttggtgcttttgttccagggttcaatcacaattttggattgagtgggggaagtgacaatgcaatgtttaggaattttggtcagcctcatgatagggtagtcaatgtcaataaccatggtcaagcacctaaagggggtttgaacaatagtgacatgactggtgttgattctggaatgatgattgggactgatggcagtgctgaccgggagcatcaacctccacttaactcaagtcatgcatttcctttgggtgcctatgtatgccatgcgggctcgcatgtcccatgtccctccaatcccaattcctcggctgaagttgcaagcgacggtgacctagaccatggccggacgcgtaggagagaacaagaaggccgtggacagcaagagtaaatccaagaccaagaccaagaaggtggcaagtgttagccttctcggtttgatgcttgttatgctcgtatttggcgcttttgttccagggttcaatcacaactttggattgagtgggggaagtgacaatgcaatgtttaggaattttggtcagcctcatgatagggtagtgaatgtcaataaccatggtcaagcacctaaagggggtttgaacaatagtgacatgactggtgttgattctggaatgatgattgggactgatggcagtgctgaccagaagcatcaacctccacttaactcaagtgagaccttgcctgctttgttgtatgtgccaaggaatggaaagcatgtcaagatcaatggcaatctgattattcattctgttct

SEQ ID NO: 1806 - DNA, 935 bp, Triticum aestivum
  unsure (1)..(935): unsure at all n locations
  Clone ID: PAT_TA_1806
nttgcaaaaaaagggggnnnnnnnnananaattcaccaaaaagaggaaaaaaaaaagactgatgggctgaccgacctcctgtgcatgttttgcagctgaaccggttccagggcgggggatacgccgtcggcgtgagctgcacggtgctgctgtccgacccgctgtcgctggcgaggttcctccgggcgtgggcgcgcacgcacgccgagatgaaggagcagggcaaggtcgcccccacgcccatgatgcagtacatggcctacttccagcgcccggagatctgctgcaagcgcatcaggtccttccccgtcgactccgtcgccgccgacggcgtccacgcccagaccgtgctcttcagggccgcggccggcgacccccgcgcgctcgcggcggcctgcatcgaccgggcgagcgaggagctcggggcggacaggccgtcgcgcttcacgctcgtcgtcggccccggagaccccgcccgcggggcgacgaccgtcgagacgtcggtcacggcggacggcctgaagaagggcggcgccggccacgcgctggaagctgcggagtggggcgagctggggctcgaggagctgactatcagggacgtcaagcccgtgcatgtgtcgtacagaatcgtgtcgggcggagacgaagggctcgtcgtcgtcatgcccgacggccatggtttcctcatcacggccacggttccgaagtagacacggcaagacaagaaatatttactgcatgcatatttgctccnggggactcnaaataagccaatgttagccctcgatatccacaaaaactaggttactctccttcgcacattgtcccctagcgaatccaatttttttttgcgaaatattattattttttaactagccaagtggccctcgcattatcttaaatgtgtcgaaactcgaaagtgtatacaattcccc

SEQ ID NO: 1807 - DNA, 1268 bp, Triticum aestivum
  unsure (1)..(1268): unsure at all n locations
  Clone ID: PAT_TA_1807
ngattttcatccgagtgaagctacatacaagcttcatctcttactcaaagccaccacgttaccccttcgccttttccgccaggcctctagaagccttcccgcatttcgtcctctgacaatcttcaaaatggcttccttcgcctcccagacatacactcccaccgaggaggctgagatccagcagtggctcaccacctctgagcgtctcaaatcccccgaggacaagtccaccatcctcgagaccctcaacaaccacctttccagccgctccaccctccttggcagcaagccctccaaggccgatgtcgccatctacgagaccctcgctcccgttgtcgcccagtggtcccccgaggagcgcaccggcgagaaaggccacccccacattgtccgccatgtcgactttgtccagaactctcctctgttcggcctcgatgtcaaggatgagaacaaggtcaaggttaaccaagatgaggtcctctacgtgaagcctcaagtcgacgccaaggccgaaaaggagaagaagaagaaggctgccgctgacgcttctgctgccggtgatcaggcttctctcgttgaccgcaccaaggaaaaggtcaaggaggttgtcgagagcgccaaggagaagatcgctactgataagcccaacaagaaggagaagaaggagaaggcccctaagcaaaaggctgcccccgcccctgctgctcctctgtcgcctgccctgattgaccttcgtgtcggccacatcctcaaggccatcaaccatcccgacgtcgactctctctacgtctccaccattgctgttggtgacaagcccggcaacgaggactacgtcgagtacgagggtcagatctgccgaaccgtctgctccggcctcaacggtctcgtccctcttgagtctatgcagggtcgcaaggttgttgtcgtctgcaacctgaagcccgtcaagatgcgcggcatcaagtcttgcgccatggttctcgccgcctctcccaagatcaaggagggtgaggttgatgaccacaagggacccgtcgagcttgttactcctcctgagggatccaaggccggtgaccgcgtgtggttcgagggttgggaaggtcagcctgagggtgtcctcaaccctaagaagaaggtctgggagatgttccagcctggtttcctactactggcggtcttgaggttgctttcgatgctgctgctgttgagcagttgngcaagactggaactggtcgtctcgttactggagagcggntggtgtctgcact

SEQ ID NO: 1808 - DNA, 822 bp, Triticum aestivum
  Clone ID: PAT_TA_1808
gctgcatcacgagcatcatcgcaacgtcggtttcacagcaaaggctcctttgatagctcctcttttacgtcggtgctgggtttagctgcctgtcgcattagttctgtttggcactaacctttgctacacaaccccgatcagagagctcgtctccaagtacctactaattaatccaccgttatcgtatcataatatattgccaatcatgtcgagagcaagccagctctttctcctcgccgaccatataaagctctcgctccttgagcgacagcgagcaaagaacctcaaccttgaaggcgactcccaggatggccacatctcgcggtcctttgaccagttccgcgatggcttgaccagcctccgcgaggaagaacaacggctcaccgaagctggtgatgcaactgccgcctcgagcctgatggaatccatctcatcgcttcagaaacaactggacgacctcacagcccaattccgaggccacccctcctcttcaacaatcgaaaccctcacccatcccaactcggaggagctcgccgacgattttgatcatgcaacctctacatcgccgacctctcgaaagccaaagactgtccgcttcagcgacaccccaccttcaccatccaccgagcttttcggccgttatcgcgataatcccgatgacagcgcaggctaccgggatgaggcccaggaaatggacaatcagcagcttcaccagtaccacgctcagatccttgagcaacaagatgagcagctcgatcgcctgggcgagtctattggacgccagcgcgaactgggcatgcaaatcggcgacgagcttgacag

SEQ ID NO: 1809 - DNA, 841 bp, Triticum aestivum
  Clone ID: PAT_TA_1809
cttttccgcctatttaccgatatttcgcccatcatggcggatcctcgcgagtcgtcctcgtactcggtcgttcccagaattcgatacaacaccgtcggcggagtcaacggtcccctcgtcatcctcgacaacgtcaaattcccgcgatacaatgagattgtgacgctcactcttcccgatggaactgagcgctcaggtcaagtcctggaagctcgaggtgaccgagctgttgttcaggtctttgagggtacttccggtattgatgtcaagaagaccaaagtcaagttcaccggcgagagcttgaagattggcgtgtccgaggacatgcttggtcgtatctttgatggatctggtcgtgctattgataagggtcctaaggtgttggccgaggactacctcgacatcaacggttctcccatcaacccctactctcgagaataccccgaggaaatgatctcgaccggtatttctgccatcgacaccatgaactcgattgctcgaggacagaagattcccatcttctctgcctccggtctgcctcacaacgaaatcgccgcccagatttgtcgacaggctggtctcgtgcagaagcagggcatcaccaacaagggtgttcatgacggacacgaagagaacttctccatcgtcttcggagctatgggtgttaacttggaaaccgcccgcttcttcacccgcgattttgaggagaacggcagtctggagcgcaccactcttttccttaccttgccaacgatcctactatcgagcgtattattactcctcgtctcgctcttacactgctgaatactacgcttacaactcgaagagcacgttctggtca

SEQ ID NO: 1810 - DNA, 603 bp, Triticum aestivum
  Clone ID: PAT_TA_1810
tctttcaacaagcccaagcttaccggggagacttttggccagggcatgcgcctggtcgtcggcgccggctacccgctcacggactggatgctggtgccctactcccaccagaacctgacgtggacgcagcacgaattcaacgagagagtggcaaaggcgcgcgccgtggccgtgaccgcgttccacaagctcaaggcgcgatgggcctgcctccagaggcgcaccgaggtcaaggtggacgacctttccgtcatgctcggcgcctgctgcgcgctccacaacatctgcgagcgcagcggcgaaccgttcgacctccagctgctgcagggcttggagctcgacctagacgacgacaaccacatggtcgccaatgaccccgtgccctcccccgccgctggacagatgcgagacaccatcgcccacagcatgctccaccatggcaaggtggccggcgctgggtctttctactagcagctatagtattacctgtttcatttcttgacccgatcgatcagccgatccaaagtacgtaaaagcaataattaagggagtaggacaccggactaaaaacacaagtgttgttgaaaatctttagcaagtgcg

SEQ ID NO: 1811 - DNA, 2219 bp, Triticum aestivum
  Clone ID: PAT_TA_1811
cgaccgatacaaacagacacggataatggaataatacctattactgattctgagattggtatgacgaggcaagaacttgttgattggctaggaactttcgcaagcagtggaactgccaaattcctgaagacattaaaggagagccaggaagctaatgttgatagcgacttgattgtccaatttggagttggtttccattcgggatttcatggtacagacaaggttgctgtgtaaacaaagagcctctaatcagaaaaacaatatgattgggaagcagaagcagaatctaattcctacaccattcgagaaagagacagatccagagagagcgcattcctaggggaactcgtcctacacaatacctgaagcgtgatgacaagagttttgctcaccctgagaggctccaaaaagagatgaagaataaccctgtcgaaggttgggcccgcatttgcgcgtagcagcatcggggctacccatcagaggcgatgtcaagtgcgtacccagggggtctttcaacaggagccgatttaaacccatggtggtggatcccgtcgtagggctggccgacctgaagtgagaatccgcttcgtgggctatcaatcaatgatccatgataaggtgcatgcgcgggtgctatcctccaacctctctgcttgttccttttttcttatgtccgtaccggtttacacggcatgtatgatgagccgtgcgagtcctagtatacacttatcctagatagggttgtggttgatactaataatagtactgaacattttggccttgtgataggaagatgctaaattacttgctttatgtcaagcgggtgttcatatcagacgacttcgatggagaactgttcccaagatacctgagctttgtgaagggtgttgttgactcaaatgaccttcccctaaatgtttctcgtgagatccttcaagagagtcgaattgtgcgtataatgagaaagagattggtgcggaaggcctttgatatgatactcggcatttcttgtagtgaaaacagagatgactatgaagcattttgggagaactatggaaaatttttgaagctcggttgcatggaagacaaggaaaatcacaagagaattgctcctttgctccgtttcttttcttctcaaagcaatgaggaattaattagcttggatgaatatgtggagagtatgaaaccagagcagaaggccatttattacattgctggagatagtttgagcagtgccaaaaatgctcctttcttagagaagctcaatgaaatgggttatgaggttttacttttgattgaccctatggatgaagtgtctctcacaaacctgaactcctacaaggataagagtttcgtggatattagcaaggaagacctggacctaggtgataagaatgaggaaagagaaaaggaaatgaagcaggaatacagtcaaacctgtgactggatcaagaaacgtttgggtgagagggttgctcgagttgatgtatccaaccgtctcagctcatcaccatgtgttctagttgcagccaagtttggttggtcagccaatatggaaaggttaatgagggcgcagtctataggtgatacgtcttctctggatttcatgcgttccaggaaagtatttgaaataaatccagagcatgagataatcaagcgattgaatgctgcgtgcagaatcaaccctgacgacccagaagctctaaaggcaatcgacatcctctttgaaacttcaatgatttctagcggctttacgcctgataacccaactgacctgagcgggaagatctatgacatgatgagcacagctatggcgggcaagtgggcgtcgcagccccaacctgcccagccaagccagcagcctgcttcacctagtagctctgaacctgagccgcttgaagccgaggtggtggaacccgtcgaggctggccagcagaagtgagaatccgcatcgtgggaatccatcagggtcgatgtcaagtgcatacgcgggtgcaagctctctgcttgttcctttttttattatgtcggaatcggtttacacgccatgtatgatgagccgtgcgagtgctagtatacacttatcctagatagggttgtggtgattactaataatagtactagaacattttggcattgaacacgctcgactaccgaatcggaaagagtttgtattgcgtaattgatcataattaatgccggccgtgctggttcagttt

SEQ ID NO: 1812 - DNA, 1492 bp, Triticum aestivum
  Clone ID: PAT_TA_1812
gggaaatatacctcaatattttgtgtacaagaatatagaaaccggtttctttcttggagcggacagtgagacattacagtaagccgtggttcaaaaacaaatcggacaatctgagacgtttataccgagatatggtcagcttcccctcctgatctgcctccagcaggactatgaacgggcgctttttgcttccgggtcaacgccgaaaagctcggctacatcgcgactggtggtctggtaaacgttgatgctatcctccagctttgaagcagcagcaagctcattgctgtgagcaccctcgcattctcaagtagtcgttggagtatgttgatgagttgtctttcatccaatatggctacatcaccaatatgctcctgcttcttgccaacctccaaaaggatatcccttaaaactttcttcacttcagggtttcgacccactggaacaaaagctgtgtattcaaattgtgtttgaagcctatcatacactgccttagcaagtgtagtcttgccaagtcctccgggtccaacaacaattgagaccatcttcatcatgtgctgctgcttgggaacatcaccatcaccaacaccatctgtgagccgcctggttagctcgttccgtgcgtcttcaatgccaataagctctttcggatccttgtacaaagccaagacacgagggtcaactttgtgttttccagctgcattggcaacagcatcgtcgaccctgtatctgtcacgccggccagccacctcttgggcgcggttcttgatgtccctgatggcactagcgatctgatggcgagtcttgcctttggtgaataagttggccatcttcacgattagctgtttgagcttgtttgagtcggtgacagcatcggattcaatcccctcgacgcacaccaggaagttgtcgacaacatcctccatgtcgtatgaaagctccctgagctcgtcagcccagatgatgacctggttgtccagctggtcccttggcacctccgccaccttgacgagggcagcgttcatgctcttcatctccctctggagggactcaacgtcctccttgacgcccttctgcagcttgtactcacccacgagcagctcgccgagcttggggagcaagcttcccatggcaccggtcaccacctccatggtggaaccggtggatcttcgttctcagtgtatggatcctttagctaggaagcagtcctgtaacacacaaggattagcagttagaaactcaaaggacagtgttctctatcgcacgaaatacagaggtcagcaggtcgccccctgttgacaccctccagcaagatccgatgtagggtgttgagcgaccgtatcaaaatgccagccaaatcccccggcagcttgtggagctagctagcaatggcggttgaggaaggcgatggatctacatcccctcctcttgagcgccatgctaggtttaggaagttcagggctccggttgatacgttttatttcccgctgtc

SEQ ID NO: 1813 - DNA, 1047 bp, Triticum aestivum
  Clone ID: PAT_TA_1813
cccacgcgtccggctagctccacagttccacttccgcgacagctccccgataagagccctaactagcttcatcttcatcgcgcctcaccggaaggcatggaccgcaaggacaagtcccgcaagtcctcctcggcagcgtccatggccgcgctcgccgccgcagctgcggccggcgacgtggcccgagccgacgggatgtccggcgaggaggaccagaagctgaagctcgtgaacgttcccgtggtttccgtcggcggctcgagctcctctgccgcggcggtggcggtgaggaggggcagtggtgctgctggcgccgtggcgacgggcgcggctggggcaggcgggccgagctgccaggctgagaggtgcggcgccgacctcagcgaggcgaagcggtaccaccgcaggcacaaggtgtgcgaggcgcacgccaaggctgctgttgtggtcgtcgccggcctccgccagcgcttctgccagcaatgcagccggttccacgagcttctggagttcgacgaccagaagcgcagctgccgccggcgcctggccgggcacaacgagcggcggaggaagagctcggcggatgccaacggcggcgacgggtgccgccacgccgaccaggacgggcgtacccacccggggaacccgccgctgaaccatttccagatcagataaacctacctaagcatgctccctctcttctgtcaagcagccatgctactagctatgtatatctatatatgtatccacccacctacgtacgtacctgcctacctactacatctccactatccagtgtactaactggcagtatatgtggtctcctgtactgctatatatttgctgctgtctgccaaaaacctaagctaagctaattgtaacctgggaactggtcaggtgttagagtgattgtgtgtgtgatgtgtaattgtagcctgtgcagccgagacttctgcaggctgtgtaatattgctgctttgctgggataatttgtggcaatatatgctatctattcgaggaaaaataaaaaaaaaaaaaaaaaaaaaa

SEQ ID NO: 1814 - DNA, 841 bp, Triticum aestivum
  Clone ID: PAT_TA_1814
gggggagtgaagaaagaaagcagtgttgtacaccgtcttatatatatctactctcatcttttggtttaaatctgctagattctatctcatcaggtcatatcatcatataaacacaagctcgtcttaatactttatccacggaataacaaaccatcgccaacatgtctccgccaggtccaatcacaacaccacttacgtccctattgggaatcaagcatcccatagtcctcgcaggaatggccagagtgtcaggcggtcgacttgcagcagctgtatccaatgccggcggtctcggtattatcggtggtttccaatacacgcccaaacaacttcgcgagatcctagctgagatgaaggccaacttctcacgacctgatctaccctttggtgttgaccttgcacttcctcagatcggtggcaatgctcgaaagaccaaccacgattacactggcggaaaactggatgaattggctgacattatcattgatagtggcgccaagctgtttgtcagtgctgttggagttccgccaccagaggttattaagagattccacgacaaggggattttggtgatgaacatggttggacaccccaagcatgcaacaaaagcattggagcttggggttgacatgatttgcgctcaaggcggcgagggaggtggccacaccggagacgtcgcaaactcgattctcatccctgccgttgccgacatcgcatcaaagtaccacccccctctcctcaagggactgcctgcattggtgcttgcagcaagaggtatttcctcccgggcgaagtcttgcgagctctctgatgcaagatgcatccggcgtttgggttggta

SEQ ID NO: 1815 - DNA, 811 bp, Triticum aestivum
  Clone ID: PAT_TA_1815
cctcctcaatcccgcttgaaccccattggataaaaatggattcctcccaaggtcctggtctttaccccctccatcatctcgtcaattaacccgcccttccatgcgcctgaggcaaccgtgtgctcggccttgtccgcttttaccgaagtcctcaccgccgaacttagacccctcgacatcccagtgacccacatgcaacttggtacattcgacttctctagcttcgtccctacccgaggcggacctaaccaaggtcttgttatgcctgcaggaaaccccgaatctcctcttgtctggcctgagggtgctcgacatgtctacgccagaaactttgtcgcccagaccagctctgccatctctggaggccgtatccgcggactcaagggaagctcgctccgacgtcttcacaactctgtctttgacgtgattgatggcgatatcgttgccgacactgtccgagttggtctcggcgccagcgtctatggctttgttggccgatgggctcctcgtagtctcgtttcctggatgatgggcatccgtcgggttgatgagctttccacatggaagacaagcgcctttgaaggttcagaaagcagtgacgacgaggacgatgagagcgagaagggtgaagacggaacatcaagcgagttcatcgctgtctcagacgacaacgtctggcacgcagacactgggggctgtctggtctcacaaggcacccgaagcatcataaacgatgacatggcaaattatgctgaccatgcaatgtacattgggtccgcatgataccattatgatgggatacgtaaaaaga

SEQ ID NO: 1816 - DNA, 415 bp, Triticum aestivum
  Clone ID: PAT_TA_1816
ggccgggtcttcgtcaccgtcactgccgtcatcgccgctgagaaggctgacggcaagatcacacatgtttactcaatcatcaagggcttctccgtaattgcgcctgagaaggcgctcgagatcgtccagatcaaccacgaggaccatcagatccgtgtcgagaaggatgaggttgtgacgacggactaagggctgcgctgtagtacacattatgattcaaaaacgaaacaatagcaagtctttcgaagtgaactgaccatatttcatggcagttgttggaacatcgatatccttgatttaggcgttaacaggataggagcgacaggattgcctgaaggtaaacactcgctatgcgacaaagtattattgttattattgcacacctttgacagggtgaaatagacatttgccatcc

SEQ ID NO: 1817 - DNA, 654 bp, Triticum aestivum
  unsure (1)..(654): unsure at all n locations
  Clone ID: PAT_TA_1817
ccggaccgctcgagccggncgggccgggngcttttgggtctctctctacgccctcgacacatagccatggccatggccactgcgaaccaggacggcgccgcgacgcagttccacgaccatcgcggaggtacggcagcgacggagctccacggccggacgatctcctccgagcaggagcacggcatcatcgtcgccgcgctgcggcacgtcgtgtccggctacaccacggcgccgccggaggtcgtcgtcgccgtggcgtgcgggcggtgcggcatcgacggctgcctcgggtgcgacttcttcggggccaccgagccggaggcggtggcggtgggcgttcccgcgggaggggtgcgcaagagacgccccaggaggaagaaagagtatatcccccgcggcgggaaccagcgttgggcaaagtgggccgcgggaatgatccgcgacccgcgccgcgcgggtcgcaagtgggggggccccttcgacaccgccgaggatgccgcgcggacgtacgacctcgccgcgctcgagttccgcggcccgcgcgccaggctcaacttcccgtgctccgacgagactctgcgtgggcacggtagcgcccatggcgccgatgatgaagctggcacgtcgccgcaaaacgagactctgacccccccg

SEQ ID NO: 1818 - DNA, 896 bp, Triticum aestivum
  unsure (1)..(896): unsure at all n locations
  Clone ID: PAT_TA_1818
ggttggtggatgatccactgaccgtggtgaataacaggaacaaggcgcttatgctgattgaggcttggggagagtccggcgaggagctccgctacctgccggtctatgaggagacatacaaggtacctgaagaattgttgtatcacattctagttgcctgattctgtctcgtagcaatgagagtctatattttcatttcttgggcaatgaaaagttggcccaaatagcgtgatgtgctttgcatgaaagtgctatccaaatacgaagagatgaagaagcctatggcgtcggcacgtacagaacagccagtggtcataccaattgccgccgggaaaaaaaaatctaaaaaagttggcaatgaggatgccctggtaagaaaaccagctgctgctcgagcaatgtcgggcggcgatgatgatatcctcgatgatcttgatgagatgatatttggcaagaagggaggaagcagttcccaggacgtgtccaaaaggcaggacccaaagaaggatgacctaatcaacttctaaataccgtcccagcaagttccagagttcctctagggatacacagcatgtctgctgcttttatactgctgaacgatgtctgtattcatccagtagaagactgcactgcacgtacattcagttagggatttgggtcgcttgtttatttgcatacgatgataccttgtcctccagagtttgttcagttgataagttgctgcatacttctcgtcttctggtttcnnaaaaaaaaaaaaaaaaaaaaaaaaaaaaaaaaaaaaaaaaaaaaaaaaaaaaaaaaaaaaaaaaaggaaaaaaaaaaaaaaaaaaggcccctaaggttgaagtaacctgaagatacctgcatgaatgggaagccagcatgtggatttt

SEQ ID NO: 1819 - DNA, 1223 bp, Triticum aestivum
  Clone ID: PAT_TA_1819
gccgaaggagacctcgactggaaggcaccggcgggcgcaagaactcgcaacgaacaaaccaccgcggggcggccggccaaatctagcgccaccacgcgtgcgaggccctcgccgcagttcgattcgactcccccctcccccgcccattctcgccgcggaagcgaaaatgagcgacaatctgatggagaaagtgaacgccctcggcgagcgcctcaagatcaccgggtcggaggtgggcaagcagatgcaggccggcatgagctccatgagcttcaagatgaaggagctcttccaggcgcagaccccggccgacaagatcgtcgaggacgccaccgccgagaccctcgaggggcccgactgggccgccaacctcgaaatctgcgacctgatcaacaccgagaaggtgaacagcgtcgacctgatccgcgggatcaagaagcggatcatgctcaaggaggctagggttcagttcctcgccctcttcctcctcgagaccatcgtcaagaactgcgagaaggccttctccgaggttgcggccgagaggattctagatgagatggtcaggctgattgatgacccccagacggtggtcaataacaggaacaaggcccttacgctcattgaggcgtggggagagtccggcgatgagctccgctacttgccggtctatgagcaaacctacaagagcctgaaatcaagaggaatgcggtttcctggacgtgacaatgagagcctggcccccatatttactccaccacgctctgttgctgaagctgaagttgctgcaaatttctcccagcagacattcgaagatgtacatgtgcatacatatactgccgaagaaacaaaggaagctttcgatgttgcgcgtaacagcatggaacttctttcaaccgttttttcatctttccctcagcaggatgctttgcaggacgacttgacgaacacccttgtgcaacaatgctaccaatcccaacacaccatccagagattcgtggagacggctggggacaacgaggccatgctctttgaggccctgagtgtgaatgacgagatccagaaagtgctatccagatacgaagagatgaagaagcccgtggcgccagcgcatgcagaacaggccggtggtcatataccgatcgccagcatgagcggaacatgactatgccccttccgtatcccctgcgaagagccctggtcagaaaaccggccggttctcgagc

SEQ ID NO: 1820 - DNA, 1017 bp, Triticum aestivum
  unsure (1)..(1017): unsure at all n locations
  Clone ID: PAT_TA_1820
tttttacgaaaacccatttttattgctgcaactttcgttacaacttgcaaagttcagaaacacacgcgccgccgacattttcacgggactttacatacagttgcagcttatttctaaggtcatataaccaaaccccattcctcaattcacctcgtctcagctctatcgatccttccttgcaaacccttccccctgaactagatcgatcgacttgctatgctttcgcctacggttactttggtgtcaggatgtacatcttgcagtcatgaggcgccaccgatgcggatagctgcccctgagcggagaacgacgagtgcgcccatagatcgcgagcggtgacggacgcggatgccggaagcccgacgtttgaccagtgtgcggtgatggctgcctggtacccctgcctgttccatagaaccaccgcctttctgttgccgctgagcgggccggcccaaacctccaaaccaccatcggattgcaccttctttccctggacgcctaggctatcttggttgacagcgatgacctcctgattgctgattatggtctttgtctgcgggctcatcgagcgcacgtcgcacccgatcagaagaggagccttggcaagtgcccagatgctgaagtgcgagcggtactcggcttcggacatcccaccgtttccaacttcaagcatatcaggatcgttccatccaccaggtccagcgtaggaggcccatttgtcattctggtccgcgcgggatgtcatgctgccccagttgtcagcaatgtcgccagttgtcctccagctattaccgcccatgccacgtgcccatgtagcagggttttcgtttccccattcacagagtgagaagaagatgttctgcccgtatttcttcatggcgttgctcatcctagtgtatntttcgtgtgacactcctgccagcatcattgcagttgtcatacttcagataatcaactccccaagatgcaaaagtcttcacgtnttgctatttcgtgatcgaagccggacgcgtaggg

SEQ ID NO: 1821 - DNA, 1779 bp, Triticum aestivum
  Clone ID: PAT_TA_1821
cctgcagtctcccgctaagaaaacccatttttattgctgcaactttcgttacaacttgcacacttcagaaaacacgcgcgccgcccacatttccaccacactttacatacagctgcagcttctttctgaaggtcatacaaccacagccacagtcctcaattcacgtcgcctcagctctatcgcatcctaccttgcaaacccttgcccacatcgaccgactggctcaacttgctaagctggcccctctggtgtactttggtgtcaggatggatttcttgcagtcaccagtccacaacgacgcagatcgctgccccgcagcggagaccgacgcagaacgcccacagatagggagcggtgccgggcgcggaccacggaagcccgacgtgcgaccagcgtgcgatgatgggcgcgtgtgacccctgcctgttccatagaaccaccgcctctatgctgcggctgagaacgccggccaaaacctccgcacaaccgcggcacggcaccttctttcccaggaccgctagcctatactggctgacagcgatgtcctacggattgctgagtatggggggtatgcgcgcgctcatcgggcgcgcgtagcacctgagcagaagaggagccggtggcaagtgccccgcaagatgatgttcgaccgctggaacggctccgggacactgctcaggagatccgctgtttctggctttacgagcaatcgttccaaacccaccaagtaccaggcaaaggaggcccaaggtctgtcatttctggtcccgcgcgggatgtcatgctgcccccagtttgtcagcaatgtccgccagttgtccatccagctattaccagcccatgccacgtgccccatgtagcagggttttcgtttcccctattcacagagtgagaagaagatgttcttgcccgtatttcttcatggtattgctcatcctagtctatctttcgttgacacttctgccagcatcattgcagttgtcatacttcagataatcaactccccaaaagaagcaaaagccttcacgtcttgctcttcgtgatcgagcgctcctggggttttggtgctacaatttttgggtcccagcatcattgtagatgccgagcttcgaccctttggtgtgcacctaatcagcaagcgcattgataccagaggggcatgttctattgtatggaaccatgttaccctggtaatccctgtttagttctagcccagcgacacatcagatggtaacatatttatagcccaatcgagccagaccggtgttgatcaatgcatcagctgtctccctgatgatcgcctcgctgatcccgcagtagaagtggttctagctgttccagcccatatgcggcgtccaggcgaggccgttctcgagcgcctcccgccgaccccgccgcgcgcggagctcgaccagcgacgcgatcccctgcccgcgtccccccgcgcccacgccgccgccgcgcggcgtcaccgccgctctgcccaccagcgcgagcagcagcgacaggctccagtcaaccggcatggcagtcgagagcgtggacgtcgtgtttggttgcagtggaggggtccttttgctcccgagtatgttctgttgtcaacttcctgcttagttgcggtgttcaggcacttatcatcttactggtttcgtggatgcatctcaaatcaatctatgtactccctgccaagggtccatgcctccgtcctacaccggcgcacgacgcacccgatcagaagaggagccttggcaagtgcccagatgctgaagtgcgagcggt

SEQ ID NO: 1822 - DNA, 973 bp, Triticum aestivum
  Clone ID: PAT_TA_1822
taatatcgcatagttctccaagctcttcccttttcctgtctgatttacgcgactgtcagcattcaatatggcgttctttattgatggaaaggactgtatgatttcggaatggatccttcttgcagtatcgtacctcttcgttggcctccgaatctatgcccgtctgttccgtgctcgccagaaactcgatgcttcagattggcttctggtcgtctcagctttcaatgctctagctctcattatctgcgatacactcacgtaccagatgggtgtcttggatgaatacgaaacctcagtcaagctctccaagatctctttcgcgtcgaactactttttttatttcgggatggggcttcctaaactgagtatgttggccttctattgggcatacttcctgccctccaatggtgttagctctgccatgcgaaaaactctatacggcatcactgcatttgtctgtatatcataccttgtcattctttttgacgataccttcttctgcggaaaggatgtttctgttcagtggtctcaagaagagggagcatgcagtgttttctatgcacctgaccccttcattcttaacttcaccctgaacctggcttgctattttgctgtatacgcgcttccccttatcctactcgttcaaggcgttctcaagacctccactggtgttatggttacatttgtacttggagctctgacgatctgtaccacaatggttcggttcattaccctgaaggtcggcactggacaggaaaaccttgtctacccactcagcatgctcgagatggcgcttgccattacagttgttgcccttcctgggttgaggccactcgttagccgtcctgtgaagcatgagactgctaatgaaagtttttatgttaagaactaaagctgaatggtagccgtgtagtttttgaatcattgatggtttctaaaatggtagtttaaaattgagatcatgttatgtacc

SEQ ID NO: 1823 - DNA, 529 bp, Triticum aestivum
  unsure (1)..(529): unsure at all n locations
  Clone ID: PAT_TA_1823
ngttcctccaaatccgcaacaatcctcccacgatgttcggcgcatttcgcttcacgaatcctctatctggtggccttctatggaaggttccctggaggatgtccaagttccagaagcgccgccacagacttcgcctccgagccgtcgacgatgttgtagctaccgttgacgctgctctcgccaagaagggacagactctcaaggccctcgaccgatggaaggctgagatgcctactgaggctgaaatgctgccaagggataaatacaccatgtttgaccgcaaggctaagcgttaccgcaagggtattcacaagctacccaagtggacaagggtgtcacaacgagtcaacccccctggttactagagaatcgatttcacgaggtcgaaaaagcaggactaccaggtcgaagatcatatggagaacggcgtattcatcccacagtgggaattacaagcagatccatgctggggtccatgtacaacacctttgtttcaattacgaattgcgagataatgacaatatttgcc

SEQ ID NO: 1824 - DNA, 569 bp, Triticum aestivum
  Clone ID: PAT_TA_1824
gcaaaaaaagtaagtcaattaatagccgatcgataaaattgattaatcagccgatttctgattaatctctaatccccagccgatgaaacgctaacgataagtaatatcctcaacattaacaatgtatatttctcggcaccgaactgatcagcaaatggacaaccaatccgcagttacaggtatcatacgaatgcattactcaaaaatcaggtagtataataaacagctttgccagaccaaaagatccacgaaaatggcaatgtataggtgacataacacagagatcaatagctgcgaccccagaatgaccacttttgagcaggctttccggaagcaaagcacacggttccggaaggaagatctggctggtcaaatggagtacacaatgttttcgcagccccaagttcacctttggtccgagctttcacgtccttctcgacctcctcttcatcacaccatggagccaagatcaactttttgttgttgagagccgctatgaattcatcccaggtgctgatgatttcaatgcatgcatctctttttgcttttgctgtttccaacaagtttac

SEQ ID NO: 1825 - DNA, 1007 bp, Triticum aestivum
  Clone ID: PAT_TA_1825
cagatccatcacttaaggttgtacacaatatatttctggctagccagtcaacactgaactgatcgacatgcaatcacaggtatcatacgaatgcattactcaaacatcaggtagtataataaacagctttgccagaccaaacgatccacgaaaatggcaatgtataggtgacataacactgggatcaatagctgcgaccccagaatgaccacttttgagcaggctttccggaagcaaagcacacggttccggaaggaagatctggctggtcaaatggagtacacaatgttttcgcagccccaagttcacctttggtccgagctttcacgtccttctccacctcctcctcatcacaccatggagccaagatcaactttttgtcattgagagccgctatgaattcatcccaggtgctgatgatttcaatgcatgcatctctttttgcttttgctgtttccaacaagtttgcttgaatcccatccagcaacactctaacctgctcaaccaagtcggttgaaggaatatcaacctttgtaccattgtctcgtcggacaatacgcacctgcttgttcgccagatcttttggacctatctcgattctcaaaggaacacctttcatttcccattgagaatatttccaacctggagagtagttttcacgagcatccaaatctgctcgaatcccagcttggttcaaggtgtaaacggccgactcacacgcccctttaatagctgttgtgtcagcatctttaaatggcacaggaataacaatgacctggataggtgccacctttggcggcagcactaagcccttgtcatcaccatgtgtcattatcatgactccaatcgagcgggtagtgtatgcccaagagttctgccacaccatggaccgttcacccttttcattctcaaaagtgatatcaaacatctttgcaaagttttgaccaagacaatgggaagttgcaccttgtataccacggccagtattggaatgaaggcctccacac

SEQ ID NO: 1826 - DNA, 1228 bp, Triticum aestivum
  Clone ID: PAT_TA_1826
cccacgcgtccgcgtgggggcgatggcgaggaggagggccctcgcgctcgtgtcccagctcctccagaggcgggttctccccgcgccgcgcttcctctcgtcggcggccggcggcgctctagaccgcctcaattcgccgcccttcgcgcgccaggccgcgcacaggaatcccgctcccccttccccatgggatcggctcggagggcagaagaggaccatgttcatccagacgcagtcgacccccaacccgcagtcgctcatgttccatcctggaaagccggttatggaagttgggagctctgatttccctaatgctcggactgccatgacatctcctttggcgaaggcgctgtttgcgatagaaggcgttacgagagtattctttggatctgattttgtaactgtgacaaaatctgacgagacttcatgggattatcttaagcctgaggtatttgctgcgataatggatttctactcatctggacagccacttttcctggactcaaataccgcagctgctatggacacagcaattcatgaggatgattcagaaatagttgctatgataaaagaactattggagacccgcattcgtccggctgttcaagatgatggtggtgacattgaataccgaggatttgagccagaaacagggatagtgaagctaaaaatgcaaggtgcctgcagtggctgcccgagttcatcagtcacgttgaaatctggcatagagaacatgctcatgcactatgtgcccgaggtgaaaggagtggagcaagagtttgatggtgatgaggaagctgaactggctggccagatggaatgagtttttacatttaaatcgcaaccatgtgacatgctgttcagggaaaccatgctacgcatgaaacgtcccggagaatttaaaccactcttaaaaccataggttaccactatattttgtgagataaaccaggagtagcctggagtttttgtgatgattagatggttgtaattttgatcagatgtgtgcaagaagcagactatcgtacatgctagagaggcagcagtagcctaaaccaacatcgactgcagtagggctgaataaagtgatagttggattgatctttccttttgtccaacactttatatgctgagcttgctaatagcaaaggtcatcactttggcatgacaggtgtaatttcatggtggttatttctgctatgtatatgtactttgtaagttttgcatt

SEQ ID NO: 1827 - DNA, 1931 bp, Triticum aestivum
  Clone ID: PAT_TA_1827
cgagaccatgctcttggcattttatcccgcgataatctagtcgtgcgaaggggcaaatgtccctgaaggccgtagacacagtattcctatcgacgccgatctgatcgatctggcactatctctaagtagcaaacggcgtaccaatacccagcgacccatagcatacccaaggattactcgcagatcacatagaacatgcactacttacacagattgaccagttcagaggacacatgacgaatgcaaacatcaaggtgccggaacgcagatgttcaggggccatgacactacaacgagtatttgcggccccaggttcccgatgcgtaggacgcctttccagaagcgaaaccccctgttccagacggagtacacaatgggttaactgctgtacgttgagttttggtacgaccttttacatctttcttcagatctttctcaatacttctcgaagtcctgttcatctttctatcgagcgaagttgaatttcatctagtcgaaatccactctgcttcaatgccaggttctcaggattctaatgctgtttaccattttttcgcttgaatttacgaacatgattatttgacatcctcttctggaacactctaacctgtctcaaccgaagacctttcgtttcccaatgaaaatatgtccaatttgctcagtagttttcacgaagcaacctaatttgcccgaatcccagcttggttcaaggtgtaaacgtcctgactcacacgcctcctttaatagctgttgtgtcaagcatctttaaatggcacaggaataagagtgaaatgggataggtgccacctttggtggcaggactaagcccttgtcatcagcatgtgtcattatcatgacaccaatcgaagcgggtagtgtatgcccaagagttctgccacaccatgggaccgttcacccttttcatttctcaaaagtgatatcaaacatcttttgcaaagttttgaccaagacaatgtgaagttgcaccttgtataccatcgggccagtatttggaatgaaggcctctacacgttggttgtataaaagtccacccaagcaaacttttccatctcacttttcctccctttggacactggaactgctaaaaattcttcatatattctcctgtagagttccaatatttggcggacctcttcgatctgcctcctctttagttgcaaaaactgtatggccttcttgccaaagaaattcacggctccttatgaaaggagttggattgctaaactcccatctaacaacattgcaccactggttacacttcaaaggtaagtcccggtggcttcttatccatttagagaagtatggatacatgaccgtctcacttgttggacggattgcaataggagcttccagatcagattttcctgatttagtaacccacgctacctcaggggcaaagccctcaatatggtctttctccttctgcagaacattctccgtaacaaacaaagggaaataatacggtttcagcttcaacttttttatttccgaatcaaaaaattctttcagcaactcccatatttccatcgcccaaggcctcaagatataacaaccagagatgtcatagtactcaatcatttcgctgttaacaacaacctcggagtaccactccccgaagttatcatccttcttgtaccccatccccagtttcgtctccttcttcacctccttcttcttcttccctccacctccgcccttgttggtcgacatggctagatcccgaaccaccgcagggagggaggcgctgctggtgggagcggctgctcgacggaggttggcgctgctgggctcctgtaccggcggcggggcagcggagggttcggccggcaggggcggcggcggcggcggcggctaggaaccctactagctgtcgcgctctttttggggggaggctcgcttctgcataaagt

SEQ ID NO: 1828 - DNA, 1002 bp, Triticum aestivum
  unsure (1)..(1002): unsure at all n locations
  Clone ID: PAT_TA_1828
tcttgaattatttagtgggtttacacagttacaggagctggaggtagacattcctggccctcttggagacagtgcgatttccattcttgagtctcttcccaatataaatttgctgaatggtgtcaatgcgtcaactatagtcgagaacgctaagcatgtagtggactctgcacttagaccacgtgttccagaatggtcacctgaagaatccctggctgaaagagttattggtgcatgtggctgtatcttatgacataccggcttgccgatgaagaaaagtttgatgaaacacccatttggtatgtcatggatgagttgggctcagcgatgcgccatagtgatgatgcaaactttaggatatctccttttttgttcatgccagaaggaaaattagcttctgctataagttacacaattctgtggcctatttgtgatgttcatactggagaagaatgtacccgagatttcttgtttggtattggcgaagacaaacaacgctcagctaggcttacagcttggttccacacaccagagaagtattttattcaggaattcaggaagtaccaggagcagcttcagtcaactactatttgtcctacaaaagaggcgccctcaaccaaaagtgcacttccaagtgatggccgtccacttcgagtattcactgatataccccaagtagaggagttcttaacacgtccagagtttgttctcacaactgatccgaaagatgcagacatcatctgggcaggcatgcaaattgattctgaattaaagagttcactaggtctcacagaccaacaatacatgaatcagtttccttttgaggcttgtctggtcatgaagcaccacctagcggatactatccacagggcatggggctcacctgagtggcttcaacctacatataacctagagacccatttgtctcaactaattggtgattactctgtgaggaaacgggatggtaaggacaacttatggatcatngaagcctggaatatg

SEQ ID NO: 1829 - DNA, 621 bp, Triticum aestivum
  unsure (1)..(621): unsure at all n locations
  Clone ID: PAT_TA_1829
gcacgagggagagaggccccacgcgtccgcggacgcgtgggatgcgggaggaggtcaggagctcgtcgggggcggcggccgagccgcagttcgccgtcgtccggtcgtcgtcgccgccgcccaccccggtcgccagttctgctggtgcctcatcacctgctatgcaaattaatatagtaagcatagattggttgggtagcagacaagcttccagggttgattcctcatcacatgttgcaccacatgcctatgggcctgctcatagctttgatgctgctggaactgctttggattctgcaccatcttgtagaccatgggagcgtggagacttacttcgtcgactggcaacattcaaaccttcaacttgggatgctaagccgaaggctgccagttcattggcttgtgctcaaagaggctgggtaaatgttgatatggacaaaattgaatgtgaatcatgtggtatgcatcttatattcagtgcactggcatcctggtccccaactgaagttacaaatgctggagaagcctttgcggagcagcttgatgcatcacacaagaatagctgtccctggnnnggcaatagctgtgctgatagcttggttcnnctccaccttacacann

SEQ ID NO: 1830 - DNA, 771 bp, Triticum aestivum
  unsure (1)..(771): unsure at all n locations
  Clone ID: PAT_TA_1830
ggtgttgttccnttnngtnggttttcctgttcgcaattaaccctactaaagggaacaaaagctggagctccaccgcggtggcggccgctctagaactagtggatcccccgggctgcaggaattcggcacgagggagatcgtcacactcgggtggtaccgagggagagaccgcagcaagctgctcctcaactgcttcttccgcaccggctgcgccgccgcgctgctgtcgaacaccgcatcggcggcagcgccggtcaagtaccggctcgtcgcgctgaagcgcacgaccatcgcggccgacgacggcggctacaatctggccgtgagggaggaggacgacgagggcatcacggggttcaccatcgggcgcggcctcggacgtttgttccgggacctcctccgcgcccacctccccgccttcggcgcctccatcctcccatggcacgagaagctccgctacgccgcagcgctcatgcgattccaccgccaccgcaggagcatcaaaaacctccaaggcggagaaggccacgtggaggcgccgaagccgaacttcctggccgcggcgagccacttctgcctaccgtcgtcggggatgccgaacatacggaggctagcggaggggcttttggggggnnnaaaangnanncnnnngnnnnncttgnnaactttccannggggngggggcccaccanggnggnnntnnggngctccggcgcccccnccacggngnccgggggnggcntncgggggggcnaaccnnntggggcancn

SEQ ID NO: 1831 - DNA, 793 bp, Triticum aestivum
  Clone ID: PAT_TA_1831
aagccccccccgatcgccgagatgaagcctactcagcacgtcggcattactcaatgctttccagggcttgaggttatgcacctctttgcctctgagacaacttcgtgcgcccctccagcaaacgtccaagacgcttgatgcgacccgacgactccaaaatgtccgagccttttcgacaacctcatcaatgctgggcagctggctggaacccaatctgaaccgaaagaagaagatggccaagggtcgacctcgtgtcgcaacgggtggttctaccaagggtacgacggtgctctttggcgaatacggtctccgaatgacggatcaccaccgaatttttttcgcaaagcaactaaagatggccgaggacaccattaaagtgcgacttcgaggacaaaaataccgactatataagcgaaagaactgtaacgtcggtgtttacgtcagcggtaatgatatgcgtatgggtaagggtaagggttcttttgaccattgggccacccgaatggctgtgagccaaattcttttcgagatccgaggaaaacttcacgaacaagttgtgagggatgccttccgcttggctggaaacaagctgcctggccagtgggaattcgtaaagaggggagatgctccaatggttggaatcaccaagttggatggtgttactctggaagagttgaagagacctcgacgacagattgctcccatagagctgctagaggcttccaaggacacagcagagacccttgttgggagcacatctgaggcttcccgcaacccttagtgggctgaaacg

SEQ ID NO: 1832 - DNA, 1121 bp, Triticum aestivum
  Clone ID: PAT_TA_1832
ctcgtgccgaaaggaagcagctactagcctactaggtgctcagcgcacgcatgtctccttcctctgtgccagcggccgccgtggcgacgtcgacccgcctcatcctggtgcacggcacgggccacggcggctggtgctggtacaaggtcgccaccctcctccgcgccgcgggacaccgcgtggacgcgccggacctcgcggcctgcggcgccgacgcgcgccggctgagcgacgcgcccaccttcgaggactacacgcgccccctgctcgacgcgcttcgggacctcccggacggcgagcgggcggtgctggtgggccacagcttcggcgggatgagcatcgcgctcgcggccgaggagttcccggacaaggttgcggcggcagtgttcctcaccgccttcatgcccgactgcgacgccccgcgcacccgcgtcatcgaggaggttcccgtgtccgactggatggacagcgtggtcgacgaggagcacgccccgccgtcggtgttcctcggccccgagttcgtgcgccggaagctctaccagctgacctccgaagaggactacacgctgtgccagagcctggcgcgggtgagctcctactacgtcgccgaccagcagcagcggccgccgttcagcgctgcccgatacggcgcggtgaccaaggtctacgtgatcgccaagcaggaccaggccatggtcgaggagtaccagaggcagatgatcgcaggcatccccgtggccgaggtcagggagatggctgacgccgaccacatggccatgctctccgcgccggagggactggcgggccacctcgccgacatcgccaacaactacacttaatcgagttgtggagcatatttaccgatcttattaatacgtatatttaccgtagttgggttgtacgagtacttccaagaataaacgatgaaatccactccagatgtaacgcaagccgtgcctcacatgatcaatcgaatcttctatagaattctactgtttttctatataaattatgttgtatgcaaatctgtagatattttccaatagaatatttttttcaatgggaataaacatttcacttttccaagctaaaaaaaaaaaaaaaaaaaaaaaaaaaaaaaa

SEQ ID NO: 1833 - DNA, 1268 bp, Triticum aestivum
  Clone ID: PAT_TA_1833
ggccccagttgcaccgacgcacgcacccacccaacgcacccacccaagcacgcgcgcgggtgaaatctaggacggaatccgttccagtccccgtcgatcacgccccgagaggcggaagagctttcgtggcgaggaatccgccggaggctccccgatttgcatgtccggggctcgctggaatcggaatgcactggtgccccggaatcgggccgcgggtgcgctccttcctgcgtgactacgacgcgctccagtccctcgccctcgccctcatatacctccaggaatagtacccctgatgagaagtatggtcaactttttgtcttctcactcagacttgcattgtggatgcaaactattgggttttcagtgaggtttttgtcttcatttatatggatccagatgtacaggttaggggtctcatcaagcacgccaacatattatgaagcaaatgatgcaagaaatagtttcttgagccccagatctaattcagttagacggggttcaatggctgatgatatattgggtggttcaatttacgatccttcttactactcttctctcttcgaagatgttcgaaataatgcatgcaatcatcagggtgataaacatagtggtggtaatgatggcgggtcaacatctgcaggccaatctccacggcttaaatcttttggtagtagatcttttctttctaatgatgtggaggctggactaagaaggccgctgaattcatgctcagtggagacaagttgaaaatggaacttatttttgccaacctgactacctgagcactctttgtttggtcctccttgagccagtaactcttgttgacttaacatagagatttgtacagtgcaaatgttcatggctcggaacagtggctccccagtaaaacaagagcagcaagatagtacaacgatgatggactgtgttgctacgcaattcttgggcttgtgcaagagtttcgggtgccaatctggcagttggtttttgcctggagtacactttgagttggattgtttcacaggggcagacgctgactagttggcaacatgtggaatactggtagtactttgctgcctagtatggtccattttccagacacgtgtatggcctgtttctcctcttggttgtcacgcaaatgaggctgatagttgcctactccgctatagttaaatcggccattccgaaccggatcgttcggttggtgttgtcaacatcactcactttttgacaatgcactttttggagcaactccaacgcgccgacac

SEQ ID NO: 1834 - DNA, 520 bp, Triticum aestivum
  Clone ID: PAT_TA_1834
ctcctgtccatcatcacctccacgacgcctgcctcctccctttctcaagctgctacaaaagaccacacacaagcaagcaagcagagtcacatcacaccaccggcttggctagctccccacctcacctcgggcaattccctctcgcataaactatttcttggatccttgagagaggatctagagcagcagctgggatctgcgcgcgcgcaccagcttccatgggcctcgatgtcgcggaaatctctgaattggcggcgctccggccgatccagacggccgtgagcggcgcccgggccacgccagtaccgggggaggacgacggcatgccgttgccgacaccggctgcgtcacaccgacggcgagcggcgcgcaatcggccatggcagggggagccgacgacgacgacgcagccgccgacactggctgcgtcacgccgagggcgagcggctgcatggccatgctgccaattgcgccagtgcagcaagacgacggcgccgccgcccccctggcaacgggtgga

SEQ ID NO: 1835 - DNA, 684 bp, Triticum aestivum
  unsure (1)..(684): unsure at all n locations
  Clone ID: PAT_TA_1835
aattacggatggccgctcccgccaaccaaactgaacgcacgcacgcacgcacgcttccgtgctccggcggcccgaaaccaaccagcgaccagcgaccatggcgtcgccacgccgcgcctatctcccactcctcgcgctctgcctcgtcttcctgcgccacgccgcggcgcagcaggcggacgagcggcagctcctgctcgagatcaagcgcgcgtggggcgacccggcggagctcgcgacgtggtcggcggccacgggctcgccctgcgccggctgggcccacgtctcctgcgacggcgccggccgggtgacctccctcgccctgccgaacgtcaccgtctccggccccccccccgacgccatcggccggatcgccagcctcgccacgctcgacctcagcaacaccagcgtcagcggcggcttcccgaagtccttctacaactgcacgggcctcacgcacctcgacctctcgatgaacacgctctcgggcgacctccccgccgacatcaaccgccttggagggaacctcacgtacctggccctgaacggcaacggcttcaccggggagggtgccgcccgcgctgtccaagctcaagaacctgacggtcctcgctctcggcaccaaccagctcaccggcaccatcccgccggagctcggggggctgatcggcctncagacgctca

SEQ ID NO: 1836 - DNA, 919 bp, Triticum aestivum
  Clone ID: PAT_TA_1836
aattcggcacgaggctcgaggactacaaggggttccaggcctgcgcaagagcaaggcgctcatccaggggaagctctggaccgtcgtcctcgcctccgccgcgctcaccatccccttcctcgtcgtggaccccgccctccgcgcctgggtcgtccagggcgcgcgccacggtctcggcgcgggagggaggctgctccttggcctcgtcatcctggctgcgctgtgctcggtcgtcatggtggcgctggtggtgcagacggtggtgtacctggtgtgcaagagctaccaccacgagagcatcgacaagagcaacatctccgaccacctcgaggtctacctcggcgactacgtcccgctcaaggccagcgacgtgcagatgcagcacttcggcgacgaggtctgacccctcccaaagatcgacctgcttctgtttgctctcctctctgtaataccactactagtctagtcacacaggaatcacaattccattgctggtcatttacccaaaacaaaatgagatggaaggaagctgaagagaagtaggatcatttgatcagcagtttctcagtaattatactcagctttgctatgacacgaggaacagttggatgttgcttgtagtaatttgtaatggagggatgggattggtactacactactactagtaaatgctagcttgatcgcttgtgcgtacaccgaaatgaatgaggacatgttgtgttaattatggatagtagatcaatcgtttgagattctgcaattaattaattgcacttccttgtgattatgagtgagctgaatgtagtaactagtagctcccaggctatgagatgaattgagattacactatctggagagttcgcggggggtccggactctactgagtaattaccatgccttgagtatcaaaaaaaaaaaa

SEQ ID NO: 1837 - DNA, 1181 bp, Triticum aestivum
  Clone ID: PAT_TA_1837
agcctggacacgcagggcggcgagctgcagctgctaaccgtcgaccacaggctggaggagaatgtcgaggagagggagcgtgtcacggcgagcggtggggaggtcggccgtctgaatctcttcggcggtcaggaggttggccctctccgttgttggccaggtggtttgtgcctctcaagatccattggagacatggatgttggggagtacattgtgccggttccacatgtcaagcaagtgaagctctcaagtgtcggaggaaggctgataatggcatctgatggcatatgggatgcgctatccaatgaggcagcggccaagtcatgccgaggattgcctgcagaactcgctgcaaagcttgtggttaagcaagctttgaaaaaatgtgggctgaaagatgataccacctgtgtggtggttgacatcatcccatctgatcatcatttgacatcgccacagttatccccaaagagaaatcagaacaagctcaagtctcttctttttcgtagaaggtcgcacagttcagttggaaagtttggaggcaagtctgcctctattggttccgtggaggagttatttgaagaaggctctgcaatgttggaagaaaggttgggtaggaatctgtccttgaaagcagcttcaccaccttctcgctgtgcgatctgccaagtggaccaagaaccatttgaaggattgatggaggagaatggaggtagccactgctcttctccatacgcgccttggggaggcccgtatctttgtctggagtgtcggaaaaagaaagacgcaatggagggcaagagaccgagctgctcgacagcatgtaggtgaaaaggaagcatgacttgtgtcaaaagtatgcttcttctccgtgtaaaaactaaagagatggagataagttgttggtggttcaattattattgtttgctgaacctaactagattctcagcccggtataaattgtatttggctgctaaccagtttgttgcctatgaacaatcctaatattggattcttttaaaatatattatcgaggaaaatacggtgcagactgtaccattgtgtggggagaaacgatctgcctatttattgtgtgtttttgtgtgttagggcctatcatttctattattaatcttggaatgtatttttgcctgaagcgaagtatgagctgagccaactct

SEQ ID NO: 1838 - DNA, 854 bp, Triticum aestivum
  Clone ID: PAT_TA_1838
atcgcgacttttctgcttcatccgaggtctcgttcaactgctcaattgacgatagccaattgggtgattacgttggtgtccgtaaaatggctgcttcactcagaactggcagcgcaatgctgtcaaggatagctacgccatcgacatgcctcgccagaaggacattcaccacttctctcgccttccgaacaggccccaagatcaccacagaggaggaatcctcaccagctgtcaatcctcttgcccggtctgaccctttcgttagcgatccctctgccgaggcccgatctgaagctcatgacgaggccgcttccgaaacacgaccgaaccctcttatcggcagtttcccacctgcccctcctcgcaatgttcctgagacggcagaatcaaagaccagcagccacacctacgatgccaccaaaccctacacactagatattgctcagatcatcgccaacaaggccagcgcattcggcaatgaacaagcttcagaccctatagcccgtccccaaatccgtgccaagcccgttaccggtcgcacagtctttgtcaaggagtttataaccaagaccagcggtcctactcctatgatggccctcaagatcctcaacaggattgtacgagaggatcaagtcaagaacaaataccacagccaaaagttccacgagcgaaagggtctaaagagaaagaggcttgcaagtcagagatggcgagcgcgattccaacacggattcaaggcgacagtcagcagggttatggagcttagaagcagggatggtagatgttcgagtctaaatatcggcaaaagcatcgttgtattatagatgtgagcatgaaaatatgattaccaaggg

SEQ ID NO: 1839 - DNA, 900 bp, Triticum aestivum
  Clone ID: PAT_TA_1839
cctccggccgccaccccgccggtcggggccccgccccgcccccacccgtccgcccacgcgtccgcccccccgtaccagacactcccacggctgccggcaatggcggcggcggcggcggagcaggactactggggcctgttccgggaggagacgggctggtacaacgagatcttcctcagcgccgtcgtgccgggcggcggcggctggtggcgggcgctgccgcacccgctccgctcctggctgcgcaactgcatcggcggctacctcctctacttcgccaccggcttcctctggtgcttcgtcatctactactggaagcgcaacgcctacatccccaaagatgctgtccctacagtagaagctatgaagaagcaaataattgttgcatcaaaggctatgcctttctactgtgctcttccgtccgtatctgagcacatgattgagagtggatggacacggtgtttctttcatatcagcgaagttggttggcctatgtacattgtctatgtgtctctatatctcatctttgtggagtttggaatttactggatgcacagagagttgcatgacataaagccactatacaagcacctacatgcaacccaccacatttacaacaaggagaataccctatcaccatttgctggactagcattccatccattggacgggatactgcaagccatatcgcacgtgattgctctgttccttctcccgatgcacttcaggacgcacattgctctcttattcatagaggcggtgtggacggccaacatccacgactgcatccatggcaagatctggccggtgatgggcgccggctaccacaccatccaccacacgacgtaccggcacaactacggccactacaccgtgtggatggactggctgtttgcaccc

SEQ ID NO: 1840 - DNA, 763 bp, Triticum aestivum
  Clone ID: PAT_TA_1840
gtccccatctactttggagactacccagcttcgatgcgtgcccaacttggcgatcgcctccctacatttacaccagaggagaaggcccttgtcttgggctcaaacgatttctatggtatgaaccactacacagccaactatgttaagcaccgtgagggcgaggctgcccctgaggactttgttggcaaccttgagcttcatttctggaaccaccgaggcgactgtattggcgaagagacccaatctacctggctgcgaccatgtgcccagggtttccgcgacctacttgtctggatctctaagcgttacggcttccccagaatgtatgtcactgagaacggcacgagcatcaagggcgagaacgacatgccacgggagaaaatcctccaagatgacttccgtgttcagtactacgacgattacgtcagggccatggctgatgcttcgcgactcgacggtgtggatatccatggctacttcgcctggtctctgctagataacttcgagtgggctgagggttatgagactcgattcggtgtgacttacgtcgactacgagaacgaccaaaagcgttaccccaagaagagtgcccagcacttgaaacccttgttcgacagtctcatcaagaaggaggagaatggcttgaacggggtgggcaaagtcaaggcaggacaaacttgaaaccggccgagactatatgattatgataactatatgattttttgcgtatgagtatgaactatatatcaattacttattgtcg

SEQ ID NO: 1841 - DNA, 753 bp, Triticum aestivum
  Clone ID: PAT_TA_1841
gttggtctggtctgatgaagtgaaccctagctcgattccgcttccggctacgcgtccccccgcgcgcccggcccaagcccgaggaggagaggaattcgattcgaccagcgccgccgccgaagcccgaggaggagaggaggaaagggggatggcgtccgtggggccgacgctcgagtccctcgtcgaccaggtgatctccgtcatcaccaacgacggccgcaacatcgtggggactcttcgggggttcgaccaggccaccaacatcatcctcgacgagtcccacgagagggtctactccactaaggagggagtacagcagcttgtcctcggactgtacatcatcaggggcgacaacataggcgtggtgggtgaggtggacgaggagctggacgcggcgctggacatgtccaagctgagagcgcagcccctcaagccggtcatccactgaagatgatgaaatgttctatcgatctgatcctgatcgcgcaagccgaagctgatgttgttcagtcaatctgtaccgtaggttaatcgattgatcgctcactcatctcatatctcatatcatggacccttgtatgatgaaaaaaacagggtttgctgcgtcgatggaccggtcatgttcttgtatgagagagagagatacatgcatctctgtgcacgtaagtaatgaatgaatgaatgaagtaggcaattgatgttggaagctacattgatattatgatgatccatttagttgacagcagagaagag

SEQ ID NO: 1842 - DNA, 830 bp, Triticum aestivum
  Clone ID: PAT_TA_1842
ccgggccgggatctccaccggatcccgtccatccatcttctgtgttgtgttgtcttcttctcttccctgttcctctccagtccatctccctcaactcaaagtcgaccgacattgattagttagcttgcgccattaattctcaccacccgccacaatgcgcttctcatcgtctactgttctcgcggctctgcccgccctcgctgctgcgcaggactctcccgtcgaccagtacaaggctcagttccagaatgtcatcggccagttcgcctcttacattcctaacccagcctaccatgaccccgttgctgccgccgaggccaaggctggttccatgagactcagcgtcttgactctggacaactggaaggagactctttacgagcctgtttccgctgacgccactactcccgaggagtggtggttgctcgtctctggtggaaacaagacctgctatggtcgatgtggaactgtcgagcaggccttcaacgagaccgctgccaagtttgcgctcctcgacaagactccccacatggcttacttgaactgcgacaaccagcctattctttgcaattcctggtctgccggccctcccagcctctacgttttcgagatgcttcccgagcccgcagctgtcgaggtctacagcaagagactcaacttgaccaccaccacctccgacactctggtcgccctccaggcctctggtagcaaggaagagttccaccgtcataccagcgcctggttccaccccgtgaacggcaagctggccgagcatggcctagccattcccttcggttacttgatgtgggccatgaaactcgtccccactg

SEQ ID NO: 1843 - DNA, 1315 bp, Triticum aestivum
  unsure (1)..(1315): unsure at all n locations
  Clone ID: PAT_TA_1843
cggccgctcgaggccnnggccgggccggggaggttcaacagcccaactcatcacttccactcgttttctacactcgttacctctgaagctacttttagtttcattactgtcgtttatcgtctctgctgtctcacacacacatctcatcttatcttatacccaagacaccaccttcaaaccgtcaagatgcagttctctcttctcaagctcgccacctacgctggtctcatccaggccgccgctgccgctgtccccgtcggtaccccgatcaccagctgcactgtcgacaagaacatcgccctcacctttgacgatggtcctttcgactacaccaccgagctccttgaccagctcaagaagtacggttacaaggccactttcttcctgaacggcaacaactggggcaacatcaatgactacaagtctgttgtccagcgcatgatcaacgagggtcaccaagttggctcccacacttacagccaccctgatctcgctaccatcagcagcgccgagatccgcacccagatgacccgtcttgaggctgacttcctcaacatcatcggaaagtaccctacctacatgcgagctccctacttcagttacggctccaacgctctccccgtcatgaagactctcggctaccacgtcatcggtgctgatgtcgacactcttgactgggagtacaacacccctgccgagaccgacattgctctcaagctcttcaagcagggtaccactgctctcaggatccatttctctcttccacgatgtccacgtcaacactgtccgcaacctcatccccaaggtcctcgacgccgtcaagcgcagcacccgtatccccgttactgtcggccagtgccttggtgaccccgctgccaactggtacaagaccaccaagcgtaccaagcgtgactttgaggatgatgaggaggctgaggatgagaagactgttgatgagcgctctctgtccgagtacatcgagcgatctcgtttccgccgccacgctcaccacgcttaagcgtcttttgtctacaatactttgatgtgactacgaattgttggtaaagtacatcattgggaaanactgaacngctcataanccaatttatacccattaacagcatagacattcncataaaaaaaangggggcccggtaccaattccctanatgatctatacnncctcacngccgtctttaaantctgacggaaaaccngngtnccaantanccctggaaaatcccnttccaanngggtatacaaaggcncccntncctccaaaatnccacctaaggaatggaccccntnnggatta

SEQ ID NO: 1844 - DNA, 1232 bp, Triticum aestivum
  Clone ID: PAT_TA_1844
cggacgcgtgggcggacgcgtgggcggacgcgcttccttctctccctagtagcttcattcttcttctcttccaaacagactggagttcatcaaggatctcgtcctgaaactggagcctacaagcactcaaaggaagaagagcaagaagacaggctcccagccgatacaaggtaggagcgaacaacgttagggtactgtcgttatatcctgagttgatatggtgacagtgagagaagagacacgcaaagggccatggacaccacgggcggagaagcaggacatgcgcctggtctgcattgtcggttagttcggtgggggcctttgggattaagttgcaggtttatggggtttgaggggtgggagattcggaaactatattgaaatattttgggcaaaatcgcaccgatacggtgggtcttttctatcaactttcgccttgcgtctgcctctgtgatctccctggaagaccgcctcacactcgagagccatgctcggtggggaaacaggtgtacctccaccgtgcgcctaaagcgtgggcgcatggctcatgaggacaagaactactggagaacacatatgaggaagaaagcacaggagaggaagaggaacgtgtcaccctcatcatcttcatcctcagtgacataccaatccattcagccacagacgccatcgatcgtaggaattggcgagcaggagcttcatggtggcagtagctgcatcacaagcatattgaagggcacgcctgctgacatggatggatacctcatggatcagatatggatggagattgaggcaccctctggggtcaactttcatgacgggaaggataattcatacagcagcccctctggtcctctgctaccatcaccgatgtgggattactacagccctgaggcaggctggaagatggatgagataaagatggccccacaagttagctacagtaaaggaattggccccagttattgaagccatatatattgtatcagattactaagttacttgcaacctagcagaagtgaaatgcttttgttgaaagaaccattagcatggatctaaaaagtatttatatctatctagcattccaagtgtgctcatgttttatgtatctactatgtagcatctagtgtgcaagacatgtaatgcaaggacacttccactctgtattcacaataatcagctatctcctgtaagacttttccaatgcaaacatgattagcaggtgttatatc

SEQ ID NO: 1845 - DNA, 736 bp, Triticum aestivum
  unsure (1)..(736): unsure at all n locations
  Clone ID: PAT_TA_1845
ccgccaccaacaaacaaacagaagccacgccggagtctcgtatcgcaaacgtcggaggtaggaagcaccgtccgccgtctcttcccggagatggccgctcccgccgccgccgccgccgccgtggtggtgctgttcgacttcgacaagaccatcatccagtgggacagcgacgactgggtcatcaccaagctcggggccgccgacgccttcaaccgcctgcgccccaccatgcgctggaactccctcatggacaggatgatgggggagctccacgcgcaggggaggtcggccgacgacatccgcgagtgcctcaggagcgcaccgctcgacgcgcacgtcctctccgccatccggacggcgtcggcattagggtgtgatttgaaggtggtgagcgacgccaactccttcttcatcgagaccgtcctggagcaccacggcgtcctcggctgcttctctgagatcaacaccaaccccgcgcgcgtggacgcccaagggaggctcaggatctctccgttccatgatcccacgacctcgccccatggttgcagcctgtgccctgacaacatgtgcaagggcaagataatccagaggattcaagggacagacggtgccaagaacaagcacttcatatacatcggtgatgggaagggggattactgccctctcttaactagggaagggatattcatgccaaaggagaatatccctctggatctatancaacggtcccagctat

SEQ ID NO: 1846 - DNA, 596 bp, Triticum aestivum
  Clone ID: PAT_TA_1846
taccggtccggattcttgggcccacgcgcgcgtcagcttcattgctatcctgccaaccccaaatccccagttccgccgaggttcccacacccaatctggtgcgtagcagcgtgcgccggcgatgggcggcaagaggaagagcaccgcggacgtgaagacaccgccgacagtgggccggcggccgggccgcccgaggaagaacacgccgccggaggcgatccggcgcccgggccgcccgaggaagagcgagccgggcgtcgaggtgccgctggcgcgcagcccggtcccggtgcagacgctgccgtcgcccagatccaagcgcgaggaggaggcgaacggcgggctgctggagctcgcgcgcggcgcggcggccatagccgcggcggaggaggaggaggagcaggtcaggatgcgctgcgacctctgccatggccccctcaggccccccatctaccagtgcaccagcgtgcagcacgtcgcgtgccgcgactgcggcgccgacgagtgccgcccgtgcggcggggacccggccgccgtcttcgtccacaacgcccagctggacgccctcttcggctacatcagggtgccgtgcccgt

SEQ ID NO: 1847 - DNA, 565 bp, Triticum aestivum
  Clone ID: PAT_TA_1847
aatttcgcgccgaggactatcttggcgatgttcaaaacctgatcttcagcttctttcccgaggtgtcacacgctaagccaaccacaccacaatggatttaagtgcgcacccaatgccgagatgtcggcttctttattcgacagtatataattgatagacattttacgaccatgaacgggagtccgcggcaggacaatggcgggcatgatttaaaaggcacatacacactcgttgctctttgaagcagtatctattccctctttgagaattcttatttattaacactcacgtctgtcttggtttggattggtttattggaggagaaagggtacatgtccaatatttaggtaaccaatgtatttggtttggatattggtgacttggcgtttaacagggccatgaaggaaacaaacaggactggatctgacattgatggatgtacagaggatgccattttcctcttcgatggatgattgattgattctttttgacgattgttgtatctagatttaccatactagatcacacacacactagcctccaacggcatatttttctttatcgc

SEQ ID NO: 1848 - DNA, 543 bp, Triticum aestivum
  Clone ID: PAT_TA_1848
cggacgcgtgggcccaccaccgggcgggaagcagcctgggaagtagctagggtagcttcgaggagtccgcacgcgccgcagccgccgcctctccccagcgccgccacagccgcgccccatggccaagggcaagttcaagggcaagcccaccgggcagcgcaccttctcctccaaggaggagctcgaggctggtacttcagcagatcgcccaaagaccttttctaagaagaagcaagaggtatctaacagaagggaagagtcaattgaggaggaaagcgatgaagaggttgagaagaccaaacacaaaggcactgcaggtctcatcgagattgacaatccaaacctggtgaaaccaaagagtattaaagccaaggatgttgatgttgataggacaactgatctctccaggcgtgaaagggaggagcttgagaagcagagagctcgagcgcactatatgagacttcaggaggaagggaagacagaacaggctaggaaagacctagatcgccttaccttgatcccgcggcagagggaggaagctgc

SEQ ID NO: 1849 - DNA, 1599 bp, Triticum aestivum
  unsure (1)..(1599): unsure at all n locations
  Clone ID: PAT_TA_1849
gcactcttacattgaggatagctgatcaatcacgtacatctggtatctccgtgactttctttgctaacaacactgcactactgccatgtgttaggtcaagcggcgatatcatcagtctccataatgttgtggtaaaagtgctacatggagaattctttgtaactatggagaaaaggttttcttcgtttgcactatttggagggatggtatctacagagttcaggccttaccagatttctatgaaacatcaaggaaccaaacatgacaaccaaattttaacccagatgagaatgtggcttgtgtatcatcctccaggtctgaaagatcttgaattgcagctacggaatataaagtctgattctacttttgaccttgtatgcaaggtacttcatgtctgtgaagctcccagtggcgaatggattttttatgtttgggatggaactgatactcctccaactgagcttcagacacgtttggacatggaagcagttacaccaacccctctgcatcctgaagaagcgccgttacccagggaggttctatgcacactgccttgtgttggaactgtcctgagggtattctcaaacagattttcaaaggaaatactacacttgcaaaaggatatttactgggcccggttctgcaatattacttgcaaacaggagtttggcatgtggaaaggctctttgctgccttctagtagaatccgtcttttatctagtgaagatggcagtgtcattgaacgtttgaagacattcgatggtcgttttgccacccaagttcatcgagagccaatggctagcctccacacggcctctgatattactgatgtggagttcaagagagcaggttacacgacattaatggagtcgctcacccatggacaggtgacgcacaaattcaaaaccctggtccgtgtggtggcggcatacccttgtcaaggcaaagagctgcattcactattgacgggtgattattgccttcggctgactctcgaggatcctacggcgaggatccatgcatacgtccacaaggacaatgcggtgagctttttcggcggtttcctcacactggccgcgctgaccagaaagatgaacaggctgctgggcgtcccagagccagaagatgatgccgaggaaggcatggccggcggcaggaaccctccctggatatggtgctgcctgaagtcgtaccgcctggacaagtacgacccctggggcagcaggcggtatcggatcttcggcacagagatcagggactgagataggcggaaggtgatccatcgatccgcgacgcggcgaaccgcctcggagactgcactgtgtacagagaggtctgcctgaactggcactactagtcatcccgttgctgctgtttgttccttagactagaggagccactctgttggtgttactggattagtgcagtttttgtgcagtcgatggcatgttggcactagtcaccgctagtgtgcatcctgtatatcctgtatgacttgtgctcggtgttcctcccnaaagttgcgaagtcgatggcactagcttagttagtgtgtgtgtgtgcccgtgtgcgtccgtggggaagaaacgtgaggagttt

SEQ ID NO: 1850 - DNA, 622 bp, Triticum aestivum
  Clone ID: PAT_TA_1850
ccacgcgtccgcccacgcgtccgcggacgcgctcgcggcggcgtcgtgggtggaacccgctccaggcattcttccaccgaagaatccggacttttccgcggctagatttggcgtcgggagaggaaattcgatctgaaaatggggttgttccgggccgcgtcgggtttagcccgggtggcgctgcggaggagcctgtcgcgcgctccggcgagcccgttcgccggccccgcgccgcggtacttccactcgacgctcccccggcggtacgcggcgcctgagccccgcgccgtgccgctctcgcgcctcaccgacagcttcctcgatggcaccagcagcgtgtacctcgaggagctgcagcgggcgtgggaggcggacccgacctccgtcgacgagtcctgggacaacttcttccggaacttcgtcgggcaggccgccacgtcccccggcatatccggccagacgatccaggagagtatgaggctgctgctgctcgtgcgcgcctaccaggtgagcggccacatgaaggccaagctcgatcctcttggactggagcagcgcgcggttccggatgttctggacccggcgttctacggcttctctgagtctgatttggatcgggagt

SEQ ID NO: 1851 - DNA, 772 bp, Triticum aestivum
  Clone ID: PAT_TA_1851
gcgggggtgacaagtaactgcaactttaccctcccttgctatagcgcagttcgtttttaaccacgtacacatctccaaccacgaaccagtcgctcgctatatcaactcaaaacaatccaacgattgattaccagtttccgcaatgtctggctcaggatacgacgctgtcgtcgacgttgacgatgagggtgatctcggccacaccgatctccaagaagacctcgaattccatacgtccaacttcaatgacacaaatcccaacacccgcaagcctccctctggcggcagcggtcttcccgcgccggccacagcttcgagcggctcaggatcatctaagcgcttcctctggagcatgaacttttatgcgcagttctttgatgtcgatacttctgctgtcctgtcccgctgctgggctgctctcttccctcgggccaacttcctcgatgttctcgaaggcaaccctgatttatacggaccgttttggatcgccacaacggttgtcctgattcttttcctgggaggtaccatcagccagtatatgtctgatacaggcaagggaccattcctctacgatttcaagctattgagtggcgccgctggcctcatctatggctacaccctttttatccccatgggtcttttccttgccctccgatacttcggcagcgaatccgccaacctgctcgagtgctgggctctgtacggctactctaacctcatctggatccctgtggcccttatcagctcatcgcctatttcgattctcaattgg

SEQ ID NO: 1852 - DNA, 1047 bp, Triticum aestivum
  Clone ID: PAT_TA_1852
caccacccctcgtggtacagcaagcgagcgccgccccaagccctacaccagcaatggccgatccagcggagcaccgcgaggaggaggaggaggccgcggcggccggcgaggaagaggacaccggcgcccaaatcgctcccatagtgaagctcgaggaggttgccatcacaaccggcgaagaggacgaggacgtcctcctcgacatgaaagcgaagctctaccgatttgacaaggacgggggccagtggaaggagcggggcacgggtgccgtcaagctgctcaagcacaaggagactgccaaggtccgcctcgtcatgcgacaggccaagaccctcaagatctgcgccaatcacctcgttgtggccacgacgaagatgcaggagcacgctgggagcgacaagtcgtgcgtgtggcacgctctggattttgccgactgtgagctcaaggaggagatgttcgccatccgctttggatccgtggagaactgcaaaaaattcaaggatcttgtagatgagattgctgagcagcaaggaaagaatgaggagaaagaaagcgaggaagtctcctctgctgccgagttggtagagaaattgactgtggcggaggtcaaaaaggaggaacaaacggagaaagtggagactcctgcagtagatgataagaaggatgctgaaaagtgaaaacttgggccggctatttcatcctatgctctaggcggagcactgctatactcgaactagtgaattttcaaatgagtgtcattcgattcattttatggtcaaagttcatcttcctttcacaaattttcattgtgttgttctgtgggatgtttgtttgtgttgggccaagtttgatttgtgtcagtcatgggtttcttggttgatagactgtcatttgtttttctggatggtgtgcctggggttagcatgtttgtacaattatttgggaattgcttttggaatggatacggtttgagttgtccaaaaaaaaaaaacaaaaactcgagactagacctgcccgggcgcccgctcgaaatcacttagtgaattc

SEQ ID NO: 1853 - DNA, 832 bp, Triticum aestivum
  Clone ID: PAT_TA_1853
aagtcaagaaatcgagctcgagcggttccccacactgctagtagcaaataagttcgagtccctggagtgccagtcaaccatcgacggccaaaccgccgccacgaccatgagcgacaccgtcgtcatcaccgtcgccgtcgacaactctattgtcggcgagaggggcgccattcaatggcctgccacccgcaaggggctgcagactggcacaccatcggcagaaggaattgagagcgtgatgttcacgtaccgattcatggaggaccggccgggcacgtaccacacttgtgacgaccaacacccgaccacaatgttcaccgacgtgcaggaaaccgaagctgggtcgtcccattcagaacacgatgcagtcaacgtgccacacggagacgaggaacagatcagatacggcttccctcacaccaccgaccgagaagtcatggcgtacacccccggaggcaggggccatgccgcccttgcaagctcagaagcaaaactcatggccggtaactctgttatctaccgcaatgacgaaggcccggtcgagcggctccttcggtgggttgctggtatatgcagaggcagggaccataacgtctatgcgtgccctgaagcgcaactcatggccgactgttctgtcattcacctgaatgacaaaggcccgattgggtggctcctccggtgatccatctgctgttacgtcccttcgaggagatgacccgttaaacttgaggtttagaggttgagaaaatcctcatgtctcgcgaggttcagggctcccgctatcatgcattaataaaaatctctctctctctctctctctctctctctctct

SEQ ID NO: 1854 - DNA, 801 bp, Triticum aestivum
  Clone ID: PAT_TA_1854
ttttcaacagggcggttcgctctctgcttcacccctagtctacctgagccaccatgtctgcctcgtcgtcctcctctctccctgtgccagccgatttccctcttgatctcatcaggtgtcccttctgcggcgcggatctggaaaccaatgtagcaagaaccgggagcaaggcggggcagcggttctacaagtgtgtccgctatgatacggcctacgtcagaaggatgactccgtaccagatcgcccgtgctcagcagcaagcgggggtgctccaggtccagatgcaggcaaacccggccggcatcgtcgctccacctgcaaaccaggctcaggtccaggcgaaccagggtcagaatcaccctctagcgacgccggagaccgttttggtgaaccagatcttcaggcccatcgcagctgctgcttctggttctcaggcgctgggggcaacagctttcatccttgccgctagcaacatcatgctcactctgctgcttctgttgttcgttgtggccatctattttggcggcggtaactagttcgttcttagtacgacatacgttgacatttcgggaagggttcttagcaaaagtgtgtgtgtgatgctcgactgcggatttggttgttcctagtttgccttaggcaatatgattagggaattaatggtgttcaagggtggctccctttacctctaagtctgtttaccagaacatgtaattcatactctaatgtaacgcactatctggaactaatgaagctttgctgtgttagttaatcagttatcaattccatttaaaaaaaaaa

SEQ ID NO: 1855 - DNA, 1405 bp, Triticum aestivum
  Clone ID: PAT_TA_1855
gctacgcgtggggccagcacgggcccacccgccgacagacggacctctccccccttctcgtctcccatggcggaagccgacgcccaaacccagagcaacgcgcactcctcctcgccgccggcggaggcgtcgggcgagccgatccggtcgccccaggtaggcgctccaagtgctgcttctccgacgtttccgctcatgtacccgatgctcgtgccagggatgttctcccagcagggtatggatgatcaggatatttgcccttccggagaatcagttcctaggggcaaggcgggtcacgctccaaagacaacgcgcactcctcctcgccgccggcggaggcgtcgggcgagccgatccggccgccccaggtaggcgctccaagtgctgcttctccgacgtttccgctcatgtacccgatgctcgtcccagggatgttctcccagcagggtatggatgaccaggctcagggtccagggatatatgccatacaggagaatcagttcatgggggcgatgggaggttacgccccaaagacattcataccgctcgcttacaatataccctcaagtgaaagcgtcggtccattggctggagaggagcaaggacaggatgctaggcagcaaaatggccctcaaagacaagttgttgtgaggaggtttcactttgcttttcagcttgacctggctctgatcatcaagttagcagcagtggtctttttgtttagccaagaaggatcaaaacaaaggctgtttcttctcatattgtttgcgtccatgatttacctatatcaaactggagcgattacacctttcttaagatggctccagcgggcgggaggtgtggccgctcgtccgccacaggctcctgctaaccgtgctcctctggctgcccagaatgatggcaacgagcaacctggtggaaacctcgcagatcctgcaaaccctgaccaagccgcggagaaccaggaaccaggagcagcagcgggcaacgagaaccagcaaggtgcagagggagaagcaaaccggcgcagctggctcggcggcatcttgaaagaggtccagctggtcgttgtagggttcgtcgcgtcgcttcttcctggttttcagcacaatgactaggtgaaagtcttcccgtggcagaatcgaatattggcaccgtaactgtttgttgtgacatagggaggaagtacaagcagaggatatatataaagcgggttcaaataagacttgtgttgcatatgcttgttataagattgactgaatgcagtgctgttgtacatcttgttttcgtttcaagtgctctagtttcctttgatctttcatccggtttatgaagtatgaacttcttgaacctacgggcatccatggtgcagctatcaccactcaaagaaaatgttagttattct

SEQ ID NO: 1856 - DNA, 851 bp, Triticum aestivum
  Clone ID: PAT_TA_1856
atttctataagcggcatctggccatctccttttcgtggaagcatgcggaggagcgcccatccaggctgccggtgcccctggccactggatccctcccccggcgtcgtcgttcgaggcaccgccgcggcgccgtcccgcttctgccgccgcggccatctccacgacgatgtggcagacctcctctcggagctccacgttgaaggctgggccgagctgccgctgcctgggtcccccgtgtgcgctgcccgcatcctgttcactgccgcagtgctgccatcggcgtgcttcgcgctaccctccaccacactcccggttggcaccatgccgccaacgatgatcccatggtgatgacgacatgcagcctatcctcgctgcgctggaggtcgtccatcctccaccctctaccggggacgaggtacgccgcggtgcattcatccatgcttcaccccttccgacccatctcggacggcgccgcactgtggtaccagccagtcgcgacgagaccggtaacgcctccgcgtgcgggcagcgcactttcaaggcccggttgcagttcgccgcatgccgccatcaccgagcgtacgtgctttccgtcaacaagagcacggaccacagcacgtacactatgccactgctctctttgtccttcaagattagctgcatgattatccggcaaaaacgagtcatgtactcacgggctgcactgatctgaaggacagactgtcgtttgcgggccgtgtgctgtttgctagctgcttccaccaggtgtgagagatcaatagagatcgagacggcgtacagcaatcaaaataaattcggttctctctctctctctctccttttgctttttg

SEQ ID NO: 1857 - DNA, 2082 bp, Triticum aestivum
  Clone ID: PAT_TA_1857
cgtccgctcgccggccaactcgagcgtggcgtccacgccggcccgcggcgggttcaagcggcccttcccgccgccgtcgccggccaagcacatccgcgcgctcctggcgcggcggcacggctccgtcaagcccaacgaggcgtccatccccgagggcggcgagccggagctgggcctcgacaagagcttcggcttctccaagcacttcttcgccaagtacgagctcggcgaggaggtcggccgcggccacttcggctacacctgcgctgccaaggccaagaagggcgagcacaagggccaggacgtcgccgtcaaggtcatccccaaggccaagatgacaacagccatagcaattgaagatgtcagaagagaagtgaggatattgagctctctgacaggccacagcaacctagtgcagttctatgatgcttttgaagatgaagacaacgtgtatatagttatggaattgtgtaaaggaggcgaactacttgataagatattggcgagaggtggaaagtattctgaagaggatgcaaaggttgttatgctgcaaattttgagtgtagtatcattttgccatcttcaaggtgttgttcatcgggatctgaaaccagagaattttctattctcatcgaaggaggaaaactcacccttgaaggtcatagactattggcttgtctgactttcgtaaagccagatcaaaggctcaacgacattgttggaagtgcgtattatgttgctccccgaggtgcttcatcgatcttatggcacggagggagcatatgttggagcattggagtaattgcctacattttgctttgtgggagccgacctttctgggcacgcacagaatcaggaatattccgagctgtccttaaggcggaaccaagttttgatgaggccccatggcctactctctctgctgaagccaaagactttgtaaaaaggttgcttaataaggattaccgcaagaggatgactgcctcacaagctctcagtcacccatggatccgtgatgcacaacaagtcaaaattcctttagatatgataatctacaagcttatccgagcttatatcagttcatcttcattgcggaagtctgctttgagggccctagctaagacattgacagcaaatcaactcttttatctaaaagagcagtttgaattgttgggtccaaacaagagtggttttatctccttgcaaaatttgaaatcggctctggtgaagaattctacggatgcaatgaaggattccagggttattgactttgttaacacggtatgcacccttcagtacagaaaattggatttcgaagagtttgcggcttccgccatcagcgtatatcagatggaagctctggagacctgggaacagcacgctcggcgcgcgtacgagctgttcgacaaggagggcaaccggcctatcgtgatcgaagaacttgcttcggaactcggcctcggcccgtcggtgcccctccacgtcgtcctccaggactggatcaggcacgccgacgggaagctcagcttcctcgggttcataaagctcttgcacggagtttcttcccggtcgatcccgaaagcctgagacggaaaacaagcattattattgttgcatcaaacctaggagatgactgatggctaagccagtgccaatctctcgctggtgtctgtgtgcgtggacgacgactgtttgaggtggctggagcaggacgatggcttgcgaccacgaccgtaacggaagggaagccgacagtctttgtgtaagaggtaagaagataaaaagaaggttgttgcttgatgcttatgactactacagtagtagctactagtgcttgcttgtacccctcccgcccccccgtgccacgtggattgatgatggtgttgtattaagctgctgtgtagacggatgtacagatgaggataggaagaaaagaatatgaattgaaagggcttagctgttgttgttgttatggcttggagactgctggttgtcgtcgtcagtgtccttcttttggtgccgtctctaaggtgtatgtaaaaaaaaaaaaaaaggaaaaaaagggccggacgcgtgggtcga

SEQ ID NO: 1858 - DNA, 1082 bp, Triticum aestivum
  Clone ID: PAT_TA_1858
ggggtattccgacggctaggtttccctctccgccgccacaccagcttctccccatctccctcctcgccgccgccctccgctcgccgctcgccgccatgggacgcatgcacagcaacgggaagggcatgtcgttctcctagatcccctacaccccggccgccgccacttcgccccagccgcctcctcgccaccgctctgtgctctccgctcgccgccatgggacgcatgcacagcaacgggaagggcatgtcgtcctcggtgatgccctacaagcgggaggccccggcctgggtcaagacgtccgcgccggacgtggaggagatcatcgtgcgcgccgccaagaagggccagctgccgtcgcagatcggcgccctgctccgcgacggctacggcatcccgctctccaaggccgttaccggcgccaagatcgtgcgcctgctcaagacgcgcgggctggcgccggagatgcccgaggacctctacttcctcaccaagaagggcgtcgcgattaggaagcacctggcgaggaacgaggtccagtcgtgtgaccccaagtttcgcctcatcctcgtcgagaagcagggtccaccgcctcacccgctactaccgcctcaccaagaagattcccgccgcctggaagtacgagtccaccaccgcgagcactctcgtcgcctgatttggttaagcggttctttgacgtaattctctgcagcttttggacttcggttttgtgttaagtagtaagcaatgctttttggggatgtaagctgttaaacctatcagctaccgctcgtgtgcctggacagaagtatttcgagagtttaagtgggactggatcaggttctgatccttggaagttgagacaaaaaaaaaaaaagggggggaaccgccacttcccgggggccgctttcgcgcttcgggttacaaaccctcgggaggaaaaacatctatgccccttctgtttattctgttttaaaaaaaaaaaaaaaaacccagggggggccggccccattcccctattgagggggtaaaataacgggcccggtttaaccacccggcgggaaaaaccccgtcccccactt

SEQ ID NO: 1859 - DNA, 1966 bp, Triticum aestivum
  Clone ID: PAT_TA_1859
cggacgcgtgggcggacgcgtgggtccccacctactccctcgccgcgccgccgcgcagccgcgagtgcagcgaacatcggcgccagtgccacgcttatggccgccacctcccattccctcctctctccggcgcccacctcgcccccccgcgcccgccttcccttccccggcgttcgagccctagtcccccgtcgaaaccgctctttcccagttcatatggtatcgttctacatggatagagcacttggatgccgagcagaaaaaggggaccaagctgcggggcggccacctataagaggcagccacagacgacgaataaatcccctaagtctaagtctggtacgactggcttctgggaaggggatagatcatgggcgaacggggtctctggaccatgcacagtctgctgttgcttcatttgacgagttggagtgatccgttcaacgtttttatttataaagcacttgcaattgttctgaaaaggctgtttgagtggtgaaaggatagggaggacgtgcacatgaacattgaggcagctctgattgagaaagttggtgagccggccaagaagttacacactgctaggagccgcaatgaccaaattgtgacagatcttaggttgtggtgccgcgatgctattgacaagattttgattcgcatcaaacagtttcaggtgtctctggttttgttagcttcaaaatatgttgacttaattgtccccggttatacccatcttcaaagggcacaacctgtcttgcttccacatcttctcttatcctatgttgaacagttggagcgtgatgctggccggctgatcgactgcagggaaagagtgaatttctgtcctcttggtgcttgtgctttggctggaactggactccccattgataggttcaaaactgctaaagatttgaagtttacagctccgatgaagaacagtattgatgcagtgtcagatcgtgactttgttttggagtttcttgctgccaactctattgctgctattcatctttcccgcattggcgaagagtgggtcttgtgggcgtcagaggagtttgggttcttgacaccaagtgactcggtgtcaactggaagcagcattatgccacagaagaaaaatccagatccgatggagcttgttcgtggaaaatctgctagggttgttggtgatctcatgactgtcctggtcctctgcaaaggccttccacaggcatacaaccgtgacctacaggaagacaaggaacccttgtttgacagtgtgaaggccatactaggaatgcttgaagtatgcagtgagtttgctcaaaatatctcttttaactcaaaaagaatacaaagttcgctgcctgctggttatctggatgcaacaacactggcagattatcttgtgaagaagggcgttccattcagaacttctcacgagatagttggaaggtgtgtggctctatgtgtgtcgaagaactgtcagctgacagagcttgaaatggacgacttgaaagcggttcaccctgtcttcgaggccgatgtgtacgcctatttgggtgtggaaaacgccgtcaacaagttcatatcttacggttctacgggttcagaacaagtaaaaaaacagcttgaagattggcgcgttcagcttgggatcaacccctaaggcgcggcatcaacagaggaataaatcccccaagtctagtgtggctgttatttattttgggaagtggattgtagtgttatgaacgtggtttctggacgagagacagtctgctgttgcttcatttgagagttggagtgatccgttcaacgttttatttgtaaggcacttgcaattgtactgaaaaggctgtgtatgtttgatctccagtcacgaccccaaaaaggatgcccattagtttacagagggagtatttatgtttatgtccaaacaggtccccggttatatttatgttttaaacgtccccatattatggcgccc

SEQ ID NO: 1860 - DNA, 525 bp, Triticum aestivum
  Clone ID: PAT_TA_1860
gcccggaagtcccgactgacggccctacgtaccaaccacttacgtccggccattcattttcattcttactcaccccacgacgtcacaccccacatcacacctcccttacctaaccaacctcaatcaccttggacaatatcacagcctcacatctctttgagataaaaggtcattgtctattctctttgtctctacatcacgaccttgctctactgcaaacgtgatcccactctctagcacagcaagaaaagaccttggtgcagaacccctaatcagccaggtcacaaaaaaagaactgaaacacgttccttttcctcttcgctcccttgcgcgcaatcgatatcaccgacgaccggaacaaagcgatccccgccgacacccgtcatcgtcacatccgaatcgttgtgctgttgtagacaacaataaaagaaagaaccccaaaaacaagaagctgctgtgaagtgaaagaagcgcgtggtcttccaatacctaattctttggtcgatattctcaatatcgcctact

SEQ ID NO: 1861 - DNA, 1344 bp, Triticum aestivum
  unsure (1)..(1344): unsure at all n locations
  Clone ID: PAT_TA_1861
tcggcacgtgcgagagctgcagttggtttcatgcctccggagccgacactgcaatccctccacgttcctcacggtgccctctctagcctgggtgtgggtggtgtgttcgtcccggtccgggatgtgttccaggcgcgcgggctgggctcccgtgggcgtgttgcgtcacctcgctggtctctactggctcctgaggttccctctgctcggatcttctaaagagcaagcatgaaacagcggaatttcatggagcggctagggctctaagtggaggtggtgtttatgtcagtgacaaaccaggagtgcacgatttcactgttctgaaaaagctcgttctaccagatggctcgattctaagagcaaggtatgctggtcgtcctactcgcgattgcctgttcaatgatccagtcatggatggtaaaagtcttctgaaaatatggaacctgaacaatttgtctgctgtcgtcggagtattcaattgtcagggagctggaaactggacttggttagtcgaagaaatttcacatgttcccaccgccgttaacataaccggtcatctctcgccatcagatgtagagtctctcgaggagattactggtgatgagtggaatggagagactgcagtatatgctttcaattcatgttctctttcaaggctccagaagcaccaaagtttggagctttcattggtcactatgacatgtgagatctataccatatcaccgatacaggtttacggtggggctgttcggttcgcgccacttggactgctcaacatgttcaactctggtggcgcactcgacagtatcactggcacagttgattcttcagctacgacagttcagatcaaatgccgagggcccggacgttttggggcgtattcatctgctagaccggcactctgtagagttgatgcgcatgaagtagagttcagtcattctgatgatggcttgctagcatttgatctctcagatggatcttcccacagcagcctctggaacatagagattctctacacagcctcctgaagacctgaacctgtatgtgaccttgatgtctcttgttgcaatttctgctctgcgccattcatttctcggagaccaaccactgatgtttataccgtggtggtttctccgtaattgctgcctcccagcttctgaaacaattactctgctcaccggatttagaagtgtgttcatgtcgcgtcgtgtttccgtgtgcgtatgcgtgtgttttctgtgtcgttatggctgttatagtctgttggacacgaaccaaaattatagatttatgtagatcaatttgtgagattatttgctggaatgaacggacggattttgcana

SEQ ID NO: 1862 - DNA, 1458 bp, Triticum aestivum
  unsure (1)..(1458): unsure at all n locations
  Clone ID: PAT_TA_1862
cannnnntccnnncaataaagcaaaagnnnnntgccctcgttgagcattggttccataaagggcatcacgcggaaagacctgttcggcgctggtgaattctccactaaaactcctgggtctgcagaccaggtgacaccatcaaccccctttcacatagggagcgcaactatacatcccacacaagaacaccgtgtggtggcacacgtgtcaccggttagttgcactaggtctgtagccactggccttttggacttcagagaggaagtagaggcagactgtgtaaacctgaacaaaccggttgaggaaatatcactacccgcaccaccacccaaaaggagagttgcccctgggcctgccggccgatcgccgtttgtcatgcaatatcgtttgtccgagagggcttcaggagatgcaacacatttgtatctaacattctcccagatggacggagcagtgctaagcaacaactgggttgttagtccatttccaagctacatagagctgacgggcatcgtactcaaaagacagttgagcgtgggaggtttcatagagatagacttgatgaatgtttttatgcggaggttccagcagctagagaatgcttgggccagaaaatatggcgactcaccatggaggcattacttggaaccagacttcatgagccacgtattgcgaggcggaggattcatccataatgactatgtaaggaacatttttgttgggcatcacatctcgcatgatgtcaacagatgccctatgatggtcttgccagtgcatcatgcgcacgcttggtcaacatatatattcgacttcccgaggaggaggacaaccattttagatcctatgatcaacaacggggacagaccagcagatgaattgcgcaacgaacacataaaaatagcagatgagctacgcggggcactaatggaatgcatagctgaatacttcgatggttggacacccaagaccaaaggatggcagaactggttcccaaaactcacaactggaccttgggtctgcagcagggcttctagcggggtcatggcgctacactatgctaggcagtggatggggacgaagctacagaggactttatcgccgatgggggatgagatcgaccaatctaggatgattcttttttatgaagtattgggattagccggcaatatcgggcagctcccaacaaaattcaagatttgccagaatgtttgctgagaggcgcacacgtaagcttcgcaggattgtggcttccagcatcatcagaacatctacgaagacttgtgaggcgtgtcgcaatgattagaacttaacaaaaataattcccagatattagtagttttccttctaaaactttatcgcaaggttatgtaataagaatctgatgatttccccttctacatgcttagaatccggtttcttagatctaacctgtattttcaaatttgctaagccccggg

SEQ ID NO: 1863 - DNA, 589 bp, Triticum aestivum
  Clone ID: PAT_TA_1863
aattcctccattcccttcatcttcatagcagctaagcctcttttctccatcctcctctaggttcttgatcgcttcaggaagacacatcagtaattccatcatgagctaccagcagggcgccaccgccacggcctaccctccgccgggccagcagcagcagcaggcctacgtagcgccgccgccgccggccggctacccgcagaaggaccagcagtatcctgccgccgccggcgccgacaccaccacgagccgcggcggccatggacaccaccacggcggcggcttctggagaggctgctgcgccgctctgtgctgctgctgcctcctcgacgcctgcttctgatcaagtcaatttcatccatcgtgctcggttaggctacgtggcctaacgactgcacctgctgttcatcacggttgatgtggagtccggatgtcatctagtaattgtttgttttcctttttcgcttgactcaaaacacttttgtgagcatagctatttctccgttgctcagcaccatttctgtgtagtatgtcatggtgatgcggcccgatctcttgaacatttgattatgttaatatataaagatgt

SEQ ID NO: 1864 - DNA, 1331 bp, Triticum aestivum
  Clone ID: PAT_TA_1864
ctcctctaatacgctcactggaggcgagagatcacatcccccccttttggcgaattgtcgaagtcccacgtaagcactttactcgttctaagtggggctttcttaaccttgcggctaagttacccccagatgccctacagtctgaagtaggcctaaagctgcttattgcatatggaaggcagcaacaacctcgtaaaagcgattcagtgacaaatctgatggttaagatgggtgatgtggtacacatgttaatgcatagagctgaaatgcgttacctatgttcaaagagtctacaacctgagcagccggaaaggattgccaatgggatggcagtgcatgtaaatgctcatgcacctgtgcaaaacttgaatctggatatgggggaacaatcacctgaacacacagtttctaagtcttggagcccttctggacgctcttctgctgagctatcgagttcatcacattcagagcaaccaaaaactaatggtgtagaaagatctcagcctggtgctctttgggatgtcttccgcaggcaggatgtgccgatgctgaataaatatttagcttctaactgggaggaacttacaaataacagtcaggcgatgctctctgtgaagcatcctatttatgatcaagctgtatatctcagggagcatcataaaagggtattaaaggatcaatatggaattgaacctcggacatttgaacaacatattggcgaggctgtttttattccagctggctgtccttaccaagtaaaaaatctccagtctacggttcagttggctctggattttttgtcgcctgagagtttgcgggagtcggctcgtatggcccaagagatacgctgcctgccaaatcatcatgatgcaaaactgaagatgcttgaggttggaaagatagctttatatgcagcaagttccgctgtcaaagaaattcagaaaataacccttgatcccaagtttaatttggatatcagatttgaggatcagaacctaacccgggcagtttcagagaacttggctagagtcactaaacaacgaaaggtgtcttgtggttgacattctacaagccctcaggagatgcgggatgtaaaattgaaactgaaacccatgtgaagtagatatagcaaattgtacatgtagcataccatgtcccgaaaggaacacattcacaactcttgtcagatagtattgacctcacctgtatattgtgggttaggactaacggctgtgctcatgtcaacaaaaataatgtgttgagcaattaatgaacattacaatgagagtatgattgataactgctcttccgccatttaaagagaattcaga

SEQ ID NO: 1865 - DNA, 641 bp, Triticum aestivum
  Clone ID: PAT_TA_1865
acctactaatcccctgtgggacaacatacttgatcctatcataccatgcagcatcgttctcctgaaccacgcataatgcttcacgcagtgccttttccgatgcgccgtccttcatcatctcaacgacgcacgctgcattgagtcctgcattgcgaaacccttcaacaaattgctccacatcgtacatatgcgcaaatcgagtatgcgttggcgtactgtccatgtccttgcgattctggattggcgtgtcttgtcaataacgtctcatcaatgacggctactcacaggaacatgcacgcgcatgtacataccgtgcagtccaggcactttgctcccaaggagtcgacatattcgttacacttcctgctaccccagtggtgattacagggccaacgcataatcttctgcgggctttgtttcttttctacctcttcggcgaggattggtttcgatatatcgcttacggagttactgctttcttgaaacatgcttggccaaaggttgaactctctcctccatgccatgtcttgtgcgctcgctcttataccacgtctccctcgccgacggtgacgggaattggcaccgtgatgattcggttcgcacgtgctgccgaaaaatgtacaatgttgtaactgacgttt

SEQ ID NO: 1866 - DNA, 980 bp, Triticum aestivum
  Clone ID: PAT_TA_1866
gtgcgaacaatgatgatggtgttaggataaattccagaagtatgcatcctcataataagcttactatgctccatgcagaacaagctgataaagaaacaagacatggcgaaggtgagaatcctttaaattttggacttcgagaagacacaatcattcgtaggtttgtgggatctgctgttgttgatgagcctaaagtggaaaatgcatgccaccatgggttagttgatccaactatcaatttgaaggaggctatgtctgatataaacaacatgtttgggaaaaccactgaacttcccaggatggtaaaaaaccaaaccaggaaaacgaatgcagtatcagagagaaaagcgctcctgtttctggtttctgcatattagctgatgatgacattagcaaggaccctgctgctaaagacaaatcaagcaattcctgtacatttggatctgagagtggtctatttgagcccactatcactacccgcgacgtcatgtcggagatcaatgatatgtttggaatgtcacttgacttctaaggcacttgcttagagggaatttaattactcaacaggtgcagaagatgcacagaaaatgttacaagatcacccctctggtgatccagggtgcagaaaccgggaatgataccatgcctgtgttgttctcgctgatatcataattttccaggatattttccacaaaatgagctccagatctttgtttagcaccaggcttatgagttttgtaccatatgaatgctggtataagttaaattgttccctcaggatttgaggtcacagaacattttgttctccccactgtattttgttcattagatctttggctagcattggtgatgctgcccattacagagactttctctttgttggaagtcactgccagtccattatcaaactctgtccccgctttgcttgtgtttttgctgcttgtactgaaggaattttacagaataaaaaatacagttcc

SEQ ID NO: 1867 - DNA, 692 bp, Triticum aestivum
  Clone ID: PAT_TA_1867
cccgaggacaaagacctgatcaaaggttcgacgccgctccccaaggtgcatgactacggcagcctcgttggcggccgcaagaagctgaaggacctcgacatcaaccgggacgccgtcgcgcaagacgttcgcttcctgtcgacgtataggctcccttcccggccggacgaggcccacaacgccaagctcggtaccagcctggggaggctgtgccttgtggtctccgaggcggccaggttcaagacgatcaacgccacggtggtggcggcgatggacgagcaaggaggcccgagccggatcaccgaacgagacacgaagctcatcgtcgtttggggcgtgacgtccaaggcgctgcttgattggaaaaaggatggagtatggaacccgaaagatagcgaggacgtagaagaagcgggcatccacggcgcacaagatgccgttagcgcgctcaaggttatccttttgcccattgggtacaaacgggaggctgaggaagattaagcagcttgagaaggttgagaaggctgagaaaaagaaggtgaatgccgagttagaaaagaagagccccaaaacacatagaattattgggcttaattattatgtactcacctagtagcagtataatgaatgtgcatgcatgcaccaataaataaacaaaggctagtgttaattgaccaatgtggaaaaaaaaa

SEQ ID NO: 1868 - DNA, 1217 bp, Triticum aestivum
  unsure (1)..(1217): unsure at all n locations
  Clone ID: PAT_TA_1868
gcaacaagcagagacggaaagcacagccgccgccgcccgccgattcctccgccttttccacccgcccccgcccgcccggtcctccggctctccccctgggcccctccctcccggcgacccgccccccccccgcgggccctcccccgcggctccccgccccgcccccccccgcccgccccccccgctcgccgccccggagccctcccccgggccgctcggccgggcgcacccgccctcccccggcggccgccggcgcggccggcgctcccctccccccgccgtcccccgcagcgccgtacgccgcgtcggccaccgatttcctcactctgtgccatggggtcaagtccactaaaagggaaggctggatcaatcacagcttcaagggttcggagtctattgctgatcacatgtatcggtatcggccctgctggcgttgatcgctgattgacctacctgtctgttaaatcgaccaaaggtgtttcaaaattgctatccttcacgacattgctgaagctattgttggcgacatcactccatctgacggcatacctaaagctataaaaagcgggcgtgaacaagcagctctaaatgaaatgtgtgaagttcttggtggtgggtcaacagctgaggaaattaaggggctgtgggaagaatacgaaaacaactcctctgttgaagccaatctcgtaaaggattttgataaagtggaaatgattcttcaagcgttagagtatgagaaggagcatggaaaagtgctagatgagttctttctctctactgctggcaagttccagacagagattggcaagagctgggctgctgaagtgaattcaaggagaacccaatggatgtggacagaactaggggtaacttgatgtttggtgctcgatatagcctctatgaaattttcatgatggggtggtgtggcgaatctcagactccagattcaagcccacttcgaggcaaacataaccaatttgcctcagctaccaggtgttggtaaggaataacggaatggcgtcgacagaaactcggggatctaaatttggttaagagctcagtgggctgaatatgcactgggactagtagtatgtagcagttttcatgtatgctgttggttaggaacatccaaacacgcgtttttgttgagtcgggaaataaaaaggctggggccgttctcgactgccaaaaaaaaaaaacaaaaaaaaaaaaaaaan

SEQ ID NO: 1869 - DNA, 1877 bp, Triticum aestivum
  Clone ID: PAT_TA_1869
ttctaaccatgcgcacgaggagaagaggaacagaaaacagtgggaaaaagaggccgggctcctcgaatctctcactaattttctccttgtctgcgtgcctacgccttgcctccttcggggttggtgagcgagcgagctcgggatcagttggggactacacacccagaggttgttgtccgagaattatttacgcccgcccacttcttccttccaccccttcttagcctcgcctcgcctcgtcctcccttcgctccgtctcctcggatctccgcctcaaatttgtctccccaatccccagttccaggttcttggaggaggggggaagccatgggcagcttcgccaagctggccaagaggtgcgtggagacggaggcgccggtcatggtgaagatacaagagctgcttcgaggggtcacggatgtgatgtcgcttgcgcagggaattgtttattggcaacctcctgaggcagccctgaacaaggtcaaggaaattgtatgggaaccagcaaccagtaaatatggtgctgatgatggccttcccgagcttcgagaagcacttctcgagaagcttcgcagagagaataagctaaccaagtcatcagttatggtgaccgctggtgcaaatcaggcttttgtaaacctggttctgaccctttgcgatgctggtgattcagttgtcatgtttgcaccatattatttcaattccttcatgtcattccagatgactggcgtcactgatatattagttggtgctagcaatcccaagactcttcatcctgatgttgattggttagagaaggtgctgaaagaaaataaccctatccctaaacttgttactgttgtcaatccgggaaacccctctggagcttttattcccaagcctatgcttcagagaatttcagacctgtgcaggaatgctggtgcatggctggtggttgacaatacctatgagtacttcatgtatgataaaatggagcactactgcctagaggatgatcatattgtcaaccttttctcgttctcaaaggcttatggaatgatggggtggcgtgtaggatacattgcatatccaagtgaagccgatggtttccacgcgcagctccttaaggtgcaagataacataccaatctgtgcttccatcatcgggcagcgcctggctctatactcattggaggccggcccagagtggatcagggaaagggtgaatgatctcgtgaaaaaccgcgagctgcttgtggaggcaatgtctccccttggtgaggatgctgtcaagggtggggagggtgccatctacctctgggctaagctaccagataactgttcagacgactttgaggttgtcaggtggctcgcgaccaagcacggcgtcgcagtgatccccgggagcgccagcggaggccccggatacatccgtgtttccttcggagggctgaaggaggaagacacgaggctcgccggcgagaggctaaggcggggattgcaagagctggtgaccgatgggatggtacagtaacaacagcccgccgtatgtaagacagtaagagtacatttctacattcagatcacacaggtccgattttttcgacgatacgattctgccgggattagttgattcagaggagcaaaagcaccatatatccaagtcttttgtatcttacagaatcaccatgctggaggtgcctgatgggaatggcaattggtgtactgagaattggggcaaaataaaaaaagccgcgcagcccccgtgtcgtaattctccgttcggtacttcctgccgtttaatttaccctttcccccagcaactgtacacaagtgaaatacgacaattataaggtgcttttacacgccttccctgagaaaaaaaaaaaaaaaaactcg

SEQ ID NO: 1870 - DNA, 1636 bp, Triticum aestivum
  Clone ID: PAT_TA_1870
gacagcacccaaaccctactacatgccagacaatctgtttggtgatttgatcgatgtgaagagttctcggcgcagcaggcaagacaagcagatcgacaaatgtgcctagtccaaagggtggtggtcaacctatgatcggtggaaagaaataggtctcgcgagttcaagttagctactctgtgtcgtttggtttgtactattgctgtatatgtgttcgggtcatattggtgatattgtttaattttagttgttggtcggcaaaaaaaaaaaaaaaaaacgcttctggttctcctttaccagttgaaacgccaaggagagatgagatacccagagaggatccaacaccacagccatctgcacctccagttgttgcgccaaatgagacccccgttgaagaggatgaagaggatgagtttgctcagctagcaaaaagaaagaacaaatctgtgataagtagcgacgaggcatcatcaagtgttggtgatcatgcccttatccctattgacgatgcaacttctgaagcctcatcttctgttgcgagcaatgccctagttcctgttgagtcagcttctgtcagtggtactcggacaaaagagcaggatatgatcgaccttctaagccttaccttgtacagccctcctgaagcatctacagattcttcaactcagagccaaaatggcagtcagcagaccgccgtgtcaaatgggtcacatttaccgccgaactatcagcctgcagcatcgaatggacagcattacccttccaaccaccaggcatatccaataaatcaggggtacactccatacaacaattacgttgcgccctgggcccaaagtgaacagagtgcacagagtggagcatatccagttcagcctccacaatatacatcaacctatccagcaccgccgcaatatacatcaacctatccggcaccgccttgggccatgcctacaagtgccaactctgtaaatccttttcagcctgccacataccaaacgccgaatcctcctgttgcttctgttgcctcaacaccttacccagctccttcaacaccttatgcttctccactgatgcaacatgtgccatctccaaccccaaatcccagtcctatgcaacagcaaagctcttttgtttctcatgcaaacaacgcccttgccattgtcccagatgctcgaatgaatggaaaccaaagaccaaaagaagcaccagcgaccgcagccaaaccctactacatgccagacaacctgtttggtgatttgatcgatgtgaagagtttcggcgcagcaggcaagacaagcagatcggcaaatgtgcctggtccaaagggtggtggtcaacctatgatcggtggaaagaaataggtctcgcgggttcaagttagctactcggtgtcatttggtttgtacatttgctgtatatgtgttcaggtcatattggtgatattgtttaattttagttgtcggtcggcacatgtgtattcttaagagatggtagagcataattgctgtaaatgatttgcttcaaccatttgtctctggtagaccttccgcacaaaggaggaaaaggtaaggggagaggggggcccctgccttccctcgctgatttgtttcatcattcaaacgtgtgaaaaaaaaaa

SEQ ID NO: 1871 - DNA, 1431 bp, Triticum aestivum
  Clone ID: PAT_TA_1871
gctcgcaaccaaacaggccctaaaaccctagacaaaagctcagcggcgcagcacagcccagccgccgcgcaccacgctcttcccccctccctcctccgaccaccttctcccgaaacgcacggagatgctctccgctgccttcgctgttcaccccgccgccgtcgcgtcgcagcggcattctgtccgccagcgccagcagttctgcgctccaatcggcacggcgacgccaaggcggcggttgccagtggcgatgctttcggtcaccaacgccgtcgccacgcagagccgcgagagcgcccccgcgtcgcctcgcaagctctctttcccgatactggtgaatagttgcaccgggaaaatggggaagtctgttgctgaagcagctgtgtctgctggtcttcagttagttccggtgtcattcagtgcaatagaggttcctgatggaaagctcaacatctgtgacacagatattcatattcataatccatctgaaagtgaacgtattctccgttcaattgctaaggactacccagatatgatagttgttgactacactgtgcctgatgctgttaatgccaatgctgaactttactgcaaacttggcttgccatttgtaatgggcacaactggtggaaataggcaactgttgaacaaaactgtgcaggatgcgaatgtttatgctgtgatatccccacaaatggggaagcaggttgttgctttccttgctgccatggaaatcatggcagagaaatccctggtgcatttgcaggttacaaactagaggtaatggagtctcatcaagcgacaaaattggacgtttctggcactgccaaagctgtaatctcttgctttcagaagttgggtgtctcattcgacttaaacgaggtaaacttggttagggaccccgaagagcagcttgccattgttggtgtcccggaagaacatcttggagggcatgcatttcacaattaccatctcacttcgcctgatgaaacagtgtcatttgagttccagcacaatgtgtgtggccgttcaatatacgcagagggaactgttgatgccgccatgtttctccacacaaagatacgatctggggcgggcaagaaattatatgatatgatcgatgtcctgagagaaggcaacatgagatgagcaggggcatttgtagggttaggaggagagcttatgcagcaaaattaggtcactgtccagatgcagcatctttgcgttgtaattggatcttagatttgttttactagttatattaactcttatttacttctcggcgaaaaaaggagtcatttggacgaaataaggatgttaacttggacttgggcctctgtttgaggccagagctaactgttgttgtggcaggaatgatggaaggcaaatgcagtacgaataatttgtggaagttgaaatagtttgttaatt

SEQ ID NO: 1872 - DNA, 982 bp, Triticum aestivum
  Clone ID: PAT_TA_1872
cccccgcccctgtgtctgcgcgcggtggacccggttcctgatgctctacccatccaccgggtgccgggcggcatccgtgcttccgctccccgtacccgtgcgcggacgcctcccgcctccgagacttcccgttcctggccgatggcagctttcccgtccctgacctgggacctggcatgcgcaaggcaccatgaagagcatcaagtgagccacaattttcaggctgcaagcagagtctctgggatctcatgcatgatccccctcgcgaagcttaaggagcaatcctctggattcctcgtcaaagacagctgtgttttcggtatccagttcatcaaagttgtcgctgttaaaggtaacgatgtgtcagagaccctgtttgttcagaagattagcaacatctgcagtgacccccaagtctacacctggaacattgatgatttctttgtgttgaaaaacccgagcacctccccagagtttgagctctgtggacacaaatggttaatcactatctatccatctggttccgataagaatccgaactacctctccctgtacctgaacatgaaggactcactccataaagactctgcgatcctggcagatgttagcataaccatcaaagaccaggaaactggcaagcacaagaaattatcagcccggctccagctcaagaattgtgcccccacttggggatggggcaagttcatatctctggaagatttcaaggactcgtcacaaggttatctcgtgaagacaaagtgttgcattgaagctcagattgcagtcattggttcctcgaagacagagtagctggattatttgtcctccgcgtaatgccatgactcatgtgtgttctgtacttgcttgaactgcgattctgtatccgtacctttgtttgcttgcttgtttggttgtgctgaacctataagaagttttaagactaatggcatttacataaaaaaaaaaaaaaaaaaaaaaacta

SEQ ID NO: 1873 - DNA, 1144 bp, Triticum aestivum
  Clone ID: PAT_TA_1873
ggccgcgtcatccggggcaaggccacggcgcgcgcctccgccacgctcatctccgcggcgcgccgcctcctcgccaccgcgctcctcgacgacccggccaaccgcttcttcgcgctgctctcccagtcctgcgtcccgctcctcccgttccccgccctctaccgcaccctcctcaccgagtgggatgccgcgggggccggccgccaccgccgccaccgcagcttcatcgagatcctggacagcgagcccacgctgcacgcccgctactacgcgcgcggcgacaacgtgatgctcccggaggtgcccttcgaccgcttccgcgtcggctcccagttcttcgtgctcgccaggcggcacgccgtcatggtggtccgggaccggcggctctggaacaagttcaaggcgccgtgcctcgtcaaggagaaggactcgtgctacccggaggagcactacttcccgacgctgctcgacatgcaggaccccgacggctgcaccaagtacaccctcaccagggtcaactggaccgacgccgtcggcggccacccgcacacctaccagccggaggaggtctccggggacctcatcagggagctcaggaagtccaacgggacctactcccacatgttcgcgcgcaagttcgcgcccgagacccttgcgccgctcatggagatcgccgactccgtcatcctccgtgactaggcgccaagtgttcgtggacatgaacagaacaagggttggtgatgtgatgaagaagcataagctggtccatccatcccctttgtggtttcttcagggaggagcaaaccagcaccaaacctacttcgccttgttgttccgtcgctggccgtcgctcggcgaaggggatgctgctgcttgctcagactcagagagtgatgtggtgttggtggcgaagtgccccgactgcctctatcctatgtgagtattgttgtgtttcttggtgtttttcctttccactttgatcccgagcgagaggaagtcgtcggcacgcggtaggcgtgtcgctggtagttagcacggatgatcatcctatgtattcacaacggaggcaacctgtcgatacatgtagtgatggtttttgtagtatatgttatcccccatgttgtcattgtcaatatcacacacc

SEQ ID NO: 1874 - DNA, 1785 bp, Triticum aestivum
  Clone ID: PAT_TA_1874
tcggcacgaggatttgcggacagccttacaacccagatccagttccactactttttctgctggagaaggggagtgcgactgaggatgtgggtgaggtcgatggcgtcactgagctgactcaaatggaggatgtaggagcagcagcggcaacgcaacaaggtggccatgctttacgagctgaatctccaacgaggtctgctcaatcaacaggcagagtgaatccacaagcccccggttggcacaaaaaggctccggcttggaagtgcaccacctgaccgggtgccttgcccgtcgaggatgagcgcactagaaatttcaatccgcaagtatgcagagcaacctgataagagcgtcgttaaacctgagctgggacttagttttgattcgttgggcaaggcatatagtttggcagcgggaacaatctgggcatccccgttgccgtgctggactgcaaatccatgccccgctgggtgccatcccgcttgatgctgcgcagcaaggatctgctcgtgggtcatcctcctgcagtacgcgcgctggaactcaaagaaacgtcactgacgggcctcatagcgaaggcacttgcagaaacgatgaccagcctggttactagtcctcgcgaaggcggtcacgacctcgtcgctgcagagagggcatgccatcaaagggagcagccaatcggctgggacaggaagggaagatgaagacgatgcggacatggcagcgcggacgagattgaacaatggcgatggccaagcaggggcgagctcgggagagtaaatggagatgggtggtgtgctggctagagtgaatgagctggttgggctggtgagcatttatggagctggcgctccgacgccgtttgtgctgtgaatcttgcgtcatacggctcatgcaggctcagatgtggtgccgagccgtcgcacctccaacggggccgcgacgtgccgtctccataaatgcacctctgacacgcgagccagaaaagagatatacggcctgaaaatacatgaagacacacagatcttggcgcagaccatcggtgtggatttcgggagcagctgagcccgagctcagaatcgaattttcgctgatgaaaggtctacatgtgagcagcttttgtcacacccattcatcaagaggtatgaggaagcccggtgtcgacttggcggcatacgtcgggggtgttgtgaatccaacagaaaggttgaagcaaatagcagagatgcttgttgttcattattaccttctgttcaatggctctgatggatcctggcatcatatgaagacaccgtacatggaagaatcatctttccgcttctcagggaatgtgtatgtcgggcaaagtgccatatttgatactttgtcaaccataagaaacaagtttaaaggtgatcagcctagtggggggatttttcatgttgttgagaagatacattgtggtgcagatggggaaagagagatcaccgttcgtgtgtctggatcattcattgtgggcaaccaatttctaatacttggtgaagggctgcaagctgaagggatgcccagcccagacgagctcgcaattgacattccaagcaatcgggcaggccagttccgggagcagttcatcatgcagccagggatttccatggaatgctactacataccaagacaagatctctccatcagctagtcccgacaagatttgtaatttgtaagacttcttgggctagtttagcttaaacttatctgctcacaaaaacaacactgaaaattagtattcgagaaattacaatcaatttc

SEQ ID NO: 1875 - DNA, 508 bp, Triticum aestivum
  Clone ID: PAT_TA_1875
atttccaacgacttcaacgcctcgcacctcgagcgaatctcagacctgtccaattctcacatccgaatacccgacggtcaattgcccaacatgcaccgcatcgctttctggagtctcttcggcctcggcgcccgattttggcaaatgggtatcgagatgcgccccttcttcaacaagtcctccctgtgggtgtaccccgtctacgcagccggtggtgctagtttcggatattggctccagggcgtcgacgacagacaaaccgacacactgaaggagcgaaagaacatcctccttgagaagcgagcgcgcaaggccgagaaggatgctcaggctgaggcttaagaagggaaatgacaacgggaatgggaatgcaaagacactgagaattacacaccttcgacttcgacaaacaagattgaagggtggagggaatattgtacatttgtgatattttgggaagtagagcgtcaaaatggatgtatgggttgattgagatagaactatcttt

SEQ ID NO: 1876 - DNA, 516 bp, Triticum aestivum
  Clone ID: PAT_TA_1876
cccacgcgtccgcccagcttgatagcagggggagaatgaagatgtcacagaggaagccgtgtcgaccactttgaaaagggcgctcagcaccttttctactctccaggcacacgatggatactggcctggggattatgggggtcctatgttccttatgcctggattgcttataatgctacatgttactggacccacgcgtccggttttatcaccagaacatcaaaaggagatccgtcgatatctctataatcatcagaatgaagatggaggttggggattacacattgagggtccaagcaccatgtttggctcagccttgacctatgtttccttgagattgcttggtgagggaccagatagtggagatggagctatggagaaaggtcgaaactggattttagaccatgggggagcaacttatataacatcatggggaaagttttggctcgcggtacttggtgtatttgattggtctggtaacaatccactgccaccggaaatatggatgttgccgta

SEQ ID NO: 1877 - DNA, 502 bp, Triticum aestivum
  unsure (1)..(502): unsure at all n locations
  Clone ID: PAT_TA_1877
atgtttgatggtgcacanacgctcctccctgcagatgagctatcaaaaaagtttgagcaagaaggcattttgctcgatcacccgattgtcgtcacatgtggatctggtgtaactgcctgcatacttgccctgggcctctatagaatcggtaagcatgacgttccagtttacgacggatcttggacagaatgggaagcgcagcccgataatgattacccaaaagttgcttcaactgccccttaaatcaaccattctgtagtgatgaatgcagctgttgcattctgcggcattcagcccagatcgtcagcacaatgatacttctctgtggcaagctttgcaccgaagtcgcccaaaaggttatagggaaaagagaagtatcttttgtactatggccaatggctataggccgataaagaggaaatcctgtgtcgacttaatttataatgatgttgtacttaacaaaatcttgacttgaaaacaagattatttgtctgaattgatt

SEQ ID NO: 1878 - DNA, 641 bp, Triticum aestivum
  Clone ID: PAT_TA_1878
tgcccagtaaagggcagatttgatggtgtaagccagaaccaaggaaaggagtaagaagtgggcatatacctggaactaaatgtgttccgttccctgagatgtctgatggtgcacaaacgctcctccctgcagatgagatatctaaaaagttcgagcaagcaggcatttcccttgctgacccgattgtcctcacatgtgcatctggtgtaactgcctgcatacttgccctggggctctatagaattgggaagcatgacgttccggtttacgacggatcttggacagaatgggaagcactgccggataatgattacccgatagttacttccgctggctcttaaatcggtcattctgaggtgatgaatgcagctgttacatcctgcggcattcagcgcgatgatattttcctttggcaagctgtgcatcaaagtcaatacaaaggttataggaaaaaaaaaactattgtactatggccaatgtctataggccaataatgaggaaatcctatgtcgaaagcgtcaattaagttcatattggtgttgtacttataacgttactgttgaagaaatattgacttgaaaacaagatcattcgtctgaactgaagaaatcatgccttgaaaacaacattacgtttaaaaa

SEQ ID NO: 1879 - DNA, 1538 bp, Triticum aestivum
  unsure (1)..(1538): unsure at all n locations
  Clone ID: PAT_TA_1879
ggccgcccgggaggcgaagtactcttgcgcccacagtcggctgcaactgccggctccgctttccaatccctgctcttgccctccgtttcttcatcccagctcttgcagcagaggcggccaatggcgcaggacgacccggttgtctctgcgcagtggctgcagcagcacctagggcagcccgatatcaagatactggatgcttcctggtacatgccacacgagagcagggacgcatggcaagaataccaggtggcccatattcctggcgcgctctacttcgacatcgatggaatttctgatcggacgactcatttgccacacatgctgccattggaagaggcattcgcagcagcggtttctgcacttggtatcaggtaaccatgataaagtcattgtttatgatgggaaggggttctacagcgcgcctcgtgtttggtggatgttcagaatccttggacatgataaagtttgggtcttagatggaggtttccctcagtggcaagcttctggattcaatattggaagcagctgccctgatgatgcagttctgaaatccaaagctgctaatattgctgttgaaacagcttataatggtgaattggcaaatgctgccacatttcagacagagtttcgacatcagctattgtggacactagaaaaggtcaaacacaatgtagctgctaaggctcaccaagtagttgatgcccgagtaaagggcagatttgatggtgtaatgccagaaccaagggaaggagttagaagtgggcatatacctggaactaaatgtgttccgttccctgagatgtctgatggtgcacaaacgctcctccctgcagatgagctatctaaaaagttcgagcaagcaggcatttcccttgatggcccgattgtcctcacatgtgcatctggtgtaactgcatgcatacttgccctggggctttatagaattgggaagcatgacgttccggtttacgacggatcttggacagaatgggaagcgctgccagataatgattacccaatagttacttccactggctcttaaatcgatcattctgaggtgatgaatgcagctgtcacatcctgtggcattcagcgcagattgtgagcgcaatgatatttctctgtggcaagctttgtaccaaagtcaatacaaaggttataggaaaaataaaatacagtaccattgatgttataggaaagtgtcaacattaagtttatattgatgttgtacttaacgctattattgaagaaatcgtgacttgaaaacaacaataagtttgtattttatatgcagtagtgcagccaaatgagttgtgcaccagcaagtgcggagtgattgatcaaaatttcaacctgtgcaaatttattttgtagcccaaggaaatcaaatcaaacatttaaaaaggtccgctctgtgaccatgaggatgaaaaaaaaaaaaaaaaaactcgagacctcggccgcgaccacgctaatcactagtgaattcgccttnggcaggnaacantcnccctttcgcccaagnctgggngntn

SEQ ID NO: 1880 - DNA, 758 bp, Triticum aestivum
  unsure (1)..(758): unsure at all n locations
  Clone ID: PAT_TA_1880
cgcgagcggcgcccttttttttttttttttgatcggaaaactctactttcgtcttgaaataacaaaacggataatcttgtacacattttccatctacgaactaatgaaaattatactaaatcatcgacaattattttgggatgaaggaagtatatctttgctgcatccactctagaatgtcgtacaaattcggtactatgttttccgtagagctaatgaaataattatatacaattaatctctggataagcgagcaattcaaaattaatgaccatgacctaaacttttcagctacaaatgctaattaaatggagacgaagacgaagacgaagccgctcgcttgatcaactatcagacggcgagagctcgaggatccggccggagagcgcggagacgagcgccgccttgaacccagggtccctcgtcagcgtcgcggccatctgctccgccaggttcttcctgtccgcggccgatcctgcctccgttgtcgattgctgcctcggctgttgctgggcgagcggcggcgctggcgatgcacggacggcggctgcgtcggcagacttcctgccgccagagccttgcatcttcggcggctgtgcgtggttgtgctcgccctcgtacgttgccaccaggacggtgttgtcctcggcgctgcgctgcgccttcttcttcacctggcacgacggcgcgaacgagcaccggaagtaggccctcgggcatgggttgtnccttggtcacttttgcccgtatttccgccc

SEQ ID NO: 1881 - DNA, 428 bp, Triticum aestivum
  unsure (1)..(428): unsure at all n locations
  Clone ID: PAT_TA_1881
cacgcccgtccgnngctgcaaccccctcggaattcccaacatcaccgccgagctcgatctagcacgaccggcggcgtggctggcgctggcgtggacggttcgccgccgccgtgccggcaatggccggcgacccctacgccttcttcgactgggacgtctcctacgtcaccgcggcgcccctcggcgtcaagcagcaggtgataggcatcaacggcaagttcccggggcccgtcgtcaacatcaccaccaactggaaccgtcgtcgtcaaacgtgctcaacgacctcgacgagccccttctaatcacatggaacgggatccagcaccggaagaactgctggcaggacggcgtgctgggcaccaactgccccattccgtccgggtggaactggacctacgagtttcaggtcaaggatcagatcggcagct

SEQ ID NO: 1882 - DNA, 478 bp, Triticum aestivum
  Clone ID: PAT_TA_1882
cggacgcgtgggcggacgcgtgggagaaaacaactctagtctcgtggccgctcgtgtagcagttgatgcggctgatgtgaagtcggcgatagctgagaggatatcagtgatactgcagaacataacatccctgatgacatctttcatcgtcggttttatcattgagtggagagtggcgatccttattctggctacattccctcttcttgtgcttgccaactttgctcagcaactttcaatgaagggctttgctggtgacacagcaaaagcacacgccaagagcagcatggttgctggtgaaggcgtgagcaacatccgcaccgtggcggccttcaacgctcaaaacaaggtcatgtctctcttcagccatgagctgcgcataccagaggagcagatcctgcgacgcagccagaccgcgggccttctgtacggcctctcgcagctctgcctctactgctcggaagcgctcattctctgg

SEQ ID NO: 1883 - DNA, 523 bp, Triticum aestivum
  unsure (1)..(523): unsure at all n locations
  Clone ID: PAT_TA_1883
tcgacccacgcgtctactgaaagccggaagaagagaaacccagctgcgtcactgcatgcgcgcggagtagtagcgtaggtgagcgcgcgcaggtgcaggcgaagctagcgacggcatggcggcgcacgtgctggtgttcccgtgcccggcgcagggccacatcaactgcatgctccacttcgccgcagggctcctcgacgccggcctccacgtcaccttccttcacaccgaccacaaccggcggaggctaggccttgccgccgtcaaggcggaggccgattcgccggggctccggttcctgtccgtcaccgacggcctcccggacgacaatccccgcacggcgtgtgacctcgtcgcgctcgtggagtccatgatgacgacgacgagggtcgcctaccgtgctctgctcgcgtccctgcgcgcgggcgcgccccgcgacgatggcttccctcccgtgacctgcgtcgtcgctgacgggatcctcccgttcgcgatcgacgtcgncgaggagctcggcgtcccg

SEQ ID NO: 1884 - DNA, 895 bp, Triticum aestivum
  Clone ID: PAT_TA_1884
gcagcagctgagagactttcacaagaaacaactgagaatctgttgtcagctgatcttctgcgcatgcgcggttgtggtgaaacctgcgtttggcaggctaccctggttgttagttttggtgtctggtgtatccgccgggtactggatctttcccttgtggaaagtagaccagagctttgggggaagtacacatacgttctgaaccgtcttcagggaatcattgaacccgccttttccaagccccggaaacctctcaccgggtgcgcatgccttcagataacaggcccgggtgcgaggcccatttctggcaccttcaccacttctgctgcgatcttggagacgatcaaggacgtggaagtagctatctgtggacgcaagggtcgaagcggaacagcagcaggagacgtagcttttcctaaagggaaggagaacctggcttcagttctcaagcggtacaagcgtaggctgtcgagcaagccatctgctgggcaatagcgacatgtttttacttgttttgtagggtttctggcgccgtcctaggggcaggtcgccctttcctgcttctcaagtcctagtggttttttcgttgcacagcgtttctaagggggggcctgggagctccttgacctttttgggcccttcggtttttgcatgtgatgcttgacaggggccaaggatgatgcagggtaaaccatgttttgccgcctgagcgcggtgtgttagagaaagtgcgatctgctgaatcagtggtgtcaagtccaccactgcagctcaaccggactgttttttgggccttctgtgcctgtgccccatgtgactttgtagagaggttacaagtgatgttaatgtgatgttcgtttgacatgtgcatggttaatgtgatgcttcaaaaaaa

SEQ ID NO: 1885 - DNA, 722 bp, Triticum aestivum
  Clone ID: PAT_TA_1885
aacactctttttattgttgactgatatatcatcgtacctgacgatctatcttttgcgcgactccaagatccacctcctatccactgtcgcatagcgcttcactcaaccactacaatggccttcaagcaagacgcacctcctccggcttacggacctcctccaggtgctcctcaacctacatatggcggttaccagcaagatccttaccagcagggcggcgcgcctcctcctcaaggatactaccagcaagctcctcctcagatgggctaccctcaacaacaacaaggaccctttcccgccggccaaggcccttatcctcctcagcagggcccctacggtcagcctccccctcagggctactatccccacgatgatcaaagaggaaacggtggtggcggcggcggtctcatgaccggtcttctcgctggtcttgcatgctgttgttgtttggactgcctcttctaagcgtcaatctgacttattactcgatatcaccgccgccgatgaacggatctacaaaatacgaaatgttggaggattcgactcctctccagcaggcaagggaatgacctgcgacgagcgtgtggcgcatcaggcaatgggaatggtttcctgttttcatggcgttggggtttctttaatttcacacatcttattctacgttaggtgtttctttgtttgttcgatacctagaatacgataatcacataatgttccgtcct

SEQ ID NO: 1886 - DNA, 2178 bp, Triticum aestivum
  unsure (1)..(2178): unsure at all n locations
  Clone ID: PAT_TA_1886
agcatccaaatcccaagccaacacacacctcaccctcctcctcctcctccctcctcctcaccacacacgctacacgccacctcctcctccccggctcccacgccgccccgatccccttccccgagagcagccccccacgtgacccggatccgaccgcgctgccgccccccggcttcatcccccgtccacggccgcccaattcgcgggaattcctcgattcccggaggcccggccgtcgaggcagatccatggagcggagccggccgcagcgtcgaggctagcacatcgggaggagctctcggtttcgtagctcacagagaattctcttgccgtttggctccgcaaacgtggctgcggcgatggcgatggcgaatccttccgcggccggtgccccaggaatctgtagcgacgcactattccgggagctatggcatgcttgtgccggtccgctgatcacagtacccagaccaggcgcgcctggcggggcctccccccgccgccgcctccctccgcttgaggcgtctacaaaccagcagcttgaccagtacctgccgatgttcaacctaccatccaaaatcctatgcagcgtggtcaacgtagagctccggacggaagctgattcagatgaagcccacgctcccgcccacgcgtccgcagaggctaatcaaggtgagctcacaagcttgggtcctgagccacaagaactcgaaaaaggcaccatacattccttttgcaagacactgacagcttcggatacgagtacccatggtggtttctctgttcttaggagacatgctgaggagtgtcttcctccgctggacatgtctcagaatccaccatgtcaagaactggtagccaaagatctccatggaactgactggcattttcgtcacatatttcggggacaacctaggcgacatctacttacaactggctggagtgtctttgttagctcaaaaagattggttgctggtgatgcatttatctttctgagaggtgaaaatggtgagttgcgggttggagtaaggaggcatatgagacaagtaaataacatgccatcatctgtgatatcaagccacagcatgcatcttggagtccttgcgacagcctcccatgcaatctccactgggaccctcttttctgttttctataaacccagaacaagtcaatctgagtttgtggtgagtgttaacaagtaccttgaagcgaagaagcagaacatttccgttggaatgagatttaagatgaaatttgaaggcgatgaagctcttgaaagaaggttcagtggaacaataattggtattgggagcacgccgatggtgtcaacatctctatgggcagattctgattggaaatctctgaaggtccaatgggatgagccttcatccattcttcgtccagatagagtttcaccatgggaattggagccactggatgcagctaatccacaaccccctcaacctccactgagaaataagcgaccccgacttccagcttcatcttctgtggttccagaacttgctccaaaatttggactatggaagtccccagctgaaccaagccaaaccctctcattttcggagccacaacaggctcgagggttatttactaattcacgcttctcatcatcatcaaacgttgcattcaatcagttctactggccagcaagagaatcaagagaagactcttatgctggaagtactaacaaagtcactgttgaaagaaagcttgaaccaactgctggtggctgcagattatttggaattgagataagatctgctgtggaagaaacacaacccgtgctaactgtctcaggtgatggttatgaccaaacggctgcatctgtggacgtggactctggcgagctctcgcagccatccaatatcaacaactctggtgcccaagcagcaagcagtgagcgtgctcttcttgagacccaaagtcgccaagttagaagctgcacaaaggtaattatgacaggaatggcagttggaagagcagtggacttgacaaagctatatgggcaagattctgattggaaatctctgaangtccaatgggatgagccttcatccattcttccgtccagatagatttcaccatgggaattggagcactgggatgcaactnatccanaaccccnnaactcnatgngaaataagctccccgacttcaact

SEQ ID NO: 1887 - DNA, 704 bp, Triticum aestivum
  unsure (1)..(704): unsure at all n locations
  Clone ID: PAT_TA_1887
gcggggactctcatcatcatcatcatcatcatctttcttccttcttctcaccttttcaacaaaacaaacaaccctcttcacaaccgccaaaatggtcaaggttcttgcagttctctacgacggtggccagcacgccaaggatcaacccctccttctcggaacaactgagaacgagctcggcatccgcaagtggctcgaggaccaaggtcacactcttgtcaccacttccgacaaggaccgtgagggttccaaattcgacgaggagctcgaggatgctgagatcatcatcaccactcccttccaccctggttacctgaccgctgagcgtctggccaaggccaagaagctcaagctcgctgttaccgctggtatcggctccgaccacgtcgacctcaacgctgccaacaagaccaacggcggtatcaccgttgctgaggtcactggctccaacgtcgtctctgttgctgagcacgttctcatgaccatcctcgtcctcatccgcaacttcgtccctgcccacgagcagatcgaggctgctgagtgggacgtcgcccatgctgctaagcaggagttcgaccttgagggcaaggttgtcggcactgtcgctgtcggccgcatcggtgagcgtgtgctccgccgactcaagcctttcgactgcaaggagctcctctacttcgactaccagnnnctttcccccgaggctg

SEQ ID NO: 1888 - DNA, 714 bp, Triticum aestivum
  Clone ID: PAT_TA_1888
gacggcaaaacattcttctcttgccccagcacagcttgtttattcggaatcccttgaacagctgcgactgcaaacaccatgagagtaagaagttctttgagtccagtttatgttgatgatgcgtctgtctgtgtagtcccttgaacagctgcaacggcgcacaccatgagaaaggagatcatcatccggatgcagccgggctcggacaaataccacaagagagctctgaaggtggccgctgccatcagcggagtggtgtcgatcacggtggccggcagggacagggatctgctggtggtcatcggcgacggcgtggacgagagccatctgactaagaaactgaagaaggaggtcggggaggccgagatagtgcagctgcggacgctacacgaaggcacctcggcgtcagggtatctgccgggcacgtccagggacgtcggcggcggacagtcccggtcgccgtaccaccagcatcccatgaacactcccggccaggtcgcatacccggtctacgcgccgtcgccggcggccaatcccggcgctgcacggtggtcgggaacccagaggcatgcggaggcgggatactatcctagcgcgtccagcccgtccttctaccacgcgtccgcccgcggacgggcacggcgggtacgggggcagcagctatgcaagcgcggtggcgcgcaaccacccggcgaactactccccgatgatcga

SEQ ID NO: 1889 - DNA, 933 bp, Triticum aestivum
  unsure (1)..(933): unsure at all n locations
  Clone ID: PAT_TA_1889
gcggggatcttcatcttgtaaagtacatgcatattgcagtgagattcaaaggtctgcttattgaagctgcaatacactctttctctcatcaaacatcaacttccacagatcctggcttttataacctgctccatcaccatggctcctacactactatggatcggtctcgggaatatggggaggggcatgagcaaaaacatcgttgaaaagggtaacctagaaggacctctactcttgtacaaccgctctgtgaagaggacgactgacttcagtgctacacttcccaacggcaagactgaagttattgagtcccttgccgatggcgtagcgagagcagatatcatcttctcttgtatcgccaatgacgaagctgtccaagagacttataaaacaatgctcgagagcgatgtcaaaggcaagttctttatcgagagttcaactatccacccagagacaaccgaagccattgccaaagatgtcatcgccaagggtgccgagttcgttgccgcacctgtgtttggtgcccctgagatggccgaagctggccaacttgtcggtgtactcgccgggcctgctgctagtgtcacaaaggcaaaggcgtggttccagggcgtcacctctaagggcgtcattgacctttccgataagccgtacagcaaggctttgactctcaaagtcctcggaaacactttcatcttgaacatggccgagcagctcgccgaggctcatgttgcggcggaaaagactggactaggcactgaagccatccaccaattcgtccagtcggttttcggagggccatatgccgcttatagcgagcgcatgttgagtggagattactacnagcatgatgagccactttttgcagtcgagctagcaagaaaagatgctcgacatgctatgagtntggccaagtctgctggtgttcaactt

SEQ ID NO: 1890 - DNA, 1006 bp, Triticum aestivum
  Clone ID: PAT_TA_1890
cgtccgctccgacccgtaaaccgctcgctcgcccccccgccccgcgttctcttgccggcgatgacgccgccggcggcggcctcgccggggcggaagtctccggccgcggtcctcttcctctgcgtggtcactatctcattactcatgttcatactccttgcctcctacaccccccgcctccagccccacggtcgcagcccccaccgccgcctcaagctccaccccaagaactccgccgccgtcgcttcttcctacggggccggcgccgtccacgattccggaggaaaccgccacgcggcgcccttcgacccggccatcgccgagctggagcggcggctggaggacaaggagtgggagcgcgagcactaccgcatcctccatggcgacgccgagaaggacgaccacatgaaggagtgggaggagttcctcagggaggaagaggacttcatcaacgacgacgatcgcttcaacgtgtccgaccgcatccgcgcgctgttccccaagatcgacctcacccccaaggacggcttcgtctccctcgatgagctcatcaggtggaacctcgatcaggccaggtctgaccagctccatcgctccgccagggagatggagctctacgaccggacgcgtgggcgggatcgtctccttcactactttccgggcgctgcgccaacagtcccatggggatggcaactcactggggttcccgtggtggaaagaggagcacttcaatgcttcggacgtcaacggggatggtttcctcaataaaactgagtttcacgactttcttaatccaagtgattcggagaatcctaaaattatcaacttgctctgcagacaagaattaaggcagagagataaagatggtgatggaaagttaaactttgaagaatactttcatgggctacatgaccatatacatggttatgatgacgagaatgcagctatttctcatattgggaacatgacaattgcaaaggagcggtttgccaagcttgacaaagat

SEQ ID NO: 1891 - DNA, 1355 bp, Triticum aestivum
  unsure (1)..(1355): unsure at all n locations
  Clone ID: PAT_TA_1891
tgcagctcccttcctcctcggccgcagccattgtcttctggctcatatctcccctccccctcccctcctcgtccgcctcagacgccattaaaccccacctcgcctacgactgccggcggcgagccccgaccggagcagggatcgagcccgccgaaggggggaagacatggggacactcgggcgcgcgatctacacggtgggcaagtggatccgtggaacggggcaggccatggaccgcctcggatccaccatccagggcggcctccgcaccgaggagcaggtgtcaaggcatcgtacaggtcatgagcatatttgacaaggagcctaggatcaacaaagatgtttttgttgctcccaggtgcatctgtcattggctgatgttgaggttggtgcatggatcatcgatcagggtacgactccgttttgagaggtgaagtcaacagtattaggggtatggatcttcataaaatatacagaacaactcccttggtcatgttgcaaagactaatattagcgggaacgtccttcggacgatcattggatagcaatgttacagtaggtcatagtgctgttttacagttgatgcaccattcaaggatgaagcttttgttggtatgggtgccactttcgattgacggagtggttgttgaaaagcacagcatggttggcgctggatctcttgtcaagcagaatacaaggattccttctggggaggtctgggttggtaatcctgccaagttaccaaaggaagctgacagaggaggtgaccacattcatcgcccaatctgcagccaactacatcaacttaagctcatgttcacgccactgaagaattccaagagcttcgatgcagattgagctcgagaaagaagctgaggaagaaactttgctcacaaagatgaggagtacgactcgatgctcggagtggtccgtgagatcccgccgcagctcatcctccccgacaatatcctcccagacaaagcaccgaaagcagctgtcgctcactgagatcaagcccctcgtagggatgctttgattttgatatgttgtcgacttgggacatttgacttatgttttggtcttgttctctgttttttcatgcccaataagatttgggtcgagcgctgttgtaggatcgaccgcatacagtacctctctttcacattgcaatgaagaggagcccgggatcgcttttacaccttctgtatgaagtgcacattgttgaagcagtcctgttttgtactctagagtgcatcttaacctgttaattgtgatctgtttgtttttaaatacagcgattcaatcttcaaacaaaaaaaaaaaaaaatcccccgggggcccgncccttccccctt

SEQ ID NO: 1892 - DNA, 860 bp, Triticum aestivum
  Clone ID: PAT_TA_1892
tgctcgaccgaaacgccagtcttgctctccttcaagagggaggacatcaaatggcagtgtgccttcagggagttccatgccggcagtgagaagatcacattttacgggaggtgccagcgtgaacccagttcaaatgggcaataagatggttgagagggtagtgaacatgagaagactagctcctccgaaacatgatgatcaaagatccagcctcaatagtttgtctggaaaatcattaaattctccagatagctctggcttcggtcggtcattgtcaaagaagtcactggacatggcacttcggcacatggacatacggcgcagcattccaaacaatctacggcctcttatgacgagcattccagcatcatctgtgcatagcggccggtctggctccacaaggggcagaccgataagtgtctcggactcccctcttgcgactagcagcaacgccagctcggagccgagcgtcaacaacaacctgatgtgctttgacagcatcgacattgacgatgagctgtgcagcgatagagcaggacattatgcacgatgatttgcctctttgctagtacaaagttctgtctctgatgaattttcacgaccacaaaatgttaagagcgccagtgttgaagatcatctctgatgagctctattctcatatgtaggttctttgagtgtccaatgctcattcatttatgccatgtgggctgctccatgtccaatgctaatccatttatgttatcattgagaaggatccgtcttttatatgttctttcttcgaccagttcattatgctggtagcgaagcatgccccactggctgaactgtgttgccttttgttgtatcgcaatgtaaattcg

SEQ ID NO: 1893 - DNA, 1314 bp, Triticum aestivum
  unsure (1)..(1314): unsure at all n locations
  Clone ID: PAT_TA_1893
acgcaactccatcggtctcgcctcgcacatcttcctcaccgcctcctacccccgccccgccccgcccacctcgccggaaccctacctcctaccccttcgcgcccctgcccgatccgccgatcgtcagacttggcaagcgcaatggactccgactccgagatgcccgtcgccagcgacgaggagatggtggacgacgaggactactactactacagcgacgagggtgagggcgatgacggggacgccagcggcggcggcgcctccggcgacgaggatgtatcggccggagactacgagggccgggaggccgaggggagcgacgaggccgtctccacgcgcgagcagagatacattgttttatccgaaaaggatatatctgaacgccaagaggaagatataagcgaggtatctgcattactgttgattccaagggaagaagcatctgtccttcttcaccactataaatgggacatcagcaaggtgaatgatgaatggttttctgatgaagacaaagtccgtggtattgttggcttacttatgaatggaactgattttcataactcgaggaagctaacttgtggaatatgttttgaagggtactcttcagatatgatgagttctgcgggctgcgctcatttttattgccatgaatgttgggaaggttatatcagcgctgctgtaagtcagggtccgggatgtttgtcattgcgatgccctgatccatcgtgcagtgctattgttcttcaaggcatgataaataagttaggcaaacacgaagataaagagaagtacgcacgatttgccttgcgtgcatatgtggaaagtcgcaagaagacgaaatggtgtccagctcctgactgtacatgtgcagtggaatttgttagtgatgtaaactatgatgtctcatgtaactgcacattccgattttgctggaattgcacagaagaagctcacagaccagtgaactgtgagactgtttctaagtggattctgaagaacagcgctgaatctgaaaatatgaactggatactggctaattctaagccctgtccaaaatgccaacgaccgatagagaagaaccagggatgcatgcatatgacttgcacacctccttgcaaatttgagttttgctgggtatgtctgggttcatgggtaagaacatgggtgagaggactggtggcttttatgcttgcaatcgctatgaaccggcaaagaaagaaggagtttatgatgaggctgaagcgaggagggaaaggctaaacancactcgagagattatcactactatgaacgcgggnanctaacaaacacgag

SEQ ID NO: 1894 - DNA, 1203 bp, Triticum aestivum
  Clone ID: PAT_TA_1894
cctccggggcggacccgttcccgccgccccccggcctccagctggcgcgctggcccccgctccctcgccctcccagctcccggggcaccgcccaggaccccccggcccccgccgcgcgccgctcattgcgcgaggcgcgccagcggtgcgccggccgcggcgcgggcgccggctgcgacgctcctgcccccgcgcgggcggcccgaccggcgccggcgccccccccccccgggcgcccgcctagtacgggcgaggttgagctgctgggcgcgtgcccgcggcagaagggcgcaggtgcgggcgagctgttccccaaaggcgggcgccagctcgaccattccattgacgaggggccggggcgcgaggcccgagccaatgcgcgcgagggcgcgccgtcaggccccgcggtgggccgccgggcctggcggggccgcagctacgaggccacctacgaggggtacatgttcccgctgcgcgtcacggacgagctggagcgctggcccgagatgtccggccgcggcaggacctgggtcaccgtgcaggacgccatggaccgctgcccgcacctctggatgcgcgaggcgctccagcggttcgccgaccgcgtcgccgacgccgccttgtaggcgattctcctcgaccgtccttctcgccgcgcgtgcctgtaagctctcccccgccctacggtttgtgccggctgggctgggctggactcggccgcgcggcgctctggcgctagcggtcaggtcacacgaaccagagcgctctactgtgactcctgtcgtggcacggcctgtacattgtttgcctgggattcgaccgggcatgtaaatctcacccacttcgcctaatgttttgagatcataatatagggaaatgctagccaagaaccataactcggtttattggagtcagaatgacccattttttctctccatcaaactgacttgagccaaatacattcaaattttcgtcgtcgtcgtggctttgatcttctaagtcattgcatcgatgttctcaccaagtgttgagggttgtgagtgttgtgtgttatgagcattgggtgggcagtgtatgtgttcgtggtgcttcgtgctctatgagtagccctcttttgggttgtttgtatcggttttcgcccaatttccgtaaattaactgggcaattctcttcttcttaattaatcgatgagacaattctttt

SEQ ID NO: 1895 - DNA, 791 bp, Triticum aestivum
  unsure (1)..(791): unsure at all n locations
  Clone ID: PAT_TA_1895
nccaggtctcgagttttttttttttttttttatcatggccaaaaacacatgacccaaccactcagaggtaattctgacgttttacatgttactgtactagctccgtaactaaatataagatgtttttgcagttcaatttaaacttcaaaaacgtcttatagtacttagttacagaggtagtagttcctgaagatctctaccaaaacccctcaaaagaaaaaatctctctaccaaactagattacatctgatatgagctagatcagcatggttgtacttttaccattcttctatctcatcttcttcttcttcttcactgttattcccttcagcatcaagcatatcaatggagtttgggccacctgcgacatcgtggcgcgaggggttatttctggtcatatcattgtgggggcttatccatctctcgaaaggcctgaagtcagtgaccacgtcggagaagttgcgagaaccagacgtgctagacggatcaaatctttctttaagaatcagaccctttgtggatcgaaatgtacgctcaatttgccagaccttcgggctgcgtattgtatgccatcttgagggtgagggatgtgcatttccaaaaagaactcctcgtgctgcaacagaagcagcaataagttgtgacatgttttctgactcatttgattcatttacagtccaacgagccgatgcgattggactgccagcaagaaggcagtctgcctcactcaaatatgacatcacaacccatgcatcatcaacagcatcatcgtcaatgaaatcaacaacatt

SEQ ID NO: 1896 - DNA, 724 bp, Triticum aestivum
  unsure (1)..(724): unsure at all n locations
  Clone ID: PAT_TA_1896
tgacgcggcaagcccacggacacaccaacaattcgcccctctcggtgctcccacccctactactcgccggtgatctgatggcggcggccggcgcaccgccgccgcgcgccttctccgcggagctgaggagggctccgctctccgcgggcctcgcgccgccgcggcaggggaccagggctcgcgcgtcgtggcccctcccccgccaggaaactgtttgtagtcgtggccggttgatatcgaccatgtctagttcaaggtcattggcgtgctctccttgtcgttgcgctcaggtggctttggctgacgcagagattgcttaccagcctgaggctgagaagcatgctggagttctggcctatgaactggttcaagggaaccttgtacaatggaactcttttatggacaaatcaatacctgatccaccaacagctgtactccttcatggcatccttgggagcgggaaaaactgggggtcgtttgcaaagaggttagctcaggaatttccaatgtggcagtttcttttggttgatttgcgttgccacggtgactcggcatcaattaagaaaagaggaccacacactgttgcttccactgcttttgacgttctaaagctgatagggcaactcaagctgtctcctccaagtgttgggntggtcacagctttggtggaaaagtggctttnagtaagggaaatnaagctgnaaaccaatngcccntccngtag

SEQ ID NO: 1897 - DNA, 509 bp, Triticum aestivum
  unsure (1)..(509): unsure at all n locations
  Clone ID: PAT_TA_1897
gctagattagtttctcactgcactttgtttcaattttttttagtttggatcgagtgtgaatgtaaggaagatattgttgtcacatagtaataatccatctatgagttactaggaggtatctcatgcatgttgattgtgcttcaaggtacagtagtttgtagcatacaaaattagtggttcgccatgttgacccaactgtgtgaattcatacaaccaaaactaggaacaaagtttgattcgtaggtagctgaagaagcggcatcatgcagagctgcaccagtgtgctgcttcgctagatgggggtcatcgaagaggacaaggagaatgcgatctcaggggccttcttgagggttattggagagagtttgatcaccttctttccgagcccnaattggcaatttnggtggcnccnccnggttggcnatttcgttnaaaaccaactggcanaaactgtgtcnccaccgtggccaccagngtaggcaagctcaataantcttgtaanggcctgg

SEQ ID NO: 1898 - DNA, 1243 bp, Triticum aestivum
  unsure (1)..(1243): unsure at all n locations
  Clone ID: PAT_TA_1898
aagttcactggattgtctttgaatgttgtttcgcttatgcattatttattgtactttgacatggattagcttggctttgcatctaggctctctcttgctttcccaacaacttcagaagagatttctggatcaggtatcaggtctagagccaatggagagaagcaacatcatgatgctgctatatcttagtggtctttctttcacaatggtgatctgcttcttatctgttctaggtgtcactgtcatagcttacttggcataaccttccttcttttgatggttgtcaacacacatttaagtcacacatacaccatacaagatgcagagcctttggtatatgcagccgcactcccttgccgccacctgctacttcaagtccgccgacggccatgttggaaactagggcttctccatagcccgcctcaatctccacctcgccctccttgctggtatacatgcatctcattcagtctgttcgttgtacaacttgtagtgtccacaattcagaagtaggagttcacagaaaactgcttctctgaatcactcatcgttcagtttcgttctcttgtggttaattcaaagatccattgccaaaagtgtgaatatgagtgcaaatatgcttgtcttttgaactctggaactgttgcctatacatgcctattattgctgaatatgatggaaatgtggatgtttaagacggagtatttatcaggaagaagcttataggacttccaataagcaagaagtttcatataattttcctggatgcaataggatgaactttcattttattggaaggtgctatagtataaatttcaaagacccacttcagttgttgctgttatggttttataaatcttaaacagaacagtctttgggtgaatacatctattgtattttggtgaataaaatgcgtcagacagatccccactcttcagcagatcttatagaacattcaaattgtctattagctagattagtttctcactgcactttgtttcattttttttagtttggatcgagtgtgaatgtaaggaagatattgttgtcacatagtaataatccatctatgagttactaggaggtagctcatgcatgttgattgtgcttcaaggtacagtagtttgtagcatacaaaatttgtggtttgataggttgtgcatcctaggaacaaagtttgattcgtngtagctgagaagcgacgacttttgtctttgcattgcaggttccaaattccaaaaaa

SEQ ID NO: 1899 - DNA, 1133 bp, Triticum aestivum
  unsure (1)..(1133): unsure at all n locations
  Clone ID: PAT_TA_1899
cggacgcgtgggatcatgccaactcagctgatggggatgttagttggcttaaggcagatagatttggtggcaggccagatgaggggtcttttcagtttttacacaaaagaagccgcaatattggttccaaaagcaggaggcttttgatggataacgaggaggccctggaactgaagctttcctgggaagaggcacaggagttgttgcgtcctgctccatctgcaaaaccaacaattgtgatgattgaggactatgaatttgaagaatatgatgaacctcctgtctttgcaaagagatcaattttcaccagtcgttctacaggggaacaagaccaatggattcagtgtgatgattgctcaaaatggcgtcgtgtgcctcttaatgtcattattgcctccaagtggagatgtgctgacaacacatgggatccaaaaagctgttcctgctctgcacctgaagaattagcccacaaggagttacaaagtattctccagcagtacgaagagatcaggaggcggaagagcaactatttcttgaagcagagcatccccgaaatggatgcgtcgagccttgacgccttggccactgccgcagtctttggggaggtcgggaaccaaggcgctgcttcggttgcaacgaccaccaagcacccccggcaccggcccggctgcacttgcatagtgtgcatccagccgcccagcggcaaggggccgaagcacaacccggcgtgcacttgcaacgtgtgcatgaccgtcaggcgccgtttcaagacgctcatgatgaggaagaagcaacggcagtcggagcgagaggaggccgaggcgagcaagaggatctcttgggtgggcagggacgagcccgagggaaagcaacctgtcgcggtccccccaaaccgtgggccaccatccgaaaccggccacgtgttcatgttccacaggggccgccgccaagcgcacgggncccctactccccacccctccccccccgctagcccgccaangggggggcaaccccgcattgcgaggccccaccccccggggctgacccccggtcagccctcctcaacgggtcgctgtccccccccggtggcggggctcactcccggaccaacaatccgtcttgacccanncctt

SEQ ID NO: 1900 - DNA, 1326 bp, Triticum aestivum
  Clone ID: PAT_TA_1900
gtggcgcggggcactccgccgccgccggctcccacgtagccgaagaagctaagggagcactcagcgggcgccgccgcgcccacgccggacgctccttgacccacaaggctggcggtcaccgcttcgagtcccgctgcctccgtgcccgtgccggctgctccgccacgccttccagtccccgcctcaagccgctcccgctcttcggcccggggcgcgagcccacggcgtccccaagctcacccctcgcgctgacgcgccggcgctgcccgcggtcggcgtcgtgggccgccggcatgtctccgctgtccctgggggacggccgggcttccgggcggagttggatgcgcccggaggagtggccaggggtgtcgtcatgcgccttcgcctccgggtagtcgacaaccagctccggcacctcgaccgcgaagttctccgccgacgccgtcgccagccagctcctcctcctccaggccatgatactccgaatctgacatcctcctcttcgtcatctccccgggtggatcagtcaagtgcgacaatggctatcttcgatgtaatgcagctggtgagggcagatgtatccactattggagatgggcatagctggatccacagcttctataatccttggtggtggcgcaaagggcaaacgattcgccatgcccaacaccaggattatgatgcatcagcccgtgggaggcgcgagtggccaggccttggatgtggaggtccaagccaaggaaattctggctagcaagaggaatgtcatccggctgatctcaggctttacggggcgtacactggagcaggtagagaaagacatcgatagggaccgatacatgggtcctcttgaggctgttgattacggtatcatcgatggtgtgatcgacgaagacagcattatcccacttgagccggttccggagagggtgaagcctaagtacaactacgaggaaatgtacaaggaccctcagaagttccttacgccgcatgtcccagacgatgagatatactaagctagcctgtcagtcacatgtatttcaaacagcaggcagtcgctgtagctttcgtcaaacaaagatgatgtgagtcgcggcagtagacttgatctgccgctacattgcctcacggcccgtatttggcacagcaagcaactgctggagcttttgtgaaagcaaggacgtaacactttttttagcaaaaaagccttgtcgggtcgtcgcgtactattttacacagctagcaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1901 - DNA, 1306 bp, Triticum aestivum
  Clone ID: PAT_TA_1901
cacgaggtccttgcctcgctccctccctccctcgtcccccgccccccccccccctcccccctccgccccccccgctggctcccccccgcccgcgcccgcgcccccccgcccccctcagacggcgcggcgattgtcctcacggcgagctatctaggtcacgaggaatccactcccgactgccgttaggctgcccggctggcttgctgccgccgacagccttggcgaatcgcggtcctgataggcgcccctcctcccggcgatggggggtcgcagtcggctctggccgacgaagcgccaccacgacgcctcttcgaaccctcgccccccgcctccgtattccggatacagtcacgtggataatcaatgccaagtcccattatgggaaagggaattttgcagtcttgttggtggcatttcgtggcagaggttctgcgagaacaagcactttgcctatatgtacaaggagatagagcagtgggatgactcgggagcttttgagaatttccagaacgcaaaatcaaggttctggtctcattaccatggccaaccttctgatataccttaccccaaccctgatctgtacattgatgaggtcgaccatcgttgcgaggtcgaccccgagttggtagctgacctggacaaggtgcgggtaccctttgaggcggacaacgagcccgccgtagctgccaataacaggtgtgcccagaaccagtcagggaactgggacatctatctagaaaagccgacccctgaggtgaacaagtgggaggcggacaactcggcatccaacgcaggttggggagcgagtcaggagcctctgagcagctggaacaaaatcagcaccggctggggcgaggccctggcggagcccggttggggcagctcaggcaacaaccattgcccagggaataactggagcagctcccatggagtatccagcaacaataacacatactaccaggatccaggcggcgcatatggcaggaaaaggaacagtggaggcgggtactcccagcagaggaacagcaagcagaggaaccaggctgagagccaccaccagaggggcagatggcaggatcacagggacagggggaggcatggcgagcggttcctgtttgacaataggccaaatgggcagcgagcagagcgcggcttctgagttggtggcggtgagtgtgcgagaaaccgtggaaaggttttggttgtatgataaatgatgcgcattttctagtgtcttttgtgcggagctgcagcttgtaatggttggatgttgcaacaacgctttacctgtaaggagatgtgtcag

SEQ ID NO: 1902 - DNA, 1250 bp, Triticum aestivum
  unsure (1)..(1250): unsure at all n locations
  Clone ID: PAT_TA_1902
gnaacagcgacagagnaccgtcttcttcctcttcgagttcttggagcttgcgaccgacaggacggggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgttaccgaactcgtgccgggtgaccatgtcctcccggtgttcactggcgagctctcaggggaccttcttcgaagtcatcaagccgcgcactgagctgcccatctcgtggagatgtacatgagaaaggtgctggaggtggagaagttcatcacacacagcgtgccgttctcggagatcaacaaggcgttcgacctcatggcgaagggcgagggcatccgctgcatcatccgcatggagaactaggccgcctaacgcgcttccgatcgctccgatgtaataagcgctggggtgcggtttctgaaccagatcatcgtctgtggtttcgccttccttggcaaagtagcggagtgttagttcaagtatatctgtaattacgtaccggacaagtggctgtactacgaacgagctctcttttggcagcaatatatgctgctgctgctactactaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagccatgggggccgccttcgaatgtgtccatgatgggtggggcgtgnctgtgctggtgggcgtnccgcacaaggaggcggtgttcaagacctacccaatgaacttcctcaacgagaggaccctcaaaggcacttcttcggcaactacaagccgcgcaccgacctcccggaagtcgtggagatgtacatgaggaaggagctggagctggagaagttcatcacgcatagcgtgcccttctcgcagatcaacacggcattcgacctcatgctcaagggggagggcctgcgctgcatcatgaggatggaccagtagatcgccacctcccatcattcatcaatgtgtctcgctgttttcagatttggtgcttgagaagc

SEQ ID NO: 1903 - DNA, 755 bp, Triticum aestivum
  Clone ID: PAT_TA_1903
ttttcggtcttggagctgttggccttgctgccatggaaggggccagaatgtccggcgcatcgaggatatcggtgtggacttgaaccctgcaaaacacgaacaagctaagaaatttggctgcaccgactttgtgaaccccaaggaccacaccaagccagtgcaagaggtgatcgtggagatgaccgacggcggagtcgaccgggcggtggagtgcactggcaacgccgacgccatgatctccgccttcgaatgcgtgcacgatgggtggggcgtggcggtgctggtgggcgtggcgcacaaggaggcggtgttcaagacccaccccatgaacttcctcaacgagaggacgctgaggggcaccttcttcggcaactacaagccgcgcaccgacctcccaggcgtcgtcgacatgtacatgaggaaggagctggagctggacaagttcatcacccacagcgtgcccttctcgcagatcaacacggccttcgacctcatgctcaagggggaaggcctgcgctgcgtcatcaggatggatgagtagagtagagcacctggctcttcttcatccctcgctgctattgcactacaacacacatgtattacctctttgcttaccttttttttaagccacgccccttaggactccggttcatgaaataaacagaagaaggttgctcgattaatttgcggaaacccaagtgaaaaccataaaaaaaaaaaaaacgatcggcccggaccaacatagttcgttcgcc

SEQ ID NO: 1904 - DNA, 616 bp, Triticum aestivum
  unsure (1)..(616): unsure at all n locations
  Clone ID: PAT_TA_1904
gcanagcataagcagcgacaaaaatccatctttgtgtctcttcttctggcgacagggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttcccaggatcttgggccatgaggctggaggcatcgttgagagcgtcggagagggcgtgactgagcttgtgcctggtgaccatgtcctcccggtgttcactggcgagtgcaaggactgtgcctcactgcaagtcagaggagagcaacctttgtgatcctcctcaggatcaacgtcgaccggggcgtgatgatcggcgatgggcagtctcgcttcaccatcggtgggaagccgatattccacttcgtcgggacctccaccttcagcgagtacaccgtcatccatgtcgggtgcctcgccaagatcaaccccgaggcgcccctcgacaaagtttgtgttctcagctgtggcatctcaactggtcttggtgcgact

SEQ ID NO: 1905 - DNA, 2401 bp, Triticum aestivum
  Clone ID: PAT_TA_1905
acggccgccgccgcttccctccgccttctcccggtgccagccaccccatcctcccgcactctccgcttctcgcccatcctccgccgcgcgccccgcgccctcttatccgtctccgccctcagcaagctctccgaggcgccccccgtccccatcccgcaggaggccacccagactttgcccggcgaggacgcgcttccccctaggcccggggtctacggcgtcttcgaccccgccggggacctgcagtttctcgggatctcgcgcaacgtcagggccagcgtcgaggggcaccgcaaaaaggtgcccgctgacctctgcgcctccgtcaagggtgcaataccagacgaggaaacaccagataaaagtgtcctgactaatgcctggaaatcatggatggaagaatacatagcgtccgctggcaaggcgccaccagggaatgttgccgggaaccacacctggatcggtcctccacagagacctgcagatttgcgtttgactcctggtcgccatgttcagctaactgtgccacttgaacagttgattgatcggttagtgaaggaaaataaagtggttgccttcatcaaaggatcaagaagtgctccccagtgtgggttctcgcaaagagtggtggggatcctggaggcacatggagtggattttgcatccgtagatattcttgatgaggagcacaaccatgggttgagagagaccctcaagacctacagcaactggccaaccttcccacaggtttttgttggaggagaacttgtgggcggatgtgatattatttcatccatggctgaaaagggggagcttgctgccctatttcagaaatagcactctcaccttggagtttaagtaatgttttgttttatcaggtgcaaaatgtgaccttatctcttgtactgttgcaataatgcttaacttattgtaaggcacaaagttcttggctcagaaacacgttgattcaatttagatgaggcagcgttgtactgtgaaacttgctggttgtttttgagagagggcttagcaaaggtggctgtgtgtatttttgtggtcgtttcacatcttgcacatgaatacattgtagctacatgagaaagtatgtgatgcatgaagtgagaaaatcgttggattgagttctaaggttcaactcagaaaagtaaaattgtgattgaaacttggaatatttttctaggttcactttacaactagctgataactgagatgtttcctgttgcctcagcacttcctttatttttcttctttcaaattagaagaaaacaaagctatttgcacttcaagtgtcagttgatttattgtcactgtgctcaagagtgttcaccatgttaccgaagtgtttggatctgtacaatgaggagtcaagagagtagtcttgtagatttctggaacagattgattttctgttaatgaactttactattggaataagtaacagaagagaagcagcaagctttcctgtaccatatgttggctggttatctgtataactctaccagaagcaaatatagcaggtaagctcaacacttgatgcagattatctgaatattaaagagaagatatgtcaatcaatctttactagtttaggaaagtttctactggaggcaagatatcttccaagcatgatttattcaattaattccagaatcaggaagccatcataaatttgctgggccttatggttaggagttggacggatcgatgccatccacaatcaccaggaaacttctgatgtcatgttgcagcagactggccagtcatgctgtgaggcgcaaaaccaaaagctgaatcgacggttggcaattttcggtctctgagagctgtttgctggcagtttggaaaggggccaagatggctggggcatcaaggatcatcggtgtggacttgaaccctgcaaaatacgaacaagccaagaagtttggctgcaccgactttgtaaacccaaaggaccacaccaagccagtgcaagaggtgcttgtcgagatgacaaacggtggagtcgacagagccgtggagtgcacgggtcacgtcgacaccatgatatccgcctttgaatgcgttcacgatgggtggggcgtggcggtgctggtgggcgttccgcacaaggaggcggtgttcaagacccacccgatgaacttcctcaatgagaggaccctgaagggcaccttcttcggcaactacaaaccgcgcaccgacctcccggaagtcgtggagatgtacatgaggaaggagctggacgtggagaagttcatcacccacagcgtgcccttctcgcagatcaacacggcgttcgacctcatgctcaagggagagggacttcgctgcgtcatgaggatggacgagtaaatcaagcttcttcgtcacaccctcgctgctttaa

SEQ ID NO: 1906 - DNA, 1286 bp, Triticum aestivum
  unsure (1)..(1286): unsure at all n locations
  Clone ID: PAT_TA_1906
ctgnatttccggnacgaccgggggagttgatggcgaccgccgggaaggtgatcaagtgcaaagcggcagtggcatgggaggccgggaagccgctgtcgatcgaggaggtggaggtggcgccgccgcaggccatggaggggcaaactccggttttcccaaggatcttgggccatgaggctggaggcattgttgagagcgtcggagagggcgttactgagcttgtgccaggtgaccatgttctccctgtgttcactggcgagtgcaagtgtgcccactgtaagtcaaaggagagcaacctttgtgacctcctcaggatcaacgtggatcgtggcgtgatgatcggcgatggggagtctcgcttcaccatcggtgggaaacctatattccacttcgtcgggacctccaccttcagtgagtacaccgtgatccatgtcgggtgcctcgcaaagatcaaccccgaggcgccccttgacaaagtttgtgttctcagctgtggcatctcaactggacttggtgctactctcaatgtcgcaaaaccgaaaaagggtgacgacccaattgacgtttttgttctacgccatgtttttgcaggctgaagagaattatgtgctacaaccaagacaattaccgtgtgcttctgtctcacatgatcgcgccatggaaggggccaagatggccggggcatcgaggattatcggtgtggacttgaaccctgcgaaacacgaacaagctaagaaatttggctgcaccgactttgtgaaccccaaggaccacaccaagccagtgcaagaggtgatcgtggagatgaccgatggcggagtcgaccgggcggtggagtgcacgggcaacgccgacgccatgatctccgccttcgaatgcgtgcacgatgggtggggggtggcggtgctggtgggcgtggcgcacaaggaggcggtgttcaagacccaccccatgaacttcctcaacgagaggacgctgaggggcaccttcttcggcaactacaagccgcgcacgggcctccccggcgtggtggacatgtacatgaggaaggagctggagctggacaagttcatcacccacagcgtgcccttctcgcagatcaacacggccttcgacctcatgctcaagggggaaggcctgcgctgcgtcatcaggatggaggagtagaggtagagcgcctggctcttcacccctcgctgctatcgtacaacacacatgtatcacctctttgctactccctctgtaaagaaatatatttctttattacagatgaggtactttttttt

SEQ ID NO: 1907 - DNA, 2099 bp, Triticum aestivum
  unsure (1)..(2099): unsure at all n locations
  Clone ID: PAT_TA_1907
gcacgcgtccggttgatcctgtgaagtgagagatcagttctcgatttcgattccggttccgctcanagaggtccccaggcgagcgaggtccgcgcgtccgcccacgcgtccgcgattgcgtccggtgaagtgagagatcagttctcgatttcgattccgggctcagagaatttcccaggcgagcgagatggcgacggccgggaaggtgatcaagtgcaaagccgcggtggcatgggaggcggggaagccgctgtccatggaggaggtggaggtggcgccgccgcaggccatggaggtgcgcgtcaagatcctcttcacctccctctgccacaccgacgtctacttctgggaggccaaggggcagacccccatgttccctcggatcttcggtcatgaagctggaggcatagtggagagtgttggagagggtgtgactgagcttgcccctggtgaccatgtccttcctgtgttcactggggagtgtaaggaatgcccacattgcaagtctgcggagagcaacatgtgtgatctgctcaggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggccccccttgacaaagtctgcgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatcaaggatcattggtgttgacttgaacgccagcagatttgaagaagctagaaaatttggctgcacggaatttgtgaacccgaaagatcacaccaagccagttcaacaggtgctcgctgagatgacaaatggtggagttgaccgcagtgttgagtgcacgggcaacgtcaatgctatgatacaagcatttgaatgtgttcatgatggctggggtgttgctgtgctggtgggtgtgccgcacaaggacgccgaattcaagacccacccgatgaacttcctgaacgagaggactctcaagggcaccttcttcggaaacttcaagccgcgcactgacctgcccaatgtcgtggagatgtacatgagaaaggagctggaggtggagaagttcatcacacacagcgtgccgttctcggagatcaacaaggcgttcgacctcatggcgaagggcgagggcatccgctgcatcatccgcatggagaactaggccgcctaacgcgcttccgatcgctccgatgtaataagcgttggggtgcggtttctgaaccagatcatcgtctgtggtttcgccttccttggcaaagtagcggagtgttagttcaagtatatctgtaattacgtaccggacaagtggctgtactacgaacgagctctcttttggcagcaatatatgctgctgctgctactactatggccatgagtttcagttgaatgagtctgttcttagcctactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccgccttcgaatgtgtccataatgggtggggcgtgccggtgctggtgggcgtcccgcacaaggaggcggtgttcaagacaagcccgatgaacttgctcaacgagaggaccctgaagggcacctttttcggcaactacaagccgcggaccgacctcccggaagtcgtggagatgtacatgaggaaggagctggacgtggagaagttcatcacccacagcgtgcccttctcgcagatcaacacggcgttcgacctcatgctcaagggggagggcctgcgttgcgtcatgaggatggacgagtagatggtctcttattcatcgtgtgtctctttgttttagtgttcacggtttggtctttggtttcattgcgtctgtcggcagctttcagttagcatgtaaattactattaataagtgtggcacaatagcgtgc

SEQ ID NO: 1908 - DNA, 1736 bp, Triticum aestivum
  Clone ID: PAT_TA_1908
gaacgccccaccccacaaagaccgccccccccgccacctcctgtgaagagagcgatccttgctctcgtttccggtttccggcggacaaatgagacgtgagagatcagttctcgatttcgaccccgggtccaggagaattccccagcgcgggcgcgcgagaagggggaccgccgggaagctgagcaagtgcaaagccgcggtggcgtcggagccggggagcgccggtgtccatcggcaggagccggcctggtgccgccgcgccgcgcagagctatgggggtgcagggcaagaggctcctgctctcacttcccctctgccaacgccgatgtctacttctggggggatggcggaaggggcaggaccgcgatgttccctgtggacccttccggtccatggtaccttgggaggtataagtggtagacgttgttcggatgagcggtcagtaaaatgtaggatcggccccgtaggaatggcaccagtggtcctccgatcggtgttcgaactggaggcatctgtaaagggagggccccacatttgccatgtcgtgcggggcagaggccacatgtggtgattcctgctcatacggatctaacatccggactgagctgtccatgatccgggggtatggcaagtcacgattctccgttattgaccgggtaagccgaatttgccatttcgttagggaccttccaccttcagtgagtatactgtcatgcatgattggtatgtgttgccgagttcaaccctgaggcttcccttgacaaagtctgttttcttagctgtggatatttccactggtcttggtcgcatccataaatggtgcaaaaccaccattgggatcggacactagcaatatttgggcctaagaggagtttggctttgccgcggcaaaagatccaaaggcaagccggtgcataaaggaaggagctggcttttagggtttcaaacgggagcggatttgaagacgctagaaaagttgtctccacgggaaaagtgaaccataaagatcagacaaaagccatttcttaaatgtgctcagctggagggctggtgtgttggcgggtgcggcgcgcgaagggagccgaagtaaagacacagccgatgatcaaacaccaacgcggagggtaccttctagggcctcgtcttccgatccgtccggcccctgcactcacgaacccaaagtcgcggaccgacacgcgcgaaagtcactggcagaggaacatgagaaacgaacagggcgtgccagactctcagaacaacaacagggtggcgctctcggcgaaagcaaaagggcgttcgaaccttatggcgaaagggcgtaagggcatccactgcgttatccgcatggacagctaggccgcctcacgagtctgcttgatggatccggaacttaagtaggcgtttggcgggcggcttccgaacccagctattcggcatgggattactgccttccccttgaccaggtaccggattgtctgctcaatgttaataagtaattaggtaccggttgctggggcagatcaacgagctcgcggttgggccttactttatgcaacgtaccgtagcttcagttcaaggtatatctgtaattacgtaccggacaagtggctgtactacgaacgagctctcttttggcagcaatatatgctgctgctactactactatggccatgagtttcagttgaataagtgttctcagcctgaaaaaaaaatgtccaaaaaaaaaaaaaaaaaaa

SEQ ID NO: 1909 - DNA, 1032 bp, Triticum aestivum
  Clone ID: PAT_TA_1909
attcgtccaccgatcgatcgagtcacccaccatggccgtcatgactctctgtttcttttcttttttgacgggcgttctgataggggtgaccatggctcttaaaggagaggcgttcaggtttgccggcgacgtcgcagccatcttgccggcgccagtgaagaagaccgtggtggcactggcgcgaagcagccccgcccgtgccgccgccgatgccctggtaggtctcttcctgggcatggtctgcgtgatgttcacggccacgttcttcaacgtcgtcgcatcccttgcctgcgatggggactgctccctggccggcatcctctctgagatctcggactactccgagacgctctccctgcttctcttagcgccggcgtctgcgctcttcttcctgcgcgctgccggctacagcagtgaggtcaaggaggatttcaatgagcagccttcttcttctctccttgaaagcctcaagtcgccggcacgcttggcggttgcgactgcagggcttttctttgggatcatctcttggattcttcggatgtgtggatctccacagatttctgacattccaggcgttgcggctcttttcttcctgcacctatttatcgtcctcttctacatcagtgctgcacgggcactgtggaggatgaaccgcaggccagcaattggcatggtggcagcgtagcgcagcatcacttactctactcaggtgcgcagaggcagggtttcgatccggctgcagcaagaagatgatggagggcactggttatactactagtgcaggactgcttctgtttccagctagtagctagtacctacctatatgttgctgttaaaaataataagagatggacatgtcgtgtgatgagtagttacctatctgctagtagtataactagtaccagtaagcttgattcgatgctgggtgagagctgccactatggtactttggttatttaccttaccgttggctgtgggcacatattatttgacgtacgctctgatgaaggttttctattctatgtgtaccat

SEQ ID NO: 1910 - DNA, 707 bp, Triticum aestivum
  unsure (1)..(707): unsure at all n locations
  Clone ID: PAT_TA_1910
tatctcccgatcaattggtttccatggtgctgtgagctcgctgtgattcagcaatggctccgcgctggatctctcatgaccagacaagactggccgaccgcactgtcactccgacagccacatcttggtggtaatcagtggagtaccgccactgtccatcaaaatctttgacctcccgcatccaccgccagttccgtctctctgcaagcaaatcacaggcgccattgctcagcttctgaggagcggagcggagccgagatggagcccatccctctgctgacgccgtacaagatgggccagttcgacctgtcgcaccgggtcgtgctggcgcccatgacgcggcagcgcgcctacggcggcgtgccgcagccgcacgccgccctctactactcccagcgcgccacccccggcggcctcctcatctccgaggccacgcgcgtcgcgccggcgaggcgggacgaggagccgacgtcgttcagggacatgccggggatctgggcgccggagcaggtcgaggcgtggaggcccgtggtggacgccgtgcacgccgagggcgccgtcttcttctgccagctctggcacgccgcggccggcaacggcgacgatgccagggaaaaggcaacaggtgagcccccaagatgaagctacgattggccgccgccaaggaacttaacntcccccnaggaaggttggcnccccaaggacnc

SEQ ID NO: 1911 - DNA, 1691 bp, Triticum aestivum
  Clone ID: PAT_TA_1911
gctcgctcgctcacgcacacacgcccgcccgcccgcgcgcattaaactccgagatgcccatcccgtcccgggcaccagtgcttgcagctgcaggagcgagctagctaggtggtagctgctgccgagatttggccgcggcaatggggatctgctgcagcagggaaggaggggggagggagccacgagagagcgaggggtggttcccgtggtatcgttcaccgggagtttccgaaaggctctgggcggcggtgaggcggaggaggggacggcagtgtggagggcgctggaaggggtggctcgggagaactcggtgatccggcttcccaggatgctgagccgacggtggccggcggcgtcctcggcgggcacggaccccccggccgcgtcctcgctcggctggcccggcgctccctgcccatgcagcgccccgcctccctggcgccgagatctgaggacgtgattcatagtagtttcatacgccgtgttcacgcattcagggtcttcagattggacattaattccgttggcatgtacgcttgttgggtttcggctgtcctcggggaccagctggacaatggaggcgtcccaaggcgtctacggggagctgaggcagcactccgggatcgactgcctttgcagtggcaccactgctgtcaccgtcgttaggcagggtgatcacttgatcattgccaatttaggcgattcgcgcgctgttctttgcacgcgggacagcaagggccgcccggtttcggtgcaaatcaccaccgacttgaagccagatcttcctggtgaggctgagaggatcctgatctgcaaggggagaattttcgccatggacgatgagcccgacgtgcctaggctgtggttgccggaccaggacgcgccaggcctcgccatggcgagggctttcggagacttctgcctcaagaccatgggctcatctgcacacccgaagtgtactacaggaagctctctgaaaaggatgacttcttggtgctcgccactgatgggatatgggacgtgctgtccaacaaggaggtggtcaagatcgtctcgtcggtctccgaccgctcaaaggcggcaaagcagctcgtggaccgggcggttcgtgcgtggcgccggaagttcccgacgtcgatggtcgatgattgcgcggccgtctgcctcttcctgaagccagcagccatttcatctgaagaaggcagcacgaccaagccgcctcagacacccgtgctgtcgttcaccggaagtttccgcaaggctctgggcggcggtgaggcggaggaggggacggcggtgtggagggcgctggagggggtggctcgggtgaactcggtgatccggcttcccaggatgctgagccggcggtggcggtcggcgtccatggatgagaacaacgaccaagaatcatccaaggctgattgactgatcgattcatgctcatgcattgccaaacttaaaaaaggataatattttagaacttgattgatagtactcctagtttcatacgccgtgttcacgcattcagggtgttgagagtggacattaattcggttggcatgtacgcttgctgggtttggtgtgtgttgtggtaccaaaggacaagagaacccaaagtttgtaatggattcagcttttttatatctcaaaacaatgaattggcgccagtttttcctttcaaaaaaaaaaaa

SEQ ID NO: 1912 - DNA, 1586 bp, Triticum aestivum
  unsure (1)..(1586): unsure at all n locations
  Clone ID: PAT_TA_1912
gctgtggtttgcacgattcatcaacctagcattgacatatttgaagcatttgatgagctattcctgatgaagcgaggtggagaagagatctatgctggtccattgggccatcattctgcagacttaatcaattactacgagggcattcatggagtcagcaaaattaaagatggctacaatccggcaacatggatgttggaagtgacaacgatcggtcaagaacagatgctagccattgatttcagtgacatatacaagaaatctgaactctaccagagaaacaaggcattgataaaggaactaagccaacccgcgccgggttcaactgatctgtatttccctacccagtactcacagtcttcgagcacacaatgcatagcttgcctttggaagcagaacctgtcatactggaggaaccctccttacaatgccgttaggttccttttcactactgtgattgctctcctcttcggcaccatcttctgggaccttggtggcaaaatgagccagtcacaagacttgttcaacgccatggggtcaatgtatgctgcagtgctgttcatcggtattatgaactgtacttcggttcaaccagtggtggctgtggagaggacagtcttttaccgtgaaagagcagccggcatgtactcagcattcccgtacgcatttggccaggttgtcattgaactcccatacacactcgctcaggctaccgtatacggagtcatagtttactcgatgattgggtttgagtggacagctcctaaattcttctggtacctcttcttcatgtacttcacgctgctctacttcacattctacggcatgatggctgttggcctgacacccaactaccacatcgcctcaatcgtctcgtcagcattctacgccatctggaatctcttctcaggattcatcatcccccgaccaaaagttccaatctggtggagatggtattgctgggtatgccccgtagcgtggacactgtacgggctggttgtctcacagtttggcgatgtcacaacgccaatggaggacggcactcccgtgaaagactttatagagggctacttcgacttcaagcacagctggttaggttatgttgctacggtggtcgtggcgtttgcggtgctgtttgccttcttgttcggttttgccatcatgaagctcaacttccagaagaggtagatgatgacgatatgaggcatgttctagaaagaaatgcattagttgcccgcaaatatgaatcgatgtgtacatatcatttgaccacatggaatgtttaggttcattagttatcttgtactagtacatcatagaggtctatcttttggaaacattttgcaccacccgaatgctttttggaaaaaccggatatcagtatctcgaccctaacaagcctctccccccgccgcccccgccctcgccctcctccttaccccatttcgccagctggctgcagccacacaacacaacccccacccgccgcatgagggagtgcatctccgatccacatcggaccaggcctggcaatccaggatcggngaacagcgtgctgggagctctatngcctcgcagcatggcat

SEQ ID NO: 1913 - DNA, 793 bp, Triticum aestivum
  Clone ID: PAT_TA_1913
ccgatcgagccaagaagtttgcagtgcgtgagggagtgagagaatggcgggtggcaaagccgctctcctggtggccctgctcttcctgagcctggccttggagacccagcaggcggacagcggcgggtacgaccccgccccgacgccgctcaccacgtcccacaggaagcggcgtccgtctccgccgcgccctcgccccccgcccacctacacctcccacgccaacgccgcccccgtacactccgtcccctcctgagcccactccgcccccatacattccgtcccctcctgaacccacgccacccccatacgccccggccccgatgccatctcccttcctcgagcacggcgcggaagccgactccgctggcgtacaggccgccgccgacgccgccgactatgaggagccgccatcgacgccgccggcctacaagcccaatgtctagggctgtgactgcgagtccctgccaacgcatgcagggccattattctcattggagattaagtaatatgtagtctgaataataatgcaggttgcttggttacccgctgctgatttgtgttcgtccagagttagcgtgctatcatgcccgtgggtctttgtcgaaaaaatcatgcatgtgggttttgctaccgttgtggtgttactgtaaaacgtagcattgtctactgaatctgtcgtgtgtcctccgctgtttaacttcaacacgagcatgagttctttcgctgatgagatgtgatatgtttgcatgtcaaaacagtaaatactatggcaaccaagcttgttctgccc

SEQ ID NO: 1914 - DNA, 890 bp, Triticum aestivum
  Clone ID: PAT_TA_1914
gattaggtgacactatagaagcccggccgggccgagaccacaccgatcgagccaagaactttgcagtgcgtgaggcggtgagggagtgcgagaatggcgggtggcaaagccgctctgctggtggccctgctgctcctgagcctggccttggagacccagcaggcggacagcggcggctacgaccccgccccgacgccgctcaccacctcccacagcaacaggaagcctcccaggccgcgtccgcatccgccgcgccctcgccctcgccctcgcccccgcccacctacacctcccacgccaacgccgccgccgtacactccgtcccctcctgagcctgaacctacgccgcccccgtacactccgtcccctcctgagcctgaacccactccgtcccctcctgagcctgagcctgagcccacgccaacgccgccgccgtgcactccgtcccctccgtcccctcctgagcccacgccacccccatacgccccggccccgatgccatctcccttcctcgaccacggcgcggaagccgactccgctggcgtacaggctgccgccgacgcggccgactacgaggagccgccatcgacgcctgcctacaagcccaatgtctagggctgtagctatgagtccctgccaacgcatgcagggccattctcatcggagatctaagtaatatgtagtctgaataataatgcagattgcttggttacccgtggatattgctacgtactgttgtgttactgtaaaaccattatctatatataatatggaaatggaaatgggaaactgcatgtgttgtggtcttactgtaaaaccattgtctactgaatctatcgtgtgtcctccgctgttcaacttcaaaacgagcatgagttctttcgctgagg

SEQ ID NO: 1915 - DNA, 755 bp, Triticum aestivum
  Clone ID: PAT_TA_1915
acccgtcactaatcgagctccatatcacgtcagtaaaccgagcaaccactcactcacaggttgtcacggcaaccatcaagatcgaagcatgggatccgtgacggcgtcgacgacggcaaagcccatcctccgtgtggccgccatctccggctccctccgcagcaactcttggcacgtcggcctcatccgtgcggccgaggagatgtgcgaggagtccatcccggggctgcgcatcgaccatatcgacatctctggactgcccatggccaacccagacttggagacggacggcggcgacggcttccaggggcacgcacaaatgctgggccgacaaggcagcggcgatcgtatgcgcgggggcgactttggtgggggcagggcgtcactccacctgcgcgagatcgggatatatctggacctgcacttcatcaataagccggagctccacatcagggcgtatgaggacccgcccaagttggacggcgaggggaacctgatcgacgccaaagccagagagcggctcaagaaggtgctcctctcgctgcaggccttcgcgctcaggctgcaacgcagggagaattgactgaagatcgaatgaatttggcaccagagctagctaaataatctgcatttctgctcagatgatcacttttagtttgggctatggcccttggtttcgttagtcttagcaattttacttcgtatccgtgtaattgtattttgtacttccgtgaaaataaagacgttgctgctac

SEQ ID NO: 1916 - DNA, 643 bp, Triticum aestivum
  unsure (1)..(643): unsure at all n locations
  Clone ID: PAT_TA_1916
tcggattccgggtcggccccctanggtttctagaatattgcggtatttatagagcaaagaggcggtccggggggcaccaagtgggcacaacccaccaaggcgcgcatgggcctcctagcgcaccctggtgggttgtgctcccctcggaggaccccgcgacgcgtcatcgtgacccattgggtgtcttctgctccaaacaaatcgcggtacagtttcgtggcaattggactccatctggtattgattttcttcgatgtaaaaaacatggaaaaatcaacaaccgtcacttggcactatgtcaataggttagtaccaaaaaatgatataaaatggctataaatgattgtaaaacattcaaggttgataatataacaacatggaacaataaaagattatagatacgttggagacgtatcagcatctccaagcttaactcctactcgtcctcgagtaggtaagtgataaaaacagaattttttatgtggaatgctgcgtaacatgtcatattatatttgttttctttatagcatggacatttggacttttacttgttcaaagcaatagtctagttttgagatgataatttagatactcaagtatatcaacaagcaaccatgtctttcanaatatcaatgctaaaata

SEQ ID NO: 1917 - DNA, 503 bp, Triticum aestivum
  Clone ID: PAT_TA_1917
cgcacgacagacagacagcacgaggaaggcgagccaaccacccaccaccgccgcgaggctagcaccacgggcgagctcggccgattccgtttgcgattccgtctgcgctattgaggtttgtttgggggaaggggaggcggttcggaggtggagcttagggagagagagaccggagatggcggcttccgcgaggcagggggagagggcgaccagcttcgccatggcctgcagcctgctcagccgctacgtccgccagaacggcgccgccgccgccgagctcggcctcggaatcaacaagggtgaggccgaggctcacatggcggcggacacgaagagcactttgcccggggcggagggcgaggaggccggcaggaagaaggagaccatggagctcttcccgcagagcgccggcctgcatgacgccgccgcccctgatgctaccagggaggaagacaagagccagctgaccatcttctatggtgggaaggtgctcgtgttcaacg

SEQ ID NO: 1918 - DNA, 574 bp, Triticum aestivum
  Clone ID: PAT_TA_1918
aattgctagaaaggcgtcacttcaccgattccttgagaagagaaaggatcgtctccatgcaaaggcaccatatcaagctcctccttctgatgcaacaccagtcaagaaggagtttgagaaccagccatggcttggactagggccgaatgccgccctgaagccaaaccaataagacggcatgacaggagccttatgcccttaccagaaatatatctgaaatgtgctttgtccttagaagtatcaagtcatgaatattttatcccatatcatgttctagcgttttgtttaggttatggttctatgttattcgcctccatagttccgatgtaaagagaagtagcaaatgatgatgaccggtgcccgaagcccgagagaagttttggcatgttaacacatggtgatattgagttggccatgctaaggaaaaaagttagtgcaaagaaacatatctgtatcctatatgtaaactctgatcattccgtattgtcattgagttttatccttgatttgtaaaagcaagtgattgtaatggattcatattatgtttgtattcccatggctctatgtttacatg

SEQ ID NO: 1919 - DNA, 1479 bp, Triticum aestivum
  unsure (1)..(1479): unsure at all n locations
  Clone ID: PAT_TA_1919
gcgacctccccctccgttcatccgctcccccccgcgctcccacgcgtacgcactcggtcccatcccgcaccgcacgacagacagacagcacgaggaaggcgagccaaccacccaccaccgccgcgagactagcaccacgagcgagctcggccgattccgattccgtctgcgctattaaggtttgtttggaggaaggggaggagccgcgcgcttggaactgaggataggagaccggggatggtggggtccgggaggcaggtgcggaggtggagctgacggcgaccgagaccggggagggcggctccagcgaggtagggggagacggcaaccagctccgccgtggcctgcagcctgctcagccgctacgtccgccagaacggcgccgccgcggccgagctcggcctcggaatcaacaagcggtgaggccgaggctcacatggcggcggacacaaagagccctttgcccggggcggagggcgaggtgggccggcaggaagaaggagaccatggagctcttcccgcagacagcgccggcctgcacggacgccaccgccgctagctctaccaggtcaaggaagacaagaggccacctgtccaatgatttccaatggtgggaaggctacggccgtgttcaagttaatttcccagccgagaccgcaaaggccgtgatgcactgggctggcaagggcagccctgtcggtcagaacgtctctgcgaccacaactgctgcagacaccggcctaggtccagacgtccgtgttgttcccggtcaagtaggtctgcctagtggtccctgttcaggctcatagcgactacacgggccgattgcctctgatcctgccaattgcaagaaaggcgttacttcacaaatcaccttgagaagagaatggttcgtctgcatgcaaaggcatcatatcaaagttcccgaactgacgcaacaccagtcaaggagcagattgagaaccagccatcgcttcggtactggggcccgaatgcagccccatgaagctaaaacccaataaggcagcatgacatgagcattatgtccttataaggtaatatgtgcaattttgtttgttgtccttactagtatatacaattcatagttactatatcacagaagtagctattgcttttggccgtgggccaaagttcgagagtaattctgccatgttaacacatggtgatattgagttggccaagcaaaagaaaaggtttaggaaaaacaaacaaagctttatgatgataagaaaattgcggtattgtcatggactatgataaggaattaatatttggtgcaaagaaacatagctgtatcctatatgtgaactctgatcattccgtattgtcattgagttttatccttgatttgtaaaagcaagtgattgtaatggattcatattatgtttgtattcccgtggctcaatgtttaaaaaaagggggggcccggtacccaattcgccctatagtgngtcgtat

SEQ ID NO: 1920 - DNA, 1305 bp, Triticum aestivum
  Clone ID: PAT_TA_1920
gcacgagggtcgcacccggcactgcggcctgggccgcacccccccggcgcagcgcgccgcgtcaagaacacacagcggcgacgaagcacggtctgcgggagagcgagagcaacagcagcggcgaggctccagccatggcggtgagcaacaacatcacggcgtgcgtgacgctgatggcgctcatctgcgcggtccccgtcatcgcctcgggggtgtggttcgcgtcggcgcagggggaggagtgcgcgcggctggcgcgctggcccgtggccatcctgggcggcctcatcctgctggcggcgctggcgggcttcgtcggcgcctactggaaccgccgccgcctcctcgccttctacctcttcgccatggcggcgctcatcgccctcctcatcgcgctcctcgtcttcgccttcgcggttacccgcggctccggcgcctacccggtgctcggccgcgagtacgacgagtaccgcctcgacggcttctccatgtggctgcgcgggtacgtctccgacgaccccgcccggtgggaggggatcaggtcctgcctcgccgtctctgacacctgcaagaagctcgcccgacaggccggctacgtcactgccgaccagttctaccagtcccgcctcacgccgctccagtcgggctgctgcaagcccctgtcggtgtgcgggttcgggtacgtgagcccgacggtgtggacgaacccggcgcggcccgcgtcggacccggactgcggcctgtggagcaacgacccggcgcagctgtgctacgagtgcgagtcgtgccgcgcgggcctcctggcggcgctgcggagccagtggcacaaggccaacatcgcgctcgtcgtcgccaccgtctcgctcgtcttcctctacctcatcggctgcagcgcctacaagaacgcgcacgccgaggccatctaccaccgctacaagtggtgattcccatttcccatcccatcccatcactgagaaccaactgccatcgccagtttgcccatgtaatagactagtatgtttgcttcatactgtactgtattattattattagcttggtaactggtagtaagctagtaggggaagatgggaacttcagattcatggtttgcccatgcatgtatgtggagaattttagcgagatgcatgcgctcttggtgttgatgtgaatgttgtttgtaataaaaaaaaaagatgttcttcagatttatggttaagaattttattatgttttgctcatctggtggctcgattgcctctagaactgcaacagtgatcacttgagacggaacgaatctcatctgtc

SEQ ID NO: 1921 - DNA, 378 bp, Triticum aestivum
  Clone ID: PAT_TA_1921
tgtggacatggcaaaagaattagcccattggcaaaatttcatgatggaagacataggaggaggggataatattcacattctgttatggatgatgcggagataagagactgcggttcaaatgaatctctgtacgatgatacacaatctgttaatcggttcagagaccatgattcccaaccttcagtggggcaatactcaggtgtacctgtaagtgcacgggtaaggaggcgactgttgagtaatggttctgacagacagcatcaaatgtccagtgatgagtttcctcgcactattgtatctgattatcgtgatggtgttggtgtgctagcacaatatggttctgctggtctgctagataagtcagtgaggaggtattca

SEQ ID NO: 1922 - DNA, 336 bp, Triticum aestivum
  Clone ID: PAT_TA_1922
cggacgcgtgcacaggcattgccgcacacactcaccgtctcgccacgtgagaggagaagcccgcagcgccggtgcttgagcggatcgggaaaggatggccggcggcgcggacgcggacggggagcgccggatcggggtggccatggactactcggccagcagcaagcgcgcgctggagtgggccgtccgcaacctgctccgccggggcgacaccgtcgtcgtcctccacgtccagcgccacgggggggaggacgccaagcacgccgtctgggccaagtccggatccccgctgatccctctgtcggagtaccgggagccggaggtgatgaagaacta

SEQ ID NO: 1923 - DNA, 407 bp, Triticum aestivum
  Clone ID: PAT_TA_1923
cggcaaacactcgccatctcgccacgtgagaggagaagcacacagcgctggtgcttgagcggatctggaaaggatggccggcggcgcggacgcggacggggagcgcaggatcggggtggccatggactactcggcgagcagcaagcgggcgctggagtgggccgtccggaacctgctccgccggggcgacaccgtcgtcgtcctccacgtccagcgccacggcggggatgaggccaagcacgccgtttgggccaggtccggatccccactcatccctctgtccgagtaccgggagccggaggtgatgaataactacggtgtgacctgcgacgccgtggtgctcgacatgctcgacaccgccgcgcgccagctcgagctgaaggtggtggcgaaaggtgtactggggc

SEQ ID NO: 1924 - DNA, 1290 bp, Triticum aestivum
  unsure (1)..(1290): unsure at all n locations
  Clone ID: PAT_TA_1924
gacttgacccttggtcatttttaatacttangcctagtgtttataaaaaaaaaattatctttccatagcagccaagatgtcttccattgtgctttttaataccggatgatttggatgtaaacggatagcctcttccaaaaaaacctttgccttctggtattcttgcattgccttataggagtttgccagaccaaaccatccaatataagaacgcctgttggccgccatactagttgcaaaatgtctttttgcgttcaaatagcattcgtgctcccattcttcataacccataagagcgtgagcataatagtgggttggattgacactgatagcctttctgaagcattactgcaaacacttgccatctcgccacgtgagaggagaagcccgcagcgctggtgcctgagcggatcgggaaaggatggccggcggcgcggacgcggacggggagcgccggatcggggtggccatggactactcagccagcagcaagagggcgctggagtgggccgtccggaacctgctccgccggggcgacaccgtcgtcgtcctccacgtccagcgccacggcggggaggaggccaagcacgccgtctgggccaagtccggatccccgctgatccctctgtccgagtaccgggagccggaggtgatgaagaactacggcgtcacctgcgacgccgaggtgctcgacatgctcgacaccgccgcgcgccagctcgagctgaaggtggtggccaaggtgtactggggcgacgccagggagaagctctgcgacgcggtggaggagcagaagatcgacaccatcgtcatgggcagccgcggcctcggcaccatccagaggattcttctgggaagcgtgacgaactacgtgctgtcgaacgcgtcgtgccctgtgacagtcgtcaagggagaccgttaggttcgccatcggcgtgcatcgggatgtgcttcatcgttttctgctccgttgctgcgtccgaataaagtatggagcctattgtgttttctgtatgccgcagccttggcagattattggagccgtgtatgtttctgaacatttggattcaaattcagtaaagtatctggcaatatttgtttgtgtgccttgttcggggacagggatgaccaaatgatttgctctattttcatattgattagcaaacatattcgtgtgttgcaacgagagaaacaaactctcgcgcacctataagagtatgttttgttggtataagtgttcatgtcagcacctaaccgcaagcgtatgttaaacaaccagacgggtccact

SEQ ID NO: 1925 - DNA, 874 bp, Triticum aestivum
  unsure (1)..(874): unsure at all n locations
  Clone ID: PAT_TA_1925
ggccgctcgaggnccggccggntccgcgggtcgaaaaaaaaaccaccaagtacaccacaggcattgcggcacacactcaccgtctcgccacgtgagaggagaagcccgcagcgccggtgcttgagcggatctggaaaggatggccggcggcgcggacgcggacggggagcgcaggatcggggtggccatggactactcggcgagcagcaagcgggcgctggagtgggccgtccggaacctgctccgccggggcgacaccgtcgtcgtcctccacgtccagcgccacggcggggaggaggccaagcacgccgtttgggccaagtccggatccccactcatccctctgtcggagtaccgggagccggaggtgatgaagaactacggcgtgacctgcgacgccgaggtgctcgacatgctcgacaccgccgcgcgccagctcgagctgaaggtggtggcgaaggtgtactggggcgacgccagggagaagctctgcgacgcggtggaggagcagaagatcgacaccatcgtcatgggcagccgcggcctcggcaccatccagaggattcttctgggaagtgtgaccaactacgtgttgtcgaacgcgtcgtgccctgtgacagtcgtcaagggagaccgttaggttcgccatcggtgtgcatcaggatgcgcttcatcgttctctgctccgttgctgcgtctgaataaagtatggagcctattgtgttttctgtatgccgcagctttggcagattattgtagtcgtgtatgtttctgaacatttggattcaaattcagtaaagtgtctgccaagatttttttttcgaaaaaaaaaaaaaaaagcccctacgcgctctaaaagtggcagcgactcata

SEQ ID NO: 1926 - DNA, 1770 bp, Triticum aestivum
  Clone ID: PAT_TA_1926
ggcgctcatgagagttcatggtccgaaggttataacaaggaagtgacatctagtggaacaagtacaccaagatcagatgtactgcgtggtgggttaaccgacccacaaaatcgtccttcgttctcaagcacttcaaaagatgctcagtcaacagcgaaaaaagtatgccacccagtcttaggctcaaaggcatgggtattgtggaacaaggaacggataacatggcgttggaaagagcgcaagaatgaggtgcatgagttgagtaagcaagtgagctggccacaatggcattgtgagcaagagaatggccagcatcatccgaaacttgccgccactcaaattgtcgaattcaaccaacgaaacaaaaaagaggcatcaggttcctggtcttctttcaacaataacggctcaagtagtgcaggcagcactggacgcaccaatacgtatgtgctctatacaaatatggaccattgaagcagactgtcctggatgatgaaatcctgtgggaagatcttgtaattggaggacgagttggccaaggctcctgtgggactgtataccaggccttgtggtgcggctcggctgtgggtgtgaaagttttctccaggcaggaatattccgaggaagtgatacaggcctttcgacaagaggtatcccttatgaagaaattacgccatcctaatatactgctcttcatgggtgcggttacatctccacaccgcctctgtattgttaccgagtccctcccacgtggccgtccgtcgcgcctacttcttcggggcacgcccagggtgctgccgagcggacgtgttcacatggctttagatgttgcaaggggcatgaattatcttcatcactatagcccacctatcattcatcgagatttaaagtcgtcaaatctgctggttgataagaactggactgttaaggttgcagattttggtctttcacgtctcaagcgtgaaacttatctgacaacaaaaacaggaaaaggaacgccacaatggatggctccagaggtattgcgcaatgaaccttcagatgagaagtctgatgtgtatagctatggggtgatcctatgggtatcttgtcactcattaagataccgtggggaaaatctcaagttcaatgcaggtcattggtgcagtaggtttcatgaaccaaaggttggagattcccagtgaaacagatccttactggacatcacttatactcagttgttgggaaaccgacccacaaagccgtccgtcgttccaagaacttctggagaagctcagaggaactgcaaaggaagtacgctgtccagaaccaggtgcagcgaaatcctcctgccgctgcgaagaatagcatcatcgaggaatgaagattccaacctcttgctaaggcggtgggtgtgtgagtgaggagggaatattgtcggtcggcgatggagcgacgttttaacccaagaaaagattcgtgcctcctgtgtgattgtttcatggaacagccgaggctgaagattgtgcagatgaggcgtcctctgaattcgtgtgaggatatgcctgaacttcctccgactgcaatttctggcatcaaagattagagtagggagccgaggctggcgcttttggggttctacattccgtggtgatgcgcgactaacacgcgatcggattgatcgggcttgcatttgtaacacggagaggacggtgttgctttgtagattgttcattgttccgatgacaaattgtacacgagctgccaatcatcaagaaccttgtccgattc

SEQ ID NO: 1927 - DNA, 952 bp, Triticum aestivum
  unsure (1)..(952): unsure at all n locations
  Clone ID: PAT_TA_1927
agttcatggtgcgttacgccatcaangagacagagcgcgcanccggcgcaacggccgtgattctcaacagcttcggcgatntaaanggcgaggcggtggaggccatggaaccgcttctcggtgacggcaacggcaaacccaaggtgtacacagtcggcccgctgactctactcgcgccgtcctccacgagcagtaccatcagcaacctcagcctgtggaaggagcaggaggagtgcctccagtggctccaaggcaaggagccggcctccgtcgtttacgtcaactttgggagcatcgtcgtcatgaccaacgaacagctggtggagttcgcgtgggggctggccaacagcggccggcacttcatgtgggtcattcgccgcgacctcgtcaggggcgacgccgccgtgctgcccccggagttcttggcggagacggcggagcgcgggctcatggcctcctggtgcccacaacaggaggtgctgaaccaccctgcggtgggcgcgttcctgacacacagtggctggaactcgacactcgagagcatgtgcggcggcgtgcccgttatcagttggcccttcttcgccgatcagcagaccaactgtaggtaccagtgcaacgagtggggcgtcggcatggagattgacagtaacgtccagcgcgaggctgtcgcgggcctcatcacggagctcatggacggagagaagggcaagcagatgaggaagagggcggaggagtggcgggagaaggccatcatggcggccaaacccggcggttcgacatacggcaattttgacgagttggtccgggatgtactcctcctgccccagaatggtgaatcnaacgacgcacacggtgttgcgctggattaatactacatggggaacggaacgttggcgcctgtaaattactgtatttttaanaatgtgtctcttattaagggacgttatcagcg

SEQ ID NO: 1928 - DNA, 669 bp, Triticum aestivum
  Clone ID: PAT_TA_1928
cccacgcgtccgcggacgcgtgggttcggacccctagggttatctgctcgggggccatggcgtgttccgcgtggtgctgccttcgccgccgccgccgcccggcggtgagggcactggcttgtgtctcatgggtcgctgcctgacttccggtctggggagacgggcttcattggccaataaatagggacgggaaggtccgagactggaggtccctggtcgcaaactcgcaatcccggcagctattctactaccaatcgaaaaagatttcatgaaggagaagaagaaggcgccgaaagggaatgggagcaacaagtctgaatggacgggtcaagatccctacaaagatcaaaatgatagaaggtccggtgtgctggcgctaatgcaaagcgtggcgcggatgggctgggtcctcggcccatcatcctcattgtctgcgcctacatcacctactacatcgttgtcctcatctccgactactaccgctcgccggaacccatccatggcaaacggaactatacacctgtacatggacgccgtccgctcctggctcgggcctacagatgtagctgtgtgtggcaatgcacagtacacagttgtctatgcatcacagttggcacgggcatcatgtctgtggtgcccagcaactgccgccattaaaagggccacgac

SEQ ID NO: 1929 - DNA, 1582 bp, Triticum aestivum
  unsure (1)..(1582): unsure at all n locations
  Clone ID: PAT_TA_1929
ccgcctgctcctccccgtcaatttggttcgtccccaggtgcatctcctcgcgccccgcggcgtgcgccccccggggctgccctccccgccgcccccgcccggttccgcgtggtgctgccttcgccgccgccgccgcccggcggtgagggcactggcttttgtctcatgggtcgctgcctgacttccggtctggggagacgggcttcattggccaataaatagggacgggaaggtccgagactggaggtccctgctcgcaaactcgcaaccccggcagctattctactcccaatagaaaaagatggcaaaaaagagaagaagaaggcgccaaaagggaatgggagcaacaagtctgaatggacggtgagattcaaatttggagcaatacatcttgcccagtttcacctgtggaaaccctcttttaaggtcaagatccctacaaagatcaaaatgatagaaggtccggtgtgctggcgctaatgcaaagcgtggcgcagatgggctgggtcctcggcccatcgtcctcattgtctgcgcccgctcctccctcggccccggtgtcctcgccgccggcggctaccccccgcccgcacccgtccatgcctcacggttcgctccgcctgcacgtcgccgccgcccgcccccgcctcgggcctagagatgtagctgtgtgtggcaatgcacagtacacagttgtctatgcatcacagttggcacgggcatcatgtctgtggtgcccagcaactgccgccattaaaagggccacgacgcgaactgcagcaggatggggcgatgtacctggtgatgttccgccttgtcgagctcgtcctctcatagttcccgggcctggagatcggccacctttgtctccatcatcgccgttatcatgtccttcacctactccttcatcgcgttcttcctgagtgtgcgacctgcgcgcaaggataggccagtggcggtgtacagccacttgcatcggtcggcggccaaacgaaggagcggtgggtggtgacctgtgcgtaaggagaggccggccagcggtggcgggggcggaggccaacacagatcaatggcgacaagggaaagagaggcaaggcaagcatcgacggtggcgggggaggagggtcaggcggcgaccctcgagggagtaggagcatccggcgggcagaggcaggtggcatgcgtcgcggggtagttgttttgaggcgatttgattgcgatcagtttcctgtttttatggcttgcgtgatcgtagggcttgcagaggtgggacggtagagttttcgtccgccgaggaaaattgctaagcgcagttttgcctgagggttagtctaatcttaatggttagatctaattaagtaatctgatcatgaggttgtaattggtccatgatgttttgtgtagcttaggctaggtgcacttagcaatgaatatgtttgcttgtttaatagtagtatagataatgtccattacgccaacataaacatccatgtacatatacgatgtagtagtatacgcacaaaccacacgcatctttcggctgctccttcaatacgatgctatcacaaacgcanaanaaaaa

SEQ ID NO: 1930 - DNA, 1520 bp, Triticum aestivum
  Clone ID: PAT_TA_1930
cagacagcaaacgagcaggcaaatctcccgcaatggccgccgctgcatcgtcgtcctcccctccggcggtcatcacctgccgagcggcggtggcatgggggccggggcaggcgctggtgatggaggacgtggaggtcgccccgccggggccactggagatccgcgtcaaggtcgtctccacctccatctgccgcagcgacgtcacccagtggcagtccacggcgcagcccgatctgttccccagaattttcgggcacgaagcatccggggtggtcgagagcgtcggggaaggagtgaccgagttccaagtgggagaccacgcgctcaccgtcttcatcggggaatgcatgagctgcaagcactgcgtgtcggggaaaagcaacatgtgccagacgctcggtctggagaggaagggcgtcatgcacagcgaccagaccacccggcttctccatcggcgggaagcccgtgtaccattactgcgccgtgtcgagcttcagcgagtacgcggttgtccactcgcggctgcgcggtcaaggtcagccccaccatgcccatggacaggatatgcctgctcagctgcggcgcgtccgcaggccttggtgcggcttggaatgttgctgatgtatccaagggatcaagtgtagttatatttggtctgggaactgtaggactttcggtcgctcaaggtgctaagctacggggagcttccaagattattggagtagataccaatcctgataagcaagaaaaggggaaggcttttggtgttacagattttattaatcctgccgaactgaatgagcctgttcagcaggtagtaaaacggcttactgatggaggggctgattactcttttgaatgtgtgggtgatactggagtagtctcgactgcattgcaatcatgttctgatggatggggactgactgtaactcttggtgtaccaaaagcaaaaccagaagtttctgctcattatggattgcttctctctggaagaacactgaaggggtctttgtttggaggatggagacccaaaactgatatacctttgttagtggagaagtacgcaaacaaggaaatccaagttgatggccttgtcacacatgatatgccattcagtgacatcaacaaagcgcttgaactgatgctacaaaacaggtgtttgcgatgcgtgattcacatgccaaagtgacaggattgatttatacatcagtgccatcatacctgtacaattttggtggttttctcatcagtaatttttcacttgatctgctcctggctcgagttttcatgacaccaacatattgaagctccagtgtgattctctattggtgtctcaccttagagttatggtgttatagttgttgaggagattacaaatcatactgatattcccttggaattcctcatatgtccgacctcaagaattattcgtgtaatctaacttgttaaaaattgatctgttagtgattataatggtgtatgcatgttcggtgcattgtgcaatattaaaaaaaaaaaaa

SEQ ID NO: 1931 - DNA, 947 bp, Triticum aestivum
  Clone ID: PAT_TA_1931
ggcggagaacggggcgcgaggggtctgcggttcttagcccgcttttcccgtgggtttgtccattttcagctccaaccccgcggtgctggcagaggggcggccgtcactggtcgcgtaccatagcgggttctagtggtatcctcaagttagatgggctcacgaagggcctagaactgagggcccaaccggccgtttatgttgccccgctcaggcccgtcaaattcgcggttatgcgagcagagggtggtgagatgggtttcctcttcttatacggctttatcgcccaattatggagtctgaagccctaccgcgacggtgttatgatatgggacgccagggagaagtattgaactggacaagttacttggagctaaatccagagaaagatcccccacaggtgatagggtatgccgaggaaaacaatgtggtgttcttctggacagttgttggtgtcttcatggtccatcttgactcatggtggttcaagaagctctctaagactagtctcgattcttggtaccatccatttgaaattgcctatactccaggcatggtggtggacatgatggagctaaagttgtgagtcgttggcggatgacacgatgggcacaatacacaaaacaattgttcagttagatatgctattgtgatgtattggttgagcaggtcagcggcatgaggcttggagtgtgcttctagagagttggactgggagagactttgtacaggacttgtgaagactcatttgtaggtgttctcaccatgcatcttggttgtgttgctatatatggctgtcagacatattttgccatatgtatctacggcttggttgaacagcaaatgtgtatgcatacatctatcgaccgtactgggaatatatatggtgattagtagtagtacttcagtagtaagcaaaatacaaattgatttacctaaaaaaaaaaaaa

SEQ ID NO: 1932 - DNA, 552 bp, Triticum aestivum
  Clone ID: PAT_TA_1932
gttcctcagcacgtgatataaggtgtgagtagttcaccagcaagatacatagaggtcacagagaagccagcaagcaaacaagattgagcattcacggatggtggccgaggccgtggcgcaggcgtcgtcggtgttcgccgccttcgacaaggacggcgacggcaaggtgtcggcggccgagctgcgcggctccatgacggcggcgctgggcgaggaggtgtccgaggaggaggcggcggcgatcctggccacggtggacgccgacggcgacgggctgctggaccaggaggagttctcccggatcggcctcgccgccgccggagacgacggtggggcggccggaggcgacgacgaggaggtgaggcggcggtgcctaagggaggcgttcgcgatgtacgcgacggggggcggcgaggagcagggcgccaggatcacgccggcgagcctgaggcggatgctgggcaagctgctgggggccgagaacatggcgctggaggagtgcacggccacgctctgcaggttcgacctcatacggcgacccccccctctcct

SEQ ID NO: 1933 - DNA, 375 bp, Triticum aestivum
  unsure (1)..(375): unsure at all n locations
  Clone ID: PAT_TA_1933
caccaatggccgcccgccgccgcctcctgctactcctcctcgcgctcgccccggcgctctcgcagaccgtgctcggcgtcagcggcggcggacaggccaggaagacgtacatcttccgcgtcgaccaccgggccaagccgtccgtgttccccacccacgcgcactggtactcctccgcggctttcgcgtcggcggcggccagcgccgacggcccgctcgagccgctccacgtctacgacaccgtcttccacggcttctccgcgtcgctgtccgcgtcgcgcgccgaggagctgcggcgccacccggccgtgctcgccgcgttcgaggaccgggtccgncagctgcacaccacccgctcgccgcagttcatggggc

SEQ ID NO: 1934 - DNA, 901 bp, Triticum aestivum
  Clone ID: PAT_TA_1934
catccctcccggaactccccttcatcccctgagcgtctcgattccccagcctgagcaaaccctccccacagcccgcgccatgggcggcgagatgcccggcaccgacggcaagggccaccccgccccggcctccgcctccgcctcgccttatccgcagcagccgccgccccagtacgagcagcagcaccaccagtacggcaccttcggggccccgtccgcgtccggtcaggtcccgcagccctggtccgggttcccccagcctgcactgccgcttgggttctacgcctacccgccgccgcctccgccgccgtctgcagcggtatacggtcctctgcaggcttattcgcccaccgcgccgagctacgcccatggctaccaggccgtgcaaggttatatacctgttgttgaaggaagacctgtgaggatgcgacgtcttccatgctgtggccttggcatgggttggtttctgttcattattggcttcttctttgctgccattccgtggtatgttggagcttttgttctgatctgcgtccgagtacacgactacagggagaaaccaggatatgttgcttgtactattgctgcttcacttgctgcaattgccatgttgcttggtgccacaaaaggagcggaggtgtggtgagctggatgtgattatcatcgatttgcttataatagtactacatatgttcattctccctctactctatcgggtattctgatttgtacatgtatgcgtagaaaagatataatggaaggagattggttcactatcatatgtgctgtatgacatataatcgtagaatgatagtatttgtcttccgggtaaaaaatgtgcctgtagctcccgcgactagtattgtgttgattttctttttgcggggttaaaaaaaaaaaa

SEQ ID NO: 1935 - DNA, 929 bp, Triticum aestivum
  Clone ID: PAT_TA_1935
gcaccccgcacccacgacgtgcggcaagaagaacggacagcacatctgaactgaacaacagagagcgcccctgttgagagtcgagcgagagaagcacgtcccggcccgatccccaatcttccccggcggcgatgccggctggaggagagaagggagaggagcacggaggagctatgtatatattaagtctaagttgagtcttacccctgtggcgtctggcgctatgccgaggtggagcgtaccgccgccgcgttcgagcagcggccggtggttagcggtggctgcagtcctggctgcgctggtgtgccagttgcttgtcaggagtgggttgccggtgactccacgaataagctcgtttggtccgctgatctggaggaggtccttattttcctctgctttcaaggttaccatggtggtgaaggaggaagagaggaaagatggagatccagttcgggttcgagctcatcaccgacggagatcttggatggcctatggctcccgctgttgcggtcgatgccggccgtcgccgccgaatcctctgaccgaatggctgtctttcttcttcctcccggccaagagccagatgggaggcaatgcagcttcatcctggagttcgtggcgtggtgccatggagggctcgccgcaccaagtggtgccgtccccggtgaagacgagtcaagtttcaggctggagttgccagggacccgattgcttttttcatcaattttctggggtcctctttgtaatagtcagggaccggttagtgttttcctttttcgttcagggtcctgatgtaaaatcgctgtgtactgctcctttctaatcaatgcagcttcggggtccttccgggcccttagtttgttcaaaaagaaaaagaagggtggagttgaaggctgagactttccagcagagcagagcaaatcgctacc

SEQ ID NO: 1936 - DNA, 1249 bp, Triticum aestivum
  unsure (1)..(1249): unsure at all n locations
  Clone ID: PAT_TA_1936
aatttgatctaaacccgcaggcgcagcagcgcgcgcagcaggccatgtcccgcttcccgtccggctcgacgcccacctccgccccctcggaccgcaccgcttccagcagccggcgccgtcgcagctccaaaccccaccccagccgcactcgcaggggcagccgcatccccagccgtccccgcagcaagcggcgcaggctagggtccggagccccgaggtggagatggcgcttcaggacgccatgcgggtctgcagcccggacatcaagacgcctttccattctctcgcggacgccgttagcaggttattgccttaccatgttgttgctgactacgaggctgaagaagatgacaggatccttgacagcgacgcaactggacagattccctctcgtcttcagcaatgggatcataacattctgggaaaaattgctgagttcacaacaacttttgagaagcaagtgttggcatacaacataatgaccaagaaaagggccattggtgagtttcgatcggaggagcgactcatgctagagcaagctttgttacaggaggagaagcaggcttcgatggaactaagagcagagatagaatctagggagaaagcaggccgcgaggctgctgaagctaagatgcgtatggccatggctgagcatgctcgagtggaagctcaagcacacgctgaggtgattggtcatggccctttgagggccaatgctgctgcttcccaaggcgatgatggtcctagtcatgacatggcacaagaacaggttgaagatggatgggaaaacactcaaagggatgatgatgatccatccgaggatttcctcaatgatgagaatgagccagagaatggaaactctgatatgcaagaggagtggcggcgatcgggggaatttgatctaaactctaggtaagactgcaagggatacggcgtcgatggtggcaatctgatctgaactctaggtaagacaggtgcactcgacttgagaaaaggcttgaggatgcatcatctggtgcctggtaacttagtctctagttatctgattatatatgttttgaagataacttgtcctgtcattgtggctgtaaacacgcaatttaaaactagtattatttagcttttttttttggaggaaactagtactccctccttaaactaatataagagcgctactcatgtgttcaaacagtgtttagaatgttgagtgacctctgtatgatgtaaantaacttctaaaaaaaaaaaa

SEQ ID NO: 1937 - DNA, 707 bp, Triticum aestivum
  Clone ID: PAT_TA_1937
ccgcgcggagagagagacagggtccgcaaagcaagcaccgcccggcaaaggcaagaaagagccatccatccatccatcatccccttcctcgtgcgctgctgcctcttgcttctttcttcttcgtctagtaccaagctcaagctagatagatatccatggtttttctctccttgcttgcttgcgaattgctgcaggttgtaagtagataggtgttatacgtagtaggagctactagtagataggcggcgggtgggagaggagatgaagctccatctcctgctgaaggtcctgttcggccccgtgccggtctacttctcggcgctggccatcctcatcctgctgaccaacgcgcagtacttcgggctcggcggcgtcggcgtgccgcgcgccaccaagctggcctcctccacgcaggtggtgagcgtgatgaagtactgcgacatcttccgcggcgagtgggtgcccgacgcggaggcgccctactacaaccacaagacgtgcggcatgatccaggagcaccagaactgcctcaagtacggccgaccggacctcggcttcctcaagtggcgctggaggccgtccggctgcgagctgccgcgcttcgaccccgtccagttcctgcagttcgtccgccacaagtccctagtccttcgtctgggactcgctcgctcgcaaccatatccattccctgccctgcctccgctcac

SEQ ID NO: 1938 - DNA, 696 bp, Triticum aestivum
  Clone ID: PAT_TA_1938
gcgctgcggattgtgctgctgagggtacggacttccgccgctacgctccgcctacaaacgccggccctgggcctctcccctctgaccggcggccgcgccaacttccactccgccgccgccgcctcccgccgcctctcccctccggccggcggccgtccctgcctcatctccaccaggaatctgcgcacaagaattaacttggaatcagctagcctggaggagctcttacgagaggcaacctttttagaggaacagatcaaagagtgtctgaaccgtacgctcaaggagaaggagaggtctgatctaatcatgaaggatacttggggtactctaaagcgtatggcctgttgtgctgctgtggtgaaagtcatagcatttttcatttctcctagtgaactggcggaagaagatgaggtgatgaactagtggaagaagcacttgatgaactaacggaacaaactgaggtgatgaactagtggaacaagctgagatgtcttgtcatcagctagctgtgagctcttaacgagtagtaggttatattagggaactcatgtattaatatgcctatcagccatgtgtcagtacttcattatgttatatagaactctgagttgttaataggttatgttagggaactcgtgtattaatatgcctattagccatgtctatgtacgtcattatatagctaaaaaaaaa

SEQ ID NO: 1939 - DNA, 349 bp, Triticum aestivum
  Clone ID: PAT_TA_1939
cccacgcgtccgccctgatgatatttcaggcttcaaacaaacactagaggcgaggatgaaggaatcaaataggaatagcagtgtgcaaagatttgtgaagagtgttgagcttctgcagaagcagacaattatgcattaccagccaaataaatctcagtccttcctcaagatagtaggtgccctacctacaatggttgctagctggcggggcatccttgaaaggggcataacgattggcagtcttggttcaaagagtttcgtgacatatgaaaggcacattctcttttgcccttcgctttatgattgactgcaacattgttggtggcaattggattgaacttcctggtgg

SEQ ID NO: 1940 - DNA, 1291 bp, Triticum aestivum
  unsure (1)..(1291): unsure at all n locations
  Clone ID: PAT_TA_1940
aattccaagaccgacgaaagagccccgcgacctattggggaggcagacagtggtgggcgggcggaagatatgcctcgggaggagccggcggcggccgaggtctcggaggtggcggagatgggggaggagaaggaggacgggcagccggaggagcaggaggagaggtgggcgcgcctgctgccggagctcctcgcggaggtggtgcgccgcgtcgaggcgtccggcggcgagcgctggccggcccgcaaggacgtcgtctcctgcgcctgcgtctgccgccgctggcgcgacgccgccgtcgccgtcgtgcggccgcccgcggtgtccggaaagatcaccttcccgtcctcgctcaagcagccagggccaagggagttcccaatgcagtgttttatcaagcggaataagaagaactctacgttctacctctaccttggcttgacaactgctactgtagataaagggaagtttctcatggccgcaagaaggtttaggcgtggcccccataccgagtacattatatcccttgatgctgacgacttgtcacaagggagcaatgcatatatggggaaactgagatctgatttttggggaacaaattcaaaagtatatgatagcaagccaccacatgatggcgctaaagcatcaagtagtcgatctagtcggcgtttcggaagcagaagaataagcccccaagtatcggcaggcaactatgaatcgggcagctttcatacaaatacaacctgctcaaatccagaggcccaagaggatgtattgtgcactcgagtgcccttcacctcaagagacctgggaaaactccctcaagacgaagtttcggaagcccatgggtaccacggttttaagaaacaacgctccccgctggcatgagcacctgcagtgctggtgcttgaacttccacgggcgggtaacagttgcgtccgtcaagaacggccagctgtccgttgccgctgaccccaatgaccctactggctccagggacgaggagacggtgctgctgcagtttgggtaaggtcgacgacgacatcttcacgatggattatcggcagctctgtcggcatttcaaggcctttgccatcagcctcaagcagctttggcaccaagctagcttggtgaatanagcgatatggtgatgctcgaagtacaccgctttgggttgggcgcatgggatgtatccgcgancttgttgctctcggactctccggaattcggcgtttctgctttttctacttgatgccgatgtgcatatgttgtacaagacagtatacaagaa

SEQ ID NO: 1941 - DNA, 1408 bp, Triticum aestivum
  Clone ID: PAT_TA_1941
cggacgcgtgggcgcacgcgtggggacgcggcggcggccatggcgattcccctcgtgctcgtcctgctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaggtacaggtgtatgcggatccagaaacttggaaactaatgggcaaagagcacgcccttctcatatccaatcatcgaagtgacattgattggctggttggatggattttagcacagcgttcaggatgtcttggaagcgcaatagctataatgaagaaatcctcaaagttccttccagttattggttggtccatgtggtttgcagaatacctctttttggagagaagctgggcaaaggatgaaaaaacacttaaatcgggtcttcaaaggttgaaagacttccccagatcattttggcttgccctttttgttgagggtacaagatttactccagcaaaacttttagcagctcaagaatatgcagtctcacagggtttgacagcgcctaggaatgtgctgattccacgaacaaagggatttgtatcagctgtaagtattatgcgtgactttgtcccagctatctatgatacaacagtgattattccagaagattcgcctaaaccaacaatgctgcgtattcttcagggacaatcatcagttgttcatgtccgcataaaacgccattcaatgagtgatatgcctaactcggatgaggatgtttcaaaatggtgcaaagatatatttgtagcaaaggacgcgttattggacaaacatatagcaactggtacttttgatgaggaaattataccaattggccgtccagtgaaatctttgatggtggtcctgtcttggtcatgtctcctcctatatggtgctcatagattcttacagtggacccagctcttgtcgacgtggaaaggagtgatcctctttgcttctggattggcaatggtaaccgccgttatgcatgtattcatcatgttctcgcaggccgagcgctcaagctctgcgaaagcagcaagggaccgagtgaagaaggattgatagctcgtgtgaaattcagtctataggggaactgccaatttattatgttcagaatatatgtagacacaggctccatgggtcaaatctagtatgtccttgttgtcctcggtaagagcttcaggaattttgtgtggcgagaactgtgagctttcttccttctttctctactttgtaatgacttgtaaagatttgctttgccataccaggaatcgctgctcgaatttatcgaagctttttttatcct

SEQ ID NO: 1942 - DNA, 1143 bp, Triticum aestivum
  Clone ID: PAT_TA_1942
ccgctctcccccccctcccctcgtcctccaacatcccgaccggcggacccagcaatcagtctgcgcatccccctctcccccccacgcgaagcaagagcagcccccacacgccgacgcggacgccggccggcgagattgcttttgcgcgatgagctggagaattcctcttttcggctctcagcagcaacagcagcaacagcaacctgaaccaaatttccagaacatatctacgcaatcttggtaccctccctcagtaggtggttcatcttcacatccatccacacccagctcttccggtgctagtccacaccaaagagcttcagatcatcctcagccttcatcacgtggccaaccgtctccagctgaagctgcagggataattgctcgtttgagggataagagtgttgatgagctgcagaggctgttaaaggacaaagagtcatataatgcttttttcaattcacttgaccaagttaaaacacagaacaatttacgcgatgagcttagaaaggagaccctgcagcttgcgagagaaaatttagaaaaggagcagcggatttcagagctcaggaatcagtgtactataatcagaaccacagaactagcagccgctgaggacaggttggccgagttggaaaggcaaaaggacgagattatgaagtcctattctcctgctgctctgctcgacaagctgcaaagtacaatggcgaagctggacgaggagtcggaggagctgcaccaaaagttcctggagaaggacattgacctgccgacctttgtgcagaagtacaagaagctccgtgctgcacaccacaagtgtgcgcttctccacctctccggcaaggcctcgcttcgctgatacatctatcgattcattcatcgtctgtcgtggcatcgctgctctgttgtatcctgttccttgccctgtttttgactgcagacatcagactgaggtcgcatgtatagtcctatggctgatttcacgggcataatcacaatctgctatgtgtgattggtttatgctgaatgccatggttgtggagtcacgagaacaaggctgagctcttcttttatttcgttatcattcaccgtacacgtcattaaaaaaaaaaaaaaaaaaaaaaaaaaaaaaaaaaaaaaaaa

SEQ ID NO: 1943 - DNA, 891 bp, Triticum aestivum
  unsure (1)..(891): unsure at all n locations
  Clone ID: PAT_TA_1943
cggacgcgtgggtttatgattaattacaaaggagctattgattaccagaattatattgctttcaatgaacaacaattgtggccatcaactatgtttcttccaggcctcaagaacaccacagccagacacaagtcggaggtaacggtcattccatttgcgtatgggtaatgcaaaaagcaaagccggtgaacatcaacaagaagaggacgtagctacaggtcaggcgagtggtaaaaatgttgaagaatatagtgcaacctttgatactgacaaagatgaagctatttgcgcaacagaacctgcctctacgagcgagacaaatctgaaagaatataatccaagcatctaaaccgtagctgcaaatcttgacccaatttacacgacggaaacagatggatcagagtgggcaaggcctggataccatgccgatggtcaaacagttgcgcctacggccactctatcactagatcctcccattagttagatgcagctgcgagctgttacggaagacgacacagcttccgaactgcttgaaactgtttctctaaataatgaatgcaaaaaatacgctgaggaagcaagggagcagtacaatgcaaggaggcgtgcagcttatcggaagaaaaataatgaggatattgtcagcttacaagatgagaatcagccggtacttgcaaaatctagtgagcttgatggctgctcttagtttgatgtgcatacgtatagtatgcacatgattcgttgtattaatctatatccctgattatagatgatatgatgctcatactatgttgcttattagatcatagggatcttatcaacgctcgtaggcgggtggcttatcgcaataacaagtcagatggttcggctaccaacaagtcaanggaagtc

SEQ ID NO: 1944 - DNA, 1184 bp, Triticum aestivum
  unsure (1)..(1184): unsure at all n locations
  Clone ID: PAT_TA_1944
cggacgcgtgggctctctccctctctctctgtctcgagaagagtcttcctccttggggggaggcaggcggcagggaagaagcaaagcccagcaagcaagcaagcttccttgcttgctccagatctggtctaggtcggaggaggagcgggagggcgcgctggggtcggcgtcggagatgaaggcggcgctgcggagccggcaggagccgcggcgggtcagcaacggcgtcatcatcgccgccatgctcctctccctctgcgtcctcagcatcgtcaaggccagatactgctccacccccttcggcaagccggacgaccagctcaaggagcagatgaactccagcatccggatggagaccgacgacgagcccacgcccgccgccaccacggtcggagtgtcagaggaggactcggaggaggatgtgcgggaatggaaggtgaagccgtactgccggaagcaggacgcctacgcgctgtcgcacgtcaaggagtggaccctccggccgctctccggcggcggcccgcattgcacggtcaacagctccgcgacggccttcgtgctctccaccggcgggttcaccggcaacctgttccacgactacacggacgtgctcgtcccggcgttcatcacggcgcaccggttccgcggcgaggtccagttcctggtgagcaccttcaagtcgtggtggaccaacaggtacctggagatcttccagcggctgagcaagtacgaggtgatcgacatcgacaacgacgacgaggtccggtgctacgggagcgtggtggtcgggccgacgttccacaaggagctgggcgtggacgcgttcttcccaaggggccgacgggggcgtcgatggtggacttccgcgcgatgctgcggggcgcgttcgggctgtcgcgcgcggcggccgagccgagcggcgaccggtgggacatccggcgccggccgcggctcctcatcatctcccgcaagaactcgcgcgccttcctgaacgagcgcgccatggcggacatggccatgagcctcgggtaccacgtgcgcgtgggcgagccggacaccaacacggaggtgtncaggttcgcccggctggtgaactcngcggacgtgatggtgggcgtgcacggcgcggggctgaccaacatgcttctncttcccaccggcgccgtgctgatcccagtgatccc

SEQ ID NO: 1945 - DNA, 1999 bp, Triticum aestivum
  Clone ID: PAT_TA_1945
ccaagtctcccccccggcgtatgtctccggcccccggctccccgacgacgctccgcagagggagagcgcgcgggtgggggagagagagagagaccaccagcatgagatcgaccccgacgcggtccagaggcggcgggcggcggcgggggagtgggtcgcccagcgccggcaggctccggggccgcatccggcgctccggaagcgggacgagccgcaccccctcggcgagcacggggtgcccccccccagcggcggctccgcctgccaccagcacggggagctcccccgctcatggccccccccctgcgtctagatcgacgaccactcccgtgccctccgcggcgcctgcggccgggtgcgtaactccgcccaaccccgccgccccgtcgtcccgggctggcgttcacgtgcccgcgccggtgagcataagcaccacgcccgcccccgccggtggcagagggcgccagcggaggccgctgtgctacgagtcgtgcccgccgtcggacacgtccggggccgccggatacgtacgcgtgcagggccgcaaccagaccatccaggtccggccgctggaccgggagtggagggcggtgcgaggcggcgggggacatccgggtggtcggcaacgcctccaccatctacatcgactcgctggaccgggagtggcggaccaagccgtacgcgcggtaccacgaccccgtcgccatgacccacgtccgggagttcctcctcagacccttcccggccgacgcgccgccgccggcctgcaccaagaaccactccgtccccgggtttgtgttttccaaccgcggcttctccggcaacctctaccacgactacacggacgtgctggtgccgctcttcctcagcacgcgcaggttcaacggcgaggtgcagttcctgctcagcgacctcaagccctggtgggtggccaagttccggccacggttccgccagctgctgggcttcgacgtggccgacgtgcacaccgacctgtcggtgctgtgcctccccgggatcgtcgtgggctccttcttccactaggacatggccaccgtcccgtccaacgcccgcggcggcgtctccagcgtcgactgccagcgcaccctccgcgacgccttcgggcgggagcgcgcggcggcgtcccgcggcgccgccacgggcgccggcatcccgcgcctcctcatcatctcccgcaagaactcccgccggttcctcaacaagttcgcgcggctggtcaactcggcggacgtgatggtgggcgtgcacggcgcggggctgaccaacatggtcttcctccccgccggcgccgtgctgatccaggtggtgcccttcggcgggctggagtggctcgccggcgtgaccttcaaggagccgtccacggacatggacgtggcgctacatgggctacaagatgcagctcgaggagagctcgctgagggagcagtcacccacggaccagcccggtgctcagtggagcccgctctccatccacaagcaggggtgggaggcgctcaaggcggcgtacctggagaagcagaacgtggggcagggcccgctccggcgcgcgctcgccggcctggggcccccccagcgccgcccccctggacgcccggcccgggccaccggccctgcgcggcaacggccgggccctatctgatcatggatgtaatgatccgatgtgtacattgcgcgcggtcgatgaatcgatcaattccatgatggttaatcctggagtataggtagaagaacagatataggggtttgtccgtgctgctcttccgctccgtttctttgtttttttgcctaactttattcttgatttcttcttcttctttctctgaatctcttcctcgtaagaccccattgacggcgagcaagaacatgtggtaacagaggatgtttcgttcatacccttttgtgattatttgtttcttatatcagttaattaatttacaaaaaaaaaaaaaaaaaaaaagggcggcccgtccaaactatc

SEQ ID NO: 1946 - DNA, 2336 bp, Triticum aestivum
  unsure (1)..(2336): unsure at all n locations
  Clone ID: PAT_TA_1946
gtcacgcctcctcgccctcctcccctccggccgcacgtgccgcccgacccccaaccccccctcccctcctcctccctcgtacacccggtccaccgccccctcccagatctcgacctccccggtggtgccgcgctgccgtggcggtagcctccctccctccgctcccgccctcccttaggggttcggtcgacgaggggcgccatggatcagagccggcgggcggtggagtcctactggcggtcgcggatggtggacggcgtcacggcggaggacgacaaggtcgcccccgtctacaagctcgaggagatctgcgagctgctgcgcgcctccgacgccggcatcgtcaaggaggtcgccgacttcgtcctcaagcgcctcgacaacaagagccccctcgtcaagcagaaggctttgcggttgattaaatatgctgttggaaaatctggcactgatttcaagcgggaaatgcaacgacactcagcggctatgcgtcagcttgttcattacaaaggacaccctgaccccttaaaaggggatgcccttaataaggctgtccgcgaaactgcaaacgaggccattgctgctattttctccactgaggaccctaaagcagttgttgtgacagaaggtctaggcaagcgcatacagggctttggaaacactaattatgagccatcaagagatgacaagaagtctttcctcagtgaactaagtgaagtagtgggcattggtggtgcttccattaaacagggtttgagcaactttgctgccacacattcaatgatgccaaatgataatggtggtatgtacaagaacccaattcgcaggtctctgaccacagaaactgatagatatggcaggtacgatccaagtgaaattcaaggtgagagccgtgctacatctggtgcttcaaagaatgtgagttctggttcttggggtccaagtccctcaagttcagcatcagccggtgatactgaatcaagtcaaccaggaattaagactcgtgaggagagacttttggaaacaattgttactgcaagcggtgtgcggttgcaacccactcgagatgctctgcagatatttctaacagaagcctccaaactggatgcagttgctttgagccgtgcccttgagagcaaactgaactctccattgtggcaggtttgcatgaaggctatctgcgtgctggaagcggttgtaaggaaacaggatactgatccttattccatcgttgcttcatatttcagtgagaacagtgcttgtgttgtcagatgttgtgaattgcccccagcctcccgctgtgatacggctgcagccgtttctctgcggctcgctgctggctggtcccgacctctgacttcccaggccctcctctccccctgtttcgatccaaccaggcatctgggctcgggtgcctgttgccctacttccgcttcctgttcgctgccggccggctggcccccctcccacaatggagagttcagtttgctctcaagggcacggctcaaagcaactgcatccagtttggaggcttctgttaaaaatatctgcagggcattcgcgagggggctgcagcatatttgcctacactgtgtgtgactctttcaggcggaccgcaaacaggaacaaaggtaattgacaatgaaactcacattttttattcttaccttaaacctgcctccttccaaatacacacttcccagtccgggatccttgagcgattatcttcaacgcctgctgcttgctgagctaatccctgccatgcgaccccggcccgcggtccacccaatcctaagctaatatgttcgcctatcccatgtaggcctgtccctctactgctcttgtcaatagtgctgtacttgccgtttcgaataggctcgacttccttgagccacgtcccgctgcaagttgatctgagacaaagtcatccgcggtactttcatctttcttagcattgttcttcacaaattcttgatgtggagctagatgacttgaattgaaaccatctggtaactcagatgcaagctcccccactcattggattgaaagcagggtggcccaaggccagcattgaaatttcccgagttctgtagtaagtactgctgctgagcatgtagctcttcaacagcaaccatacttttagtacctgcacagtaaattgattgcccaaacattttgtggtgacaaggtcagccgcggcacgctggccagcacccgaccctgtcccccgagcatgctatcaagtcantcctcgatgatatgtacgccaatcccaagaagcccggacaatctcctgttcttgtcaaaatttctgaacatgccgttttcttttaggg

SEQ ID NO: 1947 - DNA, 1757 bp, Triticum aestivum
  unsure (1)..(1757): unsure at all n locations
  Clone ID: PAT_TA_1947
agtggatgctgcactggaatcactctctttagctattattgcatgaactttttgattctaccttgcaaacatatttgggagcttgttttttggacctatgttctggcctgttaaatcaaggaacgtatcaacggagttggtcatatgatttttacctgttggtgtgattctacacaaggaggagaccgatagtcgcaggcgcccgcctagagttcccaggttgtacgtgactcagacgttgtttgcagaactaggggtgaggaatgttctagccaagctgccgtctaaatggttgggattgggcagcggtcgtgctgacatagtttttgcgtcctgagatgctagattaaccggctaagtaaaattttgaacgtgatcgatttgagaggaagaacatcgtgaatgcttcttgaaaataataagacaattggcacgagcttccgaactgagggcacgtcggcgcgtcaaacgtacctgttgcgaccggtgatactctccgtgtaaagggctcagggacagcagtgaggacaatgcctctttagttgtaaatgtgttactcctaataggtaaggaagcactcctgcgataatgcatataaaaacgcgatcgatactatgattgagatgactaagatacatgctttttgtttacttggcatctgcttctcttaatttttctacaacccttcctttacatgctggtatgttttgttgccaggctcagatcggcgagacccgtgccaatgcacgaggtacaatattggttaattttccatctccaatcagattaatggtttgcatgcagaccaagcccagtgttttatggtgttcttattcctgatttagttgtacatttgacttttagtttcttcatagataataaagtagtggcagatgaaccagtaagttatctgtgcccattctttgctgtaagcattaaatttgctctctgcttttactttcaatgtgttatccgtacccctgttttttgtggctaattattatggtgttcttattcctgatttagttgtacatttgacttttagtttcttcatagataataaagtagtggcagatgaaccagtaagttatctgtgcccattctttgctgtaagcattaaatttgctctctgcttttactttcaatgtgttatccgtacccctgttttttgtggctaattattatgtcctatcaacatatgcagagtccatggtatcatacgatttgaagttgaaaaaatcatgctatgggtgatacgggaaaagtcattgccttctttgctggaacatttcctaagatgatctaaggtgaagcatttatgaatatcctcgctgatctatggatctatcattgtaagagtcgataatatatgatgagctgcctcacaccantcatttggtctttgtggcatttgagttggcaaatttgttggattcatgcgattaggcatgccatgtaaatcaatctgcaatgggaaatgggagtttgcaaactaccggagtctaattgctgagggacgaggttcgtaactgagggtcatgtgcagagctggaggaagaagttgcgaggcttggaactctccttgtgaagggctcagggacaacagtgaggacaatgcctctttagttgtaattgtgatactcctgatgtgcaagtaaacattcctgtgatactgcttatgctaaaatgttggttgttagtacagaggtggtgacattatttggttctctgatattgatttcatgatttgtaataaa

SEQ ID NO: 1948 - DNA, 623 bp, Triticum aestivum
  Clone ID: PAT_TA_1948
gggcggacggagacggtgcacttcgacaagatcacggtgtggttcaagaagctcagctatgggctcagccaggagcaccgcgaccccgtgctcggtctgcgtcagggtatacatgggcgtcaccaccatccagctcgacgagctcgccgccgagaccgccgccgcgctcacggcctcccagcctgactatgcctccctcgcggccgagaccgccgccgcgctcaccgcctcccagcctgactatgcctccctcgcggcgaggattgttgtgtccaacctgccgccaagtggaaatagtttgtgtggcgctcgtaaatagagagcattctggtagaaagctgaaagattagcgagactggctaaattctgaacatgttccatgtgagagaaatagcatgttgatttcatcttgaaataatcatagctgagggacgagcttcgtaactaagggtcatgtgtagagctgaaggaagaagttgcgaggcttggaactctccttgtgaagggctcagggacagcagtgaggacaatgcctctttagttgtaattgtgatactcctgatctgcaagtaaacactcctgtgatactaaatgttggttgttagtacagaggtgatgccatt

SEQ ID NO: 1949 - DNA, 988 bp, Triticum aestivum
  unsure (1)..(988): unsure at all n locations
  Clone ID: PAT_TA_1949
ggnctgcaggnaattcggcacgaggaaacgaatgattgtcctcataacgctgttgcgggtgctaagcggaaacacggagcctttgaggtagatgaagagctcaactcaacaattgcagagaatgaagtactttggcgggtaaattttgagaaatttatattctgtctaaagaagaagttttgtgcagaccgaaagaagccaaagctgaaggttggcacacatcctatctgggagtcatttttcgaagctaacttacctgacaaagatacaaactctgtgacatcatcaataaatggtattttggagaaactaggacaaaaggaaggaactgcagcaatgtcaattggtgacataaaaccagtcctgctggatttacagtgtactacttccgatggggaagaatttacttttgatttacgcaaaatggttgaagcatgtagaaatgaggagatagagtcgcttgtgaaaaagaaatacgggcaagaagcttttacaatctttaggctattggtcacacaaggttgtgcagttgagacagatcaaattattgacacaacaattctggacaagcagattgttcattcaactttgtacaaactatggaacgacggctacatagatacagagaaaatcgcttccgcagcaggaacagggtacgcacagttttttgtatggagagccaaaaatacatttcgtgagcagttcatcgataatctctaccatgctgctttgaacttgcgccagatggtgaattacattgctgaacttctactcgagggttcgaaggacgaaacaaagctgcggaacagaaagaacattttgatcctggccctcactagacatgatgactctctcatgctgttccatgatttttgagaatacaggtgagtctaccgtgaatgtagaacggaatccaggctgtgaagttggacaactgaattaatatatcttaggctcgtagcnatttcacctanggaaattcatttac

SEQ ID NO: 1950 - DNA, 1553 bp, Triticum aestivum
  Clone ID: PAT_TA_1950
cgtccgcgacaaggtgtcatcagaacggactcctcagcatcacttgaaagaagaggcagagtcagtgatgcagaaattggtgacttgtgttcaatatacagctgaattataccatgaaatgcatgcccttgacagatttgaacaggactatcaacgtaaacagcaggaagaggatggttcaagtgttgcccaaagaggtgagagtctgcacatactaaagcaggaggtcaagagccaacagaagcatgttaaaagtttgaagaagaagtctctctggtccaagaatttcggaggcgtgggggaaaaacttgtagacatcgtgcacttcttgcatttggagatccataatacctttgggtgctcagataatgaagaatcgcaggaacctactaaacgacgtaatagattgggtccagcaggacttgcgctgcattatgccaatatcatcagtcagattgatgctcttgtttctcgctcaacttctgttcctccaaacacaagggattcattataccagagtttgccaccgaccataaaatctgctctccgttctaagctacattcatctggagttaaggaagagcttactgttcctcaaatcaaggcggaaatggagaagacattacggtggcttgtcccggttgcaaataacaccaccaaggctcaccatggctttggttgggttggagagtgggcaaatacagggtcagaggtgaactgcaagccgacagggcatatggacctcacccgaattgagacactgcatcatgctgacagggacaagaccgaagcgcatatccttgagcttgtcgtattgcttcagcatctcatcagtcaatccagagccgcgaatggcgagcgatctcccatcaagtctcctgttcgatctcctacacaaaggggctcttcaatcacattgtctccaaacaaagcgagcagttcatcacctgttctgacacaacaagaacaagagatgctaagggatgtcaagtacaggaaattcgttcctggtataagcaaaagccaagagtttgacacaaaggcaaggcatatgcaaagcaggttgatcaaaagtaacagccattcaccaagcagtagcaacaggaaagaattcctctcgatcaggagtatgcttcctgtcattaattttgaaatcgataggaccaaagctctggatatgatcgacaatctaaaagtgcagtgaggagtcgaatcgaccggtgccaagtcctggatacttcgatgccatctgtgatcttaaaaattccatattgctcgaagtatacatcaggtctgccgagccgattgccatgtgcctgcagcgaaggcgcctgtggcagtagggcgccaatttggaggcaccaaaagagggccgggtggtctgggatcagggctagcttatgtatgatatggggtgaaaaggaaaggggaattttattgtaaaaagcaatttgttgtgtttgtgagctctttgtacaagcaatgcaagttttgatggagaaagggacactgattctgtgtcatattgtgtttccaaaaaaaaaaaaaaaaaa

SEQ ID NO: 1951 - DNA, 1980 bp, Triticum aestivum
  Clone ID: PAT_TA_1951
cgctcaccacttggctcactgtcgtactcggtaccctacagcgccgaaagagctgccaaggggctccgtcgtccatggacgtgccgaccgccggtggagccgccgccgccgcaccgcagcgcagggcctgggagtgggagggccgggtggtgtccccggtgccggcggcgacggcggacgaggcgtgggcgctgctgtcggacttcctggcgtaccacaagtggcacccccacgcgtccgcccacgcgtccgcctctcttccccgttttcctcctctcccctcgcctccgctccgcaaacccctcctctttcgcaaaccctagctctcgcccccgaccctccattgccgctcgagtcgcctcttcaccgccgtcatgggctcagatgcagacatggaagactacggtttcgagtattcggacgacgagccggaggagcaagacgtcgacatcgagaaccagtactacaactccaaaggtatggttgagacagacccggagggtgcacttgctggttttgatgctgtagttcgcatggagcctgaaaaggcggaatggggattcaaggctctcaaacaaactgtgaagctttattataagctggggaagtacaaagaaatgatggatgcttacagagagatgttgacatacataaaatctgctgtgacacgtaactacagtgagaaatgtataaacaacataatggattttgtttctggatctgctagtcagcacttcaatcttctgcaagagttctaccagacaacacttaaagctcttgaagaggcaaaaaatgagagattatggtttaagacaaacctgaagctttgcaaaatttggttcgacatgggggagtatggtcgcatgagcaagatactgaaggagctgcataagtcttgccaaaaggaagatggttctgatgaccagaagaaaggcacacaacttctagaagtctatgctattgagattcaaatgtacactgaaacaaaaaacaacaaaaagttaaaggaattgtaccaagagggctctttctattaaatcagcaatacctcatccaagaattatgggtataattcgtgaatgtggtgggaagatgcacatggccgagaggcagtgggcggacgcagcgactgatttctttgaagcattcaaaaactacgacgaagctggcaatccacggagaatccagtgtctcaaatatcttgttcttgccaatatgttgatggagtctgaagtgaatccctttgatggacaagaggccaagccgtacaaaaatgatcctgaaatcctcgcaatgacaaacttgattgcagcataccagaagaatgacatcatggaattcgagaagatcctaaagagcaatagaagaacaataatggatgatccttttatccgtaattacattgaggacttgttgaagaacatcagaactcaagtgctgctcaagctcattaagccatacacaagaataaggattccattcatttcacaggagctaaatgtcccagaaaaggatgttgagcagctcttggtgtcattgattctggacaaccgtgtccaaggccacatagatcaggtgaacaagctgctagaatgcggtgacaggtcaaagggaatgcggaaatatcaagccatcgacaagtggaatactcagctcaaatctatttaccagacggtgtccaacagagttgggtgagagatggcaggtttccattagtacctgctggttgagttgttttggtatctgggggcttaaatgtgaaggagtatcttgtccgtgaggtagggatcctggacgtgggtaaagtaacttgtcactgtaatgaacgtagcactccagtttgtggattatatcctcttatcttttctgtgatttggccagcgggatgctgggattttgtcctgagctgaaacggccctgctagttcctacttcatcctgcctagatttcactgtggtcgaaagctcggcagcgaatgcg

SEQ ID NO: 1952 - DNA, 423 bp, Triticum aestivum
  Clone ID: PAT_TA_1952
cccacgcatccccctcccgatcccgagcccacctgagcaaagccgccgtcacgccattgtcgtagacatcctctgaagccctatagcgccgcacactgttgtccaggagcagcaccatcgacctctacatcgactacatcaccggattggacgagaacgccactgcaatcgacgcatcgtccacctattcacccacggggggcggggccattgacgctcgatccctcatctccagtacgttcccggccacctcgagctcaccttcggcaccgtgatccaaggcatggagaactccaaggagtttgctaacaagttgttcgggatatgtcgaggcagaggaacattgagtcggatgaaggcattaacaaggatcggctcaaagagtggaacatgaacattgatgggatgctcacagaagatgag

SEQ ID NO: 1953 - DNA, 552 bp, Triticum aestivum
  Clone ID: PAT_TA_1953
gcacgaggcacgagatgagaggccgaacttggatttgctagccaagtaatctcgatcggttggtgtcagatcacggcagcctccctctccggcccctagcggccgcgatcgccgcggctgcaaactaagcactccaatggatggcgggtacaagaaggcggcggcgcgcgacgtccccggcgtgctgctcctcctcctcctcctcgtggtgtctctcgccacggttaccaggtcggcgtgggtgggcgactacgcgtcggaccacgggtgcgggaagacgttcgtggaggcgctgtgcgacccggcggacgcggcccagaaccgcgcctgcagcgacgcctgccactacaacggctgcggcggcggccgctgcgtctacgtcgccaccgccaggggctgctactgcaagccctagccctagcagtcgcttccatggttccatcctcctgccgcgctattgctagctagtcgatcatgtgtttccttgttgaattgaatttgaatttgaatttgaacttgaataaagaggtatgcatccagtctagtgtaggc

SEQ ID NO: 1954 - DNA, 803 bp, Triticum aestivum
  Clone ID: PAT_TA_1954
ggtgatcaatgatgagaatatttacctcttccctaaaaatggagggctgggacccgacccaaaatcatccgtcaaaattggaggcggtgaagggtccaactcaatagtgtttgcatccggtgaagatgttgatcgacctgcgcctcaggtatatgttgggcatcgcaattgtgagactgtgaagggtgtgacttttattgggccaaatcatgaatatgttgccagtgggtcagactgtggtcggttatttatttggaggaagagagatgggaaatttttacgggcaatggagggtgatgaatgcatagtcaattgtattgagccccatcctcatgctatgacaattgcaagcagtggaattgataatgatgtgaagctatggactccctctgccgttgaacgagcacaagtggttaatgttgaggagttgaagccccgaaagaggaaagcaaagctctggcaatttgccttgccggaggaattggtctggcacgtgctggcatcacgacgtaggcaaccagcggctgaagaagattcatccgaggatcttgaagacaacacagaattgcttaatcttgtactgcgagctacaaacagagataacttgtctgatgagagtgatgaggatgaagaaacctcggatggctctggagaatagaggccaatgatcaattgtccttgggggatattgcaaaattgtgtatatacgataataattactccattttcatggatgataatagtattagtgtgcctatgtagcttgtgattctcatctatgttaagatatgtgtgtttcccaa

SEQ ID NO: 1955 - DNA, 743 bp, Triticum aestivum
  Clone ID: PAT_TA_1955
attccgggtccactgtccggacgccaaagccttagcagctttcaggcataacgtccgagacgaatggctcgccagacacctcggccaagaaaagccaagaacaatggccgcactaacaagcctcatgacccgcttttgcgcaggagaggacagctggttggcaagatgcagcaccagcgacccaagtacatccgaaactagggatggaaacggaaaaccgcgacgcaacaaggaccgtcgccggactaaggaaaaaagtccgaagagcacggcagtcaacgccggattcaaaagctcacgacaaaatcagaaaaaactgccccccccaaggataacagggacgagctatccaacctaaacaaaatcctggacaggatatgtcagatacacagtactcccgggaagcctgctaaccatacccacagagattgttgggttttcaaacaatccggcagactcaatgccgaacacaaggggctcgacacactaagagaaggcgaggacgaaccccaaaagcagagcaccaggaaacaaaagaacttcccacaagaagtaaaaacagtgaacttacttcacataacaaaacgtgcggcgcccataaaggtatgcaacacacggtctatccccaaagggtcccgccactggttgtcaaaaccaatcatcttcgatcagctagattattctagaaatatcaagaatgcaggctggactgccttgatacttgatccaataattggcggact

SEQ ID NO: 1956 - DNA, 785 bp, Triticum aestivum
  Clone ID: PAT_TA_1956
gggcgcggaccaaagtccgccagctgctccggcggcgagcagcgccttcgccggacgggaccccccgctcctcccccccctcaagatgccgccgccgctcggcctcctccccgtctcctccgccgcggcgcccccgccgccggcgcccccctccgccgcccacaacaaccactgggccgcgctcgtccgcacctcccgcttctgcttcaattatagccatctcgccaccacgccgtctttctacagggctggctcgagattccgactacctgacgcgagggcagtacttatgttggctgatgatatggcttgtaatcctcggaacaattatcctgcccaagtgttcaacaatgagaaccaccagcttaatctttatggtgacaatgttgaggttgattaccgaggttatgaggttacagttgaaaactttttgcgagttttgactggaagacatgagagcgctgttccaagatcaaagcgtctgttttatgattagacatgccatatacatttgtacatgacaggagattgttaagatgaatttaatacctgacgagcggataatacttatgttggcggatgatatagcttgtaatcctcggaacaattaccctgcccaagtgttcaacaatgagaaccaccagcttaatctttatggtgacaatgttgaggttgattaccgaggttacgaggttacagttgaaaaactttttgcgagttttgacttggcagacatgagagtgctgtaccaagatcaaggcgtctcttaagtgatgaaggaagcc

SEQ ID NO: 1957 - DNA, 1485 bp, Triticum aestivum
  Clone ID: PAT_TA_1957
cccacgcgtccgcccacgcgtccgcccgttcttctgctcccttgcagaaccttgcggcgacgattctccaaagggggttgggcgtcggcgccgcagacctcgccgtagtggtggcccctcgcacctgctcccaaccggcgtgcccccgatgtggcggctgcccgggctgctctcccaggccgccgcggccgggagggcggcggcgaggaccagcagcagccacgtcagcggttccaagggcttctccagcggagggggcgggtccccgctgccccgagggtggctgcggaggctgtggatcgaggagctgaaaagggagaaggaagctgcgaggagactggggggaggcgtctgcaaggccgaaggtgttggcgaggatccgctcggctatttggccaacgccgcgcgcgcgttcgtgaattccgggtccgccgcggcggggattgacaagctgagggctgggggagcggcccgcggcgaggtggccccgtctaaaggcggccagtatgaccccaaggacctcccatacctagaggccaaactggagcctctcctctcaagagccaacctccttatagccagagatgtggaatgggcaaatatcatgtttgctttcgagcaggagagtagatatatcataatggatccactcttttcccagtctcctgtaggatatattcgagagaaaagcaatgtcatctttaggcagttactccggacgagatggtgatttactgcataatttactcacgctctgggtaatgagatattcacggtccgccggccattttggttcatcaacagctctatttatgcagaagtggatggcaaggaggtaggtgtagtccacaggcgctggcatctttggcgtagaatttatgatctgtacttagggaacaagcaatttgctgtggtttgagaatcctggattttggaactggacttttacccttattgatgaagatgaaaatgtgttggcccagattgaccgtaattggaggggaattggtttcgagctctttacggattctggccattatggaattcggtttggtgatgatggccaaagaagtagacttggtctcggttcagatatcgaagaactaaacgttgttcgcccgctgagtttacctgaaagggctgtagctcttgctctggcagtgtccctggactcagattacttctctaggagagggggctgggcactgccttttctcaccgccacagagtagacagcgcatacgaatgccatcctctcagttcgcagctgaatttaaatttccatttctttcgacattgatgtctgaagaagtggcgtcattcactgttgacacaccattgagatcattacacaagtgtgccgtgtttttttttttaccgtgaccgtacttggttgggcttttcgtatgaattttagtgcactctgagagagtagacagaaagaagttagacagctcacaacaaaacacgcccccagccccctag

SEQ ID NO: 1958 - DNA, 455 bp, Triticum aestivum
  Clone ID: PAT_TA_1958
gtgctttgctcctctatagttttggtggaggcgtggggcgcctgggcaactctcgccttagcccgtaaggaaagagtgtggagggatatgcagcggtcctcgaagcctaagcacccccttgccgcgtcgctaacctcaacgcatccgtgacagtcatttatttcccgatgagtcatctatcgttctcgctacaacactacagccacacccagaagattcacagttgggtaaacaaatgggaaagaacaacaaggcacaacaatgccaagacgaaggcaaacggcgtggaaacaaaccgctgcccgacgaagcggtgcgcctttcaagctcttcatgccgacgcggcaactttcatgtcgctcccactgcgcgcgcggtgttttcttgtctctcttcataccaactacttagtgttgccggagaatccattatataaagaggtctaacattttcct

SEQ ID NO: 1959 - DNA, 620 bp, Triticum aestivum
  Clone ID: PAT_TA_1959
gcacgagaaataaggaggagcctcaccaacggcggaggcccaaacaggacagttgttgtgtacattctcctgttcctgccatggaggcttggaggaggaatgccctgcgctgcgcgcttctcgtgctgctcctcgccatttcaagcggggtggcgagggctcaggggggcggcgagtgctggagcacggacatggggtacggcatctgcgtgaagcccggggggtgcagagctgcctgccatgccctcggcaagaacgacggccagtgcaacgggggctacttctggccggtctgcgagtgcctgtctccacactgccactaggatcggattggtgttgctactaggcaggcaggcgcctcgtctcctcgtccgtcggtcgtcgtcagttgagcacctccacttgagcagcttcagcctgcgacgttgtatcaagttacggcttagctatgtgtgcgttaaaacttgaagtatggtttgaggcatccccgcccttttggcccgcattgttgtttattttataatggcaaaacacaagtacgtattggtttacatgataaaaacttgatctcagttgaggcatccccgcccttttggcccgcattgttgtttattttataa

SEQ ID NO: 1960 - DNA, 1292 bp, Triticum aestivum
  Clone ID: PAT_TA_1960
cctctccccctccctccgccatcccctgcttccttcgtttccgcctcctccaccaccacagcccttctccgctccgtccctcccgcctcccgcggcgggctcgtggtggcgtgggcggccccggcccggcgcgcgctcgcggctcctctgcgcgcggcagcggcgcaggggtcggccaactccgcgccggtcatgatggagagcaaggtcaagaagaggaacaagaagggcgccggcgccgggggcctccccgccgccatcgacgtcgagatccgggaggccgagcagtacctcgccaccgacgggcaggaacctactccagaagacttcccctttgaaatggttgatgaagatgggatgagcgtggttattctgaaaagggactacaaggatgagaagattgaggtcattgtcagcatgcctaacgtggaaggggatcctgagtttgatgaagatgacgagggcgatgatgaggatgctgccaaggacgatgacgatgaagatgaggacggccaagaaagtagcctttctatgaaggtgatagtctccaaggaatctggcccgaacctcgagttcacctgcacagccttccacgaggagatcaccattgacgacatgatgatagcggagaaaacagagtctgatgcagagaaattcccctttgagggccctgagttcaccgagcttcctccgaacgtgcagaagggcctgttcaagttcctggaggtacgaggtgtgacgctgacgaccaccaacttcatgcacgattacatgattaccaagcagaccaaggagtacgtccggtggatgaccaagctcaagggtttggttcagtagtgacgttgaacagatggccttgccccgtgactcgacagcaaaatttggtagtgtagccttctagcacgcgtagcaagagcactaagaaccctgcaaaaccagtagtttgaagtgtatctgtagtcctgtatcagcagctagctaggcagagtgagttccatttgtgttcttctggagctggccggtgaaaatcctgtaggaaggtggttactagtagcgatgaaacaagacttcctgagcttaatacaagctgtgtttctgctacttttatgcttaaatatatccggtaaggccggtggttggtgaaaaaacagagtttgctcccctggtcagtttaagctggatggtgttgttgtgggaaaaagaaaagaagagatagattgtgtatttgtgttgcttttaatttgtgaaattgaaatgaattcggtggatgatttgatgtagcaaaaaaaaaa

SEQ ID NO: 1961 - DNA, 878 bp, Triticum aestivum
  Clone ID: PAT_TA_1961
ccgccgcaccgcacggacgcgtgggcgagccaaaccctagcgccgcccccctccccctcctgccgccggccgccgaccgaggtgaaggcagaggtgggaacacaaccaagatggcggacggtcatgataacgacaagaacattgagatctggaaagttaagaagctgattaaagggcttgatgctgcccgtggaaatgggacaagcatgatatcgctgatcatgccacctcgtgatcaggtctcaagagtaaccaagatgttgggtgatgaatatggaactgcctcaaacatcaagagcagggtcaacaggcagtctgtcttggctgctattacctctgctcagcaaaggttgaagctgtacaatcgagttccccccaatgggttggtgctttatactggaaccatcgtgactgatgagggcaaagagaagaaagtcacctttgactttgagccattcaggccaattaatgcttccctgtatctctgtgacaacaagttccacactgaggcattgaatgagctgcttgagtctgatgataagtttggcttcattgtcatggatggtaacggaacactttttggaacactgagtggcaacactagagaggttcttcacaagttctctgttgatctcccaaagaagcatggacgaggagggcagtcagcacttcgctttgcccgcctgcgcatggagaaacgccacaactatgtgcgcaagacagctgagcttgctacacaattcttcatcaaccctgccaccagtcagccaaatgtttctgggctcattctagctggttctgctgacttcaagactgaactgagtcagtctgacatgtttgatcagcgcttggcaaccaagatactcaagggggttgat

SEQ ID NO: 1962 - DNA, 1836 bp, Triticum aestivum
  Clone ID: PAT_TA_1962
cgtccgcgcccctcctctctccatctcacaaacacaacagctgaccctgtcccctgcggccctcatcccgacgccgcggctccgggggctcccgatcgaggcccggatcgctggaatccgtgcggcgccgaggtcgcgtggggtgcgaattggaagcagcgagctgtacttccggacccgaaaagtgggcagttccggggcaatcgcctttgggtggactgtgtgagggagaaagggaagagcggaaaggttgccggagctcaggctttggttatctgagaatgatggaagcgggcaagttccccgggataattggtgccgtaagcggccaggacggtggcgtcaacttctgcgacatggcatactaccagaagctaggggagggctccaccatgtccattgatagccttaacagcatgcagaccagcatgcacggtggttccataatgtctgtggacaacagtagtgttggttctactgactcgcgtactgggatgcttaaccatcctagccacaggggacctgttgctgtggtcagctactcggttgggaacagcattttccgtcctgggcgggtgtctcatgccttgagtgatgatgcgttggcacaggctttgatggacactagattcccgactgagacactcaaggattatgaggagtggaccattgatttggggaagctccacatgggattgccctttgcacaaggcgcatttgggaagctatacagggggacctacaatgggatggatgttgccattaagcttttggagaggcccgaggctgaccccgcacaagctcagctgctggagcaacagtttgtgcaagaagttatgatgcttgcagagttaaggcatccaaatatagtcaagttcgttggcgcatgcaggaagccaatagtttggtgcattgtcacagggtatgcaaagggtggatctgttaggaatttcctgaataggaggcagaacaggtctgttccactgaagctggcagtgaagcaggcactagatgttgcacgtggcatggcttatgttcatggccttgggttcatccacagagatcttaagtcagataacctcttgatttctggtgataaatcgatcaagattgctgacttcggagttgctaggattgaagtgaagaccgaggggatgacacctgaaacaggaacataccgttggatggctcctgagatgatccagcacagaccatacaatcagaaagttgatgtctacagttttggcattgtcctgtgggagctaataactgggacccttccttttccaaacatgacagcagtgcaagctgcatttgctgtggtgaacaagggtgtccgcccagccataccccatgactgcctacctgcccttggggagatcatgacaaggtgctgggatgcaaaccccgatgtccgccccccttttaccgatgttgtgagaatgctggagcgtgtggagatggaggtcctgaacaatgtccgcaaggccagattccggtgttgcatctcccaacccatgaccttagactaaagcaggcagaatccaggagaagagaaagcaatctggagagaagttaaatcccatgtatttatcatattaatacttttgatacagaagcagaaaagcccacctgagcatacgtgtgtgctcgggcttcacatatttatcttagaccataccatagtccctgtcgtcgtcttaaaactgtcattgtactggagacaggtttatccttaacattgtcagaacattgtcatgtggtttccaaaaaaaaaaaaaaaaaaaaaaaaaaaaaaaaaaaaaaaaaaaaaaaaaaaaaaaaaaaaaaaaaaaa

SEQ ID NO: 1963 - DNA, 2029 bp, Triticum aestivum
  Clone ID: PAT_TA_1963
ggcccccccccccccgctcccgtctctgtcctccccgctcccttcgccgcccggcccaagccgaataagctgcggccctccccaccttgggttgcgccggccgcaccctgcagttgtttctggagcatgggggcatgttcagcgacatgaggccaatttgctgcgggaaccttgactatcatgccccccagtcggaaatcgagcgtcttttaggcaaatatggtggagtggagcgaggtgacatgcaaactggaattgcattggtctactgaggagatgaacgtgatgctggagatgctttccatagacttgacagagctgactttggtagaaaagcgaggagactgagagtcgaatggacaaaggaggatcgcagtggtggtcggaaaggaaatgggaagagatctccaagcagcgtgaaaccaaccaaaaccttgtttgtgattaactttgatccgatcaacacaaggacaagagatctggagaagcactttgatctgtatggcaagattgcaaatatcagaatccgaaggaactttgcatttgtccactatgaaacacaggggcattactattaaactcacggcgatgcccagggccctctctgtttagtatgcacttcgtgacgacgatgaaaaaaggaaccggtacaggccaaaaagagaggggaggaggccgtcatccacctcctggcctctgggacaaccgggctaggtgcgcaagtccttatggcgagagggcggggaaaggggcagcccagactatggcaggggcagggagaggggcagcccggactatggcaaaggtggtgccagagatagtcctgactatgtccgtggtggaagcccatacggcagcaaaggggatgacagggctagccccaagtatgaccgtgaacgccgtgaagccagtcctgcctatgacaggcgccgcagccgctcgcctgcaaggtcgcctgcaagggaagatagggactgaaactgtgcatggttgtgctcaacgccacctgcttcggaccaaatggctgcacctgtcatgagtgtgatgctcactcaagttggttatgttaagtagccagaaacttctgtaatatctctattagctagctctagctgaatgctttgtcaatttggtttgaactgtcatgattgttagcttaaactttgtcctttcggattcttggcaagattgcaaatatcagaatcagaaggaactttgcatttgtccagtatgaaacacaggaggatgctactaaagctctggacggtaccaatggaagcactgtgatggacagggtcatctctgttgagtatgcacttcgtgacgatgatgaaaaaaggaacgggtacagtccagacaggagaggaggccgtgatagatctcctgacagaagggacaatcgtggtaggtcggcaagtccttatggcagagggcgagaaaggggcagcccagactatggcaggggcagggagaggggcagcccggactatggcaagggtggtgccagagatagccctgactatgtccgtggtggaagcccatacggcggcaaaggggatgacagggctagccccaagtatgaccgtgaacgccgtgaagccagtcctgcctatgacaggcgccgaagccgctcgcctgcaaggtcgcctgcaagggaagatagggactgaaactgtaccatggatggttgcgctcaacgccacctgcttcggaccaaatggctgcatcgtcatagtgcgatgctcagctcaagttggttatgttcagcagccagaaacttctgtaatatctctattagctagctctagctgaatgctttgtcgatttggtttgaactgtgatgattgttagcttaaactttgtccaaagggattcttccagtgagaccatttgcggagcgatgagatgtaccgtgtatcgaccgacagcagaattctagctttgcactttggttattcttccatgttcctaggaaaaaaacagcggaatcgaaaaattaaaaaatggtggacgtgtaggaacagaagag

SEQ ID NO: 1964 - DNA, 398 bp, Triticum aestivum
  Clone ID: PAT_TA_1964
ccggcacggggtgtcctacgtggggcccggcacccggttctcgccgctggtgcccggcgccaccagcttcccgcagcccatcctcaccgccgcgtcgttcaacgcctccctcttccgcgccatcggcgaggtggtgtcgacggaggcgcgggcgatgcacaacgtggggctggcggggctcaccttctggagccccaacatcaacatcttccgggacccgcggtggggccgcggccaggagacgcccggcgaggacccgctgctggccagcaagtacgccgtcggatacgtcaaggggctccaggacgccggcgcggcgggcgtcaccgacggcgcgctcaaggtcgccgcctgctgcaagcactacaccgtctacgacgtcgacaactggaagggcg

SEQ ID NO: 1965 - DNA, 1225 bp, Triticum aestivum
  unsure (1)..(1225): unsure at all n locations
  Clone ID: PAT_TA_1965
ccacccgtgcggaggccggctagcactagcagcaatggccacggcggcgcgtcctccgttcctcgccgtgctgctgctgctcgtggcgacggtgatgctgagctgtggcggcaatgtagaggtggcggaggcgcagacgccggtgttcgcgtgcgacgcgtcgaacgcgacgctggcgtcctacgggttctgcaaccggaaggcgtcggcgtcggcgcgggccaaggacctggtgtcgcggctgacgctggcggagaaggtggggttcctggtgaacaagcagccggcgctggggcggctgggcatcccggcgtacgagtggtggtccgaggcgctgcacggcgtctcctacgtggggcccggcacccggttctccccgctggtgcccggcgccaccagcttgcccgcagcccatcctcacaacttcaatcttcgggtgacggcccatgacatcgcggacaccttcaacccgccgttcaagagctgcgtggaggaaggccgggccagctgcgtcatgtgcgcctacaccaacatcaatggcgtccccgcatgcgccagcggcgacctcctctccaggaccttcaagggagactggggcttgaacgggtacgtttcgtcggactgtgatgccgtggcgctcatgcacgacgcgcagttctatcggccctcgccggaggacacggtcgcagttgccctcaaggccgggttggatttgaactgcgggaactacacacaggtgcacggcatggccgcggtgcggcagggaaggatgacggagcaggacgtggacagggccctccgtaacctcttcgccgtccggatgcggctcgggcacttcgacggggacccccggggcagcgcgctgtacgggggccttggcgccaaggacgtgtgctcgcccacgcacaagaacctggcactccaggcggccacgagcggcatcgtcctgctcaagaacgacgccggcatcctcccgcttcgccggggcgcggtggcgtccgccgccgtcatcggccataacgccaatgacccccgcgcgctcaacggcaactacttcggccctccctgcgaagaccacgacgcccgctngcaggggctccaggggtatcgtgcaagaacgtcaggttcctggccggggtgcgactcggcggcgtgcggctttgccgcnacgggccaaggcggtggggctaagcggcctcgntcgggactaaggtgtttcctgttn

SEQ ID NO: 1966 - DNA, 1293 bp, Triticum aestivum
  Clone ID: PAT_TA_1966
cggacgcttgggtcgcccacgcgtccgggggcggggggcaggggctctggagcgaagcacggacatatggagacatccaattgatgccatttgttgattattacagcttgattctttggaagaccattgccatttgcatatatggaacaaatgtactttcagccaagtatgttatgaaaaccgaggaggacgctttcgttcgtgtagatgagatactttcgtccctacatcaagtaaatatcagccatggactgctgtatggtcgcgtcaattctgattctcagcctcaccgagatccgtatagcaagtggtacataacttcagaggtaacagtttaaattatatttttttctattgcacaattatgcaagcgtgtttttagcacagggaaagtctttatctgcgcgatggaaatttagtttttgttcaaaccaatgatggaaacttcaccactaatgtgttttggacggccatgtacattgtgcattatcttttatcatgtagcagatgcttagcaaatgtttccgcctttatgtaggaatggcctgaagagagttatcccccatgggcacatggaccagggtacattgtatctgaggatatagcaaaagaagtttacaggaaacacaaaagaggggagctaaagatgttcaagctggaggatgtggcgatgggaatatggatcaatgagatgaggaaggaaggcattgatgtcacgtaccagaacgacggaaggatcttggtggaaggctgtgaggatgggtatgtggttgcccactaccaggagccaaggcagatgatgtgcctctgggacaaattccagaaaacaaagcgaggaaactgttgcaacgagtaagggtgaacgatcttctatgttctgatggctactgcttgctggcatctaacggcaagtttgagaacatccatgaaagaggagccagagagcttctcgcggatggtttctgatcacaattgacaggccacaatttttttttgacatcggccattcttttgtgtccgtgttctggagtagttccctggcttacaaccatatatttttgtaggagatgtagtaggtcccttcggttttggccataggtagggaggtgtggctgcttgtaacatatcatacgagaacgtagggctacatttttaggatagttgggagggccagctttagccaagaaaaatcagtggatgaattttgcatccgtgtaaagctattcgagaaccacttgtataattgatagtccacttgtgtttaaaaaaaaaaaaaaaaaaaaaaaaaaaaaa

SEQ ID NO: 1967 - DNA, 659 bp, Triticum aestivum
  Clone ID: PAT_TA_1967
acggactccaatacacgcggtagccaaagctccccactcctccccattccacgccgccgcaccccgaaccctagcgccccatccatccagcgagcggtagccatgccggcggacgcgaagatccggtggggggagctcgaggaggacgacgggggcgacctcgacttccttctcccgccgcgggtggtcatcgggcccgacgagaacggcttcaagaagacgatcgagtaccgcttcgacgacgacggcaacaaggtcaaggtcaccaccaccacccgcgtccgcaagctcgcccgcgcgcgcctctccaaggccgctgtcgagcgccgcaactgggccaagttcggcgacgccgccagcggcgacgacgcctccgcgcgcctcaccgtcgtctccaccgaggagatcctcctcgagcgcccgcgcgccccagggagcaaagctgatgaaccaagtgcttctggtgacccactggcaatggcaagcaagggaggtgctgttctcatggtttgcagaacctgtggtaagaagggtgaccactggacctcaaagtgcccctacgtacacctcgctccaccaactgatgcatcggacatgcctcctacacctgacgcgctgccagcactgagtggccctgccaagggctcattacgttgctc

SEQ ID NO: 1968 - DNA, 775 bp, Triticum aestivum
  Clone ID: PAT_TA_1968
cccacgcgtccgcaaagccagagcgcccgtctctcccccctcccacgccgccgcacaccgaaccctagcgccccagcgagcgagcgagcgacagccatgccggcggacgcgaagatccggtggggggagctcgaggaggacgacgggggcgacctcgacttcctgcgccgccgcgggtggtcatcgggcccgacgagaacggcttcaagaagacgatcgagtaccgcttcgacgacgacggcaacaaggtcaaggtcaccaccaccacccgcgtccgcaagctcgcgcgcgcgcgcctctccaaggccgccgtcgagcgtcgcaactggtccaagttcggcgacgccgccagcggcgacgacgcctccgcgcgcctcaccgtcgtctccaccgaggagatcctcctcgagcgcccgcgcgccccagggagcaaagctgatgaaccaagtgcgtctggtgacccactggcaatggcaagcaagggaggtgctgttctcatggtttgcagaacctgtggtaagaagggtgaccactggacctcaaagtgcccctacaaggacctcgctccaccaaccgatgcatcggacatgcctcctacttctgacggccctgcagcactgagtggccctgccaagggctcatacgttgctccaaggctaagggctggtgctgttcataccgatgctgggcacgacatgaggcgcaggaacgacgagaacagtgtccgtgttaccaatctgtctgaggacacccgcgagcccgacctcctcgagct

SEQ ID NO: 1969 - DNA, 1180 bp, Triticum aestivum
  Clone ID: PAT_TA_1969
tcggcaccaggccaaagctccccagcccgccccactcccctcccccgcccccgcaaccctagcgccccatccagccgagcgagcgagcgggcgacagacatgccggcggacgcgaagatccggtggggggagctcgaggaggacgacgggggcgacctcgacttcctgcttccgccgcgggtcgtcatcgggcccgacgagaacggcttcaagaagacgatcgagtaccggttcgacgacgacggcaacaaggtcaaggtcaccaccaccaccctgcgtccggcaagctccgccgcggctgcgcgcctctccaaggccgccggtccgagcgccgcaactgggccaacgttccggcgagaacccccgccatgccgcgcgatccgaccgcctccgcgcgcctcaccgctcgtctccaccgcagagaggatcctcctctgatgcagcccgcgccgccccatgaggagcaaagctgatgaaccaagtgcttctggtgacccactggccatggcaagcaagggaggtgctgttctcatggtttgcagaacctgtggtaagaagggtgaccactggacctcaaagtgcccctacaaggacctcgctccaccgaccgatgcatcggacatgcctcctacttctgacggccctgcagcactgagtggccctgccaagggctcatacgttgctccaaggctaagggctggtgctgttcataccgatgctgggcacgacatgaggcgcaggaacgacgagaactctgtccgtgtcaccaatctgtcggaggacacccgcgagcccgacctccttgagctgttccgcacgtttggcccggtcagccgtgtctacgttgcggtggatcagaagactggaatgagcaggggctttgggttcgtcaactttgtccacagggaggacgccgagaaggccatcagcaagctcaatgggtatggttatgataacctcatcctccatgtggagatggctgcacctaggcctacttagttacttgcctactaagcatccagatttcctacaagtgtcgtatcattatggtctccgaaataccagtacttttgtgtcgtgagcttgtgtctgtgttttgccttgttgagaataactacactctgttggtgaaaaagtgaatttcgtaaggacggcacttgagtttatatttccaaaaaaa

SEQ ID NO: 1970 - DNA, 783 bp, Triticum aestivum
  Clone ID: PAT_TA_1970
gaattcgacgcgaaggcaattgaaaagcccagcaaataagcatagggagaagctcagcaatggccatcaccaaccttgggttcgctgccatgctggtgatactactgcaagtgtccacgttatgcgccgtggcacagcaccacggcgtgatgacgctgaacgggttcgagaaaggccaggacggcggtgggccgtcggagtgcgacggcaagtaccacagcaacaaggaaatgatcgtggcgctgtccacccgctggtacggcggcggccgccggtgccagaagatgatccgcatcaccagcgagcacaacgggcgcaccgcacaggcaaaggtggtggacgagtgcgactccagcaacggatgcaaggacagcatcgtcgacgcctccgccgccgtgtggaaggcgctcgggctcaacaccgacatcggcgaggctcccgtcacctggaccgacgcctgaaaccatgcatccatccaccgttaataaagcagcggccggcgaccgcaaagacgacatgcagtgctcatcggtgcagtcatgtcgagtacgtatatacgcatatatatggcagaataaactacccgtatggatagcagtgcgggtttatcgagtatcttgtaagagtcatgtgagtctcaatttaactagtcggttttttctgttgtgcaataacccgacctatttgtactactcttgttgtattacggaagaaatgctagctcttcagtagtcttcactaaaaataactagaaaaaaaaaaaaaaaaaaggcccctagggcc

SEQ ID NO: 1971 - DNA, 574 bp, Triticum aestivum
  Clone ID: PAT_TA_1971
ctctgttgccgctccgattcgccacgtgcctccactgctggctcgtcggtcccttgcgccccgcatcatttgttttgcattgtttacctgcgcccgcctgtttcttacattggttcacgaagctactgaccctgaaagagtggtgatgcgagtgagattctgagagatttctctcggatcaaaaggagctcgacgttatgcttcacagatctcttcctgctcggactggattcattgcttcataggtatcttgcagctcgcattggtacgaacacactcactgctgaatttagttagttacacttgatgagcatatgcaccttctatttatttcagtgcatattacatagtaaaataccatataaatttcttcctcttgattattctattctatttatttgttcaaacatattggctgcaatctacttcaaggcatcctggtaggcatttagtcttacgtagtaatgagcaccctctcctgttaatcacaacatgttgtcactgcccttatattgaggtcagttaggataatacaaatagtttacccttatgatatctatgagttagccattat

SEQ ID NO: 1972 - DNA, 1178 bp, Triticum aestivum
  Clone ID: PAT_TA_1972
acttggacataagcatcggccacccagtcggctgaagcccctccaggggcggcagcgacctccatccccaccacgctccccagccctccaatggcggccgcgacctcctccttcgccacgctcgccatcgcccccccggcgccggcgcggtcggcggcgcagagcgcgaccccctcctcggccacgcccgcctccgcccgcccggcgggctgggggcgcgtcgcgcccccggcgctctccgcctcgaaggtgccctggtcgcgcctctccgtccgcggcagcggcgacgcgtacccggccctctccgactcccagcagagaaacgcgcgcttctgtggcatccgcctgcgcagaaccgtaggcacctaagctgcagagcaaagttacagagccaaggtggtactttcgacataagcattcgcaaccctgtcgggaagaatgttggaaggattgtcatcgggctctatggggatgacgttccacaaaccgttgagaacttccgtgctctctgcgctggggagaaagggttcggatacaagggatcaagtttccaccgtgtcattaaggacttcatgattcagggaggagactttgacaagggcaacggtactggagggaaaagcatatatggccgcacctttaaggatgagaacttccaattggttcatactggacctggagtgctcagcatggctaatgctggaccgaacaccaacggcagccaattcttcatctgcacagtcaagacaccgtggctggatgggagacacgttgtctttggccaggttcttgaaggcatggacatcgtaaggacgatagagtcgtcagagactgacagaggtgaccgtccgaagaagaaggtggtcattagtgagtgcggggagcttccagtggtctgagttttatttagatggcttatcaccttccatctgcgcatctggattttgctgtggacttgttacaggtctttctcctagtagttagagaccgcactgagttgaacccaagatttctactctgaggcatacggcattcatctactgttcgactggaataagaatgtgattgctttcctcaacctgttttgtagcattgttcatgatagataatgccttgtgaattttctggcagatccatgaaatgcctggatatctcttatctatttgtttttacctgct

SEQ ID NO: 1973 - DNA, 665 bp, Triticum aestivum
  unsure (1)..(665): unsure at all n locations
  Clone ID: PAT_TA_1973
gttcatcccaacaaagcgttcaaacctctcccctcaagtgttgtccaataaccactacttctctccaccctcttcttcggctctctcgagcgaaagcaaaaaaaatgtcggagggcctcatcccgttcatctacagggccgtggcgcagtacaggaaggaggggcaggtctccctcgccgacctcctcttcgacgagcagccgtcctcgtcgcccacggcggcctcggcctacttccgtctcgccggggactccggccgccaccagctcttctcggccgactccggtgcggccggagcggcgcggcggtctccgccgcaccgtcggcgcaccatggagcatggatcgtggtgactgactgtgattgaagcgcagaaagtcatccaagggataataagaaaacaaagcaaagcaggtgaagacttgcctaggtacgtcgtccagtacatgcagatacgatgtcgattgctgagcagctgcacgtattggcctagctaagctaatacgagctgcagacctgcagtttatgtgtgctatacatgcatatatttgtactatttcgttaaccaantncngtttaaatggtcaacttgttaaatattggggaattgaanaaaacnccaagggacctncccaaanggaaggactgtttaaaaaaaaatnttt

SEQ ID NO: 1974 - DNA, 750 bp, Triticum aestivum
  Clone ID: PAT_TA_1974
tggtaagacatcaggaggttcaagtggcaaaacctctggtggctcaagtgagaagaaaaatgaaccaaatgaatcagtagagttgaattcgagtaactttgatgaactcgtcgtcaaaagcaaggatctttggattgtggagttctttgcaccgtggtgtgggcactgcaagaaattggctcctgaatggaaaagggctgcaaagaacttgaagggtcaagtgaaactaggccatgttgattgtgactctgataagtccttgatgagcaagtacaaggtagaaggttttccaactattttggtatttggtgccgataaggagagcccattcccctaccagggggctagagctgcttctgccatcgagcccttcgcattggagcagctggaagcgaacgctgcaccacctgaagtttctgagttgactagcgcggatgtgatggaagagaagtgtgcttctgctgccatttgctttgtgtctttccttccagacatccttgactcaaaggcagaaggaagaaacaagtaccttgagctgctactttctgttgctgagaaatttaagaagagtccatacagttttgtctgggcaggtgccggcaagcaagctgatctggagaagcaagtcggagtcggtggttatgggtatccagccatggttgctctcaacgtgaagaaaggcgcatacgctccactgcgaagcgccttcgagctcgccgaaatcaccaagtttgtgaaagaggcgggggc

SEQ ID NO: 1975 - DNA, 1615 bp, Triticum aestivum
  Clone ID: PAT_TA_1975
gcgcccgtccgcgccacgatctagccccccctccggcttccagaagcttctcgacggcgccatgcgtccggccatcctcgccgccctcctcctccttctcgccgccgcggcctccccggcggccgcactctactccgccggctccccggtcctccagctcaaccccaacaacttcaagaaggtgttgaacgcgaacggggtggtgctggtggagttcttcgcgccgtggtgcgggcactgtaagcagctgacgccgatttgggagaaggccgccggcgtcctcaagggcgtcgccacagtcgccgcgctcgacgccgacgcccacaaggagctcgcgcagcaatatggaatacggggattcccaaccataaaagtgtttctccctggcaagccaccagtggattatgaaggcgcaagagatgtaaagccaattgtaaattttgctctgtcgcaggtcaaaggtcttctcagagataggttggatggtaagacatcaggaggttcaagtggaaaaacctctggtggctcaagtgagaagaaacatgaaccaaatgaatcagtagaattgaattcgagtaactttgacgaacttgtcgtcaaaagcaaggatctttggattgtggagttctttgcaccgtggtgtgggcactgcaagaaattggctcctgaatggaaatgcgccggtggtgtgggcactgcaagaaattggctcctgaatgttgattgggactctgatacgtcctggatcaagtgaaactaggccataggctttgcaactattttggtatttggatccgataaggagagcccgttcccctaccagggggctagagctgcttcggctatcgagtccttcgcgttggagcagctggaagcgaatgctgcaccccctgaagtttctgaattgactagcgcagatgtgatggaagagaagtgtgcttctgctgccatttgctttgtgtctttccttccagacattctggactcaaaggcagaaggaagaaacaagtaccttgagctgctactttctgttgctgagaaatttaagaagagtccatacagttttgtctgggcaggtgccggcaagcaagctgatctggagaagcaggtcggagtcggtggttatggttatccagccatggttgctctcaacgtgaagaaaggcgcatacgctccgcttcgtagcgccttcgagctcgccgaaatcaccgagtttgtgaaggaggcggggcgcggcggaaagggcaaccttcctctggagggcgcccccacggtggtccagtcggaaccatgggacggcaaggacggagaggtcatcgaggaggacgagttctcgctcgaggagctcatggccgacagctctccacccaacgacgagttgtgattctcaaaccgtcctagcgtttagaggaacactgatgcttcacttgttctgatgtacactgtacaatttggacgggacactttttggaacgattttcttttgtcgatgttagtattgtgggagaaaacgaaagctctgatgtgcaaggtggggtgggggtgtctttgcccctgaaataaaaccggttctgagttttgtctttgcccctgaaagaaaaccggttctgatttt

SEQ ID NO: 1976 - DNA, 174 bp, Triticum aestivum
  Clone ID: PAT_TA_1976
gctggtttcttcttctgaaatcccatgtattactagcagagtttgtttgttttggtctacagaaagttcatatagtttttcatgtgcgtaatatctatatggacaagatgagtttactgttttttgccttttctatgttacaagatactggtaatatggtattgtttcttctgt

SEQ ID NO: 1977 - DNA, 379 bp, Triticum aestivum
  Clone ID: PAT_TA_1977
cggacgcgtgggcggacgcgtgggaaagaatggcgggggacggcgagcttcttccccggatcgcggtggtcggcgcgggcatcttcgcgcgcactcagtacatccccaggctccgcgagatctcccacctcgtcgtcctcaaggccatctggagccgcacccaggaatccgcagaggctgccgcggagctcgcccgcgattttgcgcctggcatcgagtgtaaatggggcgacgcggggctggaggagatcatgggagacccttccatcctgggcgtagccgttgttcttgcaagccaagtcaggttgagcttttcttgaagatgctcaaggcaggaaagcatgtgatccaagagaaacctgcctctggatcgacaacc

SEQ ID NO: 1978 - DNA, 1462 bp, Triticum aestivum
  unsure (1)..(1462): unsure at all n locations
  Clone ID: PAT_TA_1978
ggtcgacccacgcgtccgatctgattcaggtcctcccttcccttcacttcagtcgtgaagcaaaccatactccaaagaatggcgggggacagcgagcttcttccccggatcgcggtggtcggcgcgggcatcttcgcgcgcacgcagtacatccccaggctccgcgagatctcccacctcgtcgtcctcaaggccatctggagccgcacccaggaatccgcagaggctgctgcggagctcgcccgcgattttgcgcctggcatcgagtgtaaatggggcgacgcggggctggaggagatcatgggagacccttccatcctgggtgtcgccgtcgttcttgcaggccaagtccaggttgagctttccttgaagatgctcaaggcaggaaagcatgtgatccaagagaaaccggcctctggatcgacaaccgaagcagaaactgcgctatcagtctacaactcattcccaaacaagttcccctataagccaatttgggctcttggagagaactacagatttgaacctgcatttgtggagtcaagcaagttgatgaacgatattggtgatatgatgaacatccaagttattgttgaaggatcaatgaacagttcaaacccatatttcaatagctcctggagacgaaattttgtgggtggtttcatattggatatgggcgtgcatttcattgcaggactaagaatgcttgttggttcggaagtagcaactgtatcgtctatctctcgtcatgtggacacggatttgccaccacctgataacatttgttctcttttccaactggaaaatggatgtgctggggtcttagtatttgcagttaattcgaggtcgccaaagatattgtggcgggttgatggaacaaagggaacagtaaaaattgaacgtggagatgatggtgggaaacatggttaccaggtgcttttctcaagtgaaagtggggagtgccagaagactttttacccattctgtggtgtgcatgaagaactgaaagcatttgtccatgacatggtgcaggctagcaaagatggggatcacaaggctgaaccccgcagttcttatgtcgaaggtgctcgtgatgttgctgttttggaagccatgcttgaatctagcgcgaagcaaggagccatggtgcaagtgaagaaattctaacaaatctcaattagcaaatgagggaacatgaacattcttctgctagaatgatcgggctggtaggacgtgaaaatttgtagcatcggcgacaaaaggaacatcattttatgattattatgcaattgatgctataggataggatgctgcaagtcgggctgttccctggaaccatcattctttcacacagatctatatgacagctgctacagatttatttaccatatactgtactatctatcacgtatactcttgctactatcctggttgccttttcctgccttttttggtnaggaaaaaa

SEQ ID NO: 1979 - DNA, 713 bp, Triticum aestivum
  Clone ID: PAT_TA_1979
gttttctctccttctacatccagtcctcttccttcatccccacctctcccttccaccaacccccgccgccggcgtatggaagccacgggctcccctatgcatcctcgcaggattccaacccccggcactctccgctcatccgtgccgcacgccgccacttcctcccccataggaacacctcgaggtttgaacccgacgtgtcctacccgttgcccgaggtcaaagtttgttcatcatccgagctcatttagatacaagaggatgctgccatttctcatggagaacggtggccaagcttagaaaattttcttaagataaacaaactgtcatcagatgagatttaatctgccaccgtagaagtttctctggagagcactgtagaaagccacaccagaataagagttagcttcagttggggacccactgccgtgcgtacattgctccaaaggttttgcaggttatgggagtaaaggagctgctctagatttgtgcacatcattctcagctacaaagtcacatatactactgtgtggaaagatcaaacgaaaaaaaacaaaccagattattgtctagtttgtagctatgttttcatagtacctacaaaatacatttctttttttggtacatggacatatgtcctgctgttttatgtgtgaaataagactctctatgcgctctcctatatatttgcacattttctgcattttttgcag

SEQ ID NO: 1980 - DNA, 368 bp, Triticum aestivum
  unsure (1)..(368): unsure at all n locations
  Clone ID: PAT_TA_1980
cccacgcgtccgcggtgactctggcgcaaacgtcaaacgccttgagcaagagacaaacgtaaagattgagcagctcaagcagcaggcagcaaacatctctccagaggtgattcagatgcttctgaggcacgtcacaactgtgaagaactaaaggttgatgagtcagccctgcatatgatggcaactttgtactatctgttcatttctttggcaggtattataagaaatggcttttgccacttccagctgtaattccttgttgtcttggaaataagctgctacagttcagcagcagccatgtctgatactacttgctaaacctttggtgattagttcgtaaattttgtcgatttcnngnnnncntntnt

SEQ ID NO: 1981 - DNA, 734 bp, Triticum aestivum
  Clone ID: PAT_TA_1981
cctctctctgtctctcgtctcctttcgccgccgccgtcgccgacgctcgccctcctcgattcgacgccgttcttcggttcagacggtgccgtgccgttggggttgccttgccggtcgaccggagatggagcttatcgtttgagcctctgccctccccgtcgaggtcgctcctcaccatcgcaggcacggtctggtcggggccacgacgacgagaggagcagcagaggataacttttccccacggatccttctcgtcttccacgtgattcgagtctcctctctccatcaggttttgaaggcggttttgtgtagaacagccacggagcagaaacaacgaacatgctgcttcagcaacagctggcatcatacggtgaaggaggggatctggatcaagagccgtaatggtgcttgtgatggcatgtctagcacttgctcgaccctggagtctgacttcttcttgcaagttgaccatactattgtgagaatctcagccaggatcattctttatatcatgttggatcatcttggaatttgtagagccatttaccatcgaaggatgtactcacagaacaaatcagtgtgactatgcttttctacacttctgtccaaagtaatgggatatgtattctgtactgtacagctaccctttaatgcactactcagccttcaatctctgtatgtacaaatgacttgatctaattattatgaatgacatatggagtgtgctgctttct

SEQ ID NO: 1982 - DNA, 862 bp, Triticum aestivum
  Clone ID: PAT_TA_1982
ggcctcgagtccagccacctcccccgtccacatccccgcgcccgcctccctccctctgcaattggctcgatttgggcggttttcttggcctcttggttggagcctagggccagcgccaccaccaacctgcgcgtcccgtgtgaaattcgtgttcttgcactcctccgagcctgtccggagcgagctgcctctgctgggtcgagttcttggacttcttccggcgaattggttggcttcgagtgagggaggggtggggatttttctggagttgttgtcctcatgaggacggacgtgaggaggggcgcggcggcggcggggagggaccagttccccgtcggcatgcgggtcctcgccgtggacgacgacccggtctgcctcaaggtgctcgagaccctcctgcgccgctgccagtatcacgtgacggcgacgaatcaggctgttatcgcgctgaggatgctgcgggaaaacagggacatgtttgatctggttatcagtgatgtgcacatgccagacatggatgggtttaagcttcttgagcttgtggggcttgaaatggacctccctgtcatcatgttatctgtgaatggagagacaaaaactgtaatgaaggggataactcatggtgcttgcgactatctcctaaaacccgttcgcatcgaggagcttaggaacatctggcagcatgttgttaggaggaaattcagtacccgtgactctgttaatcttgatacctatgaagagtgcaataagccaccaagtgcggactctgactatgtgtatggccaagttacatgtgggtcgcccgaccaaagtgggaggcctagcaaggagaggaaggaataccaatatgaggaggaagatt

SEQ ID NO: 1983 - DNA, 854 bp, Triticum aestivum
  unsure (1)..(854): unsure at all n locations
  Clone ID: PAT_TA_1983
gcggggcgggggacgcatgggtccttggtccggcggcgtcggcaggatgctgtgcgccggtcttgctttcttgctagataagtatttaggaaaaatctacaatactccttcaaggtttatacatcaattgcaaagggttttaggaatgcatcactacattgttttgggtttatacatgaatctcgaagagttttataaatgtatcattatattgttttaggtttatatatgaactgcaaaagaatttaggcatgtgaaaatcagagctcaggaggcatgtgatattctttttctgtggtggcgtgtatgtattctgtgattttacttcctgtttggtttctctacctaggtaaatgactgattttgtcgataacttcattttggtccattaggtagtttatttatgctccagtgtttatagccatcttctgtaattaatctgatccattgagcggacatttccttttgttttcttttgtttgttctaaagctttccccaattctatctgtcaccgctgcattttttggattatgcaccagactaaatgtaggtgagctttgaagtatgtgtgttttcttagctttgtaacttatttccttgctgggttagcatttgggggtattttgttttgttgccaccttctttgtcatatagtttctggagggcaggccaacgcttcatgtcctttgtatagttaaatctaaatgcatgtattataaatgtatgttatacantggttttcccttttcgattttccttgctggttttaatcctccatgcctttcggggagaaactatgcttctatcctctctgggaaaactcattgttgtcatgaaacatatttcgcaggga

SEQ ID NO: 1984 - DNA, 1501 bp, Triticum aestivum
  unsure (1)..(1501): unsure at all n locations
  Clone ID: PAT_TA_1984
cgtgcgcccacgcgtccgcttgtctacattgaacagtccttcgacaaacatgactgggagcactcggagagggaccaccctagagctgtgtgaggatgcaagagacgacttattgatgtgagatcctgaacgcattaagcgggcagtaaatgaatatacttgcgacgctcttactctcaaggcaagtgaagtgggcactgtcactgaggccatataggctgtgaaacatgcaaaggatgcacattggggtgtgatggtgtcacataggtctggggacacggatgattctttcatcgccgacctggctgtcggtgcagcagctggacagatcaaagccgggcactttcccgcccacgcgtgcgagtgggagcagaggatagcttttccccacggtagcctttctcgtcttccatgccattcgagtcgcctcgcctttccccgtcaccccacacatcaactcaaagcaggcgcccccgagtggaatccagcaattgcttgctgcagagcaagaagctcagccagattgtaaatgctgctagggctgctaaaacggcgaggactcagggcaagccaaagaagaggctgaagagggagaaatagctgaagtaccgtgcaacaaatggcaggctgattttcaatgcaggaagctcaaccgcactgagacgcgggtgactctctggcgcaaacgtcaaacgcctttgagcaaggaagacaaacgtaaaggatgagcagcatgctcacaagcagcaggcagcaaacatctctccaaggaggtgattaaaggattgcttcacaggaagcacgtgcaccaactaagtagaaatggactaaatcgggttgatgagtataatggcaactttattactgattggtcaacttttgtactatctgttcaatttctttgggttagggtattataagaatatggcctttttgccacttggcaacttgtaagttccttggcttcatcattggtaaataagctgctacagttcagcagcagccatgtctgatactacttgctaaacctttggtgattagttcataaattttgtcgatttccgccctttttgtctctcccttggtatggctatcagtatatgtatttttttatgttgaagatatattattcaataatagtaaataagtttttaatccaaaaaaaaaaaattagtgcacctaagtccgctgccaaggacatgcagagccacacaaaatattatcctaactgctaagaatagaggcagaacttgtatcgctaaggggattacgaaggtaataattggagaactaccacgagctgactcgtgacaaactggtaccaaatagatccggggcgggggctcgttgcaaaactccccatacgcttcctcacacctcctcgctggacttctttcgacgctgacgtatgacttgcgtttcaaaaaaacacctgacaaaccccttccactgagtatacaaaggcccactttccttcaaatnccactaaggnatgacccct

SEQ ID NO: 1985 - DNA, 1199 bp, Triticum aestivum
  Clone ID: PAT_TA_1985
tttttttttttttgttttaaaccatcgcattcacatggcagcaaatctaacttaagcatttgcgactctgtacttgatcattacattactcagtctggaaacaagaaacaataccaggacataattcattgaaagaaacgcggcacggttaagttagcgattcaccgacgcaaaacggtagagatggtgaaacggtatgcattggaactacggatagcctcctactacttggcatagttcttcaaactgtaaactgtaagcaaaggaaccagatatgcgtccgggcaccatccttctatatataccctacaggtttcgccttctatctatctacttgtgtagcggtgaacttgaccaatctgcagtttcggtgatgagctccttgagtacgtgttttaggccattcatcttcttccgggctctcttctgaacctccgagattttgatttcagcgtcgttgagctgagaagcaactgttctctcagcatgttggaggagcttcttgtgtgatgctttttgcttgtcagctactcccttcagctctgcgtgataggcttcaaattcctcaagagagttcttgcaaccaagcaactgctgattaacctcctccttaaacttctcatgaagaacccttaactctacttatagctcttcaaatgttgattctagtcgctttcttttagattgtcgcgtggggggaagcttgtgcacatcatcctgcatctgcacctcaactccctcgaggtgctggcgtattatctctccagtacctgccagtatctcagaacttttgtttcttgtttcagacttgatcttggtttgaaaccttcccagcaccaccagtaactgatcaaaagccctggttaggtagtcatctgggcattgcactggttctttgtctgacattatagtttcttgtgttcctgaagtgacaaaaggaataggcgaaggtaagcgccgttttttgcctcttttaccatctttcatatgtgatttcctatccagattttctggagagattatcagggctgtctacatctgaaagccatttgcgagttttatatcctttcccaaagcttggaatagaagtttgagccatttcatcttcagttggcgaaatgggtgaaagatctggttgttttttgttctccctttcttctgaagaattaggagattcattttaggtaaatcataggttt

SEQ ID NO: 1986 - DNA, 1319 bp, Triticum aestivum
  Clone ID: PAT_TA_1986
cggacgcgtgggcaagcattcacatgcacgcgtaggtcccgggcttcgcctgctcccatcccaaccaccaccatgcctcccccgctgctcgtcttcgtttgcctcgtcctgttcgtccttcttggcgcgccatggccgtccgaggcgggggcgaggccgcagcttttcgcgctgcgggcgcgccagatgccggccagggcgctgccgcggcagcccagcaagctgcggttccaccacaacgtcagcctcaccgtctcgctcgccgtcggcacgccgccgcagaacgtcaccatggtgctcgacaccggcagcgagctgtcctggctgctctgcgcgccggcgggcggcgccaggaacaggtacaacgcgacgtcctttcgtccgagggcctcggccaccttcgccgccgtgccctgcgcctccgcgcagtgccgctcccgcgacctgccgtcgccgccggcctgcgacggggcgtcgagcaggtgcagcgtgtcgctctcctacgcggacggctcctcctccgacggcgcgctcgcgacggacgtcttcgccgtcggcggcgggccgccgctgcgcgcggcgttcggctgcatggcctccgcgttcgactcctccccggacggggtcgcgagcgccgggctgctgggcatgaacaggggcgccctctccttcgtctcgcaggccagcacccgccgcttctcctactgcatctccgaccgcgacgacgccggcgtgctgctcctcggccacagcgacctgcccaccttcctcccgctcaactacacgcccctgtaccagccggccttgccgctcccctacttcgaccgcgtcgcctactccgtccagctcctgggcatccgcgtcggcgccaagcacctgcccatcccggcgtcggtgctcgcgccggaccacaccggggcggggcagaccatggtggactccggcacgcagttcaccttcctgctcggcgacgcctactcggcactgaaggccgagttcacgcgacaggccaggcccctcctgcccgcgctcgacgaccccagcttcgcgttccaggaggcgttcgacacgtgcttccgcgtgccccaggggcggaccccgccggcggcgaggctcccgagcgtgacgctgctgttcaacggcgcggagatggcggtggccggggagaggctgctgtacaaggtccccggggagcggcgcggcggcgacggcgtgtggtgcctgacgttcggcaacgcggacatggtgcccatcatggcgtacgtgatcgggcaccaccaccagatgaacgtgtgggtggagtacgacctggagcgcgc

SEQ ID NO: 1987 - DNA, 1497 bp, Triticum aestivum
  Clone ID: PAT_TA_1987
gcacgaggaggtggtgctacgctaaatgagagcataccattaagtgagcaagaagatctcattgtttggatgagaactgctgccctcccaactttcaggaagctgtatggcagaattgagaaagatatcaatgcattggttggtggagcactgctgcccccccacctctctggcacctgtagggctggagggtcaaaggcgtcggtcctttcgactgcgtctcggtggggaggcagaaccaccttcactcgcatggctttgctggctcttgggcgtcggtcccgtgggttgtgtgcctgaaggtgagaccgctgatcatgctccaattgttccatgtgaccttgttgcttggagttttttcaacgacaaatagactgtccgggtcaatggaggtgttacgcaagagaataaaaaggacatcgattggaggattgacaagatcaattaattcggtgactgttcttatcccaataccttgcgcttggcatggcttacaggcatggctacgcttaatgagagcataccattaagtgagcaagaagatctcattgtttggatgagaactgctgccctcccaacctcacaatcgcatgtcaaatgtatttgaaaagatatcaatgcaaatgactccaattgttccaagcaacaaggccaccatgagacattggtgcttggagtttgttcaacgacacatatacagtccgggtcaatggggtggttactcaagtgaataaaaaggacatagcttggaagagtgacaagaacaataaattcggcaagaatatctatcccagtaacttccagaagggaaggcttataggtggcgctacgctaaatgagagcataccattaagtgagcaagaagatctcattgtttggatgagaactgctgccctcccaactttcaggaagctgtatggcagaattgagaaagatatcaatgcaaacgataatgtaacagtggttatacagaacaactataacacatatagttttggaggatcaaaagcgttggtcctttctactgcatcttggattggaggaaaaaacaacttcattggtattgcatatctgactattggtggtttgtgcctttcccttgctatgggcttcttagttctctacatggttaaacgaaggaactttgcagacccctcgaacctgtcatggaatagatgaatagagttaactattagactggagtatcctgtctgagaataaaagatcattcaatgggtaaattcttccaattggatctatgggtgtctgttcttattcccattcactgggcttgtcatggctcataggcatgaggatcttgttgactttggagccgtaatagcatcatacatacatgaacagaatgtattgtgatcggttgacttaaaccttatctgaccttatctgaccataccgagagtcgtttctgaatgcttattatgaattatgaaccaactaattgtgcttatgggaggagatacctatacttgttcttgc

SEQ ID NO: 1988 - DNA, 399 bp, Triticum aestivum
  Clone ID: PAT_TA_1988
gaaacagacccgagacccaccgcaagtccgcaacccccggcgggatcgatttgcgctgggacctaccaacccgacccaacccagccgcggccggccgagcagacccatcccctccctccccgcttcctcctcccctccacctccacccacaccaccaccgcctcctccctccccataactatcccagcccactcgctgtcactgggagcagatcgatccgggtggccggctcagattggcgttcttcaatctcgctctaccgccgcctcgctgcgctccaatccgtgccgccgccgcgtttcttggttcggcggctgcttggctgggacggggggaggcaggggatgaaaggggctgggcggcgggccgtaggtgctgctggtgcacttcttgttcaac

SEQ ID NO: 1989 - DNA, 528 bp, Triticum aestivum
  Clone ID: PAT_TA_1989
caattggcagtacagcaggatagttacatgcagagcagagctgaggctcttcaaaatgtggaatcaaccatccatgagctgagcaacatctttacccagccggcacgcatggccacgcagcagggagagctagcaatcagaatcgatgagaacatggaggagacggtagccaacgtcgagggagcgcagggtcaactcctgaagtacctcaacagcatctcgtcaaacaggtggctgatgatgaagatattcttcgtgctgatggtgttcctcatgatcttcatattcttcgtggcatgatccccaccccttgtaacgcatgttgtgtgcaagtatattctttaatttttaccgaactacatacaccatgtacacaattttcactgggatgatgatgatgataagcgtcaggcagtctagtagcctctgtggtcatgtaaattgggaggagcatccaggatggatctgttgttactaccgaccgggcggtggtattatatttttattacagtatgttttatgatacgg

SEQ ID NO: 1990 - DNA, 1313 bp, Triticum aestivum
  unsure (1)..(1313): unsure at all n locations
  Clone ID: PAT_TA_1990
gcttcccaccaaatcccccatcccctccaccgcgtctcccccctcccccccccaataatcctcgtccgggaaaagcggcaccgcgaccgaacccgtgatcaatcccgctcacccacccgcccgcccgcgcccccgagcccaacctacgcggcggcccagatccagatccggcgtcggcggcggccatgaacccgtcgcggtccgccccggcgtcgttccgggaccgcaccaacgagttccgctccgccgtcgagagcgcacgccgccacgtcgcaccctccccggccgccgcgtcggccagcggcagcgccgggcccctcgacgactcgcgctccgccgcgtcggcgcactccgagttcaaccgccgcgcctccaagatcgggctcgggatccaccagacctcccagaagctcgcccgcctcgccaaattggcaaagaagacatctgtttttgatgaccctaccttagagatacaagagttgactgcagttgttaagaaggatattggtgctttgaataatgctgttatggacttacaagttctgtgcaattcacaaaatgagagcggcaatctttccaaggacacaacaaatcattccactacagttgtggacaacctgaaaaatcgactgatgagtgcaacgaaagaattcaaagaagtccttacaatgcggacagagaatttaaaggtccatgaaaacagaaggcaaatgttctcctcctcagctgcaaaagatgcatcaaatccattcattcgtcagcggccccttgttcccagagaggcatccgacactgcacccccagcaccatgggccagtgactctgcaactacgccgttgtttcaagaggaagaggtccgatggggatcgggcagcgccgctatcgcccccctccgcgccgccccgcatgcaccccccgcagttcccccaacagcatctcgtcaaacaggtgcttgatgatgaagatattcttcgtgctgatggtgttcctcatgatcttcatattcctcgtggcatgatccccaccccttgtaacgcatgttgtgcgcaagtatattctttaatttttaccgaactacatacaccatgtacacaattttcacttgggatgatgatgntgataagcggcaggcagcctagtagcctcttgtggtcatgtaaattgggaggagcatccaggatggatctgttnntaccgaactgggggcggtgatattatattttaatgacaagtatgntntgtaataccgtctcatggtgcgcggtgatgtaggttaaacttgtgtaattntgcctgaaaatgtttgtcgcttg

SEQ ID NO: 1991 - DNA, 593 bp, Triticum aestivum
  unsure (1)..(593): unsure at all n locations
  Clone ID: PAT_TA_1991
ggataggatcttacacctgccaaggtacgaggaagatcatggcgtccgatggcaagagcaagatccttgtgatcggcgcgacggggtacatcggcaggcacgtcgtcgccgccagcgcgcggctcggccaccccaccctggcgctcgtccgggacgccgccccctccgacccggccaaggcgcagctgctcaagaccttccaggactcgggcgtcacgctcctcacgggcgatctatacgaccacggtagcctgctgagcgccgtcaaggcggccgacgtcgtcatctccacgctgggctcgatgcagatcgccgaccagaccaagctcatcgccgccatcaaggaggccggcaacgtgaagaggttcttcccgtcggagttcgggctggacgtggaccgcaccggcgccgtggagccggccaagtccatcttcgccctcaaggcgggcatccgccgcgccgtcgaggccgagggcatctcctacacctacgtggtggccaactacttcgccgggtactcgctgcccacatcgggcaggtgctctccccggcgcccccgaccgacagcgtngtcatcctcggggacggcgaga

SEQ ID NO: 1992 - DNA, 1129 bp, Triticum aestivum
  Clone ID: PAT_TA_1992
ccccgcgtccgcccacgctccgcccacgcgtccgcccacgcgtccgcgccgccagcgcgcggctcggccaccccaccctggcgctcgtccgggacgccgccccctccgacccggccaaggcgcagctgctcaagaccttccaggactcgggcgtcacgctcctcacgggcgatctatacgaccacggtagcctgctgagcgccgtcaaggcggccgacgtcgtcatctccacgctgggctcgatgcagatcgccgaccagaccaagctcatcgccgccatcaaggaggccggcaacgtgaagaggttcttcccgtcggagttcgggctggacgtggaccgcaccggcgccgtggagccggccaagtccatcttcgccctcaaggcgggcatccgccgcgccgtcgaggccgagggcatctcctacacctacgtggtggccaactacttcgccgggtactcgctgcccaccatcgggcaggtgctctccccggcgcccccgaccgacagcgtcgtcatcctcggcgacggcgagaccaaggtggtcttcgtggacgaggcggacatcggcacgtacacggtcctggcggcggacgacccccgggcggagaacaaggtgctgtacatcaagccgccggccaacacgctgtcgcacaacgagctggtgtcgctgtgggagaagaagaccggcaagacgttccagagggtgtacgtccccgaggacgccgtcctcaagcagatccaagaggcgccgatcccgatgaacatcatcttctcgatcgggcacgcgtcgtacatcaagggggaccagaccaacatcgagatcgcgccgtcgttcggcgtggaggcgagcgagctgtaccctgacgtcaagtacaccaccgtcgacgacttactcaacaggttcctctgaggatatgctgctggtctatctgtgcctgagtccagtgatagtttttttttctttcgaaacgagagtccagtgatagttaatgtatcatgtatgaacggaccgtgtatgtttgggactgatgatgtctgatgagtcgacagttgtatgctgctggttgcttttgttggtttgtaaattgtatgtcctcctccttcatggatgaataaattactcgggat

SEQ ID NO: 1993 - DNA, 1354 bp, Triticum aestivum
  Clone ID: PAT_TA_1993
acgtgtgtgtgtgtgtgggatcttacacctgccaaggtacgaggaagatcatggcgtccgatggcaagagcaagatccttgtgatcggcgcgacgggatagatcggaaggcacatctcggccggcagcgcgcggcagcgagcccgccacggcgattggatcttgcacctgccaacaaggtacggggaagatcatggcgtccgatggcaagagcaagatccttgtgatcggcgcgacggggtacatcggcaggcacgtcgtcgcggccagcgcgcggctcggccaccccaccctggcgctcgtccgggacgccgccccctccgacccggccaaggcgcagctgctcaagaccttccaggactcgggcgtcacgctcctcacgggcgacctctacgaccacggcagcctggtgagcgccgtcaaggcggccgacgtcgtcatctccacgctgggctcgatgcagatcgccgaccagaccaagctcatcgccgccatcaaggaggccggcaacgtgaagaggttcttcccgtcggagttcgggctggacgtggaccgcaccggcgccgtggagccggccaagtccatcttcgccctcaaggcgggcatccgccgcgccgtcgaggccgagggcatcccctacacctacgtggtggccaactacttcgccgggtactcgctccccaccatcgggcaggtgctctccccggcgcccccgaccgacagcgtcgtcatcctcggcgacggcgagaccaaggtcgtcttcgtggacgaggcggacatcggcacgtacacggtgctggcggcggacgacccccgggcggagaacaaggtgctgtacatcaagccgccggccaacacgctgtcgcacaacgagctggcgtcgctgtgggagaagaagaccggcaagacgttccagagggtgtacgtccccgaggacgccgtcctcaagcagatccaagaggcgccaatcccgatgaacatcatcttttcgatcggccacgcgtcgtacatcaagggggaccagaccaacatcgagatcgcgccgtcgttcggcgtggaggcgagcgagctgtaccctgacgtcaagtacaccaccgtcgacgacttactcaacaggttgctgtgaagatatgcctgctgatctatctgtctttgaggccagtgatggtcagtatatgaacggactgtgtgtgtttgggactgatgatgtccgatgagtcgacacttgtatgcttctggttacttttgttggtttgtatgtcctccctcatggatgaataaattactcgggatgtcctttagatttttttaaaaaaagtctattaaaaaaaaaaaaaaaaaaacccacgcgtccg

SEQ ID NO: 1994 - DNA, 1118 bp, Triticum aestivum
  unsure (1)..(1118): unsure at all n locations
  Clone ID: PAT_TA_1994
ctttggattggtctgaaggccacaattggacagtggagaaagatttgcctgccaacaggctgattgagttcaagttcttgctgcaagattccctggggaagttccactggcagaatggacctaacagaaccctacagacaggtgaaaccacaaagacattggtggtctacgaggattggggtaatgcgaagaatcagaaagtagcagaggaggggccgccggagcgccgctggttttctttcttctcgcccaagccgccgccgacacaccaaaccggcagctgcctggtcgccggggccgaccctagaataaattacgaagcagcgccgcggtctccaggtagtagcagctcccctcgagccacacatctctcctacgtgctgttggttggttggattggatcggcatggagaaggaagcgacgacgccgcggccggtgtgcgcgcaggaggcgctggcgctgctcaactgcgccgccgagaacccctacgaccgcgacaagtgcctctccctcctcgacgcgctccgggagtgcatcgcccaaaagaaagtgaagaaattttcgttggctgaagcaggctccaccagcaccacggaagctccaaaaagcaaatagaagcccgcaatatttcagtgccacttacataacatgttctaggccggccatactggtttagtgttggatctgtcctttgtagttcatttcggattgagcccccccctccccgacccgctccgggagtgcatcgcccaaaagaaagtgaagaaattttcgttggcctgaaaggcaagggctccaccaagcaccacgggaagctccaaaaagcgcatagtagcccgccccgcctctgtgccacgttcgcaacttgctctaggcctgtctctctgggccgggtcagtagttgggttccccccccccaangttggggtttccccccccccccccccccccaaaanaaaaaaaaaaaaantccaaanntgnttttttccaantttncccctggggganttaaatgtaaatttttaacccatttngggcaaanaaggggnnaattttctttnccccaaaatttttgggggcggttcnaccaattttcatttnncagggntttaaaaag

SEQ ID NO: 1995 - DNA, 1193 bp, Triticum aestivum
  Clone ID: PAT_TA_1995
ccagcgcgggccgtcggcgctcccctacgcgagagaagcagggtggctcaaccctagccgccgccgccccgatcccatggcgccgtcgccgtccccgccgccggcggcgagcggagcgcagtacgcgcaccagttcctcaacaccgccctctcccagcgcggtccctcggcgctcccctacgcggaggacgtcaagtggctcatccgcaaccacctcgtcgccctcgccgacgccttcccctcgctccaccccaaggcggccctcttcacccacaacgacggccgcgccgcgcacctgctccaggccgacggcaccgtccccatccaccacgccggggcaacctacaacctgcccgccgtcatctggctgcccgagacctacccgcgctccccgcccctcgtcttcctctcccccacccgcgacatgctcatcaaggcccaccacccgctcgtcgaccgcgccggcctcgtcgccaacgccccctacctccgctcctgggtcttcccctcctccaacctcctcgaccccgtcagatccctctcccacctcttcggcctcgacccgccgctcttcaccagatccgtcgcagccccgcctcccactcctcctcccgctcatcctgctcctcctcccgccgccgccccccccgccccgccccccgtgcccgtcgcccccccgggccctcgcccgtgcccgccccccgcgccgcccccgcccgccgcgcgcctgccggccctcggcggacccaccgggggccttcccgcccaccgccatctccccccttgtcgtctccgccccccaaagatagggaattgggaattttggggggtcaaaaggtaattatacacttgggcctcttttaaatggagattcccggaatccaaaatttttccccattccccattttgggttaaaggaaagagaaaatgggggcttttaaaatgggtaaaaagagtttgggggtttccccccgctttgggccccctttggatgggtgggggggggcctttaacttgggaatttattcaaaaacccggatttgggattggtgggtcacccaaaattaaattaaaccctttatataaaatttttgggggtggggtggtaagaggttcattggggggaatagttttttgtggtaaaggggttgtgtttaaacctctggcacgttaaaaaaaaaaaaaaaaaaaaa

SEQ ID NO: 1996 - DNA, 780 bp, Triticum aestivum
  unsure (1)..(780): unsure at all n locations
  Clone ID: PAT_TA_1996
tctttcactagacggtgatgatgaacccggttttccatgtcgccgagcgcctgctctacgggaagcgctacgcctggtggctgcgctggatcctggtcgtgttcgtggggctcatggcgatgctcgtgcccaacttcgccgacttcctctcgctcgtcgggagcagcgtctgcgtcctgctcgggttcgtgctgccggccgcattccacatgaaggtgctaggcgccgagatcgggtggcctgcgctcatcgctgatgtggctgtcatcgtcgtcggcctggcgctctcggcgtctgggacatggacgtcgctcgcgcacatgtttggtgcttccaacgcgtaagcatcactgcaccaacaaggacacggattcttccggaatgctcaagtgtaaattgtactgtaattagcattgagacccgtcgagttcagctgccatgttgagttgggcatggtagtacatggtcccctgcattgcttgtaaagaagaagcaaatggcataggccctcatggtatcccacggccaaatctgtagattgtaatagatgtcgcaaggatcaagcgacatctacgaacctgtgtatattgtaccagagtatttatgtttgagcaaatttgcctagttctgaaaggatgtggatcgtgtaggttttgtttctcttacacatagaagatcttgtttcgtttatctctatttcgcagtgatgtatggagttctcgtgttgatgcgtgatgcttgaagtaaattacaccngggactgcagagctgccacccttc

SEQ ID NO: 1997 - DNA, 691 bp, Triticum aestivum
  unsure (1)..(691): unsure at all n locations
  Clone ID: PAT_TA_1997
ggccgggccgggactttcaaaacagctcctgcgcgcgccagagcacgctggtttgaatatatactgactctctccgcgcacgcacgccctgcctagaagcttgcgaggacgaggagcagataccgaggagagaaagagagggaggtcggccgctgtcgtttgcaccaggccgaagcgattcttgctcgaggggtggttacatggcggtgacggcgaccacggccgcggcggcggccgccatgctggcggcggtgatggccatcttcctctccttcgtgctctgcttctacatattcctctgcgccaagaggtcccgcggaggggcgccgccgccgccggggagcggcgtgatggcgcacctgcgcttcttgttctgcggcggggacgggagggccggagcgggggacggcgtcgccccctggttctacgacgggggcctggacgacgcgtccatggcgtcgctgccccgccgggaggtggccaagggggaggccatggactgcgtggtctgcatcacggagctcgccgccggggagacggcgcgcgtgctgccccgctgcggccacggcttccacgtggactgcgtcgacatgtggctcaagtcgcactccacctgcccgctctgncgctggcccggcgtcgacgcgccgccgctgccgcccgcgcccgtccaggcgcccgaggccgacca

SEQ ID NO: 1998 - DNA, 868 bp, Triticum aestivum
  Clone ID: PAT_TA_1998
atctcctctttgtattaacttgacacaacaggacagcttattttatatcttctcgacgtccgccataacaaagcttaatctcggcccgaacaacttttactcgtatttttcgaattcgcttcacgttgccaccatgggcaacaccaccagcgcagtcctggacaacctcgtccaaggatccaacttcgacagagaggaagttgatcgtctgcgaaagcgattcatgaaactggacaaggacaactccggtacgatcgagcgcgatgaattcctcagtcttcctcagatctcttccaaccctctggcaacacgaatgattgccatctttgacgaggatggtggtggtgacgtcgatttccaggagttcgttacaggtctttcggcgtttagcagcaagggaaataaggagcagaagcttcaattcgccttcaaggtctacgatattgaccgcgatggatacatcagcaacggagagcttttcattgtcctcaagatgatggttggcagcaacctcaaggaccagcagctgcagcagatcgtggacaagaccatcatggaggccgatcttgacaaggatggaaagattagcttcgaggagttcaccaagatggtggaaaacaccgatattagcatgagcatgactgttgaccagttctaaacgaccgtctatcagcaaaagagtgcgtggggggttgtggtataaatgtacaacgtcactatgaacttaaggctcatggttggctgcattcgggcatggatagggtgagggggctggaacacctagcgaatctacaaccacattacaattatgatcatgaattaacgcctactggtacggcatttcaaaaaaaaaaaaaaaaggccccta

SEQ ID NO: 1999 - DNA, 1216 bp, Triticum aestivum
  unsure (1)..(1216): unsure at all n locations
  Clone ID: PAT_TA_1999
tgcaggnaattcggcacgaggcaggaacataagcactactgtagcagctatggtggttacgttggagcatttcgaggttatcatcgagaagcgtcgcgctacaccagtcgttttggtggccgttatcgtggtggtttagggggtgcatatgggcgtgatgctgtgccttatggtggtggtttaggtggtgcatatgggcgtgatgctgtgccttatggcacttctagctatggtcctagttatgactcttcaggtgccagtgccgatcctagtgttaggtctggcgtgggtggactctatggtgctaggggaggctatggtagcagcagtggtggtggtgctactggtcgctaccatccatatgcagggtaagcctgtggatggtcaatgctagatgagaacttaagagatatcacctgcagctagaagaaccttgtgatctgcttagtttgctactccatggttgtagaacttaaagacgttgtttagtgtttgaactttaaacatactgaaacccacctcattcacttgatagcaaccctaggcgatctccttatgcagatggttatgatggatttgccagccgttacaacaatggtggtcgccttgccccctataaatcacccggttttggcgctaggcctggcagctacagtagtgcttatgttcctggcagctacagtagtgcttatgttcctggtgactatagtagcggctatggtggttatgatggagcatttggaggttatcatggagaatcgtcgctctactccagtcgttttggtggcagttatggtggtggtttaggtggtgcatatgggcgtgatgctgtgccttatggcacgtctagctatgggcctagttatgactcttcaggtgccagtgccgatcctagtgttaggtctggcatggttggactctatggtgctaggggaggctatggtagcagcagtggtggtggtgctactggtcgctaccatccatatgcagggtaagcctgtggatggtcaatgctagatgagaacttaaagagatatcacctgcagctaagaagaaccttgtgatctacttagtttgctactccatggttgtagaacttaaagacgttgttnagtgtttgaaatttaaacatacctgaagttgaaatttaaacttaactcaaagacttgtgcaaggtttcctttccggttaagatgccaagttcccatgttaaaac

SEQ ID NO: 2000 - DNA, 454 bp, Triticum aestivum
  Clone ID: PAT_TA_2000
atcccgcagagcacgctccctccgcccctcgtttccccacccaccagcctagggttccggcgagatgaagcagcaggatggagctagcccggccaagatgttcatcggcgggctctccaggcagacaagcatgggtacgttcaaagagtacttcgggaagtacggggagataatcgatgcggtaataatgaaggaccgccatacccaaaagcctagaggctttggatttattacctattcagatcctgctattgttgacagagtgattgaagataaccatgtcattgatggcaagcaggtacactccgtggttcctattactgctggaattatatcagttcacatgggagttcatcgcttttccttgcattttttagtacacaagtcacatgttatgaagtttaagatccttgactatgccacagcaaaaaaaaagcagttctatctttaatgg

SEQ ID NO: 2001 - DNA, 574 bp, Triticum aestivum
  Clone ID: PAT_TA_2001
actcccggacgcgtggggcctcctcctcctcctcccaccagtgagagtgagacttagaccagccggtggcctcgcccgtgtgctccatggtgatcctgcgctctcacagggacacggagccggcggagatggctcaggggcaggcagcccggacctggctggtttccagttctacaagctcatggctgccggaatgtcctgggagaagctggtgctgcctgacaagttcgtgagggagctcaacggccgtgagctccggggcgtgaagctgcgggtcgagggcggaggggcgcgcgcgtgggacgtggaggtcgtcgccaacgagtacggcgacatgcacctcggcaggggctggaaggagttcgtccgcgccaacggcgtagagctggggcagctcctcgtcttctgctacgacggcgccgccctgctcaccgtcacggtgttcgacgactccgagtgcgggagacactgctgccagcgcgaggaggaaaacgacagcgccgaagaggacgagtctccgccaccggcgttgccagggagtgaaagcagcagcaacgacgacgtccatggcggc

SEQ ID NO: 2002 - DNA, 1221 bp, Triticum aestivum
  Clone ID: PAT_TA_2002
ttcggcacgagggcagcctcctcctcctcccatcagtgagagtgagactgagaccagccgggggcctcgcccgtgtgctccatggtgattctgcgctctcacagggacacggagacggcggagatggcgcagcagctgcgggacagccctggcctggctggtttccagttctacaacccctccgcccccgggtgggcctgggagttgctccgcccgcctgcccgctcccggtcggaggtcaaccggcgcgcccacagggacacggagacggcggaggtggcccagggcgccccggacctggctgggttccgcttcgccaagctgttggccgccggaatgtcctgggagaagctggtgctgcctgacaagttcgtgagcgagctcagcggccttgagctccggggcgtgaagctgcgggtcgacggcggaggggcgcgcgcgtgggacgtggaggtcgtcgccaacgagcacggcgacatgcacctcggcaggggctggaaggagttcgtccgcgccaacggcatagagctggggcagctcctcgtcttctgctacgacggcgccgccctgctcaccgtcaaggtgttcgacgactccgagtgcgggagacactgctgccagcgcgaggaggaagacgacagcgccgaagaggaggagtctccgccaccggcgttgccagggagtggaagcagcagcagcgacggcgtcgtccatggcggcggaggcggcgccgcgccgagtcggttcaccgtgacgctggggcagtgccacctgggcaccaagaagaagcagtacctgaacgtgcctgtggagttcagccagtcgcacgggttcacggagaagggcagggtggtgctgcggatgcgcgggcagcagtggagcgtctgcctcaagcacagcaaccggcggaagggcagcgccaggccccgcacggcgctgaggtacgggtggaaccagttccgcgtcgacaacggcctccgcgtcggcgacatctgcttcttccagctgctgcaggacgccggcggcgacgacccggtgctcagcgtcgaggtgcgcaaggcggacggcaccatcgtccagtgactagactactgattcgggttaatttgtgccttgagcttgatgtgatggcaaataagcaaggaatggactgtatgatgaaccacgatctggatgttggatgaatgaactgcttttattatttattatactagtatatat

SEQ ID NO: 2003 - DNA, 842 bp, Triticum aestivum
  unsure (1)..(842): unsure at all n locations
  Clone ID: PAT_TA_2003
atttcactctacaccatcaacacactttcgctccatctctgacactcttcaccatgttgtccaagattctcatcagtgccctcctctcgggtgctctcgcagccaagcaggagactcttccctacgccgatgagcctaatcgatgcgacacaacctgtcaactcgcatatcgccaggctctgaccggtgagagcaatctttgggtcaaccagaatgtctcgacagaccctttttactccaaccccgccaacatgtcggactatgccgccggtgaccttgtcaagtgggaggaaatcccatctgttcagaccaccaggcgatggactattcctggaagtgtcaccttgaaccgatacttctacatgacagaggatatcaacggaaagcctatcccagctactggattcgtcatgattccttacgccaaccctcttggaaacgacaagcctttccgcactctcgtgtggacccatggaacagcaggcggaacccgacagtgcgcccctaccaaccaccgcggtctgtactacgagtggcaagccccctttgagcttgttctccagggatacgtcgtcattgctcctgattacgctggtcaaggtagtgatattcctgagggcttcatgtacgagtccggtgctcttcacgccggagatgtcagtttcggtcttcaagctgctcccaaggctctcggtaacaagatcaccaaggaatgggttgtcatcggtcacagcgagggtggtatgactgcttggcgcactgacgagcgagagggcatgaagggncaggctactggtggatccctcggtgctgtcgccatggcccccgcgctcagcccatca

SEQ ID NO: 2004 - DNA, 418 bp, Triticum aestivum
  Clone ID: PAT_TA_2004
ccggacgcgtggggttctacaaccctccacccaaaccctagagctccaggccggccatggatccgtccaagctgggcgagctgcgctccttcgtggaggcgtgcaagaaggacccggcgctcctcgccgaccccgccctcgccttcttccgcgactacctcgcctccctcggcgccaccctccccgccgccgccgccgccggagccaagcccgcccccaaggcgaggtccatggacgacatcgacgacgacgacgaggacgaggaggaggagggggaggacgaccaggacatgcgcgaccccacccccgagcccgacgagctcgacgaggacatcgtcgagtccgaccttgagctcgacaacgacggcgtcgttcaccccgaccacgacgacgcgccacagaagatggggagactttt

SEQ ID NO: 2005 - DNA, 1904 bp, Triticum aestivum
  Clone ID: PAT_TA_2005
ccccgcgtcagccctcgtccctccaccctacccccaacccctggagcgccccgctggccacgtccccgctcggcctgggccggcggtgccccatggcggaagcgagcgaggggggggaagccctcaccctagaacccaaaccctagcggccatggatccgtccaagctgggcgagctgcgctccttcgtggaggcgtgcaagaaggacccggccctcctcgccgacccggccctcgccttcttccgcgactacctcacctccctcggcgccaccctccccgcgtccgccgccgccgccggcaagcccgcgcccaaggcgaggtccatggacgacatcgacgacgacgacgacgaggaggatgagggggagggtgaggacgaccaggacatgcgcgaccccacccccgagcccgacgagctggacgaggagatcgtcgagtccgacctcgagctcgacgacgacggcgtcgtccaccccgaccacgacgacgcgccccagaagatgggagactcttccgtcgaggtgaccgaggagagccgtgacgcctcccaggaaacaaagggccaggcaatggaagcaatgtcagaagggaaactggaagaggccgtcgagcatctcaccaaggctatactgctgaatccaacctcggcaatcatgtagggtaccagagcatctgtgttgatcaaaatgaagaagcctgctgcggcaagcagttatgcgtaccctgcctgacggatcaacccagtctctggatgctgctacgattcccgtggattaggtgatggtatccttggcaagtgggaggaagctgctcgtgatctgcatgccgcgtcaaacattgactacgatgatgagatcaatgctgtgctcaagaaggtggagcctaatgcacacaagatagtggagcatcgcaggaagtatgacaggctgaggaaagagagggcggagaagaaagctgagcgtgacaggcttcgtcgccgtgccgaggcacaggctgcttatgagaaggccaagaggaaggagcaatcatcaagccgctcttcaggaggcatgcctggtggaatgcccggtggcttcccattcccaggaggcatgggtggaatgcctggtggcttcccgggaggaagggagggggtatgcctggaatggggggtggtatgcctggagctggaggtgctcctggtaatgttgatatgggtgacatcttgaatgaccctgacctgatggcagcatttggtgacccagaggttatggcggcccttcaagatgtgatgagcaaccctgccaacttggccaagcaccaggcgaaccccaaggtggggcccatcatagccaagatgatggccaagatgaacgggaaccggtgatcgccccatgggccctcgtgaccgacggtttttgcgatcagcaggacaaaaaaaactctggttaagtgttggcagtgtctttttggcatcgagagacatgcgtgtgttgtcggttggcgatactagcgcgcagagacgatacgcttgttggatgggggatgtcatgcctggctttttattatgtgttggtagtaagtagcggtagtgaactttgcggtggctgatggtctgtggatgcttgagggttttaccgagatgatgcggcagttccgtgtttatatatttggcggagaagacgttacagctgatgaggaaaccctgcctggctttttattatatgttggtagtaagtagtggtagcgaactttgcggtggctgacggtctgcggatgcttgagagtattactgagatgatgatgcgacagttccctgttatatatttggcggagaacgacgttccagctgatgatgaatgcttttcatgcctgcgattcatgttgcctgattcttatttgcaatatgatttttgcttctcc

SEQ ID NO: 2006 - DNA, 1158 bp, Triticum aestivum
  unsure (1)..(1158): unsure at all n locations
  Clone ID: PAT_TA_2006
taatgaagtgtnacgacgacacatttgttagaattgacgcggtgttggtcnagtgaagaaagttaagaatggggggagcatgtatgtggggaacataacctactaccacaggcctctgcgatctggaaagtgggctgtaacgtacgaggaatgggaagaggaagtatacccaccttacgcaaacggaccgggctatgtgatttcatcagacatcgctgagtacatcgtatccgagtttgacaaccaggcgctgagactgttcaagatggaagatgtgagcatgggcatgtgggttcagaagttcagcaagactcgccaaccagtggagtatttgcacgacgtcaagttcttccaggccggctgcttcgacggctactacaccgcgcactaccagtcgccgctcctcggcatccgccccgcggccaacctgctcgccgggcgcgcgcccggccgcaacgcctggtggcttgccacaaggtagatcgtctaacagtgttgcccggttcttcgtcgctctgaatgggaaaaaagaggtcaacgaggagctgaagaaggaggctgagttctttggtgacattgttctggtccctttcatggatagctatgacctcgttgttttaaagactattgccattgctgagtgtggggggcgagttgtgcaagcgaaatacgtaatgaagtgtgacgacgacacatttgttagaattgacgcggtgttggatcaagtgaagaaagtaaagaatggggggagcatgtatgtgggaaacataaactattaccacagacctttgcgatctggaaagtgggctgtaacgtatgaggaatgggaagaggaagtatacccaccttacgcaaacgggccgggctatgtgatttcatcagacatcgctgagtacatcgtatccgagtttgacaaacagcaaggatgagttccgagtttgatcttgatctgggcgctcgctcgagagttagcttgcccgcttccctcggtctttcgctctctggccgcttgccgctgctcccggttcctgccgctagcttcacgctcactccagctccgtgggtcaattgtttttgacctaggaactaacagcactgctgatctcacttgtataccagctgttcttatatatacatattagatgtttcgagtaaatc

SEQ ID NO: 2007 - DNA, 867 bp, Triticum aestivum
  Clone ID: PAT_TA_2007
accccccccgctcgtctgctctttcttctccggctcaccttttggcctttctcttttctttttcaagtttagccatcttaccagggccgctagctgctgtgcatctcgatctgttttagtcgatccagatctgcatccgagcaagcaagcttctccatttttctttggcttttgatacacacatacatacattctacatctctccgcctgtttttgttgggtggagcttcatttcctttgcattctaggttaggtcctcagctctcctcggtttctcgaaataagcagccgactccgctcagatcagccgcttgtttcggcgccagatttgcaaagactgactcacagatggagtgtggtttgaaatccctgagcagcagctcgacccccgtagcatcgccttctgtaatgacgccctcccggccgcgtccccttcccccgcgccggcctgcgccccctcacctcaaccccccgccgccaccggtgccccgcccgcccccgggccccccccgcccccaccaggcccccaagacgccggcgggcggggcggcatcggcgcccatcgtggtagcggcgccgcctatgccggcgtggacgtcgatggactcgatgtactcggtgtcgccgccgccgagcagcgtcccgatgccgacgtcactgctgctggccgccggcgccgggcggaagaagatgccgaccccgtgcgccgtgcaggtggctggcgggggcgtggacgtcggcgccaccgacgagctccgccgcctgctccggctctagccaccgctgctgttgctgtctgatgggccgatggcaaggcgagggagctgcggatggatgtagcccgtttctatggatgtactttttttt

SEQ ID NO: 2008 - DNA, 776 bp, Triticum aestivum
  Clone ID: PAT_TA_2008
cccacgcgtccgagcaactccctcggcggcggcggcagggacgacgccgccaaggggaggaccaggccgccgctgctgcccaagtcgccatccacgtcctcggccggtgcgggcgcgtccgggcggacggccaaggcgagcgcgtccgggtcccggaggcttctccgtacgccgtcgctcccggcgccccgcatcgggatggacccctcgtggcccaaggacaacgagctgatagtggaggaggacgctggcggcggcgatcagcaggaggccgaggtggaggacgacgacatgaactggagcaagatttacgagggcgtcctgcgcaccaggatcgccgaggaaggccgcggctcgtcggcgctcaaccgggcgccgtccatgccggtcacgtcgtccgcaaccatgggtgacggcaacggccgccgacccgccggggtcaccgagtcaacgccgagcatgcccaggctcaggcactcccacagcacgctcgagaggcactaccgctcgcgcacgcccaccaagcctgaccggacgccgagaatgacaggcggcggcagcagagcggagcgtggcccgccgcggcgcgacctccgatcgttcagcgcgaaccagcagccggccctcgtccgggacaagagcggcttgcaggacaagatgtggaagagctcgagcgcgctggagtcgatcgaggtgcaggggttcaaggacctgggtttcgtgttcgaccaggaggagctcagagagagtctggcggacgtcctcccgggcctccg

SEQ ID NO: 2009 - DNA, 1226 bp, Triticum aestivum
  unsure (1)..(1226): unsure at all n locations
  Clone ID: PAT_TA_2009
acattcaaccacagagtgagaccaatgagacttctcatatgcggtgcgaggggaggcagtgagggtgggtcgcgcgtgtactaccgcgacctggtcgacccggacggcaagcgccgcgccgcgcacgtcgtggacgccgacgatcaggacgtggtggtggccaacggcggatacgtcagggagtcgcggaggccgaccacccactccaagcccggtggaggccgtgcgctcgacgcgcgctgcaagaaggccctcctcgcgctcgaggaggaggaggagtaggtgcccccgccgcagccggtcgcgcggtacgtgtactctccgtgatgttggccgccgtcgtcaccgtgcggatacgatgacgacgtgcaggatcactcactactaagactctcgcttcatagctcctgcccaacatgaagttctctcctcttctcctctcaactcttctcgccaacacggtcgtggcccagactcctgacaagacccaggagaaacaccccaagatcgaaacataccgatgcacaaaggcaaagggctgcaagaaggcgacaaactacatcgtcgccgacgcagagcttcacggcatcagccaggccaacggccagagctgcggtaactggggtgaagccgccaactccactgcttgccccgacgaggcaacatgtgccaagaactgcaagctctttggcatgaacgaggctgcgtacaaggccaagggtatcagcacctctggtaacgctctccgtctggagatgctgcgcaacggccagtctgtttctccccgtgtttacctcctcgaggagaacaagaacaagtatgagatgctcaagcttaccggtgctgagttctctttcgatgttgagactcagaagcttccttgtggtatgaacggtgctctgtatctttctgagatgcctgccgatggtggaaagagcacgagcaagtacagcaaggttggtgctgctcagggtggcggatactgtgatgctcagtgctatgtcacacctttcatcaacggagtgggtaacatcaagggcaagggtgtctgctgtaacgagatggatatctgggaggccaactctcgcgccacccacattgctccctcaccctgcagtgtccccggcctttacggctgcacaggtgccggatggcagaangatggtatctgtgacaaggctggctgcggctggaacataacccgcacgcgntcctgatttttacga

SEQ ID NO: 2010 - DNA, 599 bp, Triticum aestivum
  unsure (1)..(599): unsure at all n locations
  Clone ID: PAT_TA_2010
gttccgacgtcgcaggacattcgacgccccatcaggcggagctcctccgggcccaggtcgtcgtagtagtcgtcatcttcgtcgtcgtggtagacggcttcctctgccgccggcatgctcacggttgtgaatatcaacccatccatctatcttaatttgcttgcgacgggcccgggcgcaggagcgattggagcagcagctggttcggctgctgctgacgatgttgcggtggcgcaggccctcgcccgtccttccgaccagcatagcgtgtctcgactctcgaggcgtgcctgcgtgccaggagcaacgcggggagccgaggaccatggtctttccccaagccggacgccggcccgcagctcggcgacactccgctcgagctcggacgagtcgtccgcgtcggcgagcgatcgcaggcggctgcgtcctgcggcagcggtgttagagtatcctgtgcatatacagcgcatgtatatacagcgcaccgaatgtggagtgcatcgcgtaacgagtatgagcagcgcggttgcgcgttgtttttcttggcgggctggtggatgaaatcaacagcttaattanaannnnnnnanannannana

SEQ ID NO: 2011 - DNA, 1082 bp, Triticum aestivum
  unsure (1)..(1082): unsure at all n locations
  Clone ID: PAT_TA_2011
tgcgcggccagctgtgacacccaggatcgtgaccgctggcgccctgacctcgaggccgccccctcctccggcttcgtgggtgcgcacgtcgacgtgggcgccgcccccgccgttccccgtctcctacgccgcccccagcgtcctgcagccatcacgccgctgaatcggtggtgtgtctactatttcaagaagctttttggggtttccccacttgatggagctgcagctctctgcttcgtagctcagaagtagggcctcaagctccttgttgttcatgtctccgttgttggtgggagtgccggaattacaagcccgacggtgttgtcaaagccgttgcaatctgtcgccttgacggacgagcaatctgagcagctgaccaagtggatacagaacgctgcgacagaggtggtggaggcgaaagcgggtgctggatctgctaccctctccacggcgtatgcagcggccagatttgtagagtcttcgctccgggcactggctggggatccagatgtttatgagtgcacgtatgttcagtcttgagttaactgagctgccattctttgcgtccagagttaagattggcaagaatggtgttgagtccatcatttctttggacctggagggaataactgagtacgaggccaatgcactcgaggcattgaagcctgagctgaaggccagcatcgagaagggcatcgagtttgcgcacaaacagcagggagccgccgcatctgtttgaagtgaggagaacggcgattccatacgaagagaaggcaaaatgattctccttgtcttctagttttgcagcctagagtattgacatgtagcagtatgccttggagcatctatatatttctcaattgttggtcagtttattacgattccaagtttacatgagggcgtgaagccccaaacttgcaccctgttctggggccttgttttgtttgacacataaattttggtcctgttccacctgctgttcttgtagcttcctggagttcaactgtggactaataaagaacatctttgatcattaccaaggcacgccatctagatctgcctngactnntggtaacatattg

SEQ ID NO: 2012 - DNA, 1325 bp, Triticum aestivum
  Clone ID: PAT_TA_2012
ggaaagttcatggttcatcgtaatgttattaggaaagccatcaacaacaccttctaccagttcatctatgaaactgaaaagcacaatggaattgcagagctgttggagatcttagggagcatcatcaacgggtttgcgttgccacttaaggaagaacacaaattgtgccttatccgggccttgattccacttcacaagccaacgtgcattgcaatgtatcatcaacagttgtcttactgcattacgcagtttgtcgaaaaagattgcaaactctcagacacagttatcaggggacctactgaaatattggcccatcacaaacagcagcaaagaggtgatgtttttgggagagttagaagagatactagaagctacacagcctgccgagtttcagaaatgcatggttcctcttttccgccagattgcacgttgtctgaacagctccctcttcctggtcgctgttcggtcactgtctgtgccgcccatggaccggttcgtgggggtggccaatcggcgctccttggcggtggtgcctcccctagtccctgcgctggagagaggtccctccgcgctccggaacccggctgggctgtgcctcactcggcatgggcgcaaattgtgctcgcagcgtgtcgccggactgtacaccgagtgtctgcggaaatacgaagaagccaaagccaaagagaaggagaataaattgaagcaagaagccacatggaaacgcctagaagagattgcgtcatcaagagcaaccagtggagaggctgtgctcgtccatcgaaccttaccccgtcaatcttcagctgtgtagctaattattcaagtgtagggggtcctccagagattcgtgaaacattgtacatgattgaattgtatatacaaggtatatcaggcaggcaaatcgacaggagatctgagaagccaggtggtgggtttggcgcagcacgggagcatcatcatttcttggtcctgagcctcggcggcttctctcggcatgctgagatctgcggttcattgctatatcctttatccttgtcggaattcggtcacagtctgttcctcccattgaagggtttgttgtggaagcaaatggtcggtcgttgttgtcggtgggtagatctctagttagagaggtagagagaagtcggtcttcatttcaaaacgagtcatggttgttctcgagtcggcatggttgtaaaaaatggaagcaaagttttcttttcctgtacaatataaccaaaatattttctcacagaacgtgtgaggtgcattcattttattattattaaatggcgttctgtcttgttggaggtaaaaaaaaa

SEQ ID NO: 2013 - DNA, 463 bp, Triticum aestivum
  Clone ID: PAT_TA_2013
gcccgacctgttgcgcccgccgccgcgcgcaaaccatagccgcagcgatctcgaatccgtgccggaggataaccatgacgctggcctgcagggggagagccatggagctcgtcaagtgcctcagcgggaccgacagcgtcaaggtgcagaagaagccgtacaaggtgagcgccggggagaaggcgcccaacatcacctgcgactgcttcggcctgcgggagacctacttcacctgcaaaagatacgtggttgacatgcgagaccgaatacgtgggaatgaggggtaatggtggtctggatgtgaactcccttcagttgatgatacttgctaaccgaattgtcactaccagacatcttgcgttctatatatgtgatggatctccaatagaatcatatgcattttttgtcctcgggaaacccggaaaaatgccatcgtttgaacccgtcggttgtgaccacgcta

SEQ ID NO: 2014 - DNA, 485 bp, Triticum aestivum
  Clone ID: PAT_TA_2014
cggtcaggtatcgcgggtcgaccagcaccatccaagacgtgttcatgccgacccagtacataccgttaatgtagttgaggctgacggggatcggatcgcagtcaagggggttgatgctcgccaccctacgatcgttatgctgcgtgacacgccatttctgaagatcaggcggcatcagcaagcaaggagctggcttaaaaagctccggcctgagggctttgagtaaacggtacagccccgacgagcacgcggcgagcggcatggtactgagattgtccacacgcgaaacaatgagcttgattacctctgtggggagcgaattccagccactctttcggcggacgctgctcggttctgccattgttagtgcttgggtttcggacgggggggaggcgccttagcggggatggaagattggacgagattatgtgcggacaaagatggagaagcgaatatgtgctgcaggaagtggacaagtgatgatg

SEQ ID NO: 2015 - DNA, 904 bp, Triticum aestivum
  unsure (1)..(904): unsure at all n locations
  Clone ID: PAT_TA_2015
ggtcgatgggcgaccagtaacgggggttgatgcgctccaccctacgatcattatgctgcgtgacatgccgtttctgaagatcaggcggcatcagcaagcaaggagctggcttaaaaagctccgtcctgagggctttgagtaaacggcacagccccgacgagcacgcggtgagcggcatgctactgagattgtccacacgcttgattaactctgtggggagcgaattttagccactctttcggtggatgctgctcggttctgccattgttagtgcttgggtttcggactctcgggtacggctagaagacgacagaagtcgagggggggaggcgccttagcggggatggaagcttggacgagattatgtgcggaaaaagatggagaagcgaatatgtgctgcgggaagtggataggtgatgatgactacagcacgccgcttgacttacgagacacataccagcagcgtagggtcatatcgatgccagacaacttgcttgagtgatcacagtactggtactccctatagtacctactacagtactatgccctagcttgctagagtagagtagtagagtaggactctgctctactactagcaccggaggagtagtatattctaatctaaaatagttacaaacttcgatgcccgatcgtggaacgactacgaaccatgctcaaagaccgtgtctatgtggtgtttggacttatatgcaaaaaaatagcaagatgcccgtgcattgcacgacacatcatcatcaccaactcggttttttctctactcctactcctataaaacactcagttggtgatgatgggggtgaggaggcgtgttcagccgggcgtgcagcggacggcgcagcactattcgatttgttacaaaanagtacttgtagagatagataca

SEQ ID NO: 2016 - DNA, 591 bp, Triticum aestivum
  unsure (1)..(591): unsure at all n locations
  Clone ID: PAT_TA_2016
cactccccaaccccacgctcccctgccctaaaatccctaaagagctccacttttcccccttcccccggatccccccctgcgatggcggcgaaagtagccggcggcgccgcatctctcccggcggcgcaagaggcgagcctcgcgaggcagtacaccgcgatggatatcagcggtggcgagatgggggaggaggcggaggtctcatccttcaccacgcgcttcgcgtcgctgcgagttcgggaggaccggctggccaagatcgctgctagcctgcgcctgatcaaggagaagcgcggctcccggccccccacctacatcgagctggccgccgccgtcctcctgaaagacagcgttgccgccgccctccaacgccgcgccaccatcgtcgtcgggcggtcgctacttgaataagtggttgttattattattattatggtacaaattaccctaatttaatgcatgttcgtgataagaccctaacgatgaggtggtagaacatatgttatggtactatgtattggcgcgcgtgttgcagtaatcccaccatggttcagttaaaagtattatgtgattannaaannnaannnnang

SEQ ID NO: 2017 - DNA, 708 bp, Triticum aestivum
  unsure (1)..(708): unsure at all n locations
  Clone ID: PAT_TA_2017
cggacgcgtgggcggacgcgtgggtttttttttttttttttttttttttttttttttttttttttnaaaaaacggggcagggaacggctgaacgcaaggggtacaagatacacttttcacttttgagcagcagtacgcaggaagccaagagcattctgtaaataccgaacatcaacaggtacaggacaattttcaaacaaaactgaaaactattttctttctgacatgatactgaagactatttaccggctctacacaggttttggcgggggcagaggccgccatccgttttacccactggcaacaatctcatggatcttgtcgctgacttcggggtcatctgaccttaccgccagcttcatcgccacttccttgggcccgcttagtccaaatgataacctgacaagaaccttgacgccccccatatacaccccagacagcaggcaaacgtgcgatcttgcattgcttggtacaacctcagtgccctcacacggttgcatgccaaggatactagtgacagcattcacggcctcagccaagctctctctagccccgagtccatactcatccacacgctcactttctgggtccatattctcccaggcattcctaaagttagaaactgcaaccctcagcatataatcagctgaaacaatttcaagatcttctagctggtattcccgttctgttgtcttctcgcaggtcgac

SEQ ID NO: 2018 - DNA, 2174 bp, Triticum aestivum
  Clone ID: PAT_TA_2018
tttttttttttctgctgcttttttttttttaatacaccataacatattttatttgagacaaaagcatgctcagaaattaactgtgcagtgaacggctgaacgcaaggggtacaagatacacttctgacttctgagcagcagtacgcaggaagccaagagcattctgtaaacaccgacgcatcaacaggtacagtacaattttctcacaaaactgaaaactattttctttctgacatgatactgaagactatttaccggctctacacaggttttggcaggggcagaggccgccatccgttttacccactggcaacaatctcatggatcttgtcgctgacttcggggtcatctgaccttaccgccagcttcatcgccacttccttgggcccgcttagtccgaatgataacctgacaagaaccttgacgccccctatatacactccagaaagcaggcaaacatgcgatcttgcattgcttggtacaacctcagtgccctcacacggttgcatgccaaggatactagtgacagcactcacagcctcagccaagctctctctagccccgagtccatactcatccacacgctcactttctgggtccatattctcccaggcattcctaaagttagaaactgcgaccctcagcatataatcagctgaaacaatttcaaggtcttctagttggtattcatcctccacaccatcttcatcagcttcccctgaagatgtgtcaacctctttaacagtgaacttcaatacatttgaaaatttcccgattgcaggaacatgttctggcttttcaaaagcaacaaaaatttgcccaggtgaatcataaggcaagcttttaagaggctttgaacaaacttctgaaaactcttcagcatccgtggcatcaacgtatactgtaacatcttctagcagttgttcaggtatggtgtttgtacagttgtactgcaatacaacatggttttcatagatgtgcttaaccacattaactgcatattcagtctctgcctctgtcagctccacaggttctgaggacttgaagagccttccaaacccagagaactcagcgatagatgaaagcatcttctgataagcatcaacagccgaaacaggcgcagggcgcgggagcaccagcaggtggcttctttccaggggcctttttatcttgaagtggatgtgatcggacgtctcttgacaccaaggaagtatcaagaggctcctcagggggttcatagcttcttagacttgctcccaagttggcaagaggcacatcaaacgagccaaatagaacttccttcacgtccttctcagagttacctacagcaacttcaccattcagagtttggaggtaaagtgtagcacggtcgcgggccggccccgctccccaattcacccgccggcgccccgggacaaatatccgaggcttcaattcttcgactaaggcaccaaactttgccaatgtactgacagcactagcacgaacagtgggattttcccatatcacacggttgtagatgtaccgtatgtatctgcttggatctgaatgttcttggcccttcatttccccaaaagtgcaatatctgactagaaagatatgtgaattcacagtcttcaatgaattcgcaaagatgcagaagaccaatttctttcgcgtctggtatcgcgccgatcagggtaactatagaatcaactatggcctttttatactcaaagcccccttcttctctcaaactgttacttaagaaaatcatcattgaacgatacttcagtgggaacttcaggcaaagagatcgtatagcttcaatgacaactatcttgaattcatctgatatgtcagacatgaaactggtaatttgtttcatgaggcgatccacacttgattcattgccagttttaagaagtgtagtgattgccagggtcgctatactcctgttctggtctgacatcagactctccaagtcaacattgcagtttgtcactgccaaagggcgtgttatagcaaccttattgagtgttcggacagctgcaaatcgaagcacgggtttggatgagctcaaaaataactgtaacacagtaatcgctggtgctaattcacgacttgtcacatccatctctgttattttcctcgcagcctctaaaatcaccatttctgctttatcggacgcgtgg

SEQ ID NO: 2019 - DNA, 885 bp, Triticum aestivum
  Clone ID: PAT_TA_2019
cggccgctcgaggcggccggtttccggttcacactatcccgtgacgactggacgagacgagcgagacgacgcgcgactcgactcggacaatacaaacgacacgatggctacttaccaaaacggcgtggctccggcccgcgccatggatgacgacagcgacgtcgaggaggaggctcttgtggccgagtacaaggagcaagttcagtacgaggatggtgatgatctcagccgcaccacctctctgaacctcgcccagcagaccgacgatatccagagccgacttgtccaggctgctcagcctctcgacttccaggcgcctctcgaggccaagttccagagctacgatgcctactgcagcttgttccacttcatcctgaactctgagggtcccgtcgatctcgagcccccttcttactactgggcttgggatgttatcgatgagttcatttaccagttcaactctttctcctcgtaccgaatgcgaattgcccgccaaacaaccaacgaggaggagcgtcaggctctccgcgagaaccccaacacatggggctgctacagcgtcctcaacgtcctgtactctctcatccagcgatctcagatcaccgagcagctcggtgccatgaagcgtggagaggaccctgcagccgttgccggcgagtacggcaacaagaacctttacaagatgttgggttacttctccatcattggtcttctccgagtccactgtctccttggtgactttagcctggcactcaagacacttgacgacattgagctcaataagaaggccatgttcgcccgtgtcatggctgcccacttcaccacatactactatgttggtttctcttacatgatgcagcaccgctacgccgatgccatccgcat

SEQ ID NO: 2020 - DNA, 2322 bp, Triticum aestivum
  Clone ID: PAT_TA_2020
gcacgcggctccaccgaacccacaaaggagcgtggaggagcaccaatccggccgagcgggcgtcccgagcgtgacgccatgagcgtggctagtcgaatccagcgagcagatcaaagcgagcgatagcccccggagaattccccatcgggagaggccgagtcccaatcttccgcggcaatgtccaaggcgcagctgaaccagctgtgccagcagcggcggtggccggcgccggactacacccaccggagcgaggggccggcccactcgctgaggttccgcgccaccgtcaccgtcaacggcgaagtgtaccactcgccggacgacggcgacgggttcagcacggccaaggaggcgcagaacctcgccgccaaggccgccttcgagcgcctctccgccctcccgccccctcccccgccgcagtccgaaacccaacttccctacaagtctcagttgcaagtttatgctcagaagagacataaagatttgccttcatatgacaccattcgaagtggtccacttcatgcacctctgttcaggtctacagtaaccatggatgggcgcaaatttgaaagtcctcaagactatcacacaacaaaggaggccgaatttgctgctgcaagagtggctttaatgtcattgtctcaagaagcaaacccatccgagcaaatgccggctggatcagcttcatgtatttctttgcctggaatccagattaatcataagcttcaattgcaaatgtatgctcagaagagaggaaaacaactgccttggtatgaccgtatccaggaaggtccatctcatgcacctcggttcaagtcaatagtgaccatagatgggcaaacatttgaaagcccacagtattgtcatacaattaaggaggcggaatatgctgctgcaaatcttgctctggtgtccttagcccaagaagtaagctcagaggagcaattgccggttcgaggaatgcaatatacaatccccccgcgcgtccgagctgagaaagaccgctcttccttgcctgtctgtaatacttcatcagataatttaaaaaattcctccatctccaaatcaaccgtgcacactctaggcgaaagttttcaggagggacctggtaacactaagaagcaaaaacagatgatggttgctccttttcaaccttccaaagacatagggtcacagatgcaacaaggaaccgaaaccctcaccgagcaagaggtcaagactgtagaatctgattcttcatttccccaagtatcaatgggaacaagtgacgggcagaatgactctaatgctactgagcatgattcttgctctgttggctcccgtattgatcttcctgttgctgacaaaacacaatctcttgatgaacctatcaagtctggcagtatggaaaatgttaaaccagctgctccagagccaagcatcaaggctgaagtaatcgacttgacacaagaatgcaggtcacccccgttagtttcagtgccaccaactgatatgctcaaccttgtggcaacaacaagtacagtgcctgttgctttacaatctcctgttgaaactatccagcctgtcaagatggaaaatgataaaccagccattccagagccaagcaccgaggctgaagtaatggacgttgcagatccaagtgctgaggcggaagtagacgttccagagccaagcatcaagggctgaaggaatggacgttgcagaaccaagcgctgaggctgaagtagacgtttccagagccaagcatccaggccgtacgaatgaactcaactccagaacacacatctctcccctttggctcaatgccaccaaccaatacttccaaccttgcggcgaaagcaactgcagtgcctgttgattctgcccgatgcagttactcgatgtcaactaaccgaatccagatctacccatgccgtcctgacctgaaaatgaaattaccagagggggcaaccgtgcttccctttagtgacgacaagtgggtggctgtgagcttaccttttccttgaaccctgaaggtggtagcaccgcggctttaggtccataagagacggagccagccaatgcacctgtcatgttgtaggttgtagtttcaccacgagtttagttccacgcccctctcgtgttttgctagtaaagttggcgaatcgtatcctcactgcaactctaattattctcctgggacatcgttatactgatgtaagttatgctatctagccgatggtactgagcacgaccatctcactgaacctggaattgtgttgttgccaagttgtcacttttaatttaagaagactacgaactttatggggaccaaaaataaaa

SEQ ID NO: 2021 - DNA, 1753 bp, Triticum aestivum
  Clone ID: PAT_TA_2021
agggccgtgcctggccaccgggcccccccctcggttttcttgtttttttgttggcttcacctccgccggtttgcgttcccccggtagtgttaagcttgccgcggtcccttgtgtttttttgattgaacaaaaactcaaagccatccagcacttgaaaggtgaagcgtacatcaggaacatgctgaatattttctcatcaagttcccaccaagcatcagcattctttgtgctcatactatttgaattgttaccattaccgctctctaaaaactaaaataaaactcatccaatatttgcttacagcaacagaaacacaggcttggcttttgttcttacctcagtaagtgatacaggtgctttttaaatagtggaactcccaaacagaaaactctcatattcagaactttttttttcttgctggaggggatcatcttgcgtcaattgcgaacttcagccttccataatcaatatatctacagctacaagatagtttcacacccggtgggaacagaaaaggaaaaaattctggcacttgctatgaagagtaactttcagaccaactgttagaaatgatattatttgacttctccagtagaactagcccgatgctgccttcaagcatagcgcctgcgcgttgatgtcttgatgtgattgtgtccacatgagagcctcagagcctctagaagaggaaagagcttcatcatttcacatcttgtttgacgccataaatttgatttttctctcagcaggtttgagaatttgaaatgaacacatcaaagtttcatcaacactcatcattgctccagcattatcaaattcaccacaatagttgggagccgaaaatatggtgaccagctgtctgtcagcaaagaattcatacccatcctcaacaacctggtgggcacggcaaataagatcaagatcatgctttagaaggaactccgtaactttgtcatggccaaatgtgtatgaaacgcccctatcattcatgccccacccttggacatcttttcctggatcagaccaaagaagatcgcatagtagacctgtatctggcacatcggtaggacggggcaagttttttatctcatctaggtgccccagatcaggagaaaggccaccatgcatgcataatattttatcatcaattagagcggccacagggagacagttaaaacagtcggtgaagaccttccatagccgcacattgaagcgacgcttgcattcatcataaaatccatatattctgtttattgaagcacactcatggttgcctctcagaagaaaaaagttctcggggtacttgattttgtatgcaaggaggaggcatatagtctccagactctgtttgcctcgatcaacataatcgcctaagaatagatagttggcttccgggggaaaacctccatactcaaatagccttaaaagatcactgtactgaccatggatatcaccgcagattttaatgggcgcctcgagctcgaggaggttgggctgggtgaggaagatgtcgcgggaggcggtgcagagctggcggatctccgactcggagagctgcacctgcttgccggggcgcgccgtccgcacctcgagcagacggcggatgatgtcgtcgaggagcgcggcgtccatgccgcctccctgccctcccgccgccggcgccgccgccatcgcctcccccggggtggagagagatcggtggagttagggtttcggcgcttcgggaggagcaggtggccgaggagggcggacg

SEQ ID NO: 2022 - DNA, 903 bp, Triticum aestivum
  Clone ID: PAT_TA_2022
cttccctccccccgaatctgaatccaaatctcggccgaccccgccgccccatgcctccctcgccgccgcagccgccgccgccggccacggaggaggtcgaggtcgaggtggaggacgcctccgacgacgaggcggcggggggagaggcgccgccgcttgccccggccccggcccctgccccgccggccggcgggggcgccgaggcgagccgtgccgcgtcggggtccggggaggcggcgggcggagaaggggccgacgaggaggacgaggacgaggatgaggacgacgaagaagacgactccgacgacgaagaagacgaggattcggaggatgaaggggacgaggacgaggacgaagactccgacgaggagggctacgacgacgacgacgaagacgaagggactctgatgaggacgatgacgacgaggaggacgaggacgacgaagacgacgacgaggacgacgacgagtagaatgggatggaaatggagcttgcggcgttcgcatctgggtgaggatgaaatgaagatgcaagtagctgaagggtctgttttgcactgatgctcaagtgtatgtatgtaagggatggcaatcggtaatcatatgttgcggatgcagaacattggctacggcatgactaaatatttgcctcagggtgacctctgaagcttctgttgctgattctctgttcccactatgtactatggtgaaaattgtattgttctgctcatctgagccctgtatctgctatttgaggaggaaactttgcgtgccacgattctatctttcgtcggcgagccacgattctaactttcaacgaaaactgtctagtcatatgtaaaactttgagtgtatcatcagtgaatgtcactccggttcaggtttaaaaaatctagttttgtag

SEQ ID NO: 2023 - DNA, 342 bp, Triticum aestivum
  Clone ID: PAT_TA_2023
acgcccacgcgttcgcccacgcgtccgcggacgcgtggggtgcccgccgcggccctatcctagatgctacctgcccgtacgtatcttggtccacggccgaatatcgcaggtcgtacgtacactcactcgccatggtggccgggcgtgtcaaggcggccatgggcttccacagcagccccagggcgcccaaatcgtcggcgccggcggcgacggccccagccgaggggtatgcatacacgccggcccggggttccttgttagaaacgttatcgcccgccccgtgcggctcggactccaaggcgttggagatagtgcgggtctaggggcgcttactttccgggc

SEQ ID NO: 2024 - DNA, 902 bp, Triticum aestivum
  Clone ID: PAT_TA_2024
agccctggctttgctgccttccatctgctgcgctgcaagcctgcaacaccgcgagtccgcatcgcacggcaccacccgcaccaacacccagctcgccgctgcgcccaggaaactttgatcgatccatccatacgccctgtcgtgccgcagcggcagcaacgagaggcttccgcgccgcgcctcaacggcaggctcgtgttcgtttcgccggatttcggtggggaattcggcggcgtggtgatagctagagcgagagggagcagcaggcatggggcgcgcgccgtgctgcgacaaggcgagcgtgaagaggggcccgtggtcgccggaggaggacgagctgctgcggagctacgtccggagccacggcgccgtcagcaactggatcgcgctcccgcagaaagcagggcttaaccggtgcggcaagagctgccggctgaggtggctcaactacctccggccggacatcaagcacggcggctacaccgagcaggaggacatggtcatctgctccctctacaactccatcggaagcaggtggtctatcatcgcatccaagcttcccggcaggacggacaacgacgtcaagaactactggaacaccaagctcaagaagaaggccatggccatgcaccaccagcagcagcactaccaccaccacggcaccgccggccggggacatgcccgcgctgcgacgatcgccacgccaccgcccgctccgcagagccaatgcgcatcatacatgcagccctcgcccgcgtccgcctcgtccgccgtcaccaccgcgagcggcgacgcgggcagcttcggcgccatgtactccccatcccaccaggccgcgccactcggtcactacaacgtcaacaccgcggcgccgctcgccgaattctcggccatgccgacgc

SEQ ID NO: 2025 - DNA, 643 bp, Triticum aestivum
  unsure (1)..(643): unsure at all n locations
  Clone ID: PAT_TA_2025
cggacgcgtgggcggacgcgtggggcacagtcctttcctagtccctaccacgccgtgcctctagctctcggccatgtcgccgtccatggccgcggccgtgtcgtcgctccgcgccctcccactccacatactcgtgccactcgtggcctcggcgctcgccttcatcgtcgccgtcttccgacgcattcttcggcggcagcggccggtgtacctgctgaactacagctgccaccttccggacgcggaccggcagtgcaacctggaggtgtgcgagtacttcggcctccgctccaagcgctacaccgacgagaccgccgacttcatgcggctcatcttccgcaaagtccgggctcgggcaggagacttcgcgccgcccttcatcttctccggcaantcgagaaganctggcttcgcatccaaggagcgnaggaagggctcttaacgtgntgtcnaactgctggcaatccgaagtctcccgcgcgacgtcaggtctatcgtcgcctgtcatgtctccctaagcgtcgcggcacatgatcggngcggtcaagatanggacactcaagggtaaagntcgcggatgggtaacgcggacggggnatcaantgngcggntcctgaancnccggtaacntgggtggacggaa

SEQ ID NO: 2026 - DNA, 900 bp, Triticum aestivum
  Clone ID: PAT_TA_2026
cctcgcgtccgaagaggctttgattccagagggggagaggagagaggggaagaagacgccagagtcgcaacccgccgcagatctcctccgtcctccgcgcccagccccgctttgtcctccatggagtgcgtccgctccggagctcttgatctggggcgctccgggaatttcttggggaagagcggctccacgacgtcatgtggtaaagtcagatgttctacaaaccttgctggttctaccaaatgcgagcaaaacttgcatgggaaggttaaacccttgctgttgtcagcaagtggaaaagcaaggggaacctctggtttggttcacagaagtgcagtacttaaacatcagcaccatctttctgtgagatccacctctaccgatgtatgtactacttttgatgaagatgtcaaaggtgtatcttcacatgctgttgaggaaaagattggagtgctgttactaaatcttggtggtccagagaccctcaatgatgttcaaccatttttgttcaacctctttgctgatccagatatcatccgactccctaggctgttcaggtttcttcaaagaccactggccaaacttatttctacttttagagctcctaagagtaaagaggggtatgcctcaattggtggtggatcaccttttgcggaaaattaccgacgagcaggcaaatgctttgaaggttgcactaaaaagtaagaacttggaagcagatatatatgttggaatgcgttattggtacccattcaccgaagaagccatcgatcagattaagaaggataaaatttctaggctcgtggttcttccgctgtaccctcaatactccatatcaacaagcgggtctagcatccgcgttctccaaaacattgtcaaggaagatccatactttgctgg

SEQ ID NO: 2027 - DNA, 772 bp, Triticum aestivum
  unsure (1)..(772): unsure at all n locations
  Clone ID: PAT_TA_2027
ccggtcttctgtctgcctcgtactccttaattaccatggcctgcaccaagcatttcttgatctccgccgcgcctctctgagcacgctcggtcagcttcagttgcctcctcgcgcggatcatggcgtcggtgagatcctgcgtgtccgtcaagccggccgctggcccggccaggtacagatccgccagggtcggggcggccagcttggagccgacaagcctgcgaatatccgcttcttcttcttcttcattgggcccaggcgcggatggctgcggcagaggtgtcggctgcgccgccagtatcagcggcaggggcgttgccgccgctcgtttggttggcgatggctggagggcgaggcggaggggcgcgcgggaggtcgtcgccgagtgcagcgccagcctggagggggtccgccacggcgcggcggcggccgccatgcccagcgtgccggcgctgcccgagcgggccaaggtggtggcgctcgtggcggccgtcatgctgctctgcaacgccgaccgggtcgtcatgtccgttgcagtcgtgccgctggccgcgcagcacggctggtccagctccttcgtcggcatcgtccagtcatcatttctatggnnggtatgttttctcatccatggttggaggagctttggcggatcgatacggggggaagaaggtgatggcaggtgctgctgcactctggtccttggccactttcctcactccatgggccgcctctcaatctgccactatgttgcttgctgtacgtgtgctctttg

SEQ ID NO: 2028 - DNA, 1114 bp, Triticum aestivum
  Clone ID: PAT_TA_2028
cccacgcgtccgcggacgcgtggggccgcattccctccgaactcatgttgttatactgagcaaacttattcgtctcgaaatctgcaccagatcgagctcagcaacgcgagccgagccggaggcgttcgtctgcccggggtggcgccatgcggatccgtctcttcctctgaaccgggcaagcgcgagccgccttcttcctcgtgctcgacggcggcgacgagcgtcggtggcggcatagcacagtccagcaacgagcagggtttcatgtaggggagggcaacctgttcccagccctcgattcccaccggagcgtgcgaagtccagtcggcagcaacggcgacgccggtgcaggcagccgcgggcacggcaatgccggttcctcttgccccttacccaacccctcctgtgcccttcacaccaccggctcccaatgcaggggctcaaagccaacttgtctgctccgggtgccggaatctgctcatgtatcctgccggcgcaacgtcggtctgctgcgcagtttgcagtaccgtgaccgctgttccggctcccgggactgagatggcgcagctagtttgcgggggatgccacactcttctcatgtacatacgcggcgccacaagtgtacagtgttcttgctgccacactgtcaacctggcaatggaagcgaatcaggttgcgcatgtaaactgcgggagttgccgaatgctgctcatgtaccagtatggcgcgaggtccgtcaaatgtgcagtctgcagtttcgtcacatcagccggggcatcatcaggttcagagcagaagcccagcaactgaagtccttccaggttcatactgaagcccgcttcccggactcctgctgctttgagtggacaggagtaccccgcaataagaatgctttctctgcccccctactccgttccccccagtcgttagctctgccgcccctccccatttcccacctgcgttgggcctggcgtgctgcccgaatttcctcgagtcttcggtgttacagagtccgccagattcgtcgaaccctccctgtttctggtccagccagatatatgaacccaccatgtttatgttcaattaaaaaaaaaaaaaaaaaactcctcgtgcc

SEQ ID NO: 2029 - DNA, 1418 bp, Triticum aestivum
  unsure (1)..(1418): unsure at all n locations
  Clone ID: PAT_TA_2029
cgcggaccgacccgagcgcgcgcgcgccacccatcccatcccatgccgccgctggaggccctcctcggcgccgccgagctctggcgccccgcggcgcgcggggccagcggctgggccaccgccgccgcgctcctcctgctcctcgtcgcccacctctccgtcctcctcgtccgccgccgccgccgggggcgcgcacgccttgcccggcagcaggaggatgcccccgcggcgcccgcctccccctccccgtcctccgggtccgggtccagctccggctcaggggtggagggcctcgtgacggaggacgatctgaggcagctggtgggcagcctgngggtcggcgcccgccagccggagctcgagggctgggaccccgtcatcgccaaggggaacgacgccgtctcctacaaggcgtggtgcgagaggaccgcggatggcacacctagatatcttagtgtgacaacttatgagggatgctcaacagagcttttgagggacttttacatggataatgagtacagaatggagtgggatgacaccgtgattaagcctgagcagctgcagtgtgatgaagatagcggaatcgagatagggcgtacagttaagaagttccctcttttaacaccaagagagtacatattggcatggcgagtttgggcatcagatgagaactctttctattgcttggtcaaggaatgtgaacactctcttgcgccaatacaaagaaaatttgttcgagtacgacttctgagatcggggtggtgtattaggaaagtccctggaagagacgcatgtgaaatcacagtgctgcaccatgaagacaatggcatgaacatcgagatggcaaagctggccttttccaagggcatctggaattatatttgtaaaatgaacaatgctttacgccggtatcctcagcaccgtggtccgtcgatatcaattttgaccatgcgaagacttaccaagaagtttccccaggacttgcagatcaacgtggatgaaagtaatcgatctccggtgaatacagctgcagctgttgctcctcctacaccttcatccggaacttctccctgcaagcagctagggaagaagtcatcacgggaaacgattgcaagtggacttttgctaattggaagcatcgtttgtctgtcgaaaggtcgatctaacctcggcgcacagcttgccatggcattcttcctgaagaaggcctttaagcaggacaaagaatcaggctcttcgccaaggggaagaactgatgcgacggtgcccatgcagtagtactaggtccggcttaagctgttgatgctaccgttttatccttacaaactgagtacttactacttacttgaaattgaaaaaggcatgattttgtaccagtggccgcggccgctttctatgcttgtcaattacataatctc

SEQ ID NO: 2030 - DNA, 971 bp, Triticum aestivum
  unsure (1)..(971): unsure at all n locations
  Clone ID: PAT_TA_2030
gagtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctacatcgtctgggaggagatccagggctcgccaatccccccatccccgtccaccctccctccctcccctgcgcccctttctcttcctccagttgcgaatttttgtatgctgccgctgtttatttggctgcgctgtggcgtactgtcagctgaaaactgcttctgtattttctactccagtactttatggagtagtatataaggacgtcttactatagtatggctgaggcagtgaccagcttggtaggtagtactagctgagaaaattcatgatgctggctgggatcaaaaaatttataggcttagttgctgtattggttctgttgttgtatggggatatatgcatagatatgtaacatgtgggttccaagcatgcttccgagaaaaagtaaaattatatatccaatttaaagatgttctatagacctctgcagctgctattctttgtctattaatctatgtcctcttatagttgataaagttgagtacttacagtatgtgtgcgactacgtcccttgtagttttagaaacacctgaatttttctgtcctgttctgttaatcctgaagataaaactcatatgtatatgttgcttaactataccgtagcttcagaaacatattgcatcatcaaactgcatgtatctgtgttcttcttctggtcctgaggataaagatc

SEQ ID NO: 2031 - DNA, 1764 bp, Triticum aestivum
  unsure (1)..(1764): unsure at all n locations
  Clone ID: PAT_TA_2031
atcttccagcccccccncagcagagagcgcccccccgacctctcctgccagtgcagcctcgccgtcgccagggaccagcggcgccgccgcctccaccccggccggcactcccgccggctcccgcggggcgtcctgcagcgagctgtatggagtggtgaattgggtaaaaaggtgaggagagaaaagtcgtagtgtcatggctgtatgcacatcaagatctcaactcctggaacctaagcaaatgacgaaatgcagtattggtgatataacatgggttcagcaggttggcacctcaggtcctcaaggcggcgtgatcgagtaagcatgtgacaatggcaaggcaacaaggaagacaagcaagactgctctggacccactggttcgcatatgtcgagccttgtaagtctaccatgggaggcctaaggtagtctaagaaagaattcgaaatgtttatgaaaaaagaacataagacgcctatgaaggcgttctatgagagtacttcagacagtgctctttcatttgaagtcgtcaagagaaaacgaggaacaagcagtcaaaaaagaagacaaaaagactactaagaaaagcagaaagcaggacggctcagagcagttcggagcaatgcaaaagatggaggtgctgttcagaaaggaaaaaagcagaaaggtgtgagacaagcaagtgctcttgacaaagctttgagtatagaatctgctgaagattctgctgaaggtttaagagataagacacccaagcaagcttctgctgtgcgagataaaaagagtggtaagaaggcattatcaggaacatcggtggccaaaaaggaaggatcctcaaagcggtcgggccgtaccaatctgaaggaacattcagatgcggcggaggacagcacatcacagctccatgtttcaagcgcaagtgaaaatgcagctgaagcaggagacatgacatccgtgaatcgaagccagcacaaaactggtttgacggtcgaaggaacccaccggaagataaaagctatggtcagggatatactgctgggggacgtcatagacaggcagcttgctgctgaaatggcatatgtgggtgaagtgatctttggaatctgtgaagctaccgaggcaaaggcgactgctgctactactactgagacagagggtggactaagcaccaagcgggccgctagtgggctggaggctgactcaagccgtgctgcgaagaagaaacctagaaagggcaaggcggcaaagccggagaccaaggaccccaactcttctcctgggcgcggggggatcggagcagcgtagcgtgcgccagatcaagatcatgcagagcctgggcctgatcgcgccgttgggatctccgttcgacgtgaagggttctgctgcagtcgcccgttgatgatattttgtaagcacaccattggttctgtatggaaacctgtagttatgttgcctacctgatctacctactagtttactagtgccaatttctgtgccaatttacggaagattcggcccggacatagctgctgcgcaagtaagcgcacagttagttctatctgtatcagcgcaaatacgagccgcagtcgctcagtgctgtaccaaattggttattaatggataaagtcgcgattaagttgcgcacttaggattatttccggttggtgctaggaaggatctggcgtgagtgacccaatgctcaggttatcttgagttagcacattgtatgagctgggacatttcaatgccatgtcgattttacatc

SEQ ID NO: 2032 - DNA, 1119 bp, Triticum aestivum
  unsure (1)..(1119): unsure at all n locations
  Clone ID: PAT_TA_2032
cggccggaatcgcgggcgaccagcaccgcgacgcgacggcggtgcatatttttatactgacaccgcccgcgcggcgagggctgctgggggagcgcctgctcggctggaaatggctccaatggctgcaaatgctgcttggcatatgggtgagtgggaccagatgtctgaatatgtttctcgtctggatgatggggacgaaaacaagctccgctcgttgggtaacacaactgctagtggtgatggaagcagtaatggtgctttctttagggctgttctttcagttcgttgcaaaaagtatgaagaagctcgtgtatatgttgagagagctcggcggtgtttggcaactgaacttgcaccattggtacttgagagttatgagcgtgcttataataacatggtgcgggttcagcagctttcagaactcgaagaggtgattgattacccccccctccggatggaaagtccaactgctgatgggcgaagggaacttatccgcgcggacgcgtgggagcgcattaaaggaacaaaacggaacgttgaggtgtggcaagccctacttgctgttagagagttggttcttcctcctaatgaagacagagatacctggataaaatttgctaaactttgctggaagagtggacgtattagtcaggctaaatctactttagtcaaacttttacagtttgatcctgaatcttctcctgagttgacactgtatcatggacatcctcaagtagtcctggcttacctgaagtaccagtatgctgttggagatgagcttaaacgaaaggacgcattttctaggctacaggatctgtcagtgcagattgcaacagccacaaatagttactctggaatgctagtaagccatggtgctatatcaagtgctggagtaccacttactgcccgtgtctatttgacacttgctagctggaagagagcactgtcacctggattggatgatgatgccattcaagaaatattggtttcctacaaaaatgccacattaagtgccaaggactggggcaaggcatggcattcgtgggctttgtnnacactgaagtcatgtcccgatatactttgcgannccgtccagntatagcnnnnnaatatgttgnn

SEQ ID NO: 2033 - DNA, 622 bp, Triticum aestivum
  Clone ID: PAT_TA_2033
cttaatttttccatgatagcatgggggcaaacatgcagctggacatccagacatctgcctatgaagcgagcttgattcagggatttttatatcttgatagtgagggttctccaattggttgggaagtcataaacccagaacctcctaaccagatgatctgtggcccttcttctgaaccaaactcaaaggtgtctggacattgtggtgagctgaacatgcagaatgaagcacgaacatctgaacaaagggagatatcagagtctgatccaagtaaaaatggtaaaaaaaggtctgagaaggttgcaggtatcaaagatgatgcccttagaaagaaacagaaagtaaatagtgttcatgcaagtcattgtgcaattggtaagaatatggacattacaactgaggttccagctagctgtgtagttcacaatgggaaagaacagataggtgcaacaagcagtgagcatgcttcttcgaatcaaaaaaggtcacaggaggctgcagatatccaagacgaagttcgtgaaaagaaacagaaagtaaatgatggtcttataagcgactccataattggtcaatgcatggatggtagtacagctgagattcctactaggtgtgtgacacg

SEQ ID NO: 2034 - DNA, 1269 bp, Triticum aestivum
  unsure (1)..(1269): unsure at all n locations
  Clone ID: PAT_TA_2034
gcacgaggcgtcagtgaagcttttgcctttgcagcactgagaagatgagcatgctcatgtctttcccgcacggtctcgccatgccggcacaggcccatccaagctggtgtaggagccgggttgcgacaagagctgggagatgggcctgcaagcccaccgcgacagctcatttcgacaacacggtgacggggacgctgccgacgtacatgtgcgtgggaaaccgggtggtgggctgcagcgacgacacgggctgcagcgacctgccctgggcgcgctggatccgcgggtggacggccgaggagaaccgccacggcgacctcctcaaccgctacctctacctctccggccgcgtcgacatgcgccaggtcgagcggaccgtccaccacctcctccgcaacggcatgcagatgctcaggccgtccagcccctaccacaacgccgtctacggttccttccaggagcgcgccaccttcatctcccacgcccacaccgccaagcacgccgcgcgccacggcgaccgctgcctcgccaagatnctgcggcgtcgtcgccgccgacgagaagcgccacgagacggcctacaccaaggtggccgccaaggtcttcgagctcgacccggacggaatggtgcaggcgctggccgcggtgctgcgggacaagatcaccatgcccggccagctcatgaccgacggccgcgacgccgacctgttcgagcacttctcggcggtcgcgcagcgcaccggggtgtacacggcaagagactacggcgacatggtggagcacttcgtgcgtaggtggaaggtggcggacctcggcggggggcagctgtccggcgaggggcggcgcgcgcaggagtacgtgtgcgggctgccgcgcaagatccggcgggtggaggagctggcccacgaccgcgtgatcaaagccgcgaaagagcccgagttcgcaaggttcagctgggtcttcgacaggccagtctgcatcagagcctgatctagccgcccatctaccaaaaatttcaccccaaaagtatctactaaattccacccctagaaaatctactaaatcctaaggccatgaatcacaagcaggggcatcaggatgatgatcgtcataaaagaatctggtagagccaggtttatacggtaaacgtaccctagatgattttgtgtgaagtgatggtaatgtatgtttgagcgaatgtatgcatttctcttttgtgtgtatgtgcagaaaactcagctaaataattagctgcaatcaatttatgtg

SEQ ID NO: 2035 - DNA, 675 bp, Triticum aestivum
  Clone ID: PAT_TA_2035
gcaattccgtggccggccatggcgagcctcctctccctcgtgctgctcctcgcgctcctcgacgcgtcgcgcgccaccaacttcgaggtcggcggcgacgccgagtgggtcgtcccgcaggccggcgactcccaaacgtacaaccattgggcgtccaagaaccacttccacgtcggcgacatcgtccatttcaagtacaatcaggactcggtgatggtggtgacggagcaggggtacaacaagtgtgagtcgtcgcaccccatcttcttctccaacagcggtaacaccgaggtgcgcctcgaccgccccggccccttctacttcatcagcggcgtcaccggccactgccagggcgggcagaagctggtcatcaaggtcaccgacaaggccaggccaccgccggggccccccagtggggctgcgccggcgggctttggatccgccggcgccattgttgtcttgatggcggtgctttggcctcttcttgttatgcacgatatttaagatgaacatccatataatgcttttggagcttcacattaatggttttagctcctttccatcattccatgtattctcggttcttagttgttcaatttagttacagtaccatggaatgtacacaaaaccaaaaggctaataaattagtgcaacattttgagaataaaaaaaaaa

SEQ ID NO: 2036 - DNA, 615 bp, Triticum aestivum
  unsure (1)..(615): unsure at all n locations
  Clone ID: PAT_TA_2036
cgaacgccacgcggcttattacggtgcagtccccgctcggcggcgacaatttcgggcagttcggcgtggtagacaacgagctgcgagacggtccagatcctctccgctcgtcgctctgtggccggttccaagcccagtttgcgctggcgggtctggtgagcccaccgggcatgcagtcggccgtcaacttcttgttcacggaggggaagttccgcgggagcacggtgtctgtgctgggccccattctggacttcgagaccacctgcgagcgcagcatcgtgggcggcaccggcgtgtttcggatggcccgcgggtacagcttcatgaggcttgtgcctgagatgagcgtacccgataagtacagtgtctacaggctcgacctcttcgtccaactcagctcggaccgtccgccacngctgccgccggttgattccgttggcgcttacggacattttaatctgaaataccaagtttgtgctagctgctcggtttaagttcagcttattatctgtagcgccagaaacgtgctgtagttcatgttgcggcccaagttaatatgtatcccgtcggagtaaactcgacacgatccgcccacatggggatcgtggcgaagtt

SEQ ID NO: 2037 - DNA, 638 bp, Triticum aestivum
  unsure (1)..(638): unsure at all n locations
  Clone ID: PAT_TA_2037
cncagcngggnacgctnagttccgccactgggtccgtcccggtgtgttttcccaaatntngnaacaattcccttgtcccggcttgtanagagtatgtngaccccggggatggcgtggcaggccggcaacggncgtcggccgttgttttcctcccggccggcgtcaacgcccagtacatcatcgagggcctctccctccggcgtcatgttcctcctccggggggtcggggtcatcctcctcgatctggcggtcgaccgcaccaggccccgcagcctgcgcgtctccttcggcggcgccggcgtcgccgccatcgtcatcgcctacgccatggccatgctcttcctccgcatcaagatacccggatacctatggtgaggcctagaaatcatctccctacttcattatgccagatccgccatcagatctgaggatactactaagctgttgctcatgactctagtagtgtacaatttaagttatgttaccttaggatgttgggtcgcactcaaatttcagtcggtgatcagaggattatctatttcaaatgatagtaaactgttgtgtgttcctttttcctgaaactgtgattgcgtgataaagctcaggtcatctcccattttctatttaaaaaaaaaaaa

SEQ ID NO: 2038 - DNA, 1040 bp, Triticum aestivum
  Clone ID: PAT_TA_2038
cccacgcgtccgcgcctctcccttctccgccttgtctctgctcctctccgcgccgaggccgccgccacacgccggcgttctcggtctacttccccggcctctccccgtagaccagcacaagccacggcgacggcgtcgagagaagacgccgctgtacaccgaccgacaggcgggtcccacacgtggtgtgggcgccccacgtcagggtgacttccgaactcatttctgcgtgcggttgaagtcaccctattccgtccgcgactcctcccgtccctccctcctggtgtggagtccaggtcggactcaccgcgcctccgattcgatccccccacgccggggttcagcaggaatcctaagcttggaagggcggaggaatcctgcacacacatagctccggaatcccgcaagcgcgagaacgcccggagctaaacccgagttactgctgcgacatgaagcccaaggttgccgcagccgctgccggcggcgagaagggccggggagtggacccgtcgctgccgcggttcaagtgccaggaatgccaccgggcgctcgtcgtcgtcggcgtggagtcattccccgataggttgcccgctcacgccaactccggtatacatgcatcctctgttcagggcagcattatgggggcgagcaggatggacagttcttacgttgtgttgtccaagcagaacagatctcaaggccccaggattcccccacggccacctagtgcagcagcccggcatgttgagcctaaccaatcaacaagagcaatagaggggtcatatataatgcttccacctgccgctgcttccatatacaagacatctacctccgaaagaggtggcgcgcatctgtcgcctccaaatgttaactctactagcccttcccaggcaacaattctggatttaactctagtgtgactgtcttaagcgggcatttgagattgctagttcacaaactcaggttgagcagccactctgtctggaatgctggagggtgctttctgatagatggacaagagatggaaggatgtaatactg

SEQ ID NO: 2039 - DNA, 1027 bp, Triticum aestivum
  Clone ID: PAT_TA_2039
gcggtattggcatgaattaacagcttccagtttcagctgacatctcaccaggaagaaagagatgcggttttggccaagatagaagtttacaggtccacctggaactgttaaagcgcacaaatgttctcaatgatgcattctatatttcacatgatggagtgattggaacaataaacaacttccgtctcggtcgtctgcctaatgtacaggttgagtgggatgagataaatgctgcttggggtcaggctgctcttctgttacacaccatggctcagtacttcccgaaatttcaatatcgaatcaagattcaccctatgggaagctacccaagagtaacagacatcaacaataatacctatgaactgtttggtcctgtgaatttattctggagcacccgatttgacaaagccatgacatggttcctcacttgcctgcaagagttctccgagtttgccataagtttggataaagagaacaatgttccatctgataagtcattgaagctcccctacaagattgatggtgacaaagtagggagctacacaatcttcttaagttttaataaactggagaactggacaaaggctctaaaatatatgctttgcaacctgaagtgggttctctactggtttatcggcaatacaagtttcgcgccgccatctgcatctttgtacttggcgcagtctccaaacaagaagggttgatgtgatgtttaaatgcagacggaatcactgacctcagaagctggatcgttgattgtagccgcatgttgaccaatcacaacaatatgaaattgatgtacataaataccaggcatagctagttttcttgttgcttccaagtcatccatgtgtgtacctgcccaatgtatatgaatatggactggagtgagttccattaatatgtactccctctgtaaagaaatagatcgtttagatcagtatttatcagctttgcgctacaagtgcagagaaattggaatgacagcgaatgcagtttcaatgtacctgcgttgcatctgacacct

SEQ ID NO: 2040 - DNA, 2056 bp, Triticum aestivum
  Clone ID: PAT_TA_2040
tccctcctggtgtggagtccaggtcggactcaccgcgcctccgattcgatccccccacgccggggttcagcaggaatcctaagcttggaagggcggaggaatcctgcacacacatagctccggaatcccgcaagcgcgagaacgcccggagctaaacccgagttactgctgcgacatgaagcccaaggttgccgcggttcaagtgccaggaatgccaccgggcgcgcgtggtcgtcgccgtggagtgattccccgataggttgtccgctcacgccaactccggtatagatgcatcctctgttcagggcagctttacggcggcgagcaggatggccacttgttacgttgtgttgtccgggcagaacaggcctccgagccgcaggactcccccaaggccacctagtacaacggctcgtcatgttgaaactgcggaggaatcatgaacactagaagcttcagaatcccggcatccagcggccgctccttccatatacaagacatctacctccgaaggaggtcgcgcgcatctgtcgcctccaaatgttaactctactagcccttcaacaggtaacaatcctggatttcactctagtgttaccgccttaaagcgggcatttgagattgctagttcactacctcaggttgagcagccactctgtctggcatgtatgagggcgctttctgataagagggacaaggagattgaggatgtagatactgacatcaaagcttatgatgcatgacttcaacgtttggagcaggaatcctacaacatccttagcgaacctgatttcctcaaggggaaggagaagatagaggaagaagaaaagaaactaaaagctgctattgaagaagcagaaaagcaatattcagaagttagctctgagatgaaggatctggaaatgaagtccaaacaatgcgaacaaatgtaagagcgacattggcttgaattcaaaaccatccagtttcagctgacatctcaccaggaagaaagagatgcggttttggccaagatagaagtttcacaggtccacctggaactgttaaagcgcacaaatgttctcaatgatgcattctatatttcgcacgatggagtgattggaacaataaacaatttccgtctcggtcgtctgcctaatgtacaggttgagtgggatgagataaatgctgcttggggtcaggctgctcttctgttacacaccatggctcagtacttcccgaaatttcaatatcgaatcaagattcaccctatgggaagctacccaagagtaacagacatcaacaataatacctatgaactgtttggtcctgtaaatttattctggagccagacatctaccaataatacctatgaactgtttggtcctgtgaatttattctggagcacccgatttgacaaagccatgacatggttgctcacttgcctacaagagttctctgagtttgccataagtttggataaagagaacaatgttcccactgataagtcattgaagctcccctacaagattgatggagacaaagtagggagctatacgatcttcttaagttttaataaactggagaactggacaaaggctctaaaatatatgctttgcaacctgaagtgggttctctactggtttataggcaatacaagtttagcgccaccatctgcatctttgtacgtgcccagaggctccatcctagattgtatgatgtgatgtttcaatcaagacggaatcacagacatcaaaagctggatcgggcattgatagtttgcatccgcatgttgactaatcacaatgtatatatgaactagatgtacataaatggcatggagcatagctagttattatgttccccccatgtaaagaaatagatcatttagataagtatttatcagctttgcgctagaagtgcagagaaatatgaatgacatctaaagcagtttaaaaaaaaaaaaaaaaaaaaaagtatcagctttgcgctacaagtgcagagaaattggaatgacagcgaatgcagtttcaataaaaaaaaaaaaaaaaaaaaaaaaaaaaaaaaaaaaaaaaaa

SEQ ID NO: 2041 - DNA, 1072 bp, Triticum aestivum
  unsure (1)..(1072): unsure at all n locations
  Clone ID: PAT_TA_2041
gccaaacttagtttattcctacaaacaatttatgtatttatatttcatcgtgcgcatccgtactgcggcgtgcgccttcgccctggggtgctcgacggtaccctgtccctccagcgggttttggctcacggcttcgccatacggtagttgccttgcccgaaggcaggttccctcgaggcaaaacttattctggcagaaggaaataatttccatctgggtgtacgttatattatgcaatcacacggactcatcggggagggccctgatgctagctacttatggattgcatgccacccacttgatgtgtatggacatgcgcttaaacgtggtcaattaagtcgcagtggaatttgggttggccatagtggagatggtcgaaaatcaagctttaatgcaattagtgttggatggcatattgctccagaaaaatatggtgactctcatcctcatttatttacctactggacgagggatggatatcagagtactgggtgctacaacatggattgtccaggtttcatagcagcgagcagcgctactgttactccacgcccggagctctcataaatccatcttcaaaggttacgcttcgagtgttgaaggatgaccaccgtggacactggtgggtgtactttggcttcaaacggcgtcccaaacggcttgtgggctactaccccaaangtcattgttcacaaacatggcaaaaaaggcaaaccagttctcgtttggtggcttcgtgttcgcagaaagggcacttccaactcctccactgggcagtggcgtccttcctggtggcaagggacgtgcggcatcgtttactgacttgcgcctcattgaacgggatggaaggagcagccccatcatgaaggacttgcctactgttatatccaacaataaatgttattctatcactcctattgttaattccgggtgcttctatggcgggccaggaggttgtgtgtaatactaagctgtactttgaacgtggtggtgtaataatgtttcccttgagtttgtcttcccaaactcatactggcctaataagacactatgtgtttccgtaaaaaaaaaa

SEQ ID NO: 2042 - DNA, 530 bp, Triticum aestivum
  unsure (1)..(530): unsure at all n locations
  Clone ID: PAT_TA_2042
gaaaaataanccaaatgggggttnccgcgcaaatttcccccgaaaaggtgccnacctaaaantggcgggccccgtgctatgtgggcgtgcacttcccgcccaccggcctccccttcggggccccggagcgcatcgccaaccggagcatcaccttggtcgactggtccccgcggcggcgccgcacccggccaccttcggcgccgccgacgtgactgaggacttcctggggatgctggtggggaagaaggggaatgctgagcggtgcatgtacaacgggcagccggtcgaggtgtgcttcctctttgcgaggaagttcgcccccgccgctttgccgcagctgctcagcctttcctccaagatcctcgggtactagctaggccttttacgaaattgattttggtctgcttatgtatagctcatactcactggagcggaatagaggaatacaattctttttttatgtgtcacgagaacaaaaggatgaatgatcgagtgggtagttgtttcttgtccattcatatttctgaaaa

SEQ ID NO: 2043 - DNA, 867 bp, Triticum aestivum
  unsure (1)..(867): unsure at all n locations
  Clone ID: PAT_TA_2043
tggatcaancaagcaatacgcaagtcggttctagaacaaacccagataattcgcttgccagcacacatggcggaagcaagttcccggttgaaagaatgccggcgacgactccggcggcagctgaataggctaccgacaaatgaagaaatcgcgttggacaccggcatgacagccagacgggtggaagcagcaatgtgcctcccaaggtacagcgtatccctcactggcaaagtcgggtgcacggacgtgacataccaggagatcacggcggacaagagcacggagacggcggaggagacgctgcacagattgttcatgaagaaagacgtggacaaggcgctggacagcctgacccctcgggagagggaggtgatcaggtacaggttcgggatggacgacggcaaagcgaggaccctgcacgacatcgggcagctgttgggggtgagcagggagaggatccggcagattgagatggccgccttccgcaagctcaggagcaagaagaaggtgacgtcactacagcactacctggagccggcagagagctggtagctatggctatagccggccgtgttatgagtacgtactacgaccttagcaacgcacggcctttgcttgctggctgccgagctagtactggattgcctgccgtatttttgaaggattaacgacaacatatacgattcactctcgagcgtcttgtactatacattgtgtaaatgaacgaaacaatcttagtagtccgtttcacaagatcggcttatgtgtatctaggcttttgccaccgataaaagttgcatcagtcacgtgcttttgtagcgacgcataaactttgcacttttaaaaaaaaaaaaaaaaaaaaaaaaa

SEQ ID NO: 2044 - DNA, 621 bp, Triticum aestivum
  unsure (1)..(621): unsure at all n locations
  Clone ID: PAT_TA_2044
acgcgaatcaggtaggtggcgctcttgatccctcgtcctcccccacaatccccagcacgcacgcgcgcacgaactaatccggatctctctgctaaccctctgatctactcggccgcgtcgcagctagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactacttcgatcaggcactgtgtggccattgctctctgaacctgtgatacttccctagcaatatcaagctctgatacttatcttcgtttcagcactgtgtatcagactttgtaccttactgcatgtagttatcggctgcgagcagcataacttgccgaacaaaaaaaaaaaaaaaaaaaaaaaaaaaaaaaaaaaaaaaaaaaaaaaaccaaaaaaaaaaaaaaanaggggcgacccgttttaaa

SEQ ID NO: 2045 - DNA, 556 bp, Triticum aestivum
  Clone ID: PAT_TA_2045
aactttcacacatcaggctggcatctgtcccgacgagcagccgcccccaggtctagggttccccctttcctcttctccacgcgaatcagctagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactacttcgatcaggcactgtgtggccattgctctctgaacctgtgatacttccctagcaatatcaagctctgatacttatcttcgtttcagcactgtgtatcagactttgtaccttactgcatgtagttatcggctgcgagcagcataacttgccgaacaatgatagttcccagagagtatcgcaattacccaaaagtttgtggacatgcagg

SEQ ID NO: 2046 - DNA, 782 bp, Triticum aestivum
  unsure (1)..(782): unsure at all n locations
  Clone ID: PAT_TA_2046
ggggccgccgcatctctcccccccttcaacatcaggctggcatctctcccgacgagcagccgcgcccaggtctagggttccccctttcttcttctccacgcgaattcactccagatactagaaccagcatcgatggcggcggcagcgccggcggacgcgaaggcggaggccgccaagatggacctcctcgaggacgacgacgagttcgagggagttcgagatcgaccaagaatgggatgacaaggaagatggcaacgaagctgtccagcaatgggaggatgactgggaatgatgacgacgtgaacgatgatttctcactgcaagcgaaggaaagagctggagggagggcaacactcaagaaggagctgaactacttccccatccatatcaaagctgtcagtaaactttatcttcgcattcaggcactgtgttgccctgttgctactgcttgaaccttgcgatacttccctagcaattcattcaatgctttgatactttatcttcgtttcactcactggtttcacatgactgttgttatcagactttagttaccattactgcatgtagttaatcggctgcgagcacgcacaacttgtggaacagtgatagttaccagacagtatcgcaattacccggaagtttgtcgaaaaaaaagaaaccccgcaagtaattagttttgtacgcttacattacgcccttccccccatccgtttaccgnaaaggaggngtagacacccgaagctagggcctattatttttatagtttgtagatnaaacgtatt

SEQ ID NO: 2047 - DNA, 1714 bp, Triticum aestivum
  Clone ID: PAT_TA_2047
cccacgcgtccgacaggagtcttttttccgtccccgtacgccgcggtggctttccccgcctttccccacccgacgcaccctcgccgtcaagtctagggtttagcggagcctgcagccgtctcccgagccgcccatggacgtcgactccgaaccgtccgccgagagcaagcccacccagatggacctcgaggaccaggcggacgcgaaggggaaggggaaggccgatgccgcggaggaggagaaaggaaatggaaaggggaagggcgacgaactcgcggactccatcgggagtctatctatcggcccggggcgcgccaacttcaagaagaagccggtgatcatcctcgtcattggcatggccgggacggggaagaccaccttcatgcaccgtctggtgtgtcatatgcaggcatcggcgaacatgaggggttatgtgctcaaccttgaccctgcggtgatgacactgccattcggagccaacattgatatccgcgataccgtgcgctacaaggaggtgatgaaagagtacggacttggtcccaatggtggcattcttacctcactcaacctgttctcaaccaagtttgatgaggttatatctgttattgaaaagcgagcagaccaactggattatgtgctggtggacaccccagggcagattgaaatctttacctggtcggcttcaggagctatcataaccgaagcttttgcatcaacatttccaacagttgttgcatatgtggattgacacccccaggtcgacaagccctgtgacctttatgagcaacatgatgtatgcatgcagtatcctctacaagacccgtttgcctctggtgctgacatttaataatgttgatgtagccaagcacgagtttgctcttgagtggatgcatgattttgaagcatttcagacagctttggattccgactcatcgtactcatcttcatttacccggagtctctctcttgtgttggacgaattctacaacaacctacgctctgttggagtatcggcggtatctggcactggaattgatgcattttttgaagctatagaagcaagcgctaatgaatacatggagacatacagggctgatcttgacaagaggattgctgaaaaggagagactagaagctgagcgtaggaatgagaacatggaaagattgaggagagatatggagaagtccaaagggcaaactgtggtgctcagcactggtttgaaggacaaaactcctgcctcagagatgatgggggatgctgatgaggaggaagaagaggaggcgttggaggatttcaggatctccgaggatgatgatgatgaagatgaaggagaagatgatgaagtgactcattttggcttttaaggttgattgagttgaacagggcatttactggagggtgttcaggaggacccggtcgggagtggtgtttgtttcgaggttattacagtggaaatgaaatgccatcgatatcactaggtggatcactgccgttagtctgtaaatcaactcgcactttaccaaactcgctgcaatctcatgatgaactgaactgtattcactggctacgctgtacgaattgtttccttgacttgttctgcacacttttgaaaactgctggggcggtaattcggttacatgaatagacaaaaaaaccgcgcgatcagccgcagccgctgtgccatcactgtcgtataattatcatggtaggggat

SEQ ID NO: 2048 - DNA, 1419 bp, Triticum aestivum
  Clone ID: PAT_TA_2048
cgtccgcccacgcgtccgcgcccatcccgctcctctcataatcctgagagtttcttcttttgttttatttttctttcttggtaggagtaacaatagttttggctctcctcctttctctctccctgtatccaaggagagaaatccagaggcgaagcttcagggtttgtaaattttccggatctaatcaactaaccaaaaaaacccaaaaaagaaaccatgagccacttcgccgccatgaagagccccgtcccggtcgccgccgctgccgccaccgacgcgaagagcccgctcttctgccccaagccgcgccgcccggtcgcgcccctccggtgccaccagagcagccactccgacgcgggcgccggcatggatctgctcgacctcctcctgtcaaagggcgacgagagcaatctttcggcggcgtccccgcagccgccgctgttctgtggctcgcctccgcggcgggcttcgaacccggtggtccacgacagccggttcggcatggactgtccgtccagtcccctgccggtcacgccagcgccggtggtggtccgtcctaccccacgcccggcgggaccgccgatgtcgccccgttcctcggctgggtgcgctcgcgtgttccagccagccgtccgcgtcgagggttttgactgcctcgacggtggccgtagcggccgtggccatggcatcgccgccatggtctagatgcacatacaacatcgaataaccaggaaatcttctcccctcagtagtgcaaaagctttggagggagagagatgagagtgaggaggagatgagtgagaggagcttaagtccaaaatttaacccctaaaaactatataatccatcagtcaaatcccataagtataatgagtctaggtaattttaccacaaatctttttgtatgtaaataaatttcaggttcagatgcaggtgcccttcttgtaaatttgggagctctagtttgggggggatggggtagaagaaatctagagggcggggatcagggacagagggcacaagaaacacaaagtttagccctcttgtatgaatcatttttttcatgagtccctttgccttccttctggattagtcattcaattaggttggagggagggaggggttgggaattagttaggtacctgtcctagttcatctgtcatcatgcttatttttggtttatgatggaattgtttttgtccatgcaaccaagaaatccagggccacgcaaggccatggagatgtgtacaaaagagtggctacaagaagagaagagagagcagctaggtttaagtcaagtcaatgagtgagttgtgtgaaaggcatgaatgatgtattcgtgatatcgttttctctgtatatgtaatatatcgtttcattgaagcaatatgtgtaatatctcatgccatgattatcccc

SEQ ID NO: 2049 - DNA, 672 bp, Triticum aestivum
  unsure (1)..(672): unsure at all n locations
  Clone ID: PAT_TA_2049
caggcaccaacacagctagcattagcgccaccaccaccacccatcagccccatcatcactggcagtaccagctagctagcttaagcttgcagcaactgcttgcgctccacacttcaagcttgtgatttgcctgcatactcaagctaagcttctcatggcgccggcgtccaaggtcatgagccacatcgtccaagacggcggcattgccacctacgccgtttacgccgcgccgtgtgacgcctggtgcggcgggcggcataggaaggccgagacggacggcgacgacgacgatgacgactatgactgtgcgcctgccgcctgaagtgtacgtacgttcgtacatggtcgtcggccaaacgaatctggaacctgcccgccaagagctagtatatatactgcgaactgatcgctgctgctgtgtatgctaatacgatgtcaagtacgtaggtacgtatatgcgtctgtttacagctacttatgaatgtatcccccctagtatatgaggcagtgaggtgtgctttttgtaaccgggaagtagagttcgtgccgcttaattaacccaccgtgctggctaaatatgctcgatttagctatgcttagttacctactcgtatagatattgaaagtacccttgtgttttnatcgacttgttacncaataaaacggacatct

SEQ ID NO: 2050 - DNA, 694 bp, Triticum aestivum
  unsure (1)..(694): unsure at all n locations
  Clone ID: PAT_TA_2050
cgtcgtttcatggcgctcgccgacgtggcggacgacgtgcaccggtgggtgcgtgaggccgcgacggacgagcacttccggggcttgatcgactgggtggaggcgctgcggcccaaaccggccgcggccagggcgtacctgggcggcaccggcggcaccaaggcgacggcgtgcatcgtgtcgtcgggcatgggttttccggtccgggagatcaactttgggacgggcctgccggcgttcgcttcgtaccacttcccgtggcccgccggcgcggcatacgtgatgccgatgccgagtgcgcgcgacgacggggaatgggtggtgtacgtgcatgcagcgccggagctggtgaaggtgatggaggaggagccgactgttttcaaagttctccgagaacagctacgtgttcggatgaaggacattgtggtgcctgttatttaagagttgtgtacgtacgtacgtactgtaataccaccaactaatcgttgcgggtatatatatataccccagatattanccccccgtgtgtgtntgtgtgttgtgtgtgtgtgtgtgtgtgtgttttgtgtaaaaaanttttnttncccccnanaagnatttgtgtggtaaaataatgttaaaactttngattgcnaacaagnattaatgccaccaatttgacacactatacnaattacttcncaacaaagtgatt

SEQ ID NO: 2051 - DNA, 670 bp, Triticum aestivum
  unsure (1)..(670): unsure at all n locations
  Clone ID: PAT_TA_2051
ggtccggaatcccgggtcgacccacgcgtccgaagtatgcagatacaatttntgaagaagtattcctcaactgttgtatctgcatacttgaagaagaatgaagaaagaatgcagatacaattttgaagaagtattcctcaactgttgccacaatttttactggtctagcctctgctgcttttctgggacataccctggcttttaaccgtctcctgggcttgtccgtggtggccacgcctgggctgctgtgcgccccacctttagcttttctcttcgaccgcaggccagcggagttgttgctggtgcctgcttcgctgcttcctcggtctccccattccgcttttgtgtttgtgacggcgcctcctgccgaggacgcctgccttccgctcggccctggtgcgccgcgtcctcctgcgcctaggtgagacgtctcttttgccgggtggttccaacagttgggggacagcagattttgtgtggtgctgcgagtgaaataaactactgtacactgttaaggcaaagacagaagttacaaatgtgttgcccttttccatttcattcttttggagggggtgcgtccgtgcgtggccaggtggcgcatgataacttggatagtaaggatatattatctccacaggaagtcctcaatacgatacacatagaaattcat

SEQ ID NO: 2052 - DNA, 790 bp, Triticum aestivum
  Clone ID: PAT_TA_2052
gcgcgttcagtgtggtctgctggcgcgagccctcccctgtgttcactaaattttgatcaatcgatggctcagctgttcagcttcttcttcgtactactcatcgctgctcccgtgcccccgctgcccgccggcgcgggggtcggcctcggcccgccggtcccgtggcgcgtgccgcccctcgtcggcggcgccgtcggctgccgcgggccccccaccgtgcagttcgtcgtcgacgtctcctgggcctccagcttccagttcgtcgccgtcggcgcggtggacttcttcgcctactaccactccgtcgggacggcgctcgcccccgcgccccccctctgcgacgggacctcgccctgccccgcaggcgcccccggcgccgcctgctccgcgtccgcccccggccagcgccgcttccggcgcctgcgcctcctgcccctcctcgccccgctccgcctgcgattgcacctggaccggcccctggagagcccgtaatggacagcggcaccgcagtagtggcctcgtcacatgggcgcgccttgatgttggtggtttctagcacaacacttgcattgatggggacgattcgggcctgaatgcgtgtgtgagacacaatgcggcgtggcattgtaggtcgtctagtgcaggctcgcgtgcctcgctatgcgccttggcgctgttcgtcccctacggtatgatagttagagaatgtgtgcagtttgagtttcttattgccgaacacaataaagtttgtgcatgtctgctgttgcgtgccccagagtaacacaataaa

SEQ ID NO: 2053 - DNA, 1198 bp, Triticum aestivum
  Clone ID: PAT_TA_2053
cggacgcgtgggccgatgaccagtcgtgtggtgacgctgtggtaccggccaccagagctgctgttgggtgctacggattatggagtaggtgtcgacttgtggagtgccggatgtatccttgccgagttgctggctgggaagcctattatgccgggacggaccgaggtagaacagttgcataaaatatttaagctatgcggatcccccgctgaagaatattggaaaaaatcaaagctgcctcatgcaaccatatttaagccccagcagccgtacaaaaggcgaatagcagagacattcaaagatttcccgcaatcagcacttcggctgattgaaacactcctatcaattgatcctgccgatcgtttaacagctactgctgcattaaatagtgatttctttaaaacggaacctcttgcttgcgatccatcaagtctgccccaatacccaccaagcaaagagatggatgcaaaacgaagagatgaagaagctagacgtttaagagctgctggtagtagacctaatggtgatggagctaggaagacaaggacgcgggatcgaccaagggctgttccagcaccagaggcaaatgccgaacttcaagcaaatatcgacaaaagaaggctaataacgcatgcaaatgcgaagagcaagagcgaaaagttccctccaccacatcaagatggcgcactcggctatccgttgggttgttcgaatcacatggaacctacatttgagccccccgacccgtcttcgttcagtaccgtatttccttacgacaagaccgccgtgcctacgtggtctggacccctggtcgaccctcctgggggcaaccagaaacggaaacacaagtcgggacgctcttcgaaacaaccatcaactgcccgtgctcggtgatacattatgtgatatttggtgcataagaaatccctcacgacggacaccgcactcgcctgcagtgcctgggagctggggagatctgattatatgaagcagcgatgaattttttcaagacccatgaattcattccatgtacggattcttttcaaaccgcagtgtatagatgggagagggagctcagttagtcgaattctgtacattaggttgtcctttttcatttcttataagcagctatatgtcatgttagattcgtttgagtgagtaatggaatttttaggtctaaaaaaaaaaaaaaaaaaaa

SEQ ID NO: 2054 - DNA, 2194 bp, Triticum aestivum
  Clone ID: PAT_TA_2054
gcgaggccgcccctcggccgcggcgtcgcaatcatcctgcacgcccccactccacgccacgccacaccgtcaccgcaccaacccgagaaagaacaacagtggaggacaccggcagcatcagcaacacgctcgctctccaccccgacaaacccaggcaaagcaaacccaaacccaaagccaagcacaagcgcaagctaatctcgctccaggtaccacgattcctcgattatctcccttcttctccaagcttctactcccctccctgtctcgcgctctcgaccccgcaccaaccagcccaagctcgggcccctccgtggtggttactaccgctagtgccggtcggtggtgggatgcccgccgctgcgacggtggccgccgcccgctaccgtttcctcccgccgccgactttcctctcgccagtcgcaacctggtggtgccgccgctgacatcgtctgcctccgcccccgcaccacgatggaccccacctcacgccccgccgtcgtcatcgacaacggcaccggctacaccaagatgggattcgccgggaacgtggagccctgcttcatcacccccaccgccgtcgccgtcaacgagtccttctccgaccagacgagggccaccgccaaagggaactggctggcgcagcacagcgcgggcgtcatggccgatctcgacttcttaataggggaggaggctttagcccggtcccgttccagcagcacatacagcttgagctaccccattcgcaacggccaggttgacaactgggacaccatggagaagttctggcagcaatgcattttcaactacctcaggtgtgacccagaagatcactatttcctgctgaccgagagcccactgactcctccagaaacccgggagtacactgggggagatcatgtttgagacgttcaatgtgcctggtctctacatagcggttcaacccgtccttgccctagccgcaggatacacaacaaccaagtgtgaaatgacaggtgttgtggttgatgtgggtgacggagctacccacattgttcctgttgctgatgggtatgtcattgggaacagtatcagttctatcccacttacaggcaaggggggtacccagtccacccggcgactcttgtggggtagcggggagcgcgttccacccgtactgcctttcgtggtcgcacggtgggcgggggtaatgtactgctatacatgttcggacattgtgaaggaatttaataagcatgacagggagccctcaaagtacataaaacgcctgactggcatcaaaccaaaaacgggtgctccgtacacctgtgacattggatacgagcgcttcctgggccctgagatattcttccaccctgagatttacaacaatgacttcaccactcctttgcaagatgttatagacaagtgtatccaatcatccccaattgacacaaggagggcactttataagaatattgtcttgtctgggggttcaactatgtttaaggatttccacagaagattacagcgggacctgaaaaagattgtggatgtacgggtccgtgcatctaatgctcgacttggtggagatgcgaaggctcaacccgtggaagtaaacgtggttagccatccaattcaaagatatgcggtttggtttggcggatcggtgcttgcttctacagcagaattctatgaggcttgccacacaaaagcagagtatgaagagtacggtgcaagcatctgccgatcaaatcctgttttcaaagggatgtattgaaattttcgtatgaagactaggaggcatcacagatagcatctccatgcaatcagcctgagcctagctagcagtagcaggctggcagcatggtaaatggtaaaactgacaccggaggcaagctctctgtagcgtttgtttgtacacaaccagcgtgcacatagagataaacgaaacatttcgttaatacatcttctgtatactactagtacatctgtagaatggggccggtagtgcagcaaacaggagaacttgtgaccggatggcgctggcggcacctgagcggcacatgcttagctgttgtatatctgtagtactgtactgctcagtgtggccgtaaacggaacagttttggttgtgggtgagctggtatggctcctcctattttcccgtgaagtcgttgccaccgattttttggatagtggaagatttaagttg

SEQ ID NO: 2055 - DNA, 850 bp, Triticum aestivum
  unsure (1)..(850): unsure at all n locations
  Clone ID: PAT_TA_2055
ccctctcgtccgagctctcgaggccgacaaggagttcataaagcagtgcgtgtggtccttgaacaaaggaggcaagggctttgttcttcttcaaggagaatcttgcagcatcttcggggacctcagaaggatcgagcagcgtgcacggaccaactctggagaagtctcgccccactacgtgcatccttacacggattgaagataagcgccgccgagccccgcgatcgtgttcatcagcgccaacggatcaagatgaagacaccaacactccgaaaaagaaagtttgcacaccaccaacaacaacaacagccagaaaagagagagtttgccgactagctagttagcatagtcaggccagaagaagctgggctctgtcatcccgggaggagaaggagctcccccttgggtaggtccggtttcggcatccccatcnggaattcgngaccgcggttcgttgcccgcaaccctgcccttgtnaaggttttttttgggggaccccttcnccccacgttgggtcgtttaatttgcctcccgtggggtttgtgttccgaacttttgctcaagggcgagacggttggtgagccgcccaccccccatgaggtgtgtttcgtggcagaaatcatggctttgcgagactgagagagagagagcttttgggaatggttccattaattaaacctgaaacaggccacccccagctctggttgccaggtagtataggatgaatgaattatacaaaaaaatagagagagagagagagagagcatttttaaactttggctggcctcagtgggctttttcgctgtataaatctcatagtttttatttgagtgcccggcatgattgtgtg

SEQ ID NO: 2056 - DNA, 695 bp, Triticum aestivum
  Clone ID: PAT_TA_2056
gcagcctcagcagcccaagaagaagttgtcgtcgaccaagagggggcgcgaggtggagctcggcgtggtggggttcggcaaggaggtggtgctgaagcagcggcggcggatgcggcgcaggccgcggctgggcgaggaggagaaggcggccatcctcctcatggccctctcctccggcgtcatctacggctgatccaggccggcccagccccacctagctagcagcagcaagcggagagaagagaagagagatgagaggagatccagagtgtgagtgatttgctcgcttgctgctgcttgtctagcaagcaagcatgcatgcaggcagagatgtcgaggcgtctctgcccccccttgttctttcctggtagtttttccggctgattagttcttcaataatgaatgaatgaacgatgatgcagctgcagcagctgctgttcttcgcgccagcttagccttgttctttcttcttgcctagtagcagctgtgatgttacccaagtagtagtagcagtatcctagtagtagtagcagcagtagtagtgtgtaacattgcagtgtaagaattgagagagctttatgaatgatgaaccatctttgtggctccaaaaaaacccacgcgtccgcttttcagctgaaatttatcccagctgatcaaaaaaaaaaaaaaaaaaaaaaaaaaaaaaaaatcgaact

SEQ ID NO: 2057 - DNA, 491 bp, Triticum aestivum
  unsure (1)..(491): unsure at all n locations
  Clone ID: PAT_TA_2057
atacacacgattttctttgccctcgctgccgaaactgctctttcttctcgagacgtaagaccggtaatcaagagggtgaggcaggaagtactgcagggctgcaaactggttttcagtcgagtgttcccgtccgattgccggccgcagcatcagataatgtggaagatggccgagcagctgggcgccgcttgctgctcggaggtggatcccagcgttacgcatgtggtcgccgtgcatgccggaacggagaaggcccgctggggctgtcaaacacaagaagtttttgctccacccccgctggttcgaggcctgcaattatcgttggcaccgccagcgggaggaagatttccctgtacctggccccaaggagggcaagggcaaggaaaatgttccagagaatgcccacctgtaactgagtataactgacccccctagtccgcgtctactaccttgatggtagatgatgagattgttggttttttgtanangct

SEQ ID NO: 2058 - DNA, 463 bp, Triticum aestivum
  Clone ID: PAT_TA_2058
gagaggaccatgtacccggggaagtacgccgtggagatgtcctccgccatctacggggactggaggttcaccgagcagtccctgccaaatgatctcctcaagcggggggtggcctccagctccgatgagcccggcggcctgaccctgcacatcgaggactacccgtacgccgtcgacggcctcgaggtgtggcacgccatcgacgggttgggtgcgcagctactgcgcccacttctaccacagcgacaaggaggtggacggcgacgcggagctgcaggcgtggtgggcacgacgtccgcaccgtcggccacggcgaccggcagggcgaccaggcgtgctggctggcgctggacaccgtcgccccccccgccccgtcgccgtcggcgccccgccgcatcgcctccgcccggcacccggccggcttccgccggcggcaccccgcgccggtctgcgctccgggtcc

SEQ ID NO: 2059 - DNA, 854 bp, Triticum aestivum
  Clone ID: PAT_TA_2059
ctaccagcaggtgggtcagatcgaccacaacgccatcctcttcatgaacgagttcaacacgctggagcagcccatggaccccaatgggacgcccaccaagttcgtcgccaagatgaagctcatccagggctaccccggcaacgccggcctcaagctcggcgtcggcctcgagagccacttctccacgcccaacctcccctacgtcaggggcgccctcgacacgctcgcgcagctcaagctgcccatgtggatgaccgaggtcgacgtcgtcaagggccccaaccaggtcaagttcctcgagcaggtgctcagggaagcctacgcccacccaggggtgcagggcatcgtcatgtgggccgcatggcacgccaacggatgctacgtcatgtgcctcaccgacaacagcttcaagaacctccccgtcggtgccctcgtagacaagctcatcgccgagtggaagacgcacgcgacgtctgccaccaccgacgccaatgggctcgtcgagctcgacctcgcccacggcgactacaagttgacggtgaaccacccttcttcgctagccgcgtcccacaccatcacggtggatgcagcgtcatccgagcacaccatcagtttgaaagtgtaggaattacttaggcttatagagtcattcattctctttcttttcttctcttctttctctagggattttttttcctatagggattttctctctcttttttcgtggagaataaccactgcctcggcggctaccttgcagccgatgcaaggggctaaaattttgtgagtcgtgtagagagatggaataaatcaataatctaagaggcagcaacttcaaagatccaaaaaaaaaa

SEQ ID NO: 2060 - DNA, 596 bp, Triticum aestivum
  unsure (1)..(596): unsure at all n locations
  Clone ID: PAT_TA_2060
cggacgcgtgcgccccccccggccggtctcccctccctctcccaaatcgaagcgagaaattccccaaaaagctaccccatttccgtcccccagccgaggcaccggcgccgcagccgtgcccgcgcccgcgcgatgccgaacgcgatcccggccttcttccgcgcctcgccggccgcggcgtcgggctccggcgccggggcggggcccagcctcgccacctccgtctacgagacccgcctcggcctggcggcgctctcctggtcgcgcgccgcgttcggcctcagcctccgggccgtgctccgcgtcggggcgctcgcctcctcctcctcggcctccgactacggctgctacgacgacggcccggagttcgacgaggaggccaccatcgcggtgcgcgtccgcccctggctcttctggcggcgccgcgggtccaagcgcttccatgtgcacgaccgccggatcgacctcgcctnnnacctcacccgcgcgcggttcgcctcccccggctcgcccgagccgtcgtacggctacttnatcgccgtcgtggtcgacggcgagatggcggtcgtggcnnnggacatggcgnnnnnnnngta

SEQ ID NO: 2061 - DNA, 1074 bp, Triticum aestivum
  unsure (1)..(1074): unsure at all n locations
  Clone ID: PAT_TA_2061
gctgggatactcggtacaagnatagctgttgaggctgccaaggggctatgctatcttcaccatgattgctcaccacccatcctgcaccgcgatgtcaaatcaaacaacattctccttgactctgattttgaagcgcatgttgctgatttcgggcttgccaagttcttgcaggactctggcacatcagagtgcatgtcagccattgccggttcttacggctatattgctccagagtacgcgtatactctcaaggtggatgaaaagagcgatgtttacagcttcggtgtagtgcttcttgagctgattacgggaaagaagccggtaggggagtttggcgatggtgtggacattgttcactggatcaagatgatgacgggttccaaaagggagcaggttatcaagatcatggacccaaggctgtcaacagtgcccgtgcatgaggtaatgcacgtcttctatgttgcgttgctttgtgtggaggaacagagcgtgcagcgacccacaatgcgggaggtggtgcaaatcctcagtgagctacccaagccgactacgaagcatggagaggagcagcttactggtagtggtgatggtgatgaatctggtcctgtaggacctcctgaaactgtggagcctgcaactgatgaagcaaaggagcagcaccaacagcagcaaccgagctcgccgtcttcacttcctcccaatctcatcagcatctgaagaactgtcaacctgaattattgccatttattttgtcaaatttggatgtttaattcttgtagtcttaaggtttggtatgctgttctctgcagcataggtctctggctttctagttgtgctgtcaagctgaattgtttacgtaggtactcctatttgtgctgtaaatatcatgctattttttttctatatctctactttcctgttacaatcaagagactagtcagggagttaagagattagttatggtggagctatcctgctttcctgttacaatcaagtgctttctccatccagtgtggcatctaacaatgannnngcaaatcaatcaagattttttaaaggttttcgttgttnnnn

SEQ ID NO: 2062 - DNA, 501 bp, Triticum aestivum
  unsure (1)..(501): unsure at all n locations
  Clone ID: PAT_TA_2062
aagaaaaggggggaaactgcacgcggcggcggcatccaccgccgaatgcacccccaaaaccaaatccgtccgccccaacccccatctccatccccatccccatccccatggcgaccgggtcgcgtgcgccgcgacgacgccgcccccgctcgccgccgacgctgatggacgacctcgtgcgcgagatcttcctgcgcgtacccgtggacgaccccatgaccctcgtccgcgtcgccgccggctgcaagacctggcgcagcatgctgtccgcccccgacttcgcccgcgagtaccgcaaggcccgtgcggcgccggtgctgggcttcctccacaacaccaccagcgaaccggaggatcgcttcgactcctcccacttcgtatccaccggggccttacgcttccgcccgccggcgcaccaggaccttctctcgcgctgggacgatcttgactcccgacacggnctcgcccttttncacgcccccaagagcaagaggaacaagg

SEQ ID NO: 2063 - DNA, 428 bp, Triticum aestivum
  Clone ID: PAT_TA_2063
gctgccccgatgtatctcccgccctggtgcctagctgcggttttttaatgctatactaaagtcaaacattaaggaaatcagctttgtcatgttcgagaagaagagggtgtttagctgtgaatcctgtgcctcttcagccatgatcttcttcaagcttgtctcccagatcgtggaggaaacgccatcactttttgcttttctgtccgggttggaaaaggacgggggttggacccgttaagttcctatttgacctgtgcggcttgtttaaaagtgggacaggaaaatggacatacagggtacaagggacagtgaacagttgtcacattctagattgctgaaaaatccggctgaaacccaattggttttcagccggatgtcaattagacagtccctaaaaaaaaaaaaaaaaaaaaaaaaaaaaaaaaaac

SEQ ID NO: 2064 - DNA, 1089 bp, Triticum aestivum
  unsure (1)..(1089): unsure at all n locations
  Clone ID: PAT_TA_2064
ctgtcgagctgcgcacgcgcgcgccctccgctccaccgccatggcgtccatcaccctcctctccctcgctccagccgcgaccttcctccacctcccggcctccaccgcctcctcctccccccacttcgccgccattccccgctccctcgccggccgccgggccctcctcctccgcgcgcgcgcgccccgccgcgtcaccgtcgtgtgcagcgccgcggcggcggccgaggcctcggaggcggagcccgcggagaagttccggctcgacaacctgagcccgcagaagggggcgcggcggaagccgaagcggaaggggcgcggtatctcggcggggcagggcgccagctgcgggttcggcatgcgcgggcagaagtcgcgctccgggcccggcgtccgccgagggttcgagggcgggcaaatgccgctctaccgccgtcttcctaagctccgcggaatcgccggcggaatgcatatcgggttgccaaagtacgtgccgttcaatttgagggacatagtgcagggtgggttcaaggatggcgatgagatttccttggagtccttgaaatctaggggcttgatcaatccatccggcagggaaagaaagcttccactcaagattttgggagatggtgatctatcagtcaagttgaacatcaaggctggggcattctcctccgcggccaaggagaaacttaaggcagctggctgtactttgacagtgttacccaagcggaagaaatggctaccagcagcttatgtgaagaaccaagctcgtgctgaagagtactttagcaagaaaaaaggcggcgctgttgaatctgatgaagccaccacatagagttcatacacactgtacttctctacccttctctttagcatatgttcattgctcccatctcatttcagaactaccatgtcagatggattttgtgtttatgtgatataagcaagtatattgtgcccttattttaaaaaaaaaaaaaaaatgcaggggccctgttgtaaaccgcttacacgaaaaaagaacgcccacngcgtccnttaaacncntgactggaaacctggnttncaactaacncttgagnaanc

SEQ ID NO: 2065 - DNA, 452 bp, Triticum aestivum
  unsure (1)..(452): unsure at all n locations
  Clone ID: PAT_TA_2065
atctctccttcnccatttgggctnggcccgtcntgacggangattttatcgtcaaaaggcgactatgtctgtgtcnncatgcatgcgttggatgnagtagcaagtggctgcagtcanaggggttccaaaaattttcaacgtcgcgggtggaatccncgcgtactcggtgaaagtcgattcttccatcccgacctactaggcatcttaatgacccgcgcgcccgcccccgcggccgctctgcatgctttaccatgcggagctaaaattacgctgggcgcctattagtagaatttggcattggttttgtgtcgatgccggggttcagagctaaaattttattctcacgccaagactcgtatcaagagttgttttttagaggctgtataccgaactactgtcgatcatatcaatatgaatagaaatgattttttgtttcaaaaaaaaaaaaaaaa

SEQ ID NO: 2066 - DNA, 709 bp, Triticum aestivum
  Clone ID: PAT_TA_2066
gagcaaagcactgcctcgcccccacagaccagctacccggagcctacaccagaacaaccggcccacccaagtccagctgctcgaccgaggagaacaccacatctcacctgaagatgtcttccgggtcgtcgtctcggagcacctccccgagctccgactcggagtggagcaagaaggagaacaagatgttcgaggaggcgctcgcctactacggcgtgagtgcccccaacctctgggagaaggtggccagcgccatggggggcaccaagtccgccgacgaggtgcgccgccacttccagatccttgtcgatgacgtcaacagcatcgagcatggccgcatcccattccccaactacaagacccagggcttctggacctaataaaaggatcgacgaagcagtgtaagctccagtggacagtgaacaaagttctacaaaatagatctcttaagaatgggctgatgttctaagaggaagcaagggtatccagcattggttagaataacaggaaaggaatagagtattgtctattgtgtggacaaagtattgttaggccctgtccaaggttaagtctgtctctatctcgttgtagattctcgtctacattcatgaactgcatgttgttcattatctcctcgaaccaagtcgtcaaataaaatgtcatgtaaactcatgtgtttgtgttatttgtaacaagtcccccctgtagc

SEQ ID NO: 2067 - DNA, 1146 bp, Triticum aestivum
  unsure (1)..(1146): unsure at all n locations
  Clone ID: PAT_TA_2067
gngnnnnnttgntcccctgctcgaaattaaccctactaaagggaacaaaagctggagctccaccgcggtggcggccgctctagaactagtggatcccccgggctgcaggaattcggcacccggtcttctcctgtcaagtcgtcgccgccgccgttcccgccgccaggcccaaccgcccccgtcgccggccggaatctctcctccgccgacagatccggccgtcccaggctgactcccgccggatcccgtcctcggcgcggccggtcgcgcggggtgagaggagctgcgacaccatggcttagaggagctaggcccgacgcccgagagaccatcccgagccaggagaagcaccaggacgaccgctcttcttccccgtcccgagcaagataaacatacaatcttaatggggcatgatcatatcactcatatagagaagctcacggcggatggttccgttgctgacaggaaatgttgccaggaacctggctgcgatgagatcgtcagtggaagggtaatgtactgcaatagtcacactagagggcattcatcccaacagcttggttacctccagagttcacagaaaacctcagatttatacatgccccctgttaaaggcagacagtgtactgaacccagtgccagtgcagagcaagatgtaagtatcaagtatgaggggaatgatcaaggcaaactcaatgatagatctggggatactcagggaaacactgggcaactaatcttgggtggccctgacacactttgcaagcacgacaactgcaaaaagcaggcccagagcaacgcattgtactgcaagctacatagtggtggtagtaagggttgcctagtacggggctgtgtgaaagctgcacatggtggcacgcctctgtgcatcggccatggaggagggaagcgctgcattgttgctggatgtccaaacgctgcatgtggccagggccgtagcgagcactgtgtgaggcatggtggtggcaagagatgcaaattcgaaggctgcgtgaagggggcacaagggaacacggacttctgcatcaggcacggcgggggaaggcggtgcaaatccgaaggatgcacaaagagcgcacaaggcccgaccgattttttgaataaagcatggcggcggcacccggt

SEQ ID NO: 2068 - DNA, 725 bp, Triticum aestivum
  Clone ID: PAT_TA_2068
cggacgcgtgggcggacgcgtgggcggacgcgtgggcgccaactacggctactccccaaactacgtcactgacctgagctacaacgcgcagaagctgggccaagcggcggcagcggcgcctggcgcgggcgggtcctacatgcagccgcaggggcacttctcgtacccggcggcggcggcgcatggaggcatgctcgcgcccaacggcatgatgcccgtgtacccctactaccactaccactaccacggctcgcaggggctgggcgtcccggccgcgcacttcttcccgccggtctccgccgccgtgcccaccgtgcccgccatcatctcaaagcccacagtcatggtgccccccaaagtggagcaggtggctgggtgcagctgaaggcacggtgacggtgcgaggagttaaaaggaggccaaccaaaaggtgctcgcccgagatctgtctgtctgattataacaagctgctgcacaagaagaagaagaagcgctcgtccacgttcaattcgttcaattccctctaactccgtgcgcccatggggtgggcgcacggcccagcaaagtctgtaacaaagattattccgtctctctctctctcgtttaccaacgtattttcagtggtaaaccccttttaccaagtcgtctgtagtcccatcgctgcaaggggcagcgaacctgaataaaatcgtcgtatccttcggtcaaaaaaaaaaaaaaaaaaa

SEQ ID NO: 2069 - DNA, 1424 bp, Triticum aestivum
  Clone ID: PAT_TA_2069
gcgggtgtatgtgatgctcctacggactgatttcttcctttgctgctgctatatgatataaggtttcctgaagcagatcaagagtgaggtatagacgctcccgtgtcgctcgcgcaacccatgtccgtggtgcgaggggcggcaatggagggagcgtggccccatccggcgccgatggagccgaccaccgccgcggatgggcctcaagtgtcggaggtgaactcgttccggcgccaggtcgacgacctcctctccaagaccgacgtgctggagaagagggtgaacgaggtggtagggttctacaattccaagaagcacagcagtggaggccgcaaggctggcggcaggtacgcggaaaacggtgccagggacagccacggcaatgggatgcccgacctcatgcgccagtttgccggtatcattcgccagattacatctcatgaatgggcacagccgtttttgcaaccggtagacgtcgtaggtcttcaacttgatgactatcaccagattataacaaaacctatggatttctcgaccatccgaaacaaaatggaagggaaggaaagtaccacatataacagtgtccgagaaatatattctgatgttagattagtttttaccaatgcaatgaagtacaatgttgaaggtcaccctgttaacataatggccaagttcctactcgagagatttgaggagaaatggcttcaccttctccctaaagttgagaacgaggaaagggaacgggaggaaccaaatgatgctccaaccataagcatttctccggaagctgcaattgcaaaattagctgaagatactggtaatgagctgaatgagattaataagcagctggaggagctccagaaaatggtggttcagagatgcaggaaaatgaccacggacgagaagagaaaactcggcgcaggtctttgccaattgtctccagaagatcttaacaaggcgctagagttggtcgcgcaagacaatcctagcttccaaactacagcagaagaagtggaccttgacatggatgctcagagcgagacgaccctctggaggctgaagttctttgtgagggaagcattggaacaacaggcgaatgtaggcgtagtggcctgtggcaagaccgatgaaaacacgaagaggagccgcgacatgtacaatgctctagccaagaccgtttcgaaacggattaagagataaccttggcggctcggcctttctgatggttcatggtatttctgtagaaaatagggccatgttctcccttgtgtgaagacatgttgtatatatacgaagatgaatctgcactaagatatgcttggtcgcacccggtctcatgtggcatgggtagcatgctattggtagctatgtaaaataaagagcaatgttgaccacacaacagaaacaagaattattccttgaaa

SEQ ID NO: 2070 - DNA, 785 bp, Triticum aestivum
  unsure (1)..(785): unsure at all n locations
  Clone ID: PAT_TA_2070
agaaatttgatcgttagntccacttaacncnaaataaccctactaaagggaacaaaagctggagctccaccgcggtggcggccgctctagaactagtggatcccccgggctgcaggaattcggcacgagcatgcccacccttcttcgctgcatctgaggccatgcctatacttccaataatttattgtaccacatctccatcgatggcgaccttgctctgaggccatggcctactctcacaaggcttcatctttcatttccccaataatccttcgtctccagctcgtctcagcgtctcctcctataaaaccctcgcccccctgacccttcgcaggaaaacttgtccaaagccgcttcagtcggttcccatcccccctcgcgtttcttcttccaagtccaggccgggtgcaagagaggcggggtgaccgaccatgaaggagtactggacgatgctggcgtcgctcatgggcgcgctggcgttcctgcaaggggtgctgcacgccgtgttccccgcggagctgcgggcggcgctggcgcggctgctcgggcgcctcacccgagccttctcgccctactgctacttcgacgtcacggagacggacgggatgagcaacaacgagatctacgacgccgtgcagctctacctcagcagcacggccgcgccggcgtcgggggcccggctcagccttacgcgcccgcacaacgccacctncttcaccttcgggctcgccgccagcgaccgcgtcgtcgacgccttccgcggcgcggccgtcacgtgggagcac

SEQ ID NO: 2071 - DNA, 1107 bp, Triticum aestivum
  Clone ID: PAT_TA_2071
cgggcgcgtgcgccggaattcccctctctactttcctctctcgctggctcgtggaaagaagacgacccaacccgatcattctcccactttctgcaagaatctgactatctgagtcttaagaaaggaggagaagaagaaggtgccagtcgggctggccaataattgcgaaggcgggagctagggagaaacctctgctctgcactgcttcgccccctgcaaatgacgagctacttcagagggcagcggcaggagccttcttctgatgatccccggcccggttaccggagggacaggggcggccgcaagcgcctgacggcgcagaagaggaaggagatcaaggaggccttcgatctcttcgacaccgacggctccggcaccatcgatgcaagggagctcaacgtcgcaatgagagcgctggggtttgagatgacgccggagcagatccagcagatgatcgcggaggtggacaaggacggcagcgggaccatcgacctggacgagttcatacacatgatgacggacaagatgggcgagagggacgccagggacgagctccacaaggccttccggatcatcgaccaggacgccaacgggaagatatcggatatggacatccagcggctggccatcgaggccggcgagcacttcacgctcgacgaggtcagagagatgatccaggccgccgacgaaaacggtgacggcgaggtcgacatggaggagttcatgaagatgatgaagcggacgggcttcggcgccggattctagagctgatgagcagaggacaagtgcggggtggaaggagtgccaagcactgggccgacatagttggtcgattgtactgtacatgtgcctactagatcgtgctgcatacgtagtacatgtagtttcgcatgtttgcacctgtggtaactgcgcatgtctcaagaaaaaaacatgtggtaactgcggcttagggtccatcaatttgtcctgtggaaacattttagtccatcaatttgagaaatgtactgggctagtcctcaaactggcaatcgggtttccaaaatcatcctggcccagacaagtggtgctgttcatttgccaataataataataatacactttcta

SEQ ID NO: 2072 - DNA, 2245 bp, Triticum aestivum
  unsure (1)..(2245): unsure at all n locations
  Clone ID: PAT_TA_2072
cgagggcctgtcttcgccaacacggnagggtgatgctctgtataacctgcgtcagagtctgaaggatagcaacaatgtattgcagagttgggatcccactcttgttaatccttgtacatggtttcatgttacatgtaacaatgataacagtgtaattagagttgaccttggaaatgcacaattatccggtgtactagtgtcccagcttgggcagctgaaaaatctccaatatttggagctttacagcaacaacataagtgggccaatacctgctgaactgggcaacctaactagcctggtcagtttggatttgtatctgaacaagttcacaggagttattcctgacagcctggggaatcttttgaagcttcgattcctccgtcttaacaacaacagcatgtcgggtcaaattcctaaatccttgactgatatcactactcttcaagtactcgatctctcaaacaacaacctctcaggagcagttccatctactggctccttttcgctcttcacccctataagttttgcgaataatccacttctttgtggtcctggtaccacaaagccctgccctggggatcctcctttttccccacctcctccatacaatcctccaacaccaccaactcaatcagcaggtgcctctagcactggagctatcgcaggtggcgttgctgctggtgctgcactggtgtttgctgttcctgctattgcatttgcaatgtggcgccgtcgtaaacctgaagaacatttcttcgatgtgcctgccgaggaagatccagaagttcatcttggtcagcttaagaagttctcattgcgagagcttcaagttgcatctgacaactttaataataagaacattttaggaagaggtggttttggaaaagtgtacaaggggaggcttgcagatggtacattggtagcggtgaaaagactaaaagaggaacgtacccctggtggcgagcttcagttccaaacagaagttgagatgattagcatggcagtgcataggaaccttctccgacttcgtggtttttgcatgacacctactgaacgattactagtctatccatacatggccaatggcagtggtgcatcacgtttgcgagagcgtcagccatctgaaccaccccttgattgggataccagaagacgaattgcacttggatctgcaaggggactctcttacttgcacgatcactgtgatcccaagatcatccaccgtgatgtcaaagctgcaaatattcttttggacgaggatttcgaggcagttgtgggtgattttgggcttgccaaacttatggattacaaggatactcatgtaactactgctgttcgtggaacaattggacacattgctcctgagtacctatccactggaaagtcctctgagaagactgatgttttcggctacggaatcacacttctggagcttattactgggcagagggcatttgatcttgctcgccttgcaaatgatgacgatgttatgcttcttgactgggtgaaaggattgttgaaggagaaaaaagttgagatgctggtggacccagacttgcagagcaactatgaagagaccgaggtggaatctctgatccaggtagcgctgctgtgcacgcagggctcgccagtggagcgccccaagatgtcggaggtcgtgaggatgctggaaggtgacggcttggcagagagatgggaggaatggcagaaggtggaggtggtcaggcaggaggcagagttggctcctcttcgcaacgactggattgttgactccacatataacctccgcgccgtggaactgtctggcccaagatgaccaacgtcctggcataggcaaaaatcaccatttgatcagtcattcagcctaattgttgtttgtgaatatgaaaggtagcttgtactcttttgtttaatgacaattttaaaggatgcattttccccccattctcctccacactgagaagttatgctaggctgcagtcatttgttaaggtgaaaggcatacattttgtgttgaatttgcaaggcactgttgtatcaatctgataaaagtgcaatgtgttatcctgtgtccacccgaaaaataaanccaagggggggcccggtaccaattccccaaantgagtcnttaccccctnanggctcctttaaantctgacgggaaacctgggtaccaantaacccctgantaaatcccttccanctgggaanacaaangcccacgntccctccaaattccactaag

SEQ ID NO: 2073 - DNA, 398 bp, Triticum aestivum
  Clone ID: PAT_TA_2073
cccacgcgtccgaaaagagttgctaatcgaccatggtaattctcaagagaaacacaagggttgtttgcttggcggtgcttgtggtcatggccacaaccttattgcctttctcaactacacaaggggcgtgcttagtggcaccggaatgctcgggtccctacccaaatgtaatatgcggtgagttatgcgctcgttacggttatagcaaaaatggatactgcaaagattcaagaaattgctgttgcagtggcaaaaacttaaaagagtcagtccaggtggatcctactgcaaatccttaggagagaaactctagaagctgctgcaccacaatatgtaatggtgagatgattaaatttgaaatgaaataagtatttataagtgcatcgggaaaaaaaaaa

SEQ ID NO: 2074 - DNA, 398 bp, Triticum aestivum
  Clone ID: PAT_TA_2074
gccagacgaagagaggagggaccatgagaaggcgagcccatggagaagtgccaccgcaagtagatcttgccgtcggcggcaagaaggccacgccccccctccaccccgtgcgttcacccagcagtggaagcaatgccctttttcccctgttgagagatcaaatcaaattgcatcggtacgccatgcctgaaccaatttgatcatgcaaacctgatgaagataatgtattatgtgcgctggttcgccggccactatcttggatacgaatgatctcaatttaaccaaaatcttagcatcaatgtaacgctgcaattttctgtgatatctgaatttagttcctcgaacgcgaccaccttagcctttcttccttcatattctactagatgggtgctactcac

SEQ ID NO: 2075 - DNA, 591 bp, Triticum aestivum
  Clone ID: PAT_TA_2075
gcacaattgtcgccaggcaagacaaggggaaggtctctgacagctagcaagagagcaaggcgatgtcaatggcggacgagcagaacgacgctggcccgcccggcgcgccgcacttgctgctgctggcggtggtggtggggctgctggttgcgtggccgcttttcctgggtggcagccgcgaggcggtcatcgataccatcgccaaagccatcgccgagctgctcggccccgtgggcctgctcctcctcccgctggggctcctcctcctcatccacctcctctcctgcgacggcggctcgcccgacgccgtgtaccatgtcggtggatcccccatcggcgtggcgctcatgctggtcctcatcctcgccctcctctactaccggtcggcactcttcggcagcggcggaggcgacgacaagtaggcgcctgccagtaggtagagtctcatctcggggtggctggttgggttttcttttccatgtgcttgttctcttccgcctctcctcctcgtcggtagtcatgcatcctgcaccaccggccagcaggcagcagtaaataacaaagtgacaactttgcgttttaaaaaaaaaa

SEQ ID NO: 2076 - DNA, 714 bp, Triticum aestivum
  Clone ID: PAT_TA_2076
tcccagccagcagcacagcgcatggacactgccgtccctcctgcggaccacggagatcggtccgatccatctacgatcatggacattgctgctgtgcctccagctatgacccaagcccctatggatcagtcacagccaccagctccttgctccatcgccgctgatcaggtggttccacctcgttcggccgacctgcccggtttacctccttcaaatccaagcagttgggctggcgtgatagacatttctgatgatgatgacgacgacgacgacgaatgaactccttttccgtcactctatatatactctgcttattctggattaaactgctgatcagtggttaccatagataggtactagtaacttatcaactggcgtttcattaaattctgctgtggaggcatagagctctgatctgaacggcgaaacatcctcctatagatgtctttctgtaatattttgcgagacggtggcttgggcatggcgaactgaagcatggagttagctgcactgtaatgctgaagcatgcgctgtaattttttgtgagacggtggcctgggcatggtgaactgaagcatggaggtagttgagactcgttgtactcgctggatcatttgcgccatgtcgtctatcattcttcttgcttcgagaaaatctctgtctaatactgtgtggttaaaaaaaaaaaattaatttaataaaataaaaatatag

SEQ ID NO: 2077 - DNA, 1166 bp, Triticum aestivum
  unsure (1)..(1166): unsure at all n locations
  Clone ID: PAT_TA_2077
gcacgaggctcctactacctcaccccgctccctccagcgcaccacaggcttcgtctccacctcacctcagtcccctctcctcacctcactccatttgtagcgtagcagcggcccgcgtcacgcgatcctgctcgtatacggcgccggtggctagactccttgtccccgcccgcccaagcctgcagcaaaaggcgaccgacccctccgtccctttctttctttcatcgtctcgttcggtgtggccgaggtagcgagcgggggagcgggagagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggtctgatgcggtgtagcaagagctgccggctccggtggaccaactacctgcgccccgggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggccaagccggcggcgcagaggcctgcctcctcctccaagggccagtgggagaggcggctgcagacggacatcaacatggcgcgccgcgcgctgcgcgaggcgctcaccacgctcgacgacatcaagccgcagcagcccgacgcggccgacggcgtcaatgggcctgccgcagccggcgccgacagcggcagcccggcggcctcgagctcgtcggccgcgtcgctgtcccagtgctcgccctccgcggccgggccgtacgtgctcaccaccgcgaacatctcgcggatgctcgacgggtgggccagcaagggccgcagcgccggcgccgcggcggacagcccctccggctcgtcggcgtcgngaggtttcctacggcagcggcngcggccgcccgtgcgctggggtccgcgttcgagtacgacaggaagccggccgttctggcgccggatcagacgcagctgaacgcgatcgagacgtggctcttcgccgacgacaacagcaacaacgaccaccatggc

SEQ ID NO: 2078 - DNA, 764 bp, Triticum aestivum
  Clone ID: PAT_TA_2078
gggcccccccacgccaccaccgccgtccccaccttctccgacgaaaccctagcgatggcgttccgcggcgcagcctcccgctccttcctcgccgccgtccgcggtcgcaccgcctccactgccccgcgcgtacgcgcggcccccattcccgccgcccctccccgtcgcatccctgcctcggcgccctcctcccctctcgccgccgcaaggccattggcggcgttgatggggtcgccggcgctggttgccgcaaggctgacggggcactgcgcggcgagcgcgcgggcgtgctgtgagctctcccagggtacttaaaggacgagttgctgcccttcgcaaggatacaacagttcttttgggtgcatctctttggaagctcttctgagttcagttcgttttcctggattctgcaaagttacaagaaactccccactcccagtgctagcttttgtctcctagacaaacggacattctacttgatatttatatatgatgaataacgtccttttgatcagcacatgtttcattggatggttcttgtttgtgatgcgtgttgaaatctttaattcataatcggtatcatgctgtttctccatgagttaacactcgtagcgaatttgtaactgggagttcaatgaaatcaaagaaaacccacatgtgatctggggggtttatcgttgatggccgaactgtagatctgttgtgctttcaaccgtttaaatttatgaatttaaaatttctgctgtaaaaaaaaaaaaaaaaaa

SEQ ID NO: 2079 - DNA, 777 bp, Triticum aestivum
  unsure (1)..(777): unsure at all n locations
  Clone ID: PAT_TA_2079
ccggccccccgcttatttccagcacttggccaggcgcccaaacgccgcccgcctgctccctgggctctccctgcacagcctcctgatggccggctctgcggtgcctcggccctagctggtcctgagcaagtggccctggcgggaacctgcgccgaaccgccgcctgccccaaccatggcctcaaggctccttcccgcctgggtagggcgtcagttatgcgtggccccttgaacgcgggccaaaaggagaccttgcagaaaaaagctctgcacaacggcctgtgaaaaagtccaaataaatgtggatgagtacatccccaagcggtcaaacctcaccaccaaggtcgacaccggaaacgccagagccgccctacgcacaagagcccgggacaccgccgagggccggacatttctatgcagtgagtccccgaccacacggacaaaaccgagcgcgccaggaacgaccggggagaatctgtgctgcctgagcccacatgcataattggcttccataagatatgcagtattgtacccgtgcctggccctcgggcgaaaacaagaagaagctaatgacagctgctgaccagtgagcaaatggtctagcctgcccgtccgtggaaaatgatttcaataagacaggaattaatcaatgcttgccccgtcacatgcattaattgattggcatggaaaataataataatcttggggccgggttnnaaaaaaaannnnnnnnnnnnnnnnnnnnnnncctcgggggggggggcccggtncccaattc

SEQ ID NO: 2080 - DNA, 1084 bp, Triticum aestivum
  unsure (1)..(1084): unsure at all n locations
  Clone ID: PAT_TA_2080
cgccctggagccagaggcactcgccgccctgcgggacggcaggtcgttcccgggttccctccggtctacgcagtctgcccgctcaagtcgacggccacagaacaggaggcggcacatggcggcgcgtcttcacccattgcctggctcggagagcagccggcgcggtcggtgtgtacgttgccttcggcaaccgcaacgcggcggcgctngaccagatccgcgagatcggtgccgggctggaggcgagcggctgccggttcctctnggtggtgaagacgactgttgtggaccgcgacgacaccgcggagctcaaggacgtgctgggcgacgggttcctggagcgcgtgcaggggcgcggcctggtgaccaaggagtgggtggaccaggaggcggtcctgcggcacccggccgtggggctgtacctgagccactgcgggtggaactcggtgacggagtcggcggcgtacggcgtgccgatgctggcgtggccgacgctgggcgaccagcggctgatcgccaaggtgataaagagcggcgggttcgggctgtgggtggagcactggagctgggacggcggggaggactcgctggtccgcggcgcggagattgcggagaaggtgaaggaggtgatgggcgacgaggcgatctcggcgagggccaaggagatcagccaggaggcgaccaaggccgtcgccgaaggcgggtccagccaccggagcatgcaggagttccttgccacgctcagttgactgctctgctctgttaccggccgggagctgttgtttactgaacctcgtgccctgtcgcactttgtatcgtcgtttcgactgaatcgaccacgatgcatgccataatcgttgatcgatcgagaataaaaaggagaaccaggaggaaaatgagtgcactagtggcaccctgctgcctcatggtttcattttgactttagctatatgtcagtcaactgaattttatatctgggtcagccgatttttgtccgctgaattttctttgagattcgtgctgctttcttttcctggcttgtttgttgtgtgggtttgtttctttgggtttgtttagggtacat

SEQ ID NO: 2081 - DNA, 1556 bp, Triticum aestivum
  unsure (1)..(1556): unsure at all n locations
  Clone ID: PAT_TA_2081
cgggctctgttgctgctcccgtcgaggctttcgtgcttgcccttgagcgtaactctgagggtgtcccagcacgagctgaatgtcgcgcttgaccttcaacgctgaccactcgatttcggcgccattatacaaagacatcagtctatcttgtccacattgcagggacgtctgtccttgagctgtggcgctgctcatcctgtgttgaaggctagtgcaacacggcctccgtctacagaatcttagcctgctgcaggcactcctggattggccttaagcttcctattggtgtagcaaaacctgctgcagctccattagctgatttgcttgacttaagctctgacgatgcaccggtcacttccgctgcttctgactactacagcacctagtgatttcctacaagaccttttgggtattggtgggacaattctatcaactgcaggggcaccttcacctgcaagcacagatattctaatggatctgctatccatgggatcctctccatcacagaatggtctgccatctccaggcctgagttctccccccctagagaaaaaacctgtctcagcggtactccatgttggtgctcatgtcccggaacctatggaccgactcggccgtttgacatcaactcccccggcctagggaccaaactcccccctggctgcacctcaagctgtcgatctgctcgacggtttgtccccaagtacaccccttcctggatctgaatgcagcttacccgtcaatcacagctttccaggaggccaacttggagagctcctccgtcatctgtaaacaggcagcctggccgcccgcgacgacactccatgccacgcttgctttacaaatttgtacatctgttacattgaccaatttcatgtttcaggcagctgtaccaaagttcatccagttgcgcttggacccagcaagcagcagcacccttccggccagtggaaatggttcaattacacaaagcctcagtgtcactaataatcaacatgggcagaaaccacttgcgatgcgcatccggatttccgtacaaagtgaatggcgaggacaggctgggaacaagggcaaatcagcaatttccccgcggggttgtagtgccacctgtgtctataatgttgtgatagtagctctttcgctttcagtgtgctgctctgctggcaaaggcgagttttacttttctagccctcccatcatcattttctcccccttgtgctgctttttctgattactagtaagttatgtacactagtagctggtttttcgctatttatccttcacctatactgtatagtagcgcgcaccgatcaatgacacacgcctccagttttgccaaaatgtattcatacaaaggtgtatatcattcacagtcggaggataaccaaaacttttcggcctcccgctcattccaggcgccagcagtccggggccctgtgctcgtccctcgcatcccccaagtttttaaacnaatttgttagtagtaaccacttttatttgggaaatgatgatatttcacccaagatgtcccttaagggataatcanaangatgnaa

SEQ ID NO: 2082 - DNA, 825 bp, Triticum aestivum
  unsure (1)..(825): unsure at all n locations
  Clone ID: PAT_TA_2082
catgtatgttggagaatcagagaagaatgtcagggacatctttgagaaggctagatcagcacgcccatgtgtgattttcttcgatgagcttgattcccttgctcctgcacgaggatcctctgcagattctggaggtgtgatggatagagtggtttctcagttgctggtggagattgatgggttaagtgataacagccaggacctcttcattattggggctaccaataggcctgaccttcttgattctgcacttctccgccctggccgatttgataagcttctctacattggtgtaaatactgaagcatcatacagggaaaggatactgaaagcacagactcgcaagtacaaactacacgagaatgtatctctcttgtcgattgctcagcactgtcctccaaacttcactggtgccgatatttatgcattatgcgcggatgcatggtttcatgctgctaagcgttccgtcaaaacgcttgaagctgatccttcgagaaataacgacgccggtgcagaagaggtcattgtcgagactgaagattttatgacggtgttgggtgatatctcgccgtccttgtcaatggaggagttgcaaaactatgaacagctgaggcagaagatcgaaggaccttctagatgatgtttgctaagacactttactagaaaaagtgtgcttttcacctcccaactaatcaactattgcctgagtgtaccgcccccgccttctttgtttccagtttgagttggggaataataaattgtntgcccaaagcatcccaaagctccttcccntgaangacccccanggggttctcccctggacnn

SEQ ID NO: 2083 - DNA, 621 bp, Triticum aestivum
  Clone ID: PAT_TA_2083
cccacgcgtccgcccacgcgtccgccgcgccgcccgtcctttcctctcttcccctcccccctcgccgccgccgccgccaccgctcgtcttccctcctatacacaggtgcggaggaggagatgttggtgctcttcgagacgcccgcggggttcgccctcttcaaggtgctggacgaggggaagctcagcagcgtcgaggatctgtggaaggactttgcttcctcggacaaagcaagaaaggtggttgagctcaaggctttcaacaagtttgaaaatacctcggatgctctttcagcggctactttgctaattgatagcaagcccagcaagggtctgcgcaagttcctgcagaagcactgtgatggtgaaacattggctgttgctgattctaaacttgggaatgccatcaaagaaaagctgcaaattgattgccttcacaactctgctgttatggaactgatgagagggctgaggaaccagctcactgaacttatgtctggactagctgagcatgatctaggtccaatgagcctaggattgtcccacagcttgtctaggtataaactcaagttcagccctgaaaaggttgatactatgatcattcaggccattggcttgttgg

SEQ ID NO: 2084 - DNA, 2105 bp, Triticum aestivum
  Clone ID: PAT_TA_2084
cggacgcgtgggcgcacgagggcggcgcctcctctcctctcttcccctcccccctcgccgccgccgccgccgccagcgccccctccaccccccctcgtcctcctatacacaggtacagggcggaggaggagatgttggtgctcttcgagacgcccgcggggttcgccctcttcaacttgctggacgaggggaagctcagcagcgtcgaggatctgtggaaggactttgcctcgtcggacaaagcaaggaaggtggttgagctagaaggctttcaacaagtttgaaagtacatctgatgctctcttcagccgggaactctgctcattgatagcaagcccagcaagggtctgcgcaagttcctgcagaagcactgtgatggtgaagtattggctgttgctgattccaaacttgggaatggcatcaaataaaagctaaaatttgaatgcctttacaactctgctgtcatgtgaactgatgagagggctgaggagccagctcactgaacttatgtctggactcgctgagcatgatctatggtctaatgagcctgagcttgtcctagagcttgtctaggtataaacgtcaagttcagtcctgaaaaggttgatactatgatcattcaagccattggcttgttggatgatcttgacaaggagcttaacacttacgctatgcgaggaggttaacggtacggttgggacggtccgtggctgacaaaattggcactttctaaaattcactacactaaagctatgaagtgaatatgaagcgcaatcagtgaagttcaccgggacttgtcttagttaagtccaccttgactgcaatgagatctggacggggcaggtggaagcagccctggaagcagcagctgtaatttccgtgggaacagaagtcaatgatctgggcctcccagtcctcgcgcttccgggggaccgagtcctgccccttgccgagctcagagcccggctctatacctttcctcccagctggacggctcccgttgctcccctcgtggccgctcgccttatttcccatggtggtgcgcgccttgtttcccgcggtgctggttggctgcaccatgcaaagcaggccggcagaaccggccacattcagggctccgagaaggccttatgcagagctctgaagacaaagcatgccacaccaaagtatggtctcatctatcatgcatcattaattggacaggcggctccgaagcacaagggaaagatctctcgttcgcttgctgctaagagtgcacttgccataagatatgatgcccttgctgacggtgacgataactccatgggtcttgaaagcaggatcaagcttgaaacacggcttcgagttcttgagggtaacgaacttgggaggtctgctggttccacgaaaggaaagcccaagatagaagcgtatgaaaaggaccggaagggtggtggtgctctgatcactcccgctaaaacttacaactcagcagcagatctagtgcttggacaaaccactgaagaaacgccaaagaagtcagaagttgcttcaaagaagaggaagcaccaagaggaagaacctactgcggaggcagctgaaaaggaaggcgagcaggagaaagagaagtccaagaagaagaagaagaaatccaaggacatcgaggagacgccggcagccgtcaccgacgctagcgagaagaagaagaaaaagaagagcaaggaggccgaggagacccctgcagccaacaccgacggggagaagaagaaaaagaagaagaaatcagacgctgaggacgcccccatggaggttgacgtgtctgccaagaaggagaagaagaaaaagaagaagcacgctgacgagtgagcggcacggagatacggcggaaatttgtggtgtaatgctgtactatcatctttgtctgaaagttttgggacttgccgttcatgtagaatggaatgccacattaggattagcagcgacgaaccctacaattcgaaacttgcaagtggtgagcagtcactttaagaggcccaatgctgtgctctcatctataacatctgctagtatgttcattctgtcgagtagtaatatatttatctgttgttaaaaaaaaaaaaaaaaaa

SEQ ID NO: 2085 - DNA, 1280 bp, Triticum aestivum
  Clone ID: PAT_TA_2085
cgcgtccgataataatcttcagcaggaggaagatgctgcctttaatattaagtaccttactagcagtaaattgatgggtttggagttgaaagacgcaagttttcgacgccacatccttgtccaatgccttatattttttgactatctcaaggcccctggaaagagtgacaaagaaggtccatccgagagcatgaaagaggaaatcaaatcctgtgaagagcgtgtcaagaatcttctggagatgattccaccgaaagggaaggagttcctacaaagcatcgagcatattcttgagcgggagaaaaactgggtatggtggaagagagatggatgcccagcatttgaaaaacaaccttttgaaaagaagtcaggacaagctggagccagaaaacgtaagccaaggtggagattgggaaacaaggaacttgctcaactgtggaaatgggcagaattaaaccctcggcccgtggctgattctgaccgaatccgcatgccatccgttacagaatattggaaaccacttgcagaagatatggacacatctgctggaattgaggaggagtatcatcacaaaaataaccgcgtttattgttggaaaggtttacggtttcaagcccgacaagatctggaaggattttctcgattttgtgactacgggatcgaaggggttgtacctcccgagctgttgccacccgacgtgcgcgccaaattcaattcaaagcccggggagaaggccaaacggcctaaacgggaagacacaaaaggcacttcagctcaccccagggagccacaggttgccgcggccacgcccgagacggacggtggcggcagcgggggcgaccaggaggaaggcgcggtgccgatggactccgacaatggcgcaggggaggacggccagaagcgcagccccggcgaggtctctgggcctgagtcagggcagtgcgaggctgaggacgatggggaagataacacgaaaagcgcgcatagtagagatcgtccgtaggggtcacaaacagcccacagaaggatgagattctccccaaggggatgatgttgtatcatgtttccaactttttgattccgatttgccgtttatcggttgtggcgccccctgagctgagacattagttaattattagcagacactaacgtcttccctttgttttgacagtgacactaatgtcttccctaattatactagtcgacaccacgccatgttttagcctgacatgtgtatgtacatgatatacgtagcaactactaagtgtcgaagctccaaa

SEQ ID NO: 2086 - DNA, 870 bp, Triticum aestivum
  Clone ID: PAT_TA_2086
cggacgcgtgggcggacgcgtgggcgcggcgggcgcgggccaccaccaccaccaccaacacgacgaggacggggccggcggcgggtactctctgttcgcgccggggccgtacgggcagttcggcaccgaccagtcgttcgcgttccccggggccgggcagcacggcggcgtctcgctcacgctcggcctcccccacggcgccggcgaccagacggcgttcctcatgggcggcggcagcagcaacggcgccgacagcggtggcagcggcgccgccggcggcgacatgaacatgcagaccaccaagtccttcgcggctcagctcatgagagacttcgtggcatagtatgaatgcatcatgcatgatataccactattacatagcgcaatccattaatcaaatcccaaaaaaatcgattaatcaaacaatttagggcttgtatagaaataaaagggtaaacgcctaggcatggttaggcttgccattaatcctaagcctctctaggtcattggggtgtaattatgtaaagatggggacattgtatatagttactagtagtataggttaggtagttaaaacccaaacatttccggttacaagattttatagggcaatagggggatggggggtatacgatacgtgaaggggtatatatatatgtaaaacattggaattggggatcttggaagtgtattgcggtatagttggtttattggagatttgagtattgtttttggatactgtactgaaatgtaatgtagttattgtagtacttctcttcactacttgttccagttccatggatgaagagaacagatgcatgagatggcatatcttgttaccttttaaaaaaaaaaaaaaaaaaaactcga

SEQ ID NO: 2087 - DNA, 1101 bp, Triticum aestivum
  unsure (1)..(1101): unsure at all n locations
  Clone ID: PAT_TA_2087
gaattttgggaggatgaagacgagacgggggaagaggctctagnatgcagatgaggatagggaagaagatgacatacagtattctgttgctgaaatgacaagacctgggcaacggttgatcgtagcacaaggaggggagggtgggctagggaatgcttctatcggcagagacgtccgtctatccaaaggaaatagacaagaggaggtagcccgtttaagtactggacagccaggaacagagtcttttcttgtcttagaactgaagagcattgctgatgttggccttgttggtttgcctaatgccggaaagagcacacttctgagtgctctctctagggctcgcccggagattgctgactatgcgttcaccacactaaggcccaatattggtagcctaacctacgacgactacttgtcagtgaaagttgctgacatacctggtcttatcaaaggtgcccatgagaaccgtggcctgggccatgccttcttgaggcacattgagcgcaccaaagttctgtcctatgtgcttgacctggcagcaacactcaacggtaggaagggtatcccaccatgggagcagctacgcgatctggtggtggagctagagcattaccaagaaggcatgacaaagcggccatcgttgattgttgcaaataaaatagatgaagtgggagctgacgagatgtatgaagaactgaagaggagagtgcaaggtgttccgatatttccagtgtgcgccatcttgcaagagggagtacctgatctgagagttggcctgagagaccttatggatgcctcggatccgcaaggtgtcgatttgagcaaagttattgtaggctaaaaaggctttgcccctcgttggagaagaattgttctccgattctttccccttgagcactgtctgcttgcagatgcactgtagacccgtgttgcaaaaattgctctaattttctgtgttgcagaatagatcatccattgttttagaaaattcagtgtaataataacgaagggtaaccagtatgtatgctttggtctttcataggaacagcaatgcgtactaccaaaacggttcattcctgtgctaaaaaaaaaaaaaaaaaa

SEQ ID NO: 2088 - DNA, 783 bp, Triticum aestivum
  Clone ID: PAT_TA_2088
atgctgaaaagattggcaacagcaagagtagtgataaaggtggtaaaagtgggatttgtgtgaaggctggcgagaagggaaatagcaacgctgctgccgctgaaaatttacaagatggaaagtccgaagttgacgacacaaggaagaaagaatttagcaaggattgcgaggctgaaaagattgtgcagaatgcaaatggcgatggtggcatggaaatgttgagggatggtgaagctgaaactgggaataattgcaacggtaacaccataggaggttctggagaaaaagatgacactacagatggcagatgtgaagaaggcagggctgaaaaagatgcagaaaatgctggtgactgtgaacctgaagaatctgaaactaatgaaccagaagcagaagtaaaagatgtgaaatctaaggaagccagtggcaatgagattaccctatcccatggtgctaactaaatgtggcaaaacaaaatagatgctaggcaacatgattactgaagcgagacgcggatgatggtcgagcggaagattctgaaggcagtacaagcaccaaaattgatgtaggttgaagcgcctttgtggacgatgtgaaaactgatgtaggatagtttatggaggattagatttccatgcggactgtagtatcaggttaggaaatggacagaatgttgtataaattgtgcttgacatgcttgttgtaccgaccttccttgtttagcgtaaaaaaagccttcctgtttcgaccttccttgtttagcttgaagagtctttccttttc

SEQ ID NO: 2089 - DNA, 766 bp, Triticum aestivum
  Clone ID: PAT_TA_2089
gggactacgggggccaggccgccagtctttccctaccagtcgcgggcgcaagcgccgccccgtctggaccatcggcgccctccccgctgcggccacgcggccctttcgtctccggtccttcctcatccggcaccccacgcgcgcgcccttggtgctggccggtccccccggccgcggcacgctggccatgggcccagagcagctgagggagttctgagagaaccaactgtcggcctcggcatgctccaacaggacccaggtcccggcctgcaacatgaagctgaaatacgcgccatatctcgagctgcctggaggaattgcgctgcagggtgctacactggttgctatcaagccctccaccgagggaagcaatggcggccatatcagccgcaaggaaaccgacgcattcatctctggagcatttgatgggccattcaaattcgccctgaaggcgctgatgaagaggcgcacataccttctggagatgaatggcttctaggagttcttcctgggtatctgcttgctggtgcaagcaagggtcgtttggctgctttaacttttggtctgtgtaatagtctgtgcttgttgtctcgtgtgttagctctttgtacagtggtgacatttcgttagctatatgaaaaacatatcaaattagtacattttctcattgctcccctatctaacgacactctgatgtgatctaaccctcatacaagctgctttttgttgttattgcaaagctgatttttcactcccaaaaaaaaaa

SEQ ID NO: 2090 - DNA, 700 bp, Triticum aestivum
  Clone ID: PAT_TA_2090
agctcggcgcggcccccccgccccctcccatgcccgccccccccccccgcctccccctcgcccccctcccccgtcccccacaccgccacccaccacccccgctaccttgtgcggagccggctccccccagtatccttcgcggccgcgacgtcacaacccggtgtccctgggtaacgcctcagtctcgagcccgcggccccgaccacgcttgacctcgctcctcgcagaatcgtcggattggacttcgtccgagcctcttgttggaattggctctgctagttcgctcgatgcagtcctcctgtaggggccttgtgcctcccgccattccaccgggaaatagcaccacaggctgcccgtgtgatgcagcccactcgtttccttctccttttcgtcttgcgccctggcgggacgttggctgcgcccctcctcatggttccgttgcgtcctctcccattttccacgttaaggagaaggggtggcttctgctgggtccacctcctcggtgctgtttggtgtgcatctgaagggtgctgtcgccgaccttactggctcctgcgtctttgtcgaccatgcctttcagtccatcggcaccgagacttgcaatcggctgtagcgggcgttcaccttcgccgcaccccgctcctgtgcgccgccggcgacgctgcgccggagccggccgccaggcgcgggggtggaggcc

SEQ ID NO: 2091 - DNA, 608 bp, Triticum aestivum
  Clone ID: PAT_TA_2091
cgcaaaaggcgaggagagagagccatggaggacagagaccacggccccgctgagaaccttcctgaatctccacaccgcatcgtcgacgccgacgaggagggagacgaagacggaggcggcttcaccttccccgtcctaccgttcgcggcggacgcgctcatcgtgcccgtgtaccccatcttcggccgccccccgtccccgccgccggcggcctcggtcgacgagcaggagacggccaccgtgcgagtcccgctggggcagctcctgctggaggagcgcgacttccgcgcgaggcagagggacgaagagagcttcggggacggcgagctggagggcgtggcgccggagagctactgcctctgggcccccggacagtccactccggcgtccccgcggcggtgccggaagagcggctcaacggggtcggtcctccggtggcggcgcatcagtgagcgcctcgtggggcggagccacagcgacggcaaggagaagttcgtctttttgaacgccacttcagggcctcccaagcagggggacgtggaggaaggaagcagcaagagcgacggcggcggcgccgccgatgcccacggatggagctattacagcaa

SEQ ID NO: 2092 - DNA, 598 bp, Triticum aestivum
  unsure (1)..(598): unsure at all n locations
  Clone ID: PAT_TA_2092
ctttgctaccagttcttcacgaccgaatcgctcgtcttaatctgtagcagctacttagatagtggttcatgggctgctgcggtgggggcgccatgtcatcgtcgtcgtcgtcgaggccgaggggcggcatccgggaggagacgctgctccgcgtcccgggcgcggcggtgcacctcgtggccggttccgaggggcccctcgagctcggccgcggcgaactctccgtcgtgaggatcttcaaggacgacgtggccgtgaccaccgtggtgcgcgtcggccgcgaccttggctggccgctggcgagggacgagcctgtggtcaagctcgaccgcctgcactacctcttcacgctgccggacaaggacggcgggctcctcaactacggcgtctccttcgccgacgccgcgctgctgccgtccttcgactcgctcctcaagtccaactcctgcttctcaangccctccgcgccgtcaaggggtcgaggccgccgccgccgggtcngngtcgcccaagcgtatggaacacttccgtcaagtgggaactacacaantnctcccaaggcatcgggcnggnacggtcactcgnaaaggactcagtg

SEQ ID NO: 2093 - DNA, 2197 bp, Triticum aestivum
  unsure (1)..(2197): unsure at all n locations
  Clone ID: PAT_TA_2093
gtccccaccgctctcccccccccgctcacacgcgtccctcccctccgctcgccgcttctcccgggcacagcacctgcccttgcggggcggacccgaagcccggccccgcgcgccgccgtggcgcccaagcaaatcatgtgaaagatatttgctgtcgggcaaccatcgtactagaagttcctcccactcgtcatgttcagagttgggaactcggagtgctgtcatcggtttccaggatagaactactcgcgcggttcctgtactgtgcagctggggcatctagctgcccccctcgcagcgtttctccgcgtttcgagtttgggtgatcaaatcagcatcatatagatttcttttgctcggccgacatgggagctaattgctgtatttctgcatagcagagtcctcagccatgtatcattccagttgaagtgtcagcttacaggaatgtaagacactccccatcatggagcttccgatgggataacagaacacatatagaagacataatggaaatccccacatttttgtccaaccatagtagtggaagcattaggcctgaaacgaagagtggttccattgcgccaactgaaggcttttctaatggcaggtagcccttctgaactgttccacaaggtcaagtggcagaaatcagaaaagaagatggaaacatctaaagttgcacaatctgatcctagagatagacccactgcaagtaactcctcccccgaggcaaagctttgcaggaaatcactagacatggtaagtgttgcttcagatacgaaggcatcaacctctgtcccttcaacaccacctgtagtatccagagcagatccttcatcctctagggggcattctcttgggatggatacagactcaatgaggaaagcacgtcgctcaccaggatatcaactatatagacaggtctcagacagcaagattccatctctcaggtctctcaatgagagcaactcccctgaaggaaggccttcctcttccatgctctcagtctgcagcaatgatttatctgtagcaggatcacatggagagtcatctgatggttggtcaatgcgaacattttctgaaatggttgcatcatcccaaagagagagatggtcaattgatagtgagctcttaggttccgtttcaagtaaaatgactcgatcaaatgcttcaaatcatactaccgtctcccctgaccaagaggtgtgcaaactatgtttaaagctactaaaggaaaggccagcgtggaatgcccaggatctgggtgttgtcgctgttttattgtgcggccatgtttaccatgctgactgcctggatagcttaactgcagaagctgagaaatatgatcctccttgtcccgtatgcacccacggtgaacaatgtactgtgaagctattcggtaagctggaatcaaagataaagaataagatgcctacaaatgtgatactcgacggtgatctagatgggagctctaagcatcaaaagaaaagtaagagagttcccagattaggcacaagtattagcatgaaggactcgttcagtcggccatttttgaggaggcatttctcaattggctcccggtcaccccggttagtttcagagagcgagtcaacaaggaagaagggcttctgggcgaggcactggagagaatagcatagtactcagtcatcaaacaggaggggtcttgaagaggaagtgaactcccaagcaaatcatgtgggttttgtagtcaatgatgtgaaagatatttgctgtcgggcaaccatcgtactagaagttcctcccactcgtcatgttcagagttgggaattctgagtgccgtcatcggtttccaggatagaagaataataacagtttctatactatgcaactgagggttcttgcagaccccgtcgcagcttattagcaagtaacctaacagagaaggggatgaccttcaggctgaaggtagggtccagcatggtagattgttatgtttgcagtttttcttattcgtattattggttatgcgcaccggcgatttgtttgatctgatacataatttgggaactaccgtacatagctgatgctatttgtttgattaaaatgcaacaccgagggcgtcgatggtttgnttttatnggggaattatgntttaaaaanaaaanatnaagtncntccccctccccccaaaaaaaaaaaaaaaaaaaaaaaaaaa

SEQ ID NO: 2094 - DNA, 1165 bp, Triticum aestivum
  Clone ID: PAT_TA_2094
ccccgcgccatgaggcaaagggggaacaatcctggtcgcagaaagatggtcatctcagcaacagctaggcgaactgagagctcgattcgtcttagtgaagcactggcgcgtatgcgtttttcggaagtggttggaggccgagatgtaatagaggcctttaggcttcttgaagtcgccatgcagcaatctgcaaccgatcatgcaacagggacgattgatatggatctaatcatgactggggtatccgcaagtgaaaggcagagacgtgacaatcttgttgcggctatccgagaccttgtcatggagaaaatgcagcttggagggcccttgatgcgtatggctgagttgctggaagaaatgaggaaacagagctccatggaagttcatcagcatgatctccgtgttgctcttggcacactgcagagtgagggctctgtatttgtccacggagacagtttcaagaggacctgatggcaacgacgttgtagccagcatcaactgaacctaccatgctcccctctccaagattgttgaagatctgatctctttgtagagctgggtgctaacctgtttggtcttttcatggcctgtgccgtagatttcttaatgttgctcttggggattgttaagtttgcattgaagcaaacttttacctgtctttgacaacgatacaattattatgcttctaatcatgagtgtggtatccgcaagtgaaattttgatacattatgatgttgttgtggttatctggcaccttgtaatggaaaaaatgcagcttggagggccctcgatgcgtatggctgagttgctggaagaagtgaggaaacagagctccatggaagttcatcagcatgatctccgtgatgctcttggcacactgcagagtgagggctccgtatttgtccatggagacagtttcaagaggacctgatggcagcgacgttgtagccagcatcaactgaatctaccatgctcccctctccaagaatgttgaagatctgatgtctttgtagagctgggtgctaacctgtttggtcttttcatggcctgtgccgtagatttcttaatgttgctcttgggattgttatgtttacatgaaggcatatttttatttgtgtttgccagcaaatggatcaatgatgctgctaccattgcaaaaaaaaaa

SEQ ID NO: 2095 - DNA, 472 bp, Triticum aestivum
  unsure (1)..(472): unsure at all n locations
  Clone ID: PAT_TA_2095
cgcgaagaggaggtctcgctctcgcagattccaccccaccccgccgcgcatgctcgcccatcatccgatcccaaatccgcaacccacaccgtcccaatcggccgcgccgacccccgtgatccctaagatcaagacaatccccggcccggccagcccccgccgccgccccctcctcgcccggcgaagatgcacctgtggccgtcgctccggatccgggactcgttcaagcacgcctacctggagaagctggagttcaacctcgcccacaagaagcgcgcgcaggggcaggggcaagggcggcagggccaggacggggacgnacaagcaggcgccgctgctcgagggccgctcgtcgtcgatggtggccaccgcgttngagctcgcctgcgacgccgccatgctcctctcgtgctgcctgctgctgcttctgctgcngngcttttngtggtnagggagaccattccnttaaaca

SEQ ID NO: 2096 - DNA, 514 bp, Triticum aestivum
  Clone ID: PAT_TA_2096
gtcgccggcgccgtggagcagggcgacggctgcgactccccgtccgcgggcgggggcatggtggccgccgcatgcccgcgctgcttcctctacgtgctcatcgcccggagcgacccccgctgcccgcgctgcgagtcgcacgtgccgccacccccggccccggcgcccaagaagaagccgcggatcgacctcaacgtcggcttcctcggaacctagccatgccaagccaagaagaagtaggtcaagatggttgtcgtccgtcctcgtcctcgtcctccgtcctcggcgcgttaggtaggcagcaggcctccggtgctcggattggccacgaacgacgccattgtttttcctgatgccaccgacggattccggtacataggggaaaggcgctccaagatttttgcttgtccatttccaagtatggccggccgtccgttccgtccgtccccgattccgtcatgtcaagatcaatcaaacactcgacagaacatgaatgaactgaaactactatccc

SEQ ID NO: 2097 - DNA, 1561 bp, Triticum aestivum
  Clone ID: PAT_TA_2097
cccacgcgtacgcggacgcgtgtgtccgtttttcctttcccccctctaaacccgcaccagaagcagcgctcctagggtttgctcctgccacaaaccctaccaccagattgcccggattccggcagaggcggcggctgcgagctggtggcatggcgggttacccggaggacaaccagcacgccatgaacggacgcggatgcggggggccgagccagggccacctcggggtgatcacgaaaatggagaaggtggaggggaggccggaggtggtggagaggctagtggctaccgcggcggtgggggcgttggtggcgggcccgcaggccgttctgccatcagcagcagcagtggttatgggtatggagctgactaccgatcagctgcagccgcctactatggtagtgcaggatatggtgcctacggtagagggtatggtgcatatggaggtaaccctgcctatgggtcaggttttggctctgcttatggtggttctatatatggaggcccgtatggtgcctatggagcatttgggggtgcgtacggaggtggtgcatatggtgcacctggcggctatggtgcaggtgcaggcgggtatggaggactaagggggagcttgaagcatgggtggtggtggaagcgcgagtggtctaggctcgggcaggtaccatccatacgggaaatgagtccacagctggtccctaggatctgataataaacacatacacccgctcatttctgctatgagaagttgcaacaccccattgactttgtcggatcagaacattttgcattcttgcattgcactggcattgtatcggagcacaaatctagattctagtcactgaaaactgaaccagcctgagcttcagctaaaacattgttgtattcattagaaccctttaaaagtcgaacccaactttgtgataggaacaatatctatgtgttggcacgatgtattacaatgtaacagtctcaccaagcaacctaactcttggcagaattgacttgctctaaaggaactgggacgtcacctctgcagtatggtgcagatcggccgtgccgtgcagctgggtcatcgcttgtctgtgccccgggtgttgcgatggtaggaggcccgcatggggcagatgggacgacgggtggggcctatggaggtggcgcatatggtgcacctggcggctatgatgcaggtgcaggcgggtatggtggctatgggggaactgggagcatgggtggtggtgggagcgcgagcggtcgaggctcgggcagataccacccatacgggaaatgagtccacagctggttcctaggatctgataataaacacatacacccactcatttttgctatgagaagttgcaacaccccattgactttgtcggatcagaacattttgcattcttgcattgcactggcattgtatcggacacaaatctagattctagttgctgaaaactgaaccagcccgagctttatgttgaagcttcagctgaaaaactgttgtattcattagaaccctttaaaagtcgaacccaactttgtgataagaaaacaaaaaaaa

SEQ ID NO: 2098 - DNA, 1990 bp, Triticum aestivum
  unsure (1)..(1990): unsure at all n locations
  Clone ID: PAT_TA_2098
ccacgcgtccgcccacgccgccgcccccccgccccctctcctcccccgctcatctgcggcgccgctccccctctctttcctcgcttccgccccgcctcgctgccgcccatcacccctcccccaagccagcaccgccgccctaccctaatcggcgccgccgccgtcgcgcgctgagctgcaaatcctcctctctattcgacgtttcctcttacgccgccacccccctgcctccaatgcaccgcctctcatcttcttcgcgacttcccatctctttcatggcatctgccccgcctcgctggtggccattagcgcttgcgcgacaaattatcccactcttggccggctccaaatccaccggcccgtcgtctttccagatttcctcatggatctcagaacctggccaccgtcagtcgagtacaaggcgatgaatctggtaaaccatataaacgactgcccatctcgatcgctcaaatgatgaaaaacatgaagactgacaatttaaaaaaattgaaaaatattgggacgaggggcactgtctcggaggttatagatgaagatgagaggaaaagtgataaagatgcttttaggacaacatcagaggttatggatgacaaaagtgatacatggggccaaaatgtgaacttacctggttttgaggaagaccaaagtagcgcagccaagaatcacattactgaaatcgctgtcagtgaggatgaaggactcagtgatgatgaaggatatagtgtgaacggtatacttgcaaaaagcagacaccgtgatggttctatatacagggatatggatttatatgattggaaaaaacattatcgcattgcagaccgtattgagactcggttggaggcaatgacattatcagatcctgctgcaaattgcaacgttcacgatggaatttgtactagacattttgctcgtagcatgctgcaaatttactcactagagttggctaaaattcctgtggatggcttagtagagttgtatggatatgtagcagtgcgggatgatctggatccattgcttaattatgttgtcaatattagcagagatgatcccgtcatcgtggagcagggttctctcatcaacatgattgggccccaagcgagggatagatatggcagatcatgctcctacttngaatatgacatgaagatcaagtcaggtgaacaagaaaaaaatgacctacagctgattgatggtgcatcattcataggccccttaggcccatgggatcaaccatgcacatttcacattgctggtgattgtggctcagttgacataactttgtcaccccttttaaaagcagttgaggcgaccgtagaggttctcatattggaagtgaaaagcagtttcagtttgtccgtcggatgtttagccagtgggtttaatgaagaaatccagctctttgatggcaccatcgctgattcacaaggcctaaagaggtccgtggttgctgtaatgaaaaactcttcgatagatttgaagttcaaggtaggcgcactgtcatccagttccgaccaacattgctgttctttcaaggcgaaaatgcacgggcatgatattgaagaaataaagactgattttgcattaatcttagtgaaggtgatttggtcgaccttgcctaggggcttttccgccatgtgtgatgggctggctcgtgattaacttggagtgtaataatcaaaactatcctagcaattctttgctaagtgtaataatcaaaacgacaagtctttgcatactcagtcgatgctccgagtcgttaagtgtaccagtggctgggttaagtgtactagtggatggggtgcgcctcgtgaggtgtaagtgtgcggtacttgtcatgctgttaaacttgttaatgtgtttgtacagcccatgggcgcgagttgcatcaaaacaacatactgtatattttactagtagcaagcagagcaagtaggtttttttttaaaaaaaaaaaaaaaaaaaaaaaaaa

SEQ ID NO: 2099 - DNA, 1193 bp, Triticum aestivum
  Clone ID: PAT_TA_2099
ccacgcgtccgcatgttgggtatcagtatctcagatcgatatttgccttcgcaagcccaagcggcgaacgatttgccagattttttggatccatcttttgaagttgaaaccctgccatctccttcttcagatcaaagatgcgcgtgttgttttcgttggttcgacctcgttttttgttgatagtttgataccatgcagcacttgtttttcagatctatgcaagttttcattggttttgatcttcctgattctgctcccctaatttgatagatctagttcgatctgtttcctcttgtggcacgcgcgagagcttaccctagtggctcgcctccctgtctctattcggacaggtcgtgggttcgattcccaagggagcctgattcctcctttttctggcaatttatccaacgccacttgatttatgcagcacttgttttcagatctatgcaagttttcattggttttgatcttcctgattctgctcccctaatttgatagatctagttcgatctgtttcctcctgtgtcacgcgcgagagcttaccctagtggctcgcctccctgtctctattcggacaggtcgtgggttcgattcccccgagagcctgattcctcctttttctggcaatttatccaacgccactgacagaatggccccagcagtcagccagtggctatgagcggcgcttctcattttttttttggactttcacatcaatggtgggcttaatagcagagatttgcatctcgttgtatggtttatggcccaataacggcccactcactatactatttatatgcgccggtctcccctgatctaaaccctaacatttcttcctcaggcggcggcggcggaggcggaggcgagcgacgacgcgtgccatggcgctctgccgtgtgggttctcggctcgctggagtcgcggcgaggagtcttctcaccggctcccatgctgccaagggcggcgctgacatccccatcgccggcctccgcgctcacctgcccaacacctctggtctcctgcgtcccaagggcgtcggccactactctcaggaaaggttctcccacaccaagccggcacccacactggtcatggtggtggtgcatgaagacccagatctcgcgcgtgtctatgcggagagcctgtctaaggctgccagggaccaaatccttgttctgcacaaggtgcacctt

SEQ ID NO: 2100 - DNA, 622 bp, Triticum aestivum
  unsure (1)..(622): unsure at all n locations
  Clone ID: PAT_TA_2100
gcttaccgagatcctagccggcgccggcgacgagccaactggcgccacgcaaggcgcctacaaggtgcgcaaggtcggctctagcaaggttcacggcgtgctcaacctctcctacaagctcggaggagtcatccacccacccgccggtcagtaccagcaggcgggcgcgacagggtacctggcggctgccgctgcgccgtacgcgtctgctccgccgccgcagcagctcagctacccgtacccgtgcccacccccgacaatggttcgtccgctgcgcgtcagcagccggtaaaagcgcggcgataccagaaagaaataaagcgcgcgcgcggcgcggcaaaccactcttgcagtggcatggcatggcaacctttgctctgttctgccccgctcatacagagaaatggtggcttggtgagtgggttagccactacccacttgtggagcgatgctgtgtaccaataaatctgaatgaaatgtatgttgtgcctgcacataaaagtagcagcaccaacaaaaaaaatactgcgcacgggcgccggtacctttccccactgggtcgttagcggtanggcntctttaaantctacggaaactggtacaantanccctagaanccctn

SEQ ID NO: 2101 - DNA, 666 bp, Triticum aestivum
  unsure (1)..(666): unsure at all n locations
  Clone ID: PAT_TA_2101
cccacgcgtccgctgacacaaaaaagtgacgtgtatagctttggggttgttcttttggagctcctaactggaaggaaaccagtagatcacacgatgccaaggggacagcagagtcttgttacctgggcaacaccaaggcttggtgaggacaaggtaaaacaatgtgttgatccaagattaaacggagagtaccctccaaaaggagttgccaagctcgcggcggtggcagctctctgtgtgcaatacgagtctgagttcagacctagcatgagcattgtagtcaaagcattgtcgccccttattaaataaaccacagcagccaccgggagctccagacacaccttcagatacttgacaacatgtgcaattcgagattcatgtaaagtaataccaattttcctcggttgccctggcaggtactgcttgcccatatttcttgtggtcatcgaggactactgcagctaattggttttttgtgtccttttcactcctatacttgttttgtttgttctgtgtctgtgttctcangcagtacttgatgctccttcacttgtaattgggttgccatactcgatccagtggttaataatgccttaaaaaaaggggggccggtaccaattcccctatatgatctatacgncgccactggccgtcgttaaactcggn

SEQ ID NO: 2102 - DNA, 651 bp, Triticum aestivum
  Clone ID: PAT_TA_2102
ccgcggccgcggcacggcgacgggcttcctccgacaagagcgcgtcgcaggcgaggcgaggggtcggggaagggaagggaagggaagaggatgtcgctgggggcggtgttccacggcgcgcagctgatgctggatctggcggtggccgggatgtcgctgatgttcgcgctcggcctgttcgccgtcgtcaccaccgtgctctgctccgccgccttcctccaccactccaagcccgtcgcgtcgtagccgcgacctgcctcccaccaagcccacgaccccctcggcgcatcctaatcgagtcagattgctgttgggacgtaataccttctttcgcatcatttgcccagcagcaggtgctccatatgctactgctgctagtactgttgggagggaactactgtagacgcaaagagtaggaactgcacatatcaggtgatagctggaggctcttgtaccttgtattacttgtcatgtctacttaagctgttctgtaaactacacttgcttgtacagtacattgttggttcgtcttgtttaaatcttctacatcttattgtttataaatgtactgtacattgtctaatgcttcttatggaagggccggatattcctaggtttcatgtgcaaatgctgcatcagttgtagtaagat

SEQ ID NO: 2103 - DNA, 1017 bp, Triticum aestivum
  Clone ID: PAT_TA_2103
cgaggagctccccccctgccacgcgcgggccaacgcaggatccggcccttcccccgtgctcgcctgtgctaggtgcgtgctttgtctggtacgctttgttgctctcctttgggcggcatggggcagccaccgtggaccacccccgccgccttggagctcggcccgcctccggccggccacctctccagcggcctcgtgctcctccgcctcgatccgtccgccccatcgccctatccgcgccggagcagccggatccgctgcccagtccaccaaccaagagccgcctcttgcctgtcctacgctcgagaggagggcgaccgagaggagcgccctattgatccgccgcctgggccgccttggcagcccgccgtgcctccggtcttcccttctctgccagctgcgcgatactccgacagccgccgtatgcctcgacgccattgattccgcacgagccagctggtcctatttcttccgttaatatacatacttcttcttcttacagcaaaagaacgcaaccgcactcgtttctgtcccccccgtcgcttatcccccctatttgccactccagtagcccggcacccatcaccccgcccgcgcctagagcggagctccagctgtgccacgagcaggccaacccaggagctgtcacttccccctctctccttctctctctcgacttttaccttcttcttctctctgtttctaatctttgttttctatagggaagtcaccatggaacaaccccaccgccggatccgccgcccagaccaccaaccaagcatcggcccttccctttcctgcggtcgtgggttgaataatataaactgcagggtccttttttaagaacaaatcgttttttagattagccacttttttgcaaaatcgccgacgacgtaccaccagaagcaatcgctgctttattagtagggaaagatatgtcgctattattcgtatctgttttgaatcttgtataaacatatatatatatttatatggagaacacatccgatcagcata

SEQ ID NO: 2104 - DNA, 515 bp, Triticum aestivum
  unsure (1)..(515): unsure at all n locations
  Clone ID: PAT_TA_2104
gaaaaacaacactagctgcccagaagaagaggaattgcaagaacccattcaccatggcacgtccaaggaacgacacacatattttgttcttggttgtagctcttctggtcatgtctaccgccttcctgccctgtaacgcagatatcgacccacccagctggtgcacgccggaggcggtttgccaggacccggttacgccgggaaacagggaaacgtgcaaaagcatctgcaaaagttttggctacaacccggaacaagcctactgcaatcccgatcccactccgaggtgctgctgcatctattaagcgcaggaaataacaatgccactggagtggcagatgatggatgacaaagctagcaaactcacttttatgtgtccatttcgacttatgtaaaaatcggaacagatcatggtccaggcctgtccgtcaattaataaagattagaaaaagtttccttttaaaaagggggggcccgtaccnaatccgcccaanagngggtccgattaccccgcc

SEQ ID NO: 2105 - DNA, 1400 bp, Triticum aestivum
  Clone ID: PAT_TA_2105
cgtttttcctccttcatttcttttgctggagagtagtagaaggttcggcagcaatctcttgagcggacaaccaggactctaatcaaggccgtgcgagggtggagtagcttcccgaccaatgacacgaatctcctagaggtagccacgttgtttccggcgaaaatcgcagctgaccagtataaagcatagattcttaaataccaggttgtgacgagaccgaggtccgtttacaagactgtcccgaactgcgaaccttgccgacccctgcaacgatcaccgatcgaagggttctatctggcccggcgattacacaaagcagaaatacctggccattccatggagggtgcggttttgtcagggaagttttgtgctcagtccatacgtgcaggattctaagatgctgtcccgcaggagccaggagagcctgcaatccgaagccccggtcgcctccaagttgtagctagttagcgcgattcaaaatttttttggcgtttcctatatgtcattgtcacattgttgtagagtccaccaggtgaattgagctgacatccatattggaactaaaagggaaatttgtaaaacaaagaagaccttttgcagaagggcaaaagtgataaaaggaatcttagatagcataaaagtgataaagggttcttagatattattatcttgtttgcagttggaaaccgaagcagtaaccgtggccgattgctttttcatgtcccctggagtaaaacccaagtcaaggtttgtgtgtgcgaaggagaagaaagcatggacaatatcctaacgatatctaagatcttttgtctgcttggatatattgatgggcttggtcagctgcaattttcagaagggtgtgtgtacaggctggattagtctctcaagatattccttgtgggcccctcaataattgtacttgtgagatatttcctgtggtaggtatgtcaccaggagatcgactcaaaaaaaaatcatcaggagataggactccctccgttcctaaatgtaagtcttttgtgccatttcaaatgaactacagcatatggatgtatgtagacatattttaaagtatagattcattcattttgctccgtatgtagtcatttgttgaaatctttaaaaagacttatatttgggaacggagatggtagtactggcaggctagtaggccatacatatatctgaggtgctagtagggcatatcattttatttttccttttcaaaaagggcggatcatatctcgtggcatgggtcttcgctagctgtatgagattgtctggaatggatgttccattccatgtgggctgtagctcaagccttcttgttgtggataatgactgaacaaaagcatccaaaattcaaaaggaaggagaaaaatcccactccgtgattagat

SEQ ID NO: 2106 - DNA, 810 bp, Triticum aestivum
  Clone ID: PAT_TA_2106
taccgcttacacgtcgacgggctacccgggccggacgtaccggttctacacgggcgacacggtgttcgccttcggggacgggctgagctacaccaagatgtcccaccagctcgtgtccgcgccgccgtcgtacgtgtgcatgcagctggccgaggaccacccgtgccgcgccgaggagtgcgcgtccgtggaggccgcgggcgaccactgcgaggacctggccttcgacgtgaagctccgggtgcggaacgccggcgaggtggccggcgcgcactcggtgccgctgttctcgtcccccccgtcggtgcacaacgcgcccggcgaagcacctgctcggggtttcgagaaggtgttcgctggcgccccggggaggccggcacggtggcgttcagggtggacgtgtgcagggacctgagcgtggcggacgagctgggcggccgcaaggtggcgcttcggcggccacacgctgcacgtcggcgacctcaagcacaccgtggaactacgggtctgatcaaagaagattccacgtagggaggatcgatttcatttgataagggaaaaaatgttagaattggatgggttgacgggggaatggaccgtagtaattgatttaagggaggtgaaataaccaatgggcctcccgctgggacaagaaagaattggatccacggggggctttgggagttgttttgttgcggttgttaaatttgatttgattcgtttggaattggagggacgatttgcaacgtctcgtcttggtggcgtctctcaacagtaatttattggaaggggaaatacctcatttcatcc

SEQ ID NO: 2107 - DNA, 694 bp, Triticum aestivum
  unsure (1)..(694): unsure at all n locations
  Clone ID: PAT_TA_2107
gcttggtcttccccttgctctgctcgatcctacctgcgctagcgcacactccgtctcacgcgcccgtgcgctgctcgatcctacctacgctagcacacactctgtctcacgctcgcgagcgaactagtccaggaacaatggcgccgcccaagaaggtgctgatgctgtgcggcgactacatggaggactacgaggcggccgtgcccttctacgcgctggccggcctgggcgtcgccgtccactgcgccgccccgggcaaggcccccggcgacccctgcctcaccgccgtgcacgacttcctcggctacgagctctacacggagctccccggccaccgcttccgcgtcaccgccgacttcgccgcggacggcggccgacccgtcctcgtacgacgcgctcgtcgtcccgggcggccgcttcgtggagcagctcaaccgttgacgccgaggcggtcgcgctcgtcaaggcgttcgcgggcgagctgccccggccggtcgtgctcacgttccatacccacctcctcctccccgccgcgggcgccatgggcggcgtccgggtgcatcggcgctctttacccttcgcggcgagctggcgccggccggggcgaccgggtcctagccccccccccccggcccctctgacgcctgtgcgcccgccctcgcccccatcgcgcggcccgcccacggggatcntn

SEQ ID NO: 2108 - DNA, 702 bp, Triticum aestivum
  Clone ID: PAT_TA_2108
tatggaagccaagtccaatccgtgtcgggcagtacatgcttttgtgtcagagaggaacactgtctccggctcccgctcattggacattgatttgtgttggagaaggacgcggtcttcaattccgtccaaatcaccacacgaaattaagcattcagagaactgaagctgggcggcgcaggggggcagcaccagctcgtccagcatggcgcagaggccggcgccgacgacctcgtggctcttggcgacgccaagccacgcctggccctctgccggagccggagcgccgcggcgcctcgccccaagagagcaagccggccgccttatcgccctccgccgcgacgcttcagcccgccaaggccagctccggaggccggcgccgacgaactcgtgccgcggcaagcgtgccggcggcgcctgcccgtctgtggaggccggcagtggataagtgcccgtggtggccgtggtggcagggttctttttgcaaaatacgaaacgttatctcaccaggacaaactttaaattggactgcgggttgaatattaagaaatagagggacttttccgtaaaaacgccgacgacgtacgggcagaagcactccgtgctttattagtagggaaagattaattccgatgcatggttatttaaatatgagcaatgcaagaaaatggcatttttctataaaaaaaaaaaaaaaaaaactcg

SEQ ID NO: 2109 - DNA, 1701 bp, Triticum aestivum
  Clone ID: PAT_TA_2109
cgggcccccgcggtaccagcgaggccagcggccagcgggaacacacaggggtaccgtgcgtgtgcatctcgcagctgcctcgcctcggaaccatcgaggtctcctcccacgccgagctcggctcacaatgcaaacaagaccctccctctctctctgctctctccccgtttgaggtttgacctctcctccagctccggagccccgcaagtctccccctcctcctggcgcccggcaatggcggccgcctcggaggaggccatcaagcagttctccggcctcatggagcagctggaggagcccctcaagaccacattccagaatgtgcaccaaggtatatccaagagggactctgctgcgttttctgaaggccagagagtggaacgttcctaaagcttacaaaatgctaatggactgcttaatttggaggcttcagaatgagattgacagcgttcttgccaaaccaatattgcccgctgatttgtatagatctattcgtgatacactgcttgtagtattaacaggatattccaagcagggtcaacctgtctatgcagtcggtgttgggctcggtacctttgaacagagcatcggtgaacttctaattgcagtctcacatacagatgaatgagtatcgagatcgtgttgtcctgccaggtgcttcttgaaatgtccgggaaaacagattatcacctgcttgaaagttaacgatatgactggcctgaacctttcagcttttaacggaatgatggaagtgtgttcggcctcttttataagagagctctaatatcatgatcaaagtgatgtgtggtccaggaagaaatgactatactgaaggttatggactacgcgtcactcccgcacttctgcaagagggaagggtccggttcaggctcgtcgtcggatgaagtcgactgctactcggtatgatcatgctttccaccaaggagtcattcccctacgtcaagcagcaagctcggtacggaaccagtgccacgcggcacgaagtcgactgctactcgtacgaccatcctttccaccaggagctgtacaactatgtgaagcagcaagctctgtggaaccaggacagcgccggccccgcgaagcaagggtcgatgcagcgaacggtagtccccgcccgttcctgcagggtcggccaagatcatggatactatccagtcggcgctccacagatccaagggcaggcgacggcatttcccagctccttcagcgggatcccgatcgcgcggtgcaggatatcgctgattccttcttaaatcgacgaccggcaagtttttctgcgatttatagcagttcttcccggcattgtaaccgctcgcgtgaacagctcgtctaggatcatatcggtagaggaagcagcagtagtagtaatagtagtagtaaaccttcggatccgctggaccgcgtgagtctgtatcgtgttgtcgaggatggtagtaattagtttgattaacctggctaatggatgtcccatttgagtattcctgtctccatcctgttgtcgcatggcagggaaattaccatgctcccagacatgagtagcaccatctctatgtatcgtatcaatcatcagtatatagtatatgtatgtatatgaaagtgctcccagacatgagcagcacgagctctatgtatcttatcaatcagtatatatagtatatgtatgtatatgtaaaaaaaaaa

SEQ ID NO: 2110 - DNA, 1934 bp, Triticum aestivum
  Clone ID: PAT_TA_2110
ccgcccctcccctctgccccgacctttccgggtgcgccccgccaccccaccccgtaaaccaaggcttcgagccggcaggggcgacgcggaacagggccacaggaaaaggaaagggtactgcgagatgaacgaggattgtgagaactgtgctttctggagggatcattactactgggatcacatgggtgacgagaagaagcaattttctgctgtagccaagggtgatttcaagaacagcatccgtataccacgggaactttcaacccatttgaggagtaggatctctgacaccattaaactcagcgctcctaatggcagggcatatgatgttgtggtgacctgggaattcggcgagctagttattcggtctggctgggatgcatttgttactgcgcaccatatagaagaaaatgacacattcttgttcatctaccatgggaattccaactttgagattcatatatttaattcacccggttgcgagaagatggcttcctgctttcaatctccttcagtgatctttgctttcgctactccttggtgacaattggaccaactttgatgtgccgaacaagctgcacctaatccaagaacatgttcagacgcaagttgagtttgactataccatgtcaactggatgctatctaaccaaatcacaagatgagaaagttgtagaaatagcccgcaaaataaggtctgagattcctttgtatgtggcaatcatgaagaaacttaatgtcaacgtgaaggactgctctatcgtaagttgtatcttttccgtatcatttcttggttatgccagtcactcctattcgtaacccacttctgttggtcagcattgcatctttttaacctttcttctgttctgttcctgaagaacataccattgaggcttgtgagccatttaaaagaggaggcaggtagtgctattatcaaactagaagcccctggtggtaacatatacaatgttcgagctagcaagcacagcgaggatcaagttgtcctccaatctgattgggatgcttttgtagctgctaatcacatacagttgaacgacctcctcattttccatagcaagggaaaaactcgtctcaaagttctcgcactggacccaagtggctgtgagaaaaactcatcatgcttcgacacaaaaaaaatctccaagactggtgaaggttcagttcagattactgatgcacgcccttgtacagttgaaattattgatctgaccagctctgacgatgatcacactgagagagaagatgctggaagatcatctgggaggcggaagcaggtaccaggttctcatgcaaaagctcggaagatggcttcggcgtcatccccatctacaaaatcaggagaaagtccaagcaattggatctgaacttcctatctatgtggcagtgatgaccaaaagctgtgttagtggccacctcttttctctggaattctgcagggaatatgcttcgactcttccaggcagagatcaaactctcatacttgagctggaggacaaggagtggcacacggcattacacgtcaatggaagtaggaagatcatttacggaggctggtcaaagttcgcctctgacaataacctgcagctgggagacatctgcctcttcaaaatggcagagcgccgcacgagaggccttgcgatgagggtccatatcatttgcaaatcgggcgtatttctgtagctcaagcatccaagtcgacaccgtccctgttgttcctattgactactactagaactacctatggcctgtatggctttaactctctgataccctaccatgagagagtccactcctgaacaactttatgtgcgtccgtttaggctgctgggtgtttgctcaacgactttctagtatacttgagagcaaatattgagctccacttcctgcttactaatgccgtctaatactcctata

SEQ ID NO: 2111 - DNA, 348 bp, Triticum aestivum
  Clone ID: PAT_TA_2111
aaaatcaaggccatcacgaggtaggaggaggggagctcgatcgatcctaacggtgaataacaatctactacagtaataaaggaaccatggaggggttccagtggtgctggcccggctccttgctcctggacgccgtcttcttcctggcggcggcggccgtgtcggaggccaacatcggcgagttcgacgagtactggcagcggcgccagctggaggccagagcccgcgcggaggccgcctaccatcccaaccccatcgaggtcgccaacagcttgaaccgcgccgtccacagggccgttcgggaggagagcggctcgaggaggaagttgctgggactgcacaagaagt

SEQ ID NO: 2112 - DNA, 645 bp, Triticum aestivum
  unsure (1)..(645): unsure at all n locations
  Clone ID: PAT_TA_2112
tcggttgaggagagcgggcctgcgtacgtggaccgctaccctgacctcgggccgtgcggcgcgcccacccgtacgtggccggggatcggatggacgatcatctggcggtgctggcgcgcggcgaggggtggacggaggagcggcacgcggcgttcctcgacggcgtggagcgctccttcgtgcaggaggtgctccgtgggcgccgccggcgtcagcgaggagcggcgagcgtcgcgcaggctctgccaccgggggccgccgcccgcccccccccgcggcccgctcccccggccccgccccccccccctccctggacagcgccgttggatccaacccgccggggaccctgtccccggccgcancccgcgacgccaaatgacctggtgggtccatctatggtacgatcatcctttccctttacacaanagaacatcaacactctctcaaccaacacagtgtactcccttgcaacgtaacttcaattacaagggtaccnctgtccccatattttccnttccttttctacccatatatancaagggctaaattcacaaatangtgtgacactctatttcgtttggtcaattgcaagtncctccaanaatcnganttacaaactnctagatgntaaattcttcaggatgt

SEQ ID NO: 2113 - DNA, 1111 bp, Triticum aestivum
  Clone ID: PAT_TA_2113
gcacgaggatcgtcttccaaagtgaagcagagcttaagaggcacaatgctgtggagcataagaagcgcatgcctcatgcacagaagaattctgctctccagacaccaaccagttctagagaccggagcgagctagagcagagtaatggcagaggtagaaagcacaacgcttgcctctccaatggttctgttgacaataccttgctgtctgttcagaatagcattgcaaatatgggccgtggctcgggaaatcaagttgctgctgttgtgtctcccttgcgatctagttctgggcactcatcacaagcaggccaaagctctgggatgaaccttgtttggcagcatcccctctttcctcccctctcccgccaggaggttcctgatgcaagaataggttcctgttttcaagaagctccatcccctcccatatcagggcaatcagggtatacaccagttgccagtcggagctcacggactgctgcacgcgcaatggatttggaattccctcctttatcaagcagtaataacagaactgctgcttcaacagagcagggggtacgaaaggtagctgagaacactcatgcatttgggctccgacaacaaagcaacggaattgtgaatacacaccattctgctcagcattggtcccttcaaaatactgatttgatcccttctggttcaagtcactccccaagttggcctacacccaacacaagtcctcacgttagtggatcgctgagtctgacttctgcaggaaatggaaggcaaaacacctgtgagccgccaggtgttgtgctctgtggatgatgttcgtgcagcgaataattcattggttgaaagaatgcaggccgcattaggaatggaccgggacaggtactcgatgttcaaagagatctccggggagtatcgttaaggagttatcaatgcttcaaagtatctttcatacgtcgaacaatttggtctgtcgcacctcgttcttgaaatgacaaggtaactgccggatccttataagcagaaggagcttgctgatgcctactatgcgaataagcgccttacaagcctacaaggtaatgatggtggtggtattgtttgctataaagactgtacacgtt

SEQ ID NO: 2114 - DNA, 1685 bp, Triticum aestivum
  Clone ID: PAT_TA_2114
ttttcggaaggctttctttaatcgaattacttggacgacggcaactctaccaggccctttaagttcattttctgttactccatctttcttttccgttccatattcttcaataccatttggtgccacatccgttgttaattcaatagataggactccagtggcatttttggcaaaattgtttagatattggagggggtcaattgaagtgactattaaagttgtgaagacagaatttcatactggtagacttattttgtccttttcgccccaattagctcagactactattacaaattctaatacaaactatgttcatcgtgagatagtcgatctacgtgatggctctgagtttgtgattaaagtgccttattgctacaactctatgtacatggatactgaccaagctcaaaatgatttattcatgatgatgcaggtcaatgtattaaatgaattggtagctccagacacttgcgcacaaagcgtagaaattttgtatgaggttaggggtggagtagacatggaatttcaagttccagttcctttcaatgttgtaccagttcaacagatagttcctcagagtggtggagaaggccaagctgagttagttcttgattcttgtattggtagttccactgtgcatgacccgtctaagatgtctgctgagctttgcattggtgaatcttgcacttctatgttacagttgatgaagaggtatctccgattggcaacaactaatgcatcatggactgcgaacaattcttttgcagtctacccgtattattatggggcttactttacttcgggtgtggcattgagtggcaccacaggctatattactggtgattatgtggggcttttggcttcatgttatgcccattctcgtggagccctgaggtatagatggatgaacggtcaaaccactgcttcgggtacgatcactaagattataccctatgataggctagtggtagctccagtgtctgttacaactaagacgacctcccaattgcttggccaagcacctcaaatcacattaagtgaaaatgcggagctctctaatcaggcgaccacctatgatgatgttcagtcatcgggtgctagttcttttatacctatgtataatcgaactttttgtagattgaatcggttgttctatacgaacaatcctggagatgctttggtctcacgtgctcctgatattgcaaaatttcaactggaaatagatagttcatctggcaactttggtgcaacatcttctctccatagatgtgcatctgatgacttccatttctcgttttggttaggagttcccacgatgggatggttacaaacttaaagtccaagtgactataaaagaaacaacaaaaacatagtaaaatgtataaaattacgcagctttccccccaccactggtggggggttttggagctgaccccttaggaaaacaattcttcgattgtttgctagatacgttatgagacggacctgtttaaggggccgttccatttctgaagctaacaaactttaagtcgttgatttgcctgcgatttgaagacgtcgtagctgcatctgctctggttaatttcagtgcatttgcggctgtttttattgcaaaaaaaaaaacaccaagggcgccacttagttgcaccttttctattattcttactttcttttttctacattaa

SEQ ID NO: 2115 - DNA, 437 bp, Triticum aestivum
  Clone ID: PAT_TA_2115
gctaaaggagtatagagtgaagaaccgatcagctgcagcagcgaggcgtgtgggctacagagctaaaaccaggttcgcctcggcgccaaccgtgtgttttgcctgttcatggtccttgcggtagtttcctccccctgcttgcttggtccaggtgccacggtagagaatgtgttgcgaatgtgctcgagcctgctgacctttccctgtactggggtgtggatttgcccatgccccgagtttgtcccgtgtatgaacaaaacatgtgtggtcttggtttggtttgtgaactagtttctcaatcgttcatatcgcagaccgttgtcctgttcatgtgcaatctagcagtcgacaaaccctccaatgaagaggataatttggcttcgcttgtacagtttgcgatatttaatagagcacgttagtgtagaagagaaagaaaa

SEQ ID NO: 2116 - DNA, 507 bp, Triticum aestivum
  Clone ID: PAT_TA_2116
cgtccgcccacgcgtccgtgattaaggaagttggtgatgggacattcgggagcgtatggcgcgctataaataaacaaaatggtgaagttgtggccgttaagaaaatgaaaagaaaatattattctttcgaggaatgtatgagtttacgtgaagtaaagtctttgcggcgcatgaatcaccctaacatagtgaagctcaaggaggtcataagggaaaatgatatattatacttcataatggaatacatggagtgcaatctctaccaacttatgaaagacagagtcaagcctttcgcggagtcagatgttcgtaattggtgctttcagattttccaggctcttgcttatatgcaccagaggggatactttcatcgtgacctcaaaccagagaatcttgtggttagcaaagatgtcctaaagctaacagactttggtctagcaagaaaaattcatttgcaccaccattcacaaaatatgtgttaacacgcttgtacccaacccctgaagg

SEQ ID NO: 2117 - DNA, 1490 bp, Triticum aestivum
  Clone ID: PAT_TA_2117
cgtccgcggacgcgtgggcggacgcgtgggttttcttcttcacggaaagacatcagcgagtgagcatcataggctagaccgcttgggtcaagtcaacacattcttgcccacgcgctcgatccagatctcactggattggttcatataaatccacccgaagcaagcaaccagcaaggaagcgattcttcgcttatgcctgggccaacgccgtttcgttgttctcttcgcagctgctcgagagaatcacccccaagtgttcgatcttccccagcttgaagcagctcacctcaaagcttgttcaaccatcagaaatggcgactagcgctggcggaggtcagccgagcgttctgagcacattgccgaagaatctgccgttagactttctgaaaaccatcaccgaccagttctcagacgagcgtaaaatcggtacaggcgcatttggaactgtttatatgggattaatgccggatgggcaaataattaccgtgaagaaactcgctgaaaattcgccaattgcgcgtgagaaagcatttgctaacgaggttcagaatattatggctctccaccatgaaaatgtactgaaattggtcggctactgccatgaaggtcaaaagaaagtggtgctgaacaatggaagatatattgtggctgacattgttgaaagtttactttgccatgagtacttaccactgggaagccttcagaagcatctttttgaactacatacaaaaatggactggaacatacgcttcaacataattaaggggatttgcaatggtttgcactttgtacacagcattcctattgtccatatggatctcaagccggaaaacatactgttggatgataacatggtaccgaaaatagcggattttggtctctcgcgactcttcggtcaagaacaaacacggatgaacacacaaaatgtagtggggtcatatggatacatagctcctgaatatctatacagaggtgaaatctccacaaagtcggacatatacagtttaggtgtactaatccttgagaccaccacaagagaggagaattgccgcgggaacaaaccatctgcaggacaatttattaaaaaggtacgtgaaaattggacagagcagcacatcgtatcagagtacccatcattaaaagcagatagcctccgacaaataaaaaaatgcatcgaaattggactgcaatgtgttgagactgatcggcagaggagaccttccatagaagcaattatcaaccagctcaatggacggcattctaattgagctacgatgccgtactgatctccagtctcgagggagaattaagttcgggtcttcttcaggagacatgtgcaagaagcaaaggacatggctcggctgtttgccaaataatttgcttcgatatgtacgtcattgtggaacctgttagctttcatttcttatgatgattgctactccagatcaggtgcagttgcctgtccaatttaagtgcgacgtaagagtttt

SEQ ID NO: 2118 - DNA, 1036 bp, Triticum aestivum
  Clone ID: PAT_TA_2118
cacagtgaagcggatgagattctcaagatttgcaacgttattggttgcccagatgagcaaacatggccccagggattgtctcttgcagaggcgatgaagtatcagttcccacagatcagaggcagtcaactgtcggaggtaatgaaatcagccagtagtgaggcagttgaccttatatcctctctgtgctcatgggatccttgcaagagaccaaaagctgcggaagttctccaacatgccttctttaaggattgtacatatgttccagctgctgtccggccaaaagctgcaggccctcctaaaactcctccgggtgttggagcaagaggagtttcaggacacattgctcggagatactccactggagctctctccacaagcaaacctgctgcaaacatatctataaaaccgagcagcttatctaagatcggtgtgcaaagaaaacttcaattggatcgtcaggcaccacagaagagtacacggcccactgagagtaacaccaaacaaactactagtcgagtaccggcaaggaatagcccagggaacgcgaacccgatattaaggcattcacgcagtttacctgaaactggccgggcaacggttcagaaggtttcgagtatcaccgaaaagcttgctcatatgtctgtgacctctcgaacacgcacggctgtgaagccccctgtcccgctgttgaaggctgggcatctcaagtcagacttcctcgggaaatctgacgaaatccctccggcaaagagattgacaagaaagttagctaaaggagtatagagtagaaccgatcagcagcgacatgtgctacagagcaaccaggttccgttattaaggcattcacgcagtttacctgaaactggccgtgcaacggttcagaaggttctaagtatgaccgaaaagcttattcatatgaatgcgacctatagaacacacacggctgagaagccccctgtccctatactaaaggctgggcatcttaagtcagactttctcgggaaatctgacgaaattccttcggccaagagat

SEQ ID NO: 2119 - DNA, 2643 bp, Triticum aestivum
  Clone ID: PAT_TA_2119
gcacgcgtccggtcgttttccgttaacaaccttctgatttgaatggcacaagtaaatgtacttgacagttcttccaatcaagcaatttgctcttacaggaagtgcttacaggaactttccagcatatcccggatacgcttatatttccactaggaaaaaacaaaccttttgaaaacagaaaaaagaaaagaacagattaagaacgaagcgacttggcaaggagtatagagcaccaagatcctataccactaactacagaatcaacatgtattaacggtttcagcggagttattgattgcgagctatatctaatttgccccatcgccccgcggatgcgacttttgccacctccaagcgacagacaggctttccttcagatcggtgtgttgagcagtccagttgagctcactgttgatcttggtggggtcactgaatacttcagcatagtctcgctggcctgcctactgaggtactcaattttgatgtcaaccccagttgcctgcttgcaggcatcgacaaactccttaacggaacggcctcttccagtgccaacattataaatgctaactatactaggctctgccttgttgagtgctttcacatgagcatttacgaacatctgtagcatcaatgtggtctctaatgcaggttccatcatgctgtatgattatctatcactttaacctcctatcctgaaacgtcttcctaagtgctgaaaaaacaagcgtactacccacataaacatttgcaagagtcttttcactgggttgcacgatgtgcaaagtaggcctactgtccaaatagatcccaagcctgcaaacatactgttcgatgataacatggtgccgaaaatcgtcaatttcggtctcttcagactctttcgtcaagaacaaacacgcatgaacacacagaatgtttttggctcatatggacatagagctccggaatatctatacagaggtgaaatctcctgcaagacagaaatatacaatctaggtatgctgatgatggagacaacctcgggagagaagaatggttccattaaaaaacacatctgcagtgccaatagtcgcaaagttcattgcagcatcaaatgcattttcagaaaagtatcttgtggacagatttttgatgcccaagatctgcatcgatcaagtgaagaatcacaggcacctgcaacaataattggagaaccttattctgctccattatttcctctagaaagattgtctacaatggtaactcgatagttgtcttttaatagctgtaatgaggcatgtgaaccaatatagccagctcctcctgtcactaagacatgggtaaccccaggttcatgacgagaaaacacactattgccaccaaaaccaggagattgcttcagaacaaatatacagagtgctacgaagagcagggccacaaagactttcccaatattatgtggtttacgcctagcatcaaagtactccatcccagccctaggctgtgttcccctcctgtttacagggaccatgtaagaattcttctccttgagacgaactagccaatggtggaacctctactcgccgccgccactgccgccgccttgatctttctgccaatggtggaatcccgtgtgcgcgcagggagacagagggagtgaggggcagctccaatcaagcagggcgagagaggagaagcctccgtccgggaggagaagtaggagaaaacacgggagaggaggggggtcgttggggtggtgttctggaccaagtcccctctctctcctctcctctctctgtatgtatagagagaagagaagtagcgatgcaaatgacctttctctgttctggcctgtggattcgcccatgccccgagtttgtcccgtgtatgaacaaaacatgcgtggtcctgcctgccgttgtgaactagtttctcaatcgttcatatcgcagaccgttgtcctgttcatgtgcaatctagcagtcgacaaaccctccaatgaagaggataatttggcttcgcttgtacagtttgcgatatttaatagagcacgttagtgtaaaaaaaaaaaaaaaaaaaaaaaaaaaaaactcgaactattctctctccaggcaaagaaccgtcggcagtgcagttcataaaaaatgtacgtgaaaattggaaagagcagcgcatcgcatccgagtacccattgttagatgcggatggcctccaacaagtaaaaaaatgcatcgaaataggactggaatgtgttgagattgatcggctgaagagaccatccatagaaacaattctcgacaagctaaacggacgatgtgcatccatcagaaactaaaatgtcatgccaggtctccaatctccatccagcatgaaatttgggttttgttcagcagacatgtgcaagatggaatggacgctccctattactgctataatgaattattttaaaacagtatgctatgatatgtacgtcattgtgaagcctattaaattgtatttctccttgtaactgctacgtactccacatatctcttcgggtatttttattctccagacaaatttatgtgatggaatgtagcaagggaaagcaaaaactttgtgtcttgatgtgttgatagaaaaataaagtctagcccgagaagggccaaacccgttttgccaaaa

SEQ ID NO: 2120 - DNA, 591 bp, Triticum aestivum
  unsure (1)..(591): unsure at all n locations
  Clone ID: PAT_TA_2120
aaccatgccggctcttcttctgctcttgctgttgcgcttgagcatgggcggagagctggtcccgtgctcatccgccggcgagggccagttcgccttccagggcttcgcggcggcgaaccttacgctggatggtctcgccgccgtcatgcccaacggcctgctcgcgctcaccaacttcactctccagacaaaaggccatgccttcaaccccacccctctccgcttcctcgacgtcaacggggcgaccaactccactgccgtggcgcgctccttctccacatccttcgtgttccgccatcgtctccaactacgacggcctgagcgaccaanggctcgccttcgtnggtcgccccgaccaacaacttctcaacggcgatngccggggcaantatctgggcctcctccgaacgccaagaacggncgccgcgaagcgaacaaaatattggcaantcgagctccaanncaataatgaaaccccgagnttccggcgaanatcaaaaagaaaaccangtttgggnnattaaangtcaaaaaccttaattntnccgggaanggccaaanccgggccggnttaataanggnaaataacgt

SEQ ID NO: 2121 - DNA, 1454 bp, Triticum aestivum
  unsure (1)..(1454): unsure at all n locations
  Clone ID: PAT_TA_2121
ctccccccccccccccccacgtgcgcctctccgagtccgcgccgtcggcgggccgagggggcgggggagggggctgtcgcggacggcgaggcagggtggatggccaggcgcggcggggcccgacgcccgggccgcgccgcgcggcggccgcggcggagccgcccgggccgggggccccgccggcggtcgtgcccggcaaggcgttcacgccgagcaggaggggcctcgtcgtccgcactggccgccgcgtactgctcgctgcagctcccctcctcctcccacaacctccccgccatcctccccgacaagacaatcctccttggtaaggaccttctccagcggcctggatagattgaagcaagtcctcccacgaggctattggctcccccggtggtttttcccgtcctgcgggaaggtatctcgaaccggatcgggggcccgagggagtttcttgaagttcattatcttgatcaactccatctgccggcatcctttccttcctcattgctgtctcactgttactaatgttcaccgggaaaaagagatgcttccttgcgaacgccacgttctggtccttgcaatggcgccccttggccggcctttcgtggttgctcctgaagcagctggtgccaaacatttctttccacatgtgcattttccgataagtttatgctagaaaataacggctaattgtcagccattctttgtcttgtgtgtctccaattatcatggcctccatcagcgccctgattcctttgatttctgggctgactgtcttctctgggatgttcatcaactggcattacctgccacgataatggcagaaggacgacctgactgatcattactccgtccccaggcatgttccctccttgccatgcggccacccacagtcccagttgctcacctgttcggaccggatgctattcgcgacgtccgaactttcgggaactagccctcacccttcacaattctcccaacgaagtgaccgagacgggagcgtggcgagagagatctcgacggagaggatggccgcggacgatgcggatgaccccgaagcctccgcctaatgcgcaagacccagctcactttgcccatgttcaaggttgccaccgttgcgctactccgtcatattggccacgttcgacttgtatactccgcggatttgtgttctggggagcatattcatttttacagtggaccgatgatatgattaatactttactgcccctcttttgttttccttgttttgagaatattggttggttaaattgtgttgtagttcctgattacagtgaggaaagaagaaaaagggtggcatccccttgcccccgatgttgtaatgtagaaaaagaatgacttgtcagtaacaatgtgaagtattttttccaagtgaactgtgattccaggcaaacaataatagtagcttggatggacaggcngtnaaaaaaaaa

SEQ ID NO: 2122 - DNA, 499 bp, Triticum aestivum
  Clone ID: PAT_TA_2122
cggacgcgtgggttttttttttgaaaggtaaaaatcagaagaagttaaaaactggagcgaatttgaacaatttggatggggagagagagagagctagtgttgcatagctagctctaggctgctgtgcatgggattattctgttcttttttcactcctctttctctttactgttttcctttgcgggttggatcagcggcgagtttcactcccagcaggccttcattttctacgcgcgcgctcaggagcttcccgtcattttgcatcatgctcagagcctcagacggccggcgccggggtccacccgaactggcacacgtcgacaggtcaaattcagaagcaaagccaggcccctttggtcaagatcaccttgtagagtagaaaacaatggataattcagcagaattcccgtcggtatatatcgagagaggaggactcacctgtcccggtcgccgcactcagagtcgctgacggagctctccacgtcgcgactctcgcacc

SEQ ID NO: 2123 - DNA, 736 bp, Triticum aestivum
  Clone ID: PAT_TA_2123
aggagagggttccggacgtggcccgccaccaggcccggccccttagccctgctggcgagcgccccacgcgtccgtaccgacatgcttcagctttgcacaggaatagatgagaaatctgtgggatcctccttccagctggtctttgcaccaattgatgattttccagatgatgctccattggtttcatccggctttcgtgttataccacttgatatgaaaacagacgttgtatcctctggcaggacattagatttggcatctagtcttgaagtaggctccactgcagcccaagcctctggtgcatctccagatgattgtaatgtgcgatctgtgctgacaatcgcctttcaattcccttatgagctgcatcttcaagacagtgttgcagctatggcccgtcagcacgttcgtagcattggctctgctggtcaaagcggcgccagtgctcccgccccggcatgccccggcacggacgccacgcggccgtcgccccgggcgctgcgtgcaggggccgcggctagtccagggctctgcccggcctagccttgccctctagcggccgctcccccgcctcaggcgcaccacccgcgggcggcctcatcgaagccgcttttgcgcgaccaacaggccatactccgaccatcgtttagcgcagtacctgtgttcccaggccccggcacgtgcgggccacacgcgtcagagcctgccctcgtccccttgcaagacctgacactgg

SEQ ID NO: 2124 - DNA, 1447 bp, Triticum aestivum
  unsure (1)..(1447): unsure at all n locations
  Clone ID: PAT_TA_2124
catctccgcaacaatctctttcaaggcaggcactttgctagctaaagttctgtacagtctagaatacctggctcttgtgccatcggccgatcgtgcaagggcaagcaagctgactgcttctggcaattgctcaaacacaccntttcatttcctcaaagcccatctctgcaagaacagatggtcttggaacaacacggattacctcgccgcctttaggttcctggactcgttgatcagccttgataaccagttcacagctcgaatttgctccgcattttatgatgaaaggtgctgtcgttccagtgttaaactgcaatacgttccactgcgaaacttcgctctctcccagcgtgttggaatttgagttggggtcaggggcaggatcatcggggtcttcttgcagtgactctacagcattgtgtgcatccgtgatctgcttctgagcacatggatgatcaatgtcaagaagagaaggcatctgtgccaataggtcatctaatgattctagcaatgctttcttttttgattttcgcggacgtcttgtagagctttgttttattacttccttgacttgctttaagatgttgtctagagatataagagatgctaatcgtgcatcttcagcagcagttggaggatttcggataggtgaaccaccttcttctttggttaacaaggcagtatcagtccgcatttgttgcatgatctttcttcttttatgatcaacggactccagagcagagcgcagcttactgacatgaacaggatcatcagcctcctctgttgccaatgtgccagctatgtccttcaagtgttgtagctgtgatgtgtaaacacgcttgctgtactcagataacagctggcctagagcatcagtgcttgggggctgcgctgtaccaaggccagccatccatccatccatgatagcggtagataacaattcaagttgcccagtagttcctccagcaacatctccaccagttacagatagaaaatcaaagttctccctcgtgccgaattccttgtccttcaagtgttgtagctgtgatgtgtaaacacgcttgctgtactcagataacagctggcctagagcatccgtgcggccgcccggcccggtaccaaggccagccatccatccatccatgatagcggtagataacaattcgagttgcccagtagttcctccagcaacatctccaccagttacagatagaaaatcaaagttctctgcaagccatgctcggatttggcgttgtaattcaccagcaggcgtgtgaacaaaaagagcagccaaggccttgtttccaatcgcaaaagccttcgcttcctcggtaatttcccgaagctttcctccagtgacatgttgtccccggccccccccccccttcccacgaagcttcagaacaatcgaggagaattttgatttcttttcggacgcggggtcgac

SEQ ID NO: 2125 - DNA, 452 bp, Triticum aestivum
  Clone ID: PAT_TA_2125
cccacgcgttcgcagcgttctgcgacggcaagtgcggggtgaggtgctccaaggcgggccggcacgacgactgcctcaagtactgcgggatatgctgcgccgagtgcaactgcgtgccgtcggggaccgccggcaacaaggacgagtgcccgtgctaccgcgacaagaccaccggccacggcgcgcgcacgaggcccaagtgcccatgatccatgcaccacccatggcgtctacatggggcatatacctacctgaactggaagatgccctatcatgtactgtacttagtaccatgtcgcggatcactactatattatatgcgtgtaatcatgatctgaaacgcctggttcatgatccgactgtatgttgataatgcataatgctggcctactggtatgccggtaaaaatgtcattgtgctgtaataataaactatcatgcattcgtagagtc

SEQ ID NO: 2126 - DNA, 919 bp, Triticum aestivum
  unsure (1)..(919): unsure at all n locations
  Clone ID: PAT_TA_2126
gccggttccgggtacaactcactcctccagctcccacggctcacaccaaccagcaggccagcgctctgccagagccaagcaactcaagaacaacacaatgaaggagctaggcaccaccacccccaccaccacgctggccctcctccccctcccccccatcctcgctcccccctccgtcctcctcttcctggttgcgtcttcgtcgtccgccagtgcgggatgagcggtgtgcggcggcgggggcgggaagagcggctccaaggcgggccgacacgaggcgtgccgcgcgactgcctgaagtccggcggcggcggccgcgagcaagggcgcgccgtcgcccgggagaccgccggcaaccaggacgaacgcccctacgaccacgagcagaccaccggccacgccccacccaagccgcccacctgcccctgatacgcatccaccaccgccctctagccatcctccgccgtccatggcgtcatctcacgtcttaccaggacttgatgcacttctatctatcatgttatgcgtgtaaaccatgatctgtagatttattgtatatgattagatcacgatctgtaggttgtggttcaataatgctttctgagttaatggtgcacgatgttgcaatgttgctgtgctgttaaaactaccgctgagctttaattatgaaccatcatgtatcagtaaagttgggtaagggcgtctggtgcatgatcctactatgtgttgataatgcatgatgctggcctgctgctatgccggtaaaaatgccgctgtgctgtaataatgaaccatcatgcatcagtaaagtttgtccagtaatttccttgttcnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2127 - DNA, 334 bp, Triticum aestivum
  Clone ID: PAT_TA_2127
gctctaaagctcaacactttgttacatctagcggatttggatttctttaacaactaaggttcctgtttttaacattttaaagccaagggcttttgcccatctccaatagctaacaagaactctttttttttacaaatccaacctttactagacttttgttttactacttacctaagctttccttttttatattgataaccctttttttttctttaaacacatcacccaagataagccccacctagcctattagtcaaaatgcaactaaactacatgaacactatttgcgtacaacctaacactttaccactaatggatagacctccaacctaca

SEQ ID NO: 2128 - DNA, 539 bp, Triticum aestivum
  Clone ID: PAT_TA_2128
gctctaacgctcaacactttgttacatctagcggatttggatttctttaacaactaaggttcctgtttttaacattttaaagccaagggcttttgcccatctccaatagctaacaagaactctttcttttctttacaaatcccaaaacctttactagactttttctgcttctttagcttacttcacctagagtcttctaccttttcttatcattgaatcaacccctttttttttttcttttaaacacatcccaacccaaagtataagcgcccacctagtcctatctagtccgaaaaatgcgaactagaactacatgagacactatctttgtcgttacgaacctaacactttctaccaagcttaatcggaataagacctcacaaacactcacaagttatatagggcttgaaagaaagtctaggtttgggtttgggttaactgctctaataaggagagtcagcttcttggattaaaaagagtgagcaaaatgaataagaaaatccaagctttttacgggatccatgagttcaaatttgatg

SEQ ID NO: 2129 - DNA, 685 bp, Triticum aestivum
  Clone ID: PAT_TA_2129
gctctaaagctcaacactttgttacatctagcggatttggatttctttaacaactaaggttcctgtttttaacattttaaagccaagggcttttgcccatctccaatagctaacaagaactctttcttttctttacaaatcccaaaacctttactagactttttctgcttctttagcttacttcacctagagtcttctaccttttcttatcattgaatcaacccctttttttttttcttttaaacacatcccaacccaaagtataagcgcccacctagtcctatctagtccgaaaaatgcgaactagaactacatgagacactatctctgtcgttacgaacctaacactttctaccaagcttaatcggaataagacctcacaaacactcacaagttatatagggcttgaaagaaagtctaggtttgggtttgggttaactgctctaataaggagagtcagctacttggattaaaaagagtgatcaaaatgaataagaaaatccaagtattttacggtatccatgagttcaaatttgatgcacacatgataattaaagattagattcaggttcaaattgatagggaatggtatcagatcatgacagtgtggtcgagtagagcaatctaagcatggctcagttttttttttttcaaatcattgactatgcaacagacactagcaacg

SEQ ID NO: 2130 - DNA, 603 bp, Triticum aestivum
  Clone ID: PAT_TA_2130
tgctctaaagtgttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaatgccaaggacgttgccaacatgacgcccgaggagcgtctagccacggcgctcagggcagctctcagcaccctcaagattgtccattccggcgatttgttttcg

SEQ ID NO: 2131 - DNA, 547 bp, Triticum aestivum
  Clone ID: PAT_TA_2131
gctcgagctcgtaagcttgaaccagctcgaagcggaaaaccaaagagggagtgagagagagagagaggaaggaagacgaaggacgccgcgatgcgttgcgccgtgctgctcctgcttgtcttcgcggcggcgcgcgccgccgcggtcgtcaccgacggtctcctgccgaacggcaacttcgagctgggtccggccaagtcggagctggtgaacgggacggtggtgaagggcgggaaggcgatccccaagtgggagacgtcgggcttcgtggagtacatcgagtccgggcacaagcagggcgacatgctgctggtggtgccgcagggcgcctacgccgtccgcctcggcaacgatgcctccatcctccagcgcatccccgtcgcccggggctcctactacgccatcaccttcagcgccgcccgcacctgcgcgcaggccgagcgcctcaacgtctgcgtcagccccgagtccggcgtgctccccatgcagaccatctacggtaggaacggctgggactgctacgcctggaccttgaaggtcaagctcg

SEQ ID NO: 2132 - DNA, 1565 bp, Triticum aestivum
  Clone ID: PAT_TA_2132
gggcgcgcgcagcttgaaggagctcggagcggcaaataaaagaagaagaagagtgagagagaggacaggaaggaggacgacgcgatgcgctgtgccgtggtgctgctgctcgtcttcgcggcggcgcgcgccgccgcggtcgtcaccgacgggctcctcccgaatggcaacttcgagtcgggtccggccaagtcggagctggtgaacggcacggtggtgaagggcggcaaggcgatccccaagtgggagacgtcgggcttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtggagctcgtcatccacaacccgggcgtcgaggaggaccccgcctgcggcccgctcatcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgactggatgatcatgtcctccaaggccgtcaagtacgtcgacgccgcgcacttcaaggtggccgagggcgcgcgcgccgtcgagctcgttggcggcaaggagagcgcgctcgtccaggaggtgcgcaccgtgcccggctgggcctacccttcgccgtcggcgactccgccgacggctgacatgggagacagcttcgccgaggcctatgccgcgcgcttccactccacagtcgcggtgccgtacgcgtccaacggcccgggcggatacaagcgcgccgtggtggacttcggcgctgtcagggaccgcacccgggtggtcttccagagcgccttctaccacatgaaggccgacggcaccctctgcgggcccgtcatcgacgacgccaagctcgtcggcctgcgcaagaagccctccgcacgtcgcctcatgctctaattaagctagccccgctgccacgtcttactacaaacaatatatgcaagcacacggcgccggatcggagtgagtagtatttattgctaggcttttggtggtgccaaccgggtgagtatatgtgtgtgagtttgccgttgtccgccgtgcttatacttgcggttgcccggcgccgtgttatttttgtttctttcactgccaatcaaccaaagaaaagggtcatgctatggcttggcctgacggagggtcacattatcatcaaaacaaagacttggcaagacggagggtcaaggcgcaattcaatggctcgtgcatgttactatttctcattgagagaagttcatattaaaaaaaaaaaaaaaaaactcgag

SEQ ID NO: 2133 - DNA, 784 bp, Triticum aestivum
  Clone ID: PAT_TA_2133
gcgccatctgcgactgttgttctaagggtctgtcccagaagaccaatgaagatgacctatatcagattctttgtgcgtgtgatcaaggatcgaccctccggcgtgtctcgaggatttgcttttattgacttccctactgtggaagctgcccgcaaaatgaaggaagctactggagacaatggccttctaattgatggtaggcagatattttccgagtacagtagtaaaccaactggtgggatgagtggtgattcttttggacaagaacatattacgaggtctacctacgggcgcaggaccatatccacacaatgtgattggatatgtactatatgtggctgtatgaattttgcccgcagaacctcctgttttcagtgcaacgagccacgtactgacgatgctccaccagctgatgcagcatcttccattcaaccgtttggcaaacgggggtctgaaataggtccaactcatgtcttagttcttcgtggtctggatgaaaatgctgacgaggaaatgcttcgatatgaatttgctaaacatgcaccaataaaggatatccggcttgttcgggacaaatttactcatgtgtctagaggttttgcatttgtccattttcattcggttgaagatgccacgaaagctcttgaagctacaaatgggattagacatgagaaaaatggccaggtgttacgtgtggcctatgctaaaagcacgcttggtcctgcatcggtggcttcacagtcaaacagccttgccgcagcagccatcgaggctgcatcatttg

SEQ ID NO: 2134 - DNA, 707 bp, Triticum aestivum
  unsure (1)..(707): unsure at all n locations
  Clone ID: PAT_TA_2134
nacttgtggcttcccccatagcactaaagacggcatccggatagcgttcaagttggcatatagacccggcccgggatggttaattttctttcccgtgaagtgaaggagaacgctaatccacagatcttgatttgtggtctagcttaaaagaaatatttgtttgggtttccattgaactttcttctatgagttggtttcaccagggaggggaacctggtgattgatcatggtgttgggtttgggatgtgtaacctggattttgtggagggtttggaatcaaatgcctatgggggtcgactaatcaaggccgtgttgcatcaagctgctcaaggagaacaaaaatgtcttggaagacaggaggtggccatctgatcgtggcgctatcttcttgatctcttggtgttagtctgattttgtggtgtggtcttgttctgtactctgctggtagggttgttgttatattctgctttgatgctcgtgtgttgtgagtctgccatgttcggtgagtgtcaccatcttccttgtatcctgcgagcatgtttcctatatacttcaaaactcaaggatttttttccccattttgtccnaagacatcaagctactatcggttgtctactggctgtgatgacatcgatgtgtaatttgatttgtccctgtacaaacctgaataagataaataaattgaatccgtttataaaaaaaaaaaa

SEQ ID NO: 2135 - DNA, 1806 bp, Triticum aestivum
  Clone ID: PAT_TA_2135
ccacgcgtccgattgattcagaaaaggacaaagttgtcactttcaggaacagacaatatgatcttcctgcttggtcagttagcatcctacctgactgcaagaatgtggttttcaacactgcgaaggttcgatctcaaactttgatggtggacatggtaccagaaactttgcaagcatcaaaatctgatcagtggagcattttcacagagagaatcggcatttgggataaaaatgacttcgtacgaaatgaatttgtggaccatattaatacaacaaaagactctactgattacctgtggcacactacaagttttgatgtggacagaaattatcctgcaactgggaaccatcccgttcttaatatcggctccaaaggccatgctgttcacgctttcctgaataatatgctcataggtagtgcatatggtaatggctcagaatcaagtttcagtgtgcatatgcccatcaacttgaaggctgggaagaatgaaattgcactactgagcatgactgttggattgaaaagtgcaggaccctattatgaatgggtgggagctggccttaccagtgtgaacatctctggaatgcaaaatggaacgatggacttgtcttcaatcaattggggcatacaagattgggttggaaggtgaacactaccgtttatttaacccgatcaagggaataaccaaaggtggaggccacaatctgagcaccaaaacatcagcctttgacatggtacaaggtgaatgttgacgttccacaaggagatgacccagttgggctagacatgcagtccatggggaaaggcctggtttggttgaatggaaatgccatagggaggtactggcccaggacaagtcctactgatgacaggtgcactccgagctgcgactacagaggaaaattttctccaaacaagtgcagggctggatgtggaaagccaactcaaagatggtaccacgtcccaaggtcatggtttcacccatcagggaacacccttgtggtctttgaggagcagggtggagatcccacgaagattacattctcgaggagagtcgcgacaagtgtttgctcctttgtctcggagaactatccttccatagacttggagtcctgggataaaagcatctcagatggtaacccagtagcagcaaaagtacagctgtcttgccccaagggcaaaaacatctcttcagtcaagtttgcgagcttcggagaccccagtggaacctgcagatcctaccaacagggaagctgccaccatccagactctctatctgttgttgagaaggcctgtctgaacatcaacagctgcacagtttcgctgtcagacgagggattcggagaagatccatgccctggcgtcaccaaaacacttgccattgaagcagactgttcttaatccgtgagttctactcagctgagggttccaccactacaaatctgctcgtcgaaaatcaagttcggaagctgcagtgctggtttgcttttacgcaatatgacaacctggaagtggaaggctaccttgatttaggttcagatttcttttgagcatcttgatgttagcctttgtttcgtcgagttctcgtgatggacgatgccatggtgctattcaggatgctggccatatgagcaaatgcgttgcgtctcaggctcgttatacctaatgtggccatgagttcaaaccacgagcaagcaaactaccacgaagcatattttacaacgcatcatgaacctcctatatcaatgctgatgtactgtgaggaatctcttgcttaattaaggccagttctgtcaggttcagtt

SEQ ID NO: 2136 - DNA, 571 bp, Triticum aestivum
  Clone ID: PAT_TA_2136
gaaggcggcgaagcggctcgtcgagtgcgccgtccgcgggtggaggcgcaagcggcggggcgtcgccgtcgacgactgctcggcggtctgcctcttcttccactcgccggcgccctgaacgagctgccccgagaccgcgattgcattgccatcagggcgaggggaaagcgacccgtccacttgccggtagatcgatcgatcggtgcgcgacgtcgccgtccgagagagacgaccagaaggtgcagttcgcgccatgattgggacgctgcacgaatgaccggggcggtgggtcgactgctgccggtggatcaccgaaaaattctccggttttgacacgctgcttgccgaaatgtacgaggatcaacggcagccactagcaaatggcagaagaaacaagacgcaccttgtccttattttcgtcctccatggctctcgttggcctgaaaatgcactatgagagacagtaatatggaaaattattggtgtacatgacggcacaacggctcgtgtgctgctatgctctgaaaaaaaaaaaaaaaaaaaaaaaaaaaaaaaaaaaaaaaaaaaaaaa

SEQ ID NO: 2137 - DNA, 660 bp, Triticum aestivum
  unsure (1)..(660): unsure at all n locations
  Clone ID: PAT_TA_2137
attcggcacgaggaggaagaggaggagcaggaggctgcggccatggccgccaagnaagccccagtaagaagaagaaaaagaagggcgggtttaccgtggacgatgaggacatcgacaagctcctggccgagatggaggatcctccccaacccacaaaggaggctgagccggaggaggctaaaggtggggattctctggctgcccctgatgccgatgatgccggcggaaagaaatcgaagaagaagaaaaagaagggagggtttactgttgatgatgaggacattgacaagctccttgcagagattgaggaccggcctgctgccgctgaggagcctgagcccaaggcagccaaggcagaggatactgtgcctgctgctgctgctgctgctgcgaccagtgtggatgatgctgaagggaagaaatcgaagaagaaaaagaagaagagtggaaggacagcacaggaagaggaggatctggacaagcttcttgctgagctcggtgaaggaccgacaccggcaccggagaaggagaaaccatcccaggcactgccttccgcttcagcagtgaaggaggacgctgaaactgtggaggatggtaatgcagagcagaaggccggggagggagaagtagagtccgctgctgccaagaagaaaaaaaaaa

SEQ ID NO: 2138 - DNA, 1029 bp, Triticum aestivum
  unsure (1)..(1029): unsure at all n locations
  Clone ID: PAT_TA_2138
cctaactcgtgccgtgcgttgcgttctgcccccgggtcccgtttccttggccggtcggcgctccgcacccgccggagatctcgcccgccgtcccgctcccccgcgctcccagcgaacccgtccggcttgccccaatggagacctgcccgtcggtgaagaacattctgttgctggactccgaggggaaacgcgtcgccgtcaagtactacacggatgattggcccgtgctctcggcgaagctggccttcgagaagtcggtcttcgtcaagacccagaaagcaagctctggagcagaggctgagattgtaatgtttgatggtcaaattgttgtgtataagttcatccaagacctgcatttttttgttactggaggagacgaggacaatgaacttattttagcatcagttcttcagggatttgctgatgccattgacattattcttagaaataatgtcgacaaaagaacagctcttgaaaatctggatctaatcctattatgccttgatgaaattgttgatggagggattgtcctagaaacagaaggaagtgtgatagctgaaaaggtactagctcatggagcagagggtgccacatcaatcgccgagcagactatagttcaggccctaacaacagcaagagagcactttgccaaatctctgctaatgtgacgtgtccctttcttgtggacgaagatggcattggaccaatgtgttcatttcattgtcaaaggagaaatgaggggaaatgtccgaatctgtgggtgtaaaattacgcgttttcgttgacgttatatgattgttcagttttacgagtgctcgaaatttgtgtggacaaagattgtgaaatgtgaccgtctcgattttgctgggttcacttcatctccttgttgttttactgttgatcgtcgtgtcggtacaatgcttacatacagaggttaacagcccatcttgttctagcttcaaacaagtaaatgttccgctgaaagcagcgataccagagtctgccaaaattcacctgcagctanagttt

SEQ ID NO: 2139 - DNA, 1764 bp, Triticum aestivum
  unsure (1)..(1764): unsure at all n locations
  Clone ID: PAT_TA_2139
gaccacgcggccgctcaattatctcccagagatggaaaagactcacaagaagaaggagaagctgctaaaaaagcaacaaagagcaagcccttctccttaatagctacttgacctttgatagattcacctctggccgctcccatcgtgaaagaaagcgtgtcacctatactttcgatgattatgaccgttcaataaatgaggccctaaaagcaataaagaaaagtgagaacccggttcaggtcgttgccactaccaacagaggagtacttgtcccaacacgagaggcatcaagtaatggtacgttagctggaccctcacctgtatgtaatggacggcgtggagaatctccactgaagtcatatagctaccaagggagtggtggtgaggaaaaggctgagacccttgatcgtaggtctcgtcaaagaaaaagatctcaaagatacacaacggactttgttgagaatgtctcggacatcgacacgaactttgacagtgatgacgatatcatgggtgaagctgtctatgacgaggagtatcttagaagtcgaaaacaacccaaggcaagtacttcagagtacgatggagagtttcgatcggaagaccaagcggagtattctttgagcagtgaagatgaagaggggattcaacggtccaaaaggttgccaagccgcagccctcaagggaccaggctgaaatccatggatgtaatccaaacaggcatcaagcgaaataagcgttctgcccggccccatatgaaccatcagcgatgctctggtaaagattccggattgggaaagccaggtgaaccgaatgcactggatccagatgccagctctgatgcaccagacagtgcaaagacctcaataaaaagtcaagagcagcgactgctccacatagtgaagatgcacgctcctggcagggaagagagcaaagttgctgggagacgattcctccaccttaacgagattgcgcctgtcagtggcttcggtggcgcgccagtccagtcttgacggcggaagacaaataacgggtaataaacatgttgtgcagcacattcaggtgcccagagcctttttttgttttcaccagggggtaccggcgccggcactgggttgaaccgcagatcacactggagatggagtatccatgagctggcgatgcgtccctcatctgtgccatcaagctgattactgctggcaggcaggagtttgtcagcgatcaagttgattactgctggcaggcaggagtttgtcagcgtggagcttatgaggagatggtccttgtgcagcggctggatttctcgaacctgctcagacgccattgatgtgcccggtctggtcgatgtttttctgtctggcagcatctgtggctctcctccatgtaggcatgtactctttttttttcgagatcatgtattctagtcttataggagcggcattttgcttgtcgcttgaggtgaggaggtggcctatactggttactgtcatgtggtgcacgcgcagttatcgactgctgacgccgcttggaagctggaacttctttttaattttttttagggaagctggaacttgttggtacctggattctccaggcaattgctagagagaattgttgtggcccgtcctgtccggtgttgaatgtagctggcacggagagaaattgacgtggtgggtagaccacgcagcgaatattattacagtgcaagagagcgatggcacataattacaagttcaaccgaacnaatatgtaggcaancnactccta

SEQ ID NO: 2140 - DNA, 649 bp, Triticum aestivum
  Clone ID: PAT_TA_2140
ggcgaatggaagcgtaccgtcgccaaggcgccgtcgaaggcgccggccgtcgtggaggccccggagccgtccgcgtccgtcgacgacgcgacaacctcgcccccggcggcgaccaccgtcgcgcgcgtgtgccaggtcaggatccgagtcaagatctggaagtggaccttctagtaacgacgcaaactcccagggggcacattgcgaaagcgaaccaaagccactttacttttcacctgggacgcggcggtagtagagatcacaaccgacggttgctgtaaaaaaaaaatcccatttgaattttacgaaatttggcggggggaggggaggagtgatgtgaggtttgaggtatttgtttattatttttccttatttttctacgtttctttttttgttgcgttaccttattttttgctagtgcaagtacaccttggggattgttctgcttaactttgtacgactacatatctatctgaatttgtaactgtttttttttgtcggggggaatttgtaattgttagtggcatgtattactaatgtactgtcaaactatactctcctttattttccatgttacagccctcttgacggacagttttgtaatagcatgtatgattatgccgggaaaaaaaaaaaaaaaaaaaaaaaa

SEQ ID NO: 2141 - DNA, 888 bp, Triticum aestivum
  Clone ID: PAT_TA_2141
ctcctccctttcctcccccgctcctccgctcccccacccgcgcctctcgagcaccgcacgggccgagcgaggaaggcgccgacggggagacggcggagcagagcggggcggcggcggaggccgtggtccctcggctgttcgcggcgaaggaggagtccgggaaaagcttctcggacatcgcggcccagacggggctcaccaacgtttacgtcgcgcagctgctgcgccgccaggcgcagctcaagcccgacatggcgcccgcgttccgggcggccgtcccggcgctcaccgacgagctcgtggagctcatgatgcggccgccttgccggtcctaccacccggacatcgtcccacgagccagccatataccagatttgaatgaagctgttatgcattttggagaagagcatcaaggagatcatcaatggaggattttggtgatggaatcatgtcggctatagacttctactgttcagttgacaaggattcaaggggctgatggaaaagatcgtgtggtggtcacatttgatgggaagtatctgccttacaccgagcagagatctgaacatatgatgtcaagattgaaccggaatgcatcttgagatggctggtgttacgaagaggatgtatgttcatggtgtaacacattgtgtgttgcctgattctactttggacttggaagaaaatgaataatggcttttctggcatgaatgaccgacaaataaacgaactgtctacatgtacgcagaataatttgttaaaaatgcggtttgtatcatcatcttcgttctgcttagtgaattatatttttcatgaatttagcatgcggattgatgtgctgaaataaaaatgttttccctaaaaaaaaaaaaacaaaaaaaaaaaaaa

SEQ ID NO: 2142 - DNA, 791 bp, Triticum aestivum
  Clone ID: PAT_TA_2142
ctgtgcgctccaaacattgtccaatttgtaagcagtgtgttgaacagtttgaccatcactgcccctggatatcaaattgtgttgggaagagaaataagtgggactttttggtctttctttgtatggggatagctacaacccttctcggtgctgccgttggattccacagactttggacggagcccattatactctcatcttctgagtcgtggactcacttcatggtgacaaaacatcctggtgctgtactgttcatgttcatggatattttcttattagctggagctcttattttgacggtggcacaagcagtaatgatagcgaggaatctcacaactaatgaggctgcaaaccagtcgcgctacacttatcttggtgggcctgatggacgcttcaggaatccttataaccaaggctggcagaagaactgcgcttattttcttgttaatggctacaacaacgacgaggaggctgcatggccaacccttcaacagacagtagagtgaagctatggttccttgctagaccaggctggatgtgctgtggtggtgcaagtgtagaaatgggatgatttttgtgcatagagttgatgacgatggttgtgtcagttgtaaaatctaacggtctggaatttgagtagtcattcacaacaaaagtaagtaccaacatacatattttcctggcacagctccaagctagactctatccatccctatttagatcttgagaatattctcatcttccagtgagaaactgaattactgtgatttttttactgctattgatgtgaa

SEQ ID NO: 2143 - DNA, 652 bp, Triticum aestivum
  Clone ID: PAT_TA_2143
tttcggtctctctcgacccttttcgcgcccgggatcactttcactcgatgctctcgccgtttgcggcgcttccgctctgtgctccctgcgttttccctggtttggctttgcatagcccgcgctctccacgggtttgtttgtcagtcttcaggctctcgtccgtgctaatgtgtcgatttggtggccttacccattcctagacttgacataccctcgagcacctgtctcggtacttggtggtggcactgcttcacttcccttgttatggcctcttcgcccttagtcctcgaggatcaagagatctctcctggaaagctggttcccacatagttacacatacgtgaagtagaccaaagaagatacacatatactggcacaatttactcccatttcccccttgtcctgaaaatcgcatggagcttctgctactacacaccgcgccgcgctcttcggacttcgctgcctgccgctccttgcgctgccaggcgcgggctcttcccggggctcgttaccccgggctcgtcgcgtggttcgccactcaaaagtggatgtgtgaattgccacgacttatgtgcaccaaaattttgggaagcgtagcttctttgaagtttgaagcaggcgttctttccagtggggaattttgtgccccctg

SEQ ID NO: 2144 - DNA, 1615 bp, Triticum aestivum
  Clone ID: PAT_TA_2144
agtccccacgcgtccgcccgaggcggcggcgcgagcgagcgagcgagcaaccggcggcgatgggtaaggcggctaagagctcgcggaaagggaagaaggcgtggcggtccaacatcagcaccgacgacatcgacgagttctacgagaagcagacgcgcgacgcccacgccggcgccgccgccattccctccctcccgtccggctccctcttcttcgtcgacaagcccgcctccgcgtccacctcctccgccgccaacgcatccgacccggcccccaaagatgttcctgtcaaaaggaagattgagaaaaacagggagaaggtccttcaccatgagagtgtgttgaagcggaacccttatatacagacaattccatcttctttgatgtcaaagaaggataagaagaagttcaagaagcacgcaaagaaaaaggaattgcaggagtcacgggaagaaaaaagtgttcccatggaagaggattcagctgagaagaacctcgacatctggggtggagatgctaaaggggctgctttgcccaaaaagggaatgaaaaggcttaagaaaaataaatctaccacatctgtgattcctgcggttgaagttgagcctcaaggatgttcatttaatcctccacatgaagcccatcaagacgctcttgctctagccgttgctgatgaaatgcgcaagatctacacgaaagagttaggccccacaccagtgccacttactgttcttggtcaagcagtagctgaagaagataaattttttcttgatgctgctgatgatggagatgctgctgctggagatgtatatgctgcagaaggtgataaagaccacgatgctgatgctctaactggagagaggaagaagaaacaaaagagttcgagagggactgaacaaaagggctcgtcgtaaagagaggttaaggacagaagcagatgcgaagaaactggaagttttttcaaagcaaatagacagcttgccaaatatattagaggagatagcaaaagaggacaaggaaaaggaggaaaagcgcataaggctaactgtggctaagcaggaaagactcaagtcagccccacgtcgtctgggtagacacaagtttgaacctgctcccgttcaagttctgttgacagaggagattagtggctcgcttagaaagctgaaggggtgctgcaatctagcgagggatcgctataagagcattgaaaaacgtggcatgcttgcaccaaataagaaattaagcaagcgccctcgccgctaaatgtgtggtgtatgttccaacacggtgaggaacatgagcaatctcactgggagttgaaaacaacttgaattgacgagggagaccagtgctgacaaggctatggaaaatatagttctacaatttgccttgttagtattgctgagggggttaaaacagtcgcatcgcttgaattttagtttgtcgctcccttgtgtctggccctatttcgtcgggtaggttcagtataccagacttcttactatctttgtatcgactgtaatagataattatgtggaagtatgatctccttcaaaaaaaaaaaaaaaaaaaaaaaaaaaaaaaaaaaaaaaaaaagactagttctagatcgcga

SEQ ID NO: 2145 - DNA, 1896 bp, Triticum aestivum
  Clone ID: PAT_TA_2145
gttcggcgccgttcccgcttcccctccccggaggcacgagagcgcgagcgagcaaccgacgacgatggggcaggcggctaggaggccgcggagcgggcggaacgcggagcggtgcgaggtgctcacccaccacctcgacgaaccctaacgagatgtaggcgaggcaggcgcacgtcgccctcgccgccgcggccgccctcccctccctcccctccgcctcggtcgacgtggccgcacaagcgcgcgaccccgtccccgtccacggccccgaccccgtccgcgacggcgtccatgataaaaggaggaaggagacctgcaacgaggagggcggtgaccatgagagcgtgtgccacccgccctgcgacggattcgatgcggaaacgccctagacccccaacgccgacttctctgacgtccaagacgcaaacgaatcaaacagggacagccgcaatgaccgtgaaaaaaaaagtgttgcgatgaagaaggaagtggtcctagaggattatagtaagttgaggcgtaacactttaatggggatgcttgttccaaaggttgatatgaacgcaataaaggaaaataaatctgtcacacccaataattctggaattgcagtgagtcctgggggggaagaatttgttcctctaggttcaggccatcgttgaaatgaagctcaacatgtggcttgtgatatgcgaaagggtatcatctcccccaaaagcgacacaaaagagtcaagacacataaatctgccacatatgtgacttgcgcagttaaaagttgaacagcatgtatgtttatttgatcctccacatgaagcccatcaagagtgctcttgctctagccgttgctgttgaaatgcgcaacatctacacgaaagagttaggccccacaccagtgccacttactggtcttggtacagcaggactcgacgaagagagaggttttcgagagaagcagatgcaaggaaactggaagttttttcgagagcaaatagccgccgtgcctgatggagaccaggatgctgatgctctaactggagagaggaaggaaaaaccaaaaagagttactagagtggaattgaacaaaagggctcgtcgtaaagagaggttaaggacagaagcagatgcaaagaaactggaagttctttcaaagcaaatagacagcttgccaaatatattagaggagatagcaaaagaggacaaggaaaaggaggaaaagcgcataaggctaaccgtggctaagcaggaaagactcgagtcagccccacgtcgtctcggtagacacaagtttgaacctgctcccgttcaagttctgttgacagaggagattagtggttcacttagaaagctgaaggggtgctgcaatctagcaagggatcgctataagagcattgaaaaacgtggtatgcttgcaccaaacaagaaattaagcaagcgccctcgccgctaaatgcatggtgtatgttccaacatggcgaggaacatggcaatctcactgggagtccaaaacaacttgaagtgatgagggaggccagtgctgacaaggctatggaaaatatagttctacaaatagactgggggccagcacaatttgtcttgttagtttgatgagggagttaaaagactcgcatcgcttgaattttagtttggcgctccctcatgtctggcccgaaaatggccttcgtgccactcgggcaggttttgtataccagacttcctactatctttgtatcgactgtaatggataattatgttctcagcaaaagtaatgaaagtatgttgatttcctcatatccttcagtatgaactatgtatactgcgttttaactgtaaaagaacatttcattgtcaactgctcctaggtcatcacaaaagagttaattgacgttggtgatac

SEQ ID NO: 2146 - DNA, 648 bp, Triticum aestivum
  Clone ID: PAT_TA_2146
gaaaagcatagcgcaaccacactctttgacctttgccccgtgatcacaccgcacccatctcccatccactgtgccaccgccccgcccctccccgtccccatttcctcgccccatcgttctcccgtctctgttctgttcgtcgaccgcctcgtgctttcttcatgtccagggagcggcgggtgccgctcgtcctggccctggcggcggcggcggtggtgggtgccctcgcggttgcggaggcggagctgcaggtcgggttctacaatgcgacgtgcccgatcgcggagggcgtggtgttcgcggagatgcacgccatcctgcacgaggaccccacgctcgcgccctccctgctccggatgcactaccacgactgcttcgtccagggctgcgacggctccatcatgctcaggtcccgccggggcacggcggagcgggaccccacccccaacccgaccatgcgcggctacgacgccatcgagcggatcaaggccaggctcgagacgctctgccccctctcccgctccgcccccggccccttccccacagccccctggcgcgccgtcggccggggcgggcggccgggcttccccgtgcactcccgccggccggacgccaacgtgacggtggccgagtacgctgagaacgacc

SEQ ID NO: 2147 - DNA, 1086 bp, Triticum aestivum
  Clone ID: PAT_TA_2147
gatgcatgcaaccttctgatattattcttagctttgatgcggacgcgtgggcggacgcgtgggcagtcccattcaggcatggagagcgcattggcttcagttacctagtttcacagaagtatactggtgagaaggcacgtgtcaaagttctccggaattcgaaaattcatgaattcaacataaagctctcaatccacaaaaagctcattccagctcatataaagggcaggccaccgtcgtactacattgttgcaggctttgtttttatggttgtatctgttccatatcttcgatctgagtatggaaaagattacgaatttgatgcccccgtcaagttgttggacaagcatttacatgcaatggcgcaatcacctgatgagcagcttgtggtggtctcacaggtgcttgtggcagatatcaatattggttatgaagaactagtcaatactcaggtgcgtgcgttcaatgggaaaccagtaaataatttgaagcagctggcgaccatggtggaagattgcaatgaggagttcttaaaatttgacatggattacgaccaggttgtcgttctcgagacgaaaacagctagggctgctactcaggacattctaacaacacactgcataccttcagcgatgtcagatgacctgaaggcctgagtaaaagcacggtggttaccgatacaatcccagttggcacacaatcccggttggcttatacaatgccaagtgcacgagaaacccctctgcagcaatgagtgctgctgaagttttggacgtggaagagcattatggttcggcaaaaaaggcgaatggtggccaacatcgctcgcatcctcactggctaaggttgaaaatgcacgcggcaccgagcaaccgagaaacctgtagaatagcagcaatcgaagttttgttctcatttgatttattgaatgaatacctggaaactcgttgcatttgcgtacccgtatccgtatcgtcatgtttgccgtgatgtattcactttaaacctctgcatcttttactcagctggcgatattttttatcgtaccaattatttgatttctggagtactcatttctttttctac

SEQ ID NO: 2148 - DNA, 646 bp, Triticum aestivum
  unsure (1)..(646): unsure at all n locations
  Clone ID: PAT_TA_2148
gcctcgtcgacaagggcggagatggcgagcctgcantccctcctggtcccccccgacagggagagcgtcgcgtacagctacggcatggtgctgctggagatcatgtccggcaggttcacggcgtcggccggcggcctgctggagggctgggcggcgagcttcctccgtggggagaggcagctgagggacgtgatggaccctgacctgagctggaacgcgcccctccatgccgagaccgtcaacaggctggacggcgtgattcggtcctgcaccgaccgggaggcgaggcggcgacccgccatggcagaggtggcgaggcggctgagggagatcacggccatgccgccggacgccgccacccccaaggtgtcgcccctgtggtgggcggagctggagatcatctccaccgaggccacctgaagatggcccggagcccgcctcctgaccagacatagcataccctccgttgattccgccgcgtctgctggtgcccttgcgtagcgtagtggctgaggtgtgctcgttttttcgcggcgccgcaccccttcccgtttgtcctgttttcccatggctctttaactctacgctccctggggcgctaccttagaanccttcacggtatacaaagccccntnctcaatngacn

SEQ ID NO: 2149 - DNA, 1827 bp, Triticum aestivum
  unsure (1)..(1827): unsure at all n locations
  Clone ID: PAT_TA_2149
catgtggtccccgcgttgtccctccttgnccctttnccccgcgcccccactacggcatggtgctgctctccccctccggtgtttgctgtcccaactgcaagccattccctgctcccttgtgcacccctgcagccccgtgtcggtccgggacgttgtcggcttgttctttccttggggagctgcccccccttggcggcccaaccccgtgaccgcgcccgtgtcgacggcgaccgtgcgggagcccccttgcccccggcgtcctccctttcccgctggggtccccgcccccttgccgggcacccccggccccaagcccctccctcgggggggcggccccgtccgcgcagttggggccgggggcggccatcccgccccccgcccgggcgcgcgccgggcgtggcgggccccgggccctccggcgccgggccggggatcgccggaatcggccgacccgcccgccggcggaggcgagctgctgcctacgcgcgcccaagggctgttcctccccttgcttagtgccccctcccgctgaagtcttctccgataggcaagatatagattctcggaggtgcccccaatccaactcttatttttatttttgtcacggatccgcgatccacatgcatttctgtatcccttatgttcaaaagatagggcagttcaagtctatatcacaaaagtcgtttctctaaaattccagcattcggcccctcaggatggcctccgcctttctgacttccttcactggtccaatgatgaacaccctatctggaggtccctttgcaccaccgatatggatttcaacattgcaagattctttcacagccattattgatgatccttttctgccaataacacgacccatttttccaggaggcacatctaagagcgaaaggatatccacttcaggaacacgagcttcagcttcaatgtcatcagggacagttggaagaggcggccaatctgcctgctggttgtcatttatgcaaaagcacctacagtatagctcacttcgtactgccagacgccatgaagatactttgcttaacttctccatcattttctcatgtatattgagaaggaagcgcacatcatctgtcgctgctcgaatcatcatttcagacaagggcctatttttccagaaatttgggtcctgccttagaagggtacggacttcttccttttcaggatatggcattccacaataacgaggatcggcaagaaggctcacgaaggatatgtaaacatcatatgctctctttttaccttcctgctcttcaatcagggaataggctatctgtgtatccatcacattatgtaatttaatgccaaactggaaatacaatgcctcactgtcccttttacagtcatgaataactttggtgacatgattggactcaagtgctggtttgcaagcttcaactagttcttttccaccctcaatagcatcgaccaagtaaacagcatcaggaaatgcaatctgcatgatacagagagcaccatggcggcaaaggtcaacaccttcacagtcaaatccaatcaccaatttcttggcagcagagggctcaagaaactcaactgggagttgactaggtttagtaacaacatgaaagggcagggatggcaattccgcgttattccctgcggggtcctcgccgtcggcggagttggggggatgggaggccatccctcgcccctcccgatcgctgaccgggagagacaggacgcggacgcaccggcaacggaagagggaatgaagaaaggggacggggaatagtcttgcccggcggcgtcaagactctactactactggtaactgcccgttgc

SEQ ID NO: 2150 - DNA, 587 bp, Triticum aestivum
  unsure (1)..(587): unsure at all n locations
  Clone ID: PAT_TA_2150
gcacaccaagnagcgtcctggtgtattgcttgtcatgggttgtcatcttcttcattttgctggtgatgaaggctgtgtcggtcggtcgacggaaattcagcgcggagttccagcttgtgttccggctgctcaaggggctcatcttcatcgtcttcatctccaccatcgtgatcctgatcgtgatcccccacatgacgatccaggacatattcgtctgcatcctcgcgttcatgccgacgggatggggcctgctcctggtggctcaggcgctgaggccggcgatcatgagcgtggggctgtgggggtcgatccgggcgctggctcgtgggtacgagatcatcatggggctgctgctcttcaccccgatcgcgttcctggcgtggttcccgttcgtgtcggagttccagacccggatgctcttcaaccaggccttcagccgtgggctgcagatctcgaggatcctgggcgggcacaagaaggaccgggcggcgctgagcaaggacgataggtagatagatcgattgctgtagtagctagtaaggtaggaggatgattgcctgcttgcttgcttgctgtagaatatatat

SEQ ID NO: 2151 - DNA, 946 bp, Triticum aestivum
  Clone ID: PAT_TA_2151
cttttttatcaaggaccctggcactcaagactctctcaggtttcacatcttgggcatggtccccttgcttgctattatcgcttctgttgtctcttccccctgccttattgcagctgctccaatattttttctcaaggagaccgttccggtacgttctgacattcatgacatagcaagcctggtctcctccttttctcttgtggcttatgggatcaccatccccttcggtatgggtgccattccgtgggctataatgtctgttgtccttccggttagcatcaagagcctggcgggaagcttcgcaacgctcgccaactggctgacctcgtttgggataacaatgacagcaaacttgctgctcagctggagtgctggaggtacctttgcgtgctacacgctcgtgagctcgttcacgtctcttgttcatcatcctctgggtgccggggagagccaagggcaagaactctagaggagatacagtggtcgttccaggttgagctcaagtcggtagttttcgcggtatatatgtcgggaattattctttcaaaggccggggcatcgtcttctttttacttagtccgaattgctccggatgaaggcccaatcatacaaaagaaaggaaaaactctgtcgtctgtatattcctgtacagacactgtttcagatgactctgtaaagcgggcttgtaattgttatgctctgttttcttctcgggcctccgtgctaccgctcctgcgcgacaacgcccacgcattttttccgtccatacaaagttgtgtatattcttgtacaacattggttcagactttcagttggctttgtaaagggggcctgtgtagtgactctcatcagattatactgcggttttgtgtttactgtaccatggtcagccgagatttttcgaaataaaatgtaagcaagaatactaagtttcaaaaaaaaaaaa

SEQ ID NO: 2152 - DNA, 679 bp, Triticum aestivum
  Clone ID: PAT_TA_2152
gacccacgcgtccgcttctctctcctttcccacaaaccgcgtctccgcttctcgagcccacccacaaatctccttcaagagagagagagagagagagagagagagagaggaggcacgcctgcccggatcataaccaagattcaaatttgcccgctcatcaatcatggttcttgattcattatcatcgcctcacaggaggtcgcaaaacacattctttctgtcatctcctaagaagcctcaatcatctcgtgatgatgttggtagttggtctgccctggttgagcggcatcgctttctcttgacaacgctagtggtgcttgccttcctgtgcaccatatatctttacttcgcggtgaccttgggggcaccacaagcttgctcagggttgacgggcgatgaaatgaccgtatgtcaggaaaaatcagccctgcaacatggaaagttgaaatatcgctaactccgcttgacagtttgcaatgtgcttgtggtccaaattcgtatattctttagtggtggatgctgaaagggcttgtattgatgctgatgtacattttaatggagtgagaggggattgtttgtgctttgaaaccgtataactgaataggtcccattttattattgtcacggtgtactaaaaatatcatggcactaattcaacctggatatatatatagagcat

SEQ ID NO: 2153 - DNA, 907 bp, Triticum aestivum
  Clone ID: PAT_TA_2153
gagcttgcattgcatgcacgcacgttacattatttatttaacgctcgacacttccaagtggctatagcgccaaaagcccctaccgaactactaccagctgacactcgagactcgacgcgccacacttgctcgtacagaccacacaccacgggcacacttcactctcttcttcgcgagcttctccatcctcgatctagctattgacgatggtaccaccattggggtggaggatctggccggagatgtaggaggagtcctgctcgctggccaggaagacgaagctgggcgcgacctcgctgggctgccccgcgcgcttcatgggcacctcggatccaaactgcttcaccttctcctccgggaaggaggccgggatgagcggcgtccagatgggccccggcgccacgccgttgacgcggatctccttctccgccagctgcatcgacagcgcgcgggtgaaggccacgatggcgcccttggtggccgtgtagtccagcagcgtcgcgttgcccttgtacgcgttcacggaggtggtgttgatgatgctggacccgggccccatgtgcttcaccgcgaacttggccatgaggaagtaggagaagatgttggtgcggaacacgcgctccaggtcctgctcgctgatctcggtgatgcaggggcggacgtactgctccgccgcgttgttcacgaggatgtccacgcgcccgccgtgcgcgttggccacctcctccaccaccctgcggcagttctcctcgtacccgaggtcgcccgccagcgccttgggctcgccggcgcccgtgcgggacttgatgtcgcggagcgcctgcagggtctcctccgcgtccttgtcctcgtgccccttcacgtacgtgaagttcaccgtcgcgccctccagcgcgaagcacaggca

SEQ ID NO: 2154 - DNA, 1359 bp, Triticum aestivum
  Clone ID: PAT_TA_2154
gtgccccctggcccgcagcagggtcatgtttaggcggggcatgcccatagttcaacttgcattgcatgcacgttacattatttatttaacgcttgacgcttccaagtggctattgcgccaaaagcccccacctaacacacaaccgaactaccaccagccgacactggagactcgaccggccgaactcgcccatacataccacaccaccacaccacggaaaacccaccccccacgttctcccctatcttctctaccccagatccacctttcgccgtctgtgtcacgattgtggtggagcatctggccggaattgtcggaggagtcatgctcgcggggcaggaagacgaagctgggcgcgacctcgttggggcgccctggccgggtcgtcggcaccgcggacccgaaccgctggaccttctcctccgcgacgtaggccccgaggagcggcgtccgatatgcgccctcccgcggggccgtggccagggatcgccgttctccaccagctgcacagccagcggccgggtgagcgccacgatggcgccctcggtggccgcgtaggcgagcgggttgcgccgtagccttgcgtacgcggttgccccggtggtcgatgtagggtggtgctggccccgggccggtactctgcgtcactgcgaaacttagccatgaagaagtaggagaagattgtttggtgcgggaacacgcgctccaggtcctgctcggtgatcttcggtgatgcagggccggacgtactgctccgccgcgttgttgacgaggatgtccacgcgcccgccgtgcgcgttcgccacctcctccaccaccctgcggcagttctcctcgtacccgaggtcgcccgggagcgccttgggctcgccggcgcccgtgcgggacttgatgtcgcgaagcgcctgtagggtctcctccgcgtccttgtcctcgtgccccttcacgtacgtgaagttcaccgtcgcgccctccagcgcgaagcacaggcacaccgcgcgcccgatgcccgagtcgccgccggtcaccagtgccaccttgccctggagcttgttggccgacttgtagttcttgatgagggtctcggggcgggggtccatggcgtgctccttgccgggctggcagtcctgctgctgcggcgggaacttctgcgacgccatcgctctggtccctcggcgagtgggcggtgctcttggtgacgacgcggcgaacgaagctagcgctctggtggcggggaggggacgcagctgattcggtcggaggcggtgaagaagaaggagaaacggctgggctctggtgggtgttgcgaggagtgcgctcgtggctgttgcgaggagtgcgccctcgccccgtgccgaa

SEQ ID NO: 2155 - DNA, 867 bp, Triticum aestivum
  unsure (1)..(867): unsure at all n locations
  Clone ID: PAT_TA_2155
gggatcgcctctggtccaaatccaaacccctccccccttttagcatcgccggcaacaacgacggccatgctctccgccgccgcctctgccattcccaggctccgctgggctgccgcgccgccggggcacgcctcgccgagggccaggtggtctctgctgcggcggcgcccactctcctcctccccgaacgtagcgcccaccgcggggccggggcccctggagccgccggaccttccccgcctcgccaagtctgcccgcatatctctctcgccgcaagaggccgaggagttcgcgcccaagattcagcaggtggtggactggtttgggcaacttcaagcggttgatcttgaatccattgagccttcacttagagctgatactgcagctggtagttctttaagagaagataaggcggaaccatttgctaacagagatgccataatagaagcccttccaagttatgatgatccatacatcaaagtgccaaatgcactgaccaaagaatgacatgtgggtctgtaaatcaaagttgtgatattggttacattctatttcattagacaatgaggcatggtgaatcaactgagcttgctaaccatcgaacgagcaatcaacaagcctgagttaagtttgctaccctcggttcgaccctgacgaccctaccctgggcaaccgggtgctgcattgcctgccacggttccctcatccttgccttgccaactcccgggcgggcccggtccctgtcgcccccctatgttccctttcatcgccgcgcccggcgttgttggggctgccggcgctaccgcgtgcctccccaaacggcgatagttcaatgttatgctacacctgggnattgtctcaattggt

SEQ ID NO: 2156 - DNA, 952 bp, Triticum aestivum
  Clone ID: PAT_TA_2156
cgtccgtctgccgcgaccacctctactacgtgacggtggtggccgacctgcaatgcgaccgctgcatcgccagtaacctcttcggttcccttcatgaacgaggacatgggcatgtacctcgacgatgagctcatccaccactaccacctcgactccgcgtgcaactccgggcttcgggcccgccgggtgctcctcgcccggtgcgcttgcccggctctccggcggtggcaactaccggcgtaatgacatcaagttctggtttacatgctattctcgtcattcatgccgacagaccttttgttgcagcgtttagagtagattgagttggctggctctcctttctgtttctgttctactatgtggtgattgcttaaggttgttgttaccatggaggtgcacgggcgtcacaagcctacaagagagtatgtcgacagagggtgcaatggtgtaaaaccacacaataattttggcaaagttgatccctggacggcgtgggcgtacagaccgcggaccatctcgttgttgctgatgggtatctgctttttaatgaggtgtgtttgccgatgaccaaaatgtgctgattgtggcgtccgcgtggatgctttacggtttgatccacgcccggtacatcttaaccaccaagggcttgtctcagatctgtagaagttgccgccactgctgctgctgcaggtggaacaggaagaagccatcatggctgctgcacatctgaagtggtattatgtgttctggaagatggaagagggataaaacttatttttgttgaactaatttttttgtattctattttgttttatgtagcatttgatagttttgtataggaacaagtgataatattttgtagggctttatggcctgtgatgtaaacatatttagtgctgaaatatgaaattatttgcaaaatttgtcgaaaaggaggatcatttctacgaat

SEQ ID NO: 2157 - DNA, 1226 bp, Triticum aestivum
  Clone ID: PAT_TA_2157
gagccccctgctcctctccccatccccttgccgtctcctccgccgcctcttctcccgcgcccctcgccgccgcaaccctacgaccccgcggcccctcgccccacacctcggccgccgccttcccctccgcctcccggcctccatgtcctcctccagcgccggggcccccgactccgtcgtcgccgacgccgacgccctcgctcgcaaggtcgccgccatccgcgccgccggcccagctaagctgcaggtgattgccgacttcgacggcacgctcactcggtactggtacgacggctcccgcggccagagtagccatgggctgctcagacaggggaatgaagagttcgactccaagagggaggcactgttcgagcactaccaccccatcgagatcaaccccgacatcccggtgctggagaaggccaagctcatggaagaatggtgggggaagactcatggtctccttattgaaggggggcttacacaagaagctataaagaaatcggtggccgatgctgcaattgcttttcgagatggagtggtggagctgtttgaattcttggaggctagagatattccagtgctagtcttttcggctggacttgcagacataattgaggaggtcttccggcagaaactccaccgatcattcaaaaacatcaagattgtgtccaacaggatggtctttaacgaagagggttgtcttgtagcatttaaagggaagacaatccatgttctaaacaaaaatgagcattccttggacatggcagctccggtgcatgacagtctgggggatccaaacgggtctgttgatgactattcattggtgaaaaagaggaccaacgtgctgctacttggagatcacattggagacctgggaatgtctgatggtttaaactacgagaacaggattgctgctggattcctgaataccaacatcgagaaatctctgaaagattactccgaggcatttgacattgtttatctgaatgacgcgtcgatgcggggagttgttgagcttgtgtctgatctgtgtccttaaccgagtcatctttagctgaacctagcaccctgaaatctgggtgtttatctatgcccgaaactttctaacttgctaagcttgcttcatgagaagcacttgtacagctaggcagcggcctgtgtgaaatgattatgatgtactgtacctaattcctaggtatgttctaaatacatccattttatgc

SEQ ID NO: 2158 - DNA, 662 bp, Triticum aestivum
  unsure (1)..(662): unsure at all n locations
  Clone ID: PAT_TA_2158
gctctaacgctttagatcatgtggctggatttcatcattaaaacctcactgcttgtttcctgaaaccacaggtgttgaacagatggggatactatccactcattctaataggatcatgggcattcggcactattaaccgtatccatgatttcatcgagccagggcataagatcttctggctctcagttcttgacgttgggacagctgcactaatggtagcaaacctatcaaataaataagttataaaattcgccatagatcatctttgctcttcccgagtcgatgttctgaatgttgtattttcagggcttgttcaattcaatagcctatggtttcaacagctcagtgcgtcgagcaatccatgagagactggagctgtaagtcaccaccgatctctttggtttgctatattattcccaataatcaatgaagcttgatttttatgaaacccttggtctgctagattcttgccagaacggctatatcgatggcttccaagcaatttcagaccaaaaaaccatctgattctacatcagcaacaacaacagcgaagcgaaatggtatcactcaagaccgaggaccagcaatgacactaactttcaactaatacattggaccgataacangaaggcggcgatgataatcagcgttggatggagaga

SEQ ID NO: 2159 - DNA, 2085 bp, Triticum aestivum
  unsure (1)..(2085): unsure at all n locations
  Clone ID: PAT_TA_2159
ccctcgtcactccgtgcgatagttgccgtttgtcctaatcaaaccgatccatttcctctccaacaagttgactcatgtcaccgctgctccgagcgtataatccttgattagcaaccaccgacggccgcaattacctcccacccccaccccacccctcgtaaaccccgattcctcgatcgaatctagagcacaggtgaagaggaggtagccggcggcgggcgagcggccaagtctctcaggtgtcttcgacgatggggttcatctcgggggtggtgatggggttggtggtcggcgtcgtgatcatggccgggtggagccgcgtgatgcagcggcgcagcaggaagcgcgtcgccaaggctgcggatatcaaggtccttgggtctcttggcagggaggacctcaagaagctctgcggcgacaatttccccgagtggatatccttcccacagtatgagcaggtgaaatggctgaacaagcatctcagcaaactttggccttttgtttcacaagctgcaactgcagttgttaaggaatctgttgaacccctgctagatgattatcgacctccaggaataaaatctctgaagttcaacaaattctctcttggaaatgtctcgccaaagatcgaaggcatccgtatccaaaatcttcagccaggccaaatcataatggatatagatttccgttggggtggtgatccaagcataatccttgctgttgatgctcgagttgcatcactgcctattcagctcaaggatctccaggtctttaccgttgttcgtgtcgtatttcaactatcagaagagattccttgcatctctgctgttgttgttgctctcctcgcagagccagagcctaaaatacagtacacattgaaggctgttgggggtagtctgactgctattccaggactttctgatatgattgatgatactgtcaattcaattgtcaatgacatgctccagtggccacacaggcttgttgttccacttggcgtcaatgttgatacaagtgagctggagcttaaacctgagggaaaactttctgttactgtagtaaaagcaacatctctgaagaataaggagttgattggtaaatctgatccctacgtgaccctgtatgtgcgtcccatgttcaaggtcaaaacaaaagtcatagatgacaacctaaatcctgaatggaatgaaacatttgaactgattgttgaagacaaggaaacccaatctgtcatttttgaggtttatgatgaagacaaccttcagcaagacaagaggctaggtgtggctaaattagcagtgaataatattgtgcccgagactcccagtgaaatcactctgaagcttatgcagtcagtagattcacttaagattaaagactacagggatagaggatcattacatcttaaggtcatgtatcatccatttaccaaggaagaacaactggaagccctggagtcggaaaagaaagcaatagaggagagaaagcggctgaaggaggctggggtaattggcagcacgatggatgcacttggtggcgccgcatcactagttggttcaggtgttggatttgtgggcactggcgttgccgggggtgttgggctcgtgggctcagggcttggtgctggcgctggtctggttggttctggtattggtgccgtgggcagcggccttggtaaagctgggaagttcatggggaggactgtgacagggcacttgggcatgtctcgcaagagtggtagcagctccactgttccccaacctgaccagccttctgcataacttgatgtacagtgagagtagcgtgtcatctttacttttggttaattgtgaacatactttcggtttgcattccagtgtgctgtatctgcggtgcaactcatataaactatttgttggtttctttattgtattttatgtgaacaatatccttgacagattactgtaaattacaacaactttcacaaactaatgcaacagaacggtatttaatacttttcaaaaaaaaaaaaaaaaaaaaaaaaaaaaaaaaaaaaaaaaaaaaaaactcgagggggggcccggtacccanttcgccctatagtggntc

SEQ ID NO: 2160 - DNA, 1821 bp, Triticum aestivum
  Clone ID: PAT_TA_2160
attttatcttatttttcatcttttttttcatcttatgcctttccactcagcctgacaatggcagcgaaggcaagatcattcaatcagataaacatcaatgcaaccagttcctccaaattcagtttcaagctccatcttcctccaagaagcacttcacttcatgccaagaaatccacgcccagcctcgtacggtgcgctccgacgagcaccagcaccgtgttcaaggacaaggatcccttcagcctcgagcgatacatggcgtccaaggcaatgaccgtgaatgaagcgctcgaccgcgctctgccgcttggccaccccgagcgcctctttgagtccatgcgctactcgctcttcgcggggggcaagcgggtgcgccccatgcttacgcttgctgcgtgcgagctagtgggcggcgatgaggccgctgccctgccggtggcctatgccgtcgagatggtccataccatgtcgctcatccacgacgacctcccttgcatggacgacgaccacctccggcgcgaccgccccacaaaccacgtcgtctttggcgtcagcatcgcgctgctcgcgggggacgcgctcctggcgcgtgcgttcgagcacgttgcccggggatgcacggagcatggcatgccggcgaactgcgcactccgtgctgtggcagagctcgccagcgccgtgggcacggacgggctcgtggcagggcaggtcgtggaccttgccagcgatggcacagacgtcgacctggccacgctagagtacatccacgtgcacaagacggcacgactcctagaggccgcggcggtgtgcggcgccatcgtctccggtggagccgatgaagagatcgagggcatccggcggtacgcgcgttatgtcggcctgctattccaggtagtggatgacgtgctggacgtgacgcgcgcgtccgagcagctggggaagacggcagggaaggacattgcgaccgacaaggcaacgtacccgaagctgatgggcatggacgggaccctcgcgtacgcggcacagcttgtggcgagcgctgaggcagagctagaccgcttcgacggtacttgtacagagcctctgcgtcacctcgcgcacttcattgcctaccggcagcactgattgatcagtgcaatcggccaattaaaagattgacggtgcttgaggaggtcagtgatagtgcagtacgatggggccgcttcaatacccagtcagcgcaccggttgcggggatgcagcagcttcagctcccggcctatagctttgaccagcagatctatatgtgcgggatgtggcggtggcagctgaaagggagggctcagtacaagcttccgaacagtccataggcaagatggacctagagctcctggatggacacgcagtgaaacaacatgcaactcaaggcgccatacgaaggattgagtaagcgcacaagatgctgcaccatttgtcggcggcagggacccaagaggatgacttgcccggatcgaggagatgttccaaagcaaccttggaaacctgttcagtgcaagaactgtggcgtcgagggtcaccggcgaaacaactgtgccaaagctgcagaactaaaactccaagagggctgctgaaattgcagctaagacaagatcagtgcatctgatgagaataatgcatgttgaaagctgaactgttttgctatgctgctttactgactaattagatcaagtgatgaactgttaagaaccaatttatgttcgtttgttgaggtgtgttgttgtgcagaattattttgtaactatcatttcggatgatactagattaaagaccactgtattttctc

SEQ ID NO: 2161 - DNA, 2099 bp, Triticum aestivum
  unsure (1)..(2099): unsure at all n locations
  Clone ID: PAT_TA_2161
ctcgcctcgcatccagactccagacctttctctcctctcctctctcccccacaccccctctccagatccccgcggactgtcaagcagctgaatctctcgtccggcccaggctgccggaggccgggggagaccgggatccgccgaggtggcgaccggcatggggctcgatttgggagccctcgctctcaagtacaccgggctggcggtgtcggaccacgactccatcgtcgccatcaacatcttcatcgcgctgctctgcggctgcattgtcttcggccacctgctcgaggggaaccgctgggtcaatgagtccaccaccgcgcttgtcctgggcctcatcaccggtggtgtcattctgatctgcaccaaaggggtgaactcgcgcatccttatcttcagcgaggatattttcttcatctacttgctcccgcccatcatttttaacgccgggtttcaagtaaagaaaaagcaattcttccgcaactttgcgacaattattttatttggtgctgctggaacactgatatcctttgtaataatcacgttcggtgctatgggattgttcagcaaacttgatgttggtccactcgagcttggggactatcttgcaattggggctatcttctcagcaacagattctgtttgcaccttacaggtgcttaaccaggatgaagcacccctactgtatagtctagtttttggtgaaggtgttgttaatgatgctacatcagttgtgctcttcaatgcaattcaaaacattgatattaatcattttgatgtcttcgttctactacaattcatcggaaaattcctctacctattcttcaccagcaccgttcttggagtagctgctgggttgcttagtgcatacattattaagaaactttgttttgcaagacactcaactgacagagaagttgctatcatgatactcatggcatacctttcgtatatgctgtcaatgctgctggatctgagtggcattctaaccgtgttcttctgtggaatagtaatgtcacattacacttggcataatgtcacagaaagctcaagggttactaccaagcatacttttgcaactttatcattcattgctgagatttttctttttctctatgtcgggatggatgcattggacattgataaatggaaattagctagtagcagtcctaagaaaccaattgctttaagcgctgttatattgggtttggttatggttggaagagcagcattcgtattccctttatcttttctatcgaacttaagtaaaaaagagtcacatccaaagatttccttcaaccaacaggttatcatatggtgggcaggtctcatgagaggagcagtttcaattgcacttgcttataacaagtttacaacatctggtcatactgccgtgcgagttaatgctgtcatgatcacaagcacaatcattgttgttctgttcagcacaatggttttcggcttgctgactaagcctctgattaatctcctcatcccaccaagacctggcaccgcagctgatatctcaagccagtcattcctagacccacttacagcgagcttgttgggatcggacttcgatgtaggccagctcaccccccaaacaaaccttcagtatcttctcaccatgccaactcgctcggttcatcgtgtatggcgcaagttcgatgataagttcatgcgcccaatgtttgggggaagaggcttcgtcccatttgtgcctggttcacccatagagaggagcgtccatgggcctggcttgttgggcactgtgacggaggcagaagaccgtagttaagtcgaagcccagaaggtgcaagtgtatttcttgtaaatgctcagatatcactcagttttgctcttgggattctttcggtgtattatcgctatttgttggtgtatattgtgcagataatttctacaggaccatgtacgctgtgtagagttttgggagccattcaagatgtacaattaatctgtaaattaatctcgttcaaaaaaaaaaaaaaaaaaaaaatgctggatattagcattcatgtataaaaggaaatcaggtggntaaaaaaaaaaaaaaaaaaaaaaaaaaaaaaaaaaaaaaa

SEQ ID NO: 2162 - DNA, 849 bp, Triticum aestivum
  Clone ID: PAT_TA_2162
cccacgcgtccgcggacgcgtgggctcgtccaagaacgcgtgggaggacgcggtgcctctgtcgcggaagacagaggcctcgcccgcggacgcgcaagcgcgacacgacgacgacgacattgacgaggacatggacggcgaaggcgacggcgcggtctattacctgagcaagtccggcgacgtgatggtgtccagcacgcagcgcagcgcggcgaggcagtactcgtccgccgtgacgtgccgcagcgacggcggcgaggccgtggcctacttcctgagccactcgggcgcggtcgtggcgtgcgacctggcgcgccgcgtgttcaccgagctcccgcggatcctgccggtgcacttcgagtactcgatcgacgtggtggcgtgcgacggccgggcctacgtggtggtcctctcggagtacctggacacggcgagcctgcgcctctgggagttctcggacggcgcgtggcggcatgtggccgcgatgccaccggccatgtcgcacgccctgtacggcaagaaggcggacgtgaactgcgtggggcacggcgggcgcgtgatggtgtgcgtgagctccggcgacgcgggcgccaacgggtgcttcatgtgcgacgtggggagcaacgcgtgggaggagctgccgcggtgcgccggcggcgacggcgaggccatggacttcgtggctgccttctccttcgaccccagaatggaggccgccgtctgaccggatcccctcgccgttgctgccgattgatgtgtgtagcgtagtgtagcgtacgtggtagtggtcgtagtagtagtacgatgatttgttgcagtagtaattcgggagatgttttcatggagatc

SEQ ID NO: 2163 - DNA, 1022 bp, Triticum aestivum
  Clone ID: PAT_TA_2163
gccggccatgcgtccgaaacgaaaacaacaacgcgtgtgacgtgtgccttcccgtccgtgtgcgtctccgagggcgacagggaaggaaggaaggaaggggatgagctccgccgccgccgccgcctcctcgtctgcgtcgccggtgccgccggaggacgacgtctgctccgtctgccacgaccgcttccggatcccctgccaggccaactgctcccactggttctgcggagagtgcatcatccgtgtttggaaccatggagctgctgtacagccttgcaagtgtcccatttgccgtcgccttataaatctgctggtacctgctaatgtatcagacgatcagaatgatgatccccaacttcagcgtgttttgggagagattcagcactacaatcacatatttggtggagcaccacgcagcctaacccagaggctgcaagacctgccgtttttcatacgaaggctgttcagagaactaatggatccccagaggaccctcccacttgtattcagggcgaggatgattctgatggtgatcctgagtggggtgtacgtcctgagcccggtcgacatcctcccagaaagcgtgctggggctgtttgggttctttgacgacttcctcatcctggtgatcgtgttcctccacctcgcggccgtgtaccggtcgctgctcctgtaccgccatggcggccactgatccggactcggcgggccgctgatgatgcatagtagcagtagctggtggccggccgcggttgtacgtgctcccacgccgccggtggcagtttgaggtttgatctgtactgtacgggaattaaatgtatcgctgtgttgatgagggtggagcggctttatttgggtttgctactagatggatcgtggatgatgaacaaacacgctgtactttagctcattgtcagtgctagttgattcgatcaatcaaccaagaaaagaaaaaggcaaccaacaggaagttgtttattctaaggggggcccggtacccaattcgccctatagtgagtgta

SEQ ID NO: 2164 - DNA, 622 bp, Triticum aestivum
  Clone ID: PAT_TA_2164
acaacccactctttaacaaatttcacacgctccctgcatttcgtgttctccccaaatatattactgcatcttcacttccacccccaccatattatcaccgcaaaaatggtggaccacggtatatcctcacagctactcctatcacacaggttatcatagagccattcaaacagagatttcgaaaagaacccctgctgcctccttcgcggcacaaatctgacccaaatccccaattgagctggacagtctctaagcacgtgaagcacagattcaactccacctttacaaacctgagacacattcgaggcgctaagatgtcttcgatgccgttcctcatctgtcataactatgtccagtttggttatatatattttctgtttatacttatatttatatatatttttcctaaatataactattacttttgattatttgttaaacatgtccatggatttaactcaatctcaataaatgcttcttagtcttgtgtctctttatcataatttggtggtgaataaattttttatttaccattgtaaaaaaaaaaactgaaaatttgcgtaaaatcattggaactcttcttttcttttctttttactgttggcaacgtttctaatcatat

SEQ ID NO: 2165 - DNA, 976 bp, Triticum aestivum
  unsure (1)..(976): unsure at all n locations
  Clone ID: PAT_TA_2165
tggtcgcctgcggtccggtccggaatcccgggtcgacccacgcgtccgtctatctcgccgtcgcctccccgctcctttgcttccgcccggccgtttctctagggtttaacgccatggacgtcgaggacgagctccagaccgcccccgcgcccgcggacggcggagagtcctcgcacgcgctggtgtccggggaccagttggacgtggaggcgtacgcggcgcagtactcggggcgcacgcgcgtggggcggctcctcttcatcgcggagaagtgcgggtcggagcagatgcggctggatgcgctccggctggcctacgactgggccctcaagggcgaggacacggccctccaccgcgacgtctccgccaagatcgccggccgcctcggcccccgctacgcagccgaccaggcctggtccgacgccgtcgagcgccgcgccctgctgcgcaaggataagcttgacagcgagctcaatgtctacaggaccaatctgatcaaagagagtattcggatgggctacaatgaccttggtgatttccactatgctcaaggccacctttcagacgccttcaagagctatatcaggacccgcgattactgcacgacctccaagcatgttgttcaagatgtgcttgaatgtcatacttgttagcatttgagctgggggcaattttatgcacgtgtcaaatttatgtcatcaaaggcggagcaaacccaagacgatatggttctattactgccgccaattgcnactgctgctgggattaacctacatggaaacaaacaagttcaaactngctgccccgaatttntanagacaggtnaanactaaggacaactatctggaantnatactccacaaatgtgcntcnatggtcacnatgccgcttgctctttgatnccaanctaaaacaanttntgcaataaatttccaatttttgggtaatccnaataaggactggaatntttntcacc

SEQ ID NO: 2166 - DNA, 396 bp, Triticum aestivum
  Clone ID: PAT_TA_2166
ccgcattgcattggtgccactcggaccctgctcgtgtctggacgtgtgcgtgtctgggtcgtcgtgggtaccgcgaacgactgggtcgtgtcgcagctcgatttccattctgctttgccgatcgccatgggcaaaactcccaaaatgattcgattcaccaacccgggtttgaccaaaatgtagcttgacctgccaggtttgggggagaactcgcagcctgatttcgtcaattctgaatccatatcattgatcggacattgtgagaacttgagtcatgtggtgtttgtaagtgatcgatgctagcgcgctctaatggcattgttgtgtggtgtttgtaaggggctgatgctagggatttctacagtgcgttgcaatggcactaattaacatgcgcat

SEQ ID NO: 2167 - DNA, 1154 bp, Triticum aestivum
  unsure (1)..(1154): unsure at all n locations
  Clone ID: PAT_TA_2167
ccggcgcgcggccgccgcccaaccgtcgcgcccgcgaactcctcacgagagaatttttgggtcctgatccgaggagaggagatgtcggacagcgaagagcaccagttcgagtcgaaggcagacgccggcgcttccaagacctacccgcagcaggccggcaccattcgcaagaacggctacatcgtcatcaagaaccgcccctgcaaggttgtggaggtttcaacatctaaaaccgggaagcatggtcatgccaagtgccactttgttgctattgacatcttcaccggcaagaaacttgaagatattgtgccatcttctcacaactgtgatgttcctcatgtgaatcgcacagaataccagctcattgatatatctgaggatggatttgtgagtctgctgactgataatggtaacaccaaagatgacctcaagctcccaactgatgaaaccctccttggccagatcaaggatgggtttgctgaagggaaggacctggtggtgtctgtcatgtccgccatgggagaggagcagattaatgcgctcaaggacatcggccccaagtaatcagcccgttagccatgggatgcactattttctcaagtgtcgttcatttttgtctcccggtgagatagatttgtgtctgccggttaagatggatttgggtgtcacagccattgaggaattttacctttttgcagaactaagttgtcagtgtttggttgatttgtagtcctaaattcatgggtgattgtatcctaaaacgtcgccccggggttttattgacccctcttgactattggtgttgctggtgttgcagtgtggaggtaatcagtacgtcttttcaggatgctataaattgagcaacaccccgccgtggtctgctggtgctaccagtcaccttaatgcaggggtcatatgatctttcagagaacacctcgacgagcaagatcttcagacagagctatccaatacactactatcaccatatgacatagaaatcatatatatatcggttctcttaggctactgttaggacttgcttttggtatatcatgtgacattttctatgacatcctcaaagtcatgtaattaaccaaaccagtactgttattagngctacttcctcctatatctttctttagaaattcaaacga

SEQ ID NO: 2168 - DNA, 768 bp, Triticum aestivum
  Clone ID: PAT_TA_2168
tcgttcctcgggctcctcgaccgggtcctgctcccgctctggaggcgggtgaccggccacacgccgacgccgctgcagtgcgtgggcgcgggccaggcgctcaccgtgctgagcatggccgcgtcgtccctcgtggagcgcgagcgcaccgccaccgtgcgcgcgcacggtcaggagggcgacccggcgtgggtgtcgccgctgtcggccatgtggctggtgctgccgttcgccgtggccggggccggggaggcgctgcacttcccggcgcaggtgacgctctactaccaggagttcccgccgtcgctcaagaacacggccacgggcatgatggccatgatcgtcgcgctggggttctacctgagcaccgccctcgtcaatatcgtccagcgcgccaccacctggctgccggacaacatgaacgcctccaggctggagaacctctactggctgctcaccctgctcgtcgccctcaacttcgggtacttccttacgtgcgcaaagctctacaggtaccagaacatcggcaagtagctcaagctcaggagacaacaatcgttgctctatatggcatggtgtgtgtgtgcttgatttgggtgtgatgaacgacagttttggcagagctatgaagcttccaactctgtgcggtttgcctggtttgagaagagatgttattactgtgtggattttgatgagcttccaactaaatgcatgctaccatctccattctctgtaaaaaaaaaaaaaaaaaaaaaaaaaaaaaaaaaa

SEQ ID NO: 2169 - DNA, 2308 bp, Triticum aestivum
  Clone ID: PAT_TA_2169
cgcccccccgggctcccatgaatgggacccactccttgctgagctgaaggaagtggcttttgctgattgaacacagacatagaagaagtgcccgcgcaagcagcatcgagttccgttacccgagtggggatcgctgccgctgcccggcagactgggggctcctggccgcccccgctctcttgtcatcgcgctgatccctagtggtagtatccttgagatagatgttgtcgccaatagtaagaacttggagcataaccttacgagcggactggctgacatggcattcagggtgctgcacctgcactaggaggagcttcgtctaactaagtctgatctgcagaagggtgttgatgtcttgggggacgtccatgattgggatcctgttgttgcggcagtgtaccttatcccccgaggccctcctctcagttctaaaaggagtactggaagcaagcctcatcatgtcccatagaggtgtgttgcgatggatcggttgtcggtcgcgatagaaggtccactggcgcacgcctacgctcattttgtggagcgctggtgcttagtagtaaaccaaatttagattaagcaggatctattatcatgtgatgcgggcattaccggtggaactgcagtgctgctgcttcatgaattgctcgacagccgtggtagtaggatgacacccaagtaaggcggaccataaaagtctggtgtcccggagaaatatggtgtgtggtctctcgtgcaccgtggtatgcctttcgtgtaagcagggtaccttatcaggcgaactgctagtgtgaagagtttccatgcacttgattgccgtttcgtcaaagatctcactgtccctgatggaacacgaatggcgccatcaactccatttcgtaagatttggtgcatgcttaacaatggaaatatcgtatggccttatggaacccaccttgcctgggttggtggagatcaatttgctcgccaaagcttagtgaaattagcgattccagaggctggtttccccttgaatggagaaatcgatgtttgtgttgactttgtttcacctgcgaaacctggtaggtacatatcgtactggagactaacatcgccatgacctacagaaatttggtcagcaagtttgggttcttattgccaggtggaagagcctgttcaagccttcggtgacaagcaaacggctgcaatagactcgaacttgcctgacatgccaccaaccctgcaacatcgagaccatccattgtgcaacagcctgtccagatcagtggcaataagggaactgctgcagtgaacttcttgagcttgcctgcagaaggcagcaccgcaacctggacctcagattctgcatctgactctgacgatgatggcatacctctgcgtgatgtgcttgccaccctgagacggaagggacccaaagcggttggaagtgttgtgccctctgcaccagcagcagatgaaccagttcaagtacccatcgcttatacccaggcagcggatgaattagttcaagtacccatcgcttatcaccaggcagcagatgaaccagttcaagtacccatcgcttatcaccaggcctcatctgctgaagctctagggatgcctgctggtgtggccgcacctgaagccgcaccactgccggaacccatcagtgtgccggaacctctaccagcacctactcttgtcaattcacatgtcgctcctgccagcattcctttgcctgatgaaaccatcaacaacaacatggaggataagcttctgagggaactggcggacatgggcttcaggcaggttgacctgaacaaggaggtgcttcggcagaatgagtatgatctccagaagtcggtggatgacctgtgcggcttccatgaatgggacccactccttgctgagctgaaggaactgatatagaagaagtgctcgagcaagaagcatcaagttccgtgaagcgtgtggcgatggatcttccttccggagagaaggagcggtgatggcctcctgcgctcatctgctggagcgctgctgcctagtagtagtaacctagatatagatatagtacctagtataatgtaatgcgggaataaccagacgaactgaagtgatgctgcataatgcagtgcactgcagccgcagtagtagtagcagccagtaagcagggccataatagtccggcgctacggtgtgtgtcagctcgtgcaccgtggtttgcctttcgtgtaagcagggtaccttatcaggcgaactgctagtatggtttatgagtatgctatatgttcataatatctgcccctgtgcttctcgaaaaaaaaaa

SEQ ID NO: 2170 - DNA, 332 bp, Triticum aestivum
  unsure (1)..(332): unsure at all n locations
  Clone ID: PAT_TA_2170
ttctccgacactcttacccgcagcctagncataatagcgtaacgcctcagagcaaagccactgacggcattgcacatgagcttcaaagaaatgctgctgctgctattcaacgagatcgattctaacctcaaagcgcccagatcccaatgacgagctcgtcgactatgtccaccacgttgcagtcgcgccatgggccccgaatgcgaaccccgtcgacatggcctggttcgttgtgccggtactgcgatccggcgacttgtcccattcgaccatccagttctcgccctcctcgtcggcgcttcagagcttcgccgtgaccctgcaacaggtgg

SEQ ID NO: 2171 - DNA, 581 bp, Triticum aestivum
  Clone ID: PAT_TA_2171
gggaatacctagatttgtgcaggctatacacaaaacccaaagggctgaacccagactacgaggatcctgtgatcttatcatccaagaggaaaacagtggaggacttttgcaaccaaatccacaaggacatggcgaagcagtttaaatatgccctggtgtggggttcaagcgtgaagcataagcctcaaaaagtcggcaaggagcatgagcttgaggacgaggacgttgttcagatcattaagaaaatataagctaccccccgtggggcgagcgattctgttttgcggatcaggaaggagttttcagctatggaactttttgagaagcagctacattagggcccttgttccttttgctagctctgatgcccattgtcgggctgctgtttgcataaaaatctggtttcgatcacaagacaatgtggacagttttttatttgttagcttgtgccaagtagccatatgtaattgtgagtttgtgactgatgcctgtcatgccccaaccgctgaacacatggaaagatgcttatctatcttgacgagatgcattcttatagcttttaagtgtttcagtttttcgtt

SEQ ID NO: 2172 - DNA, 2252 bp, Triticum aestivum
  Clone ID: PAT_TA_2172
cacaactgagctcccttccgcatccacgcgagcgaagccgcgccggcgaagagcaggcgaaccttctacaaccctccgactccgagcccccttccgcggcccgcagccatggcgaccgtcatgcagaagatcaaggacatcgaggacgagatgtcaaagacgcagaaaaacaaagccactgcacaccatcttggtcttctcaaggctaaacttgcaaaattacggcgagagtagctcactcctacaaccaaaggtggtggtggtgccggtgaggggttcgacgtgacaaacagtatagatgcacgtgttggtgtggtggtcgttaattcggcccggtaatcaacattgtgggacaagctgacaggaactttttatggaattctagtgatatgattgtaatactttaatatgtgtacgctatacccttaactaaaagggggaattcactagtgattagcgtggtcgcggccgaggtgaaggtgctaaagatggaaagggtagagggaggcaggtcatcagtacagccaggacatgtaatgtcattctgattgttcttgacgccataaaaccaataactcacaaacgtctcattgagaaggagcttgagggatttggcatccggttgaacaagacacctcccaatatgacattcaggagaaaggaaaagggtggcatcaattttacatcaacagtagcgaacacacacttggaccttgacactgtaaaagcaatctgtagtgagtacaggattcataatgctgatgtctccctgagatttgatgcaacagcagatgaccttatagatgtcattgagggaagtagaatctacatgccttgcatctacgtcgtcaacaaaattgaccagatcacagttgaagagctggatatcttgggacaaacttccccattactgcccaattagtgcacatctggagtggaaccttgatgggcttctagagatggtctgggaatacctagatttgtgcaggctatacacaaaacccaaagggctgaacccagactatgaggatcctgtgatcttatcatccaagaggaaaacagtggaagacttctgcaaccaaatccacaaggacatggcgaaacagtttaaatatgcatggtgtggggttctagtgtgaagcataagcctcagagagtcggcaaggagcatgagcttgaggacgaggacgttgttcagatcattaagaaaatataagctacacaccgtggggcgagtgattctgttttgcggaccaggaaggagttctcagctatggaactttttgagaagcagctacatttgggcccttgttccttttgctagctctgatgcccattgttgggctgctgtttgcataaaaatccggtttcgatcacaagacaaaatgtggacagttttttatttgttagcttgtgccaagtagccatatgtaattgtgagtttggactgatgcctgtcatgccgcaaccgctaacacagaaagagttgcgagcagtgatcagcatagctgattcatcactgctggtccttttggtgcgactatggctggactattgatcttcatgatgaagaaatggccatagccatggggatcttcctgttgcaggtcgaggctgccacgtattgtaccactgtcgcgcccaacatcgaggagtgcggcagcaccgtggccagggccatcgcgtccggtgccaagaacgtggccaaggggatcctatggtacggggtggtaaccgtggacaggctccacttggcgaacgaggtcagcccggagatgctcgggcatatcaaaatgcttcatgtgtgtatatgtgactatttgcttatgatgaacttgaggacagtcgttaaggtattcatggtggagggaaaggttgatgttggtcttggtcctatttactggtgagatgcaacctgcttggaattcaaggaagaagggcatttcgaacgaagaaatcagatggtgctccgcaggacacgcacagccgccgccacaccacaccgcagagacagacgaggatgtgatgctgctccttctttggtgtatgcgtcggcgtggcttgtggtagtgaggcatatcctcgtgggtaatgctatttgaagaccattcaagtgatttaaaagagaagatgtccagaatgtaccgaggttgaagatgacgatcaaaagattgacgtattaagcgactgtcaagatgcccaatatgcttgccccctgcccttattaggaataccctgggctcttctttatg

SEQ ID NO: 2173 - DNA, 940 bp, Triticum aestivum
  unsure (1)..(940): unsure at all n locations
  Clone ID: PAT_TA_2173
ccgacatggcctttgagctgcccctctcgcgctatgacaaccataacctcatcattcacggttatcatgatctcctctttgagaagcactcttggatcgcgctcaacaccggcagcttcctccttccggaactgccagtggtcactcgatcttctcgctgcgtgggctcctatggggcccaagggcttcatccgcgaggaagccgggaagatactcaccgcatacctgaagggccgtccagcattcgaggctgacgaccagtctgcgttgatacacctcttgctctcgcagaaggagaagtggatggacaaggtgtatatagagaattcatactacttgcacggtttctgggctgggctggtggacaagtacgaggagatgatggagaaccaccatccagggcttggggatgagcggtggccatttgtgacacactttgttgggtgcaagccatgcggaagctatggtgattacccagtagaccggtgtctcaagagtatggagcgagcatttaattttgccgataaccaggtgctgcgcctgtatggtttcgcacacaaggggctggaaagccctaagatcaaaaggatcaggagtcagaccacaaagcctattaacgacaaggaggaccttgatgtgaaggccaagatgtcgaccacttcttgaagctactgaagataaggcaatagcataggctctcttcnaaggtcagcattttgtcacttggttgttgttttagtttctactattttttgcttatggattttttttcttgttatgtgtaacagttagagattgcacatgttatgtttatcatgaacttaaatgtggtaggagctcaaatcagatggaaatatctcagttttgtactcaatttcatttcagtgttactttctcgcaggacaagtacccgtaatgtggtgttagtatcttgtagtga

SEQ ID NO: 2174 - DNA, 885 bp, Triticum aestivum
  Clone ID: PAT_TA_2174
gagggcgcgctctcctttctctctctccacacaccaccagcataccagcttataactgattgattgatcgatccatcaccgtgcgtgcgtgcgtacgtacgtgaccaccatgagctcctccggcgcccgcggtgtccgtcgagagtacggccggacctatgtggtgaggcccaaggggaggcacctggccaccattgtctggctccacggcataggcgacaacggaaacagctggtcccaggtgctgggcaatctcccgttggataatgtcaaatggatttgccctactgcgccaacgcggcccgtagcggccttcggtggattcccatgtactgcatggttcgatgtggaggagacttcggttgacggccccgacgacgtccaagggctggacgcatccgccgcacacatagcaaacctgctatcgtccgagccctctgatgtgcggacgcgtccgggcggtttcagcatgggagctgccactgcgctccactctgccgcatgttatggtcatggaaggttctcaaatggggtcgcttaccctatcaccctcagcgccatcattgggttgagcggctggcttccctgctccaggaccctgaggaccaagattgagagctcacagactgctttcaggagggctgctgccttgccgataatgcttggccatggaagaggggacgaggtagtcacgtataggaacggcgagaggtcgtccgagtttctgcggaactcgggcttttcttaccttaatttcaaagcctacaacggactgggccatcacaccatccctgaggaaatggacgatgtcttcaagtggctcaaggcaaggctcgggcttgatcgctcttgcggctaagtggagaagcttgtgccttggtggct

SEQ ID NO: 2175 - DNA, 502 bp, Triticum aestivum
  Clone ID: PAT_TA_2175
taaattgactcctattataaagggaataataaatatggcagagagaaagtttcagaacctaaagtctcatgactgccacatgattatgatgcaactgcttccggttgcattgagggggcttctaccggaaaacgtccgattagccattgtgaagctatgtgcattcctcaatgcaatctctcagaaggtgatcgatccagaaatcataccaaggctaaggagtgatgtggtgcaatgtcttgtcagtttcgagctggtgttcccaccatccttcttcaatatcatgacgcacgtcctagttcatcaattgacgagattgtcattctggggcccgtatttctacacaatatgttcccctttgagaggttcatgggagtcctaaagaaatatgtccgtaaccgcgctaggccagaaggaagcatctccatgggccatcaaacagaggatgtcattgggttttgtgttgacttcattcctggccttaagaagataggtctcccaa

SEQ ID NO: 2176 - DNA, 441 bp, Triticum aestivum
  Clone ID: PAT_TA_2176
aagtgcaaatgggtcaatctgtcaggaggcggggtacaggtagacccacagtacggaatgacaatagtggatctgaaaaatcttgggtacactgatgaaccgttcgtcctaaccaatgatgtggcacaggttatctatgtgaaggacatgtctaccagaccgagaaagagaaaagataaggaagcgaatacatcatacgatgagtaaaagcgccacatagttctttcaggaaaaagggacatcgtgggagtggaggacaagacagacatgtctgaagattatgaccccgccgtagtttgccgcctgcttcacgctgggcattaggtcgtagttcatcgacggcaggccgaccttgtcgttcctccccggcacgttcgccgccggcagcccgatgtacaccttgctccgggggtacctcgccgtccacttgctccactgcgc

SEQ ID NO: 2177 - DNA, 445 bp, Triticum aestivum
  Clone ID: PAT_TA_2177
ctgcagcacggtcgacaatccgggtcgacgggctggaaggaaaaggcacgctaggagggcatcaaataatatgtatggacgggcattctctcactgaagcacactacacagttctacagaattccgccttggtggctccgtatatggaggaacacaagaattttctacagtccaaacacccggagaattctgacgactagattacacgtgaacaaacgaggacttttgccggttggttgcagaaacatgccctgaatgatggtgatattcaaaatgacctatactcgctgtcccagttaccatcttcgaatataatgactttcaaagggtagatatgcagataaatgggaatacattttacacgatcgcccaagataagaagagcaccaaccaaaacagtggtgtctgcttcgatgcaacaaccaacacgggaaaggaaacatat

SEQ ID NO: 2178 - DNA, 1829 bp, Triticum aestivum
  Clone ID: PAT_TA_2178
cggtcaggaaggccgggtcggccggtctcagaaggtaatcgatccagaaatcataccaaggttaaggagtgatttggtgaaatgtcttgtcagtttcgagttggtgttcccatcatcctgcttcaacatcatgacgcacgtcctagttcaccgggtcgacgagattgtcattctggggcccgtatttctacacaatatgttcccctttgagaggttcatgggagtcctaaagaaatatgtccgtaaccgcgctaggccagaaggaagcatctccatgggccatcaaacagaggatgtcattgggttttgtgttgacttcattcctggccttaagaagataggtctccctaaatcgcggtatgaggggagactgactggaaaaggcacgcttggaagggactcaataatatgcagggacggatattcttggtctcaagcacactacacagttctacagaactctaccttggtgaccccgtatgtcgatgaacacaagaacagtctgcgctccaaacacccggagcagtgcgacgactggattacatgtgaacacatcaggactttcagcagttggttggaaacacgtctcagaggtgacaacactgtttgtgatgagttgtacttgttgtccaggggaccatcttcgactgtaatgatttggaaaggatacgagataaatgggaatacattttacacgattgaccaagatcaaaagagcaccaaccaaaacagcggtgtccgctttgatgcagcaaccaagaggggaaaggacacatattatggttacatagtggacatatgggaacttgactacggacatgattttaaggtccctttgtttaagtgcaaatgggtcaatctgtcacgaggcggggtacaggtagacccacagtacggaatgacaacagtggatctcaaaaatcttgggtacactgacgaaccgttcgtcctagccaatgatgtggcacaggttatctatgtgaaggacatgtctaccaaaccgagaaaaagaaaagataaggaagcgaatacatcatacgatgagccaaagcgccacatagttctttcaggaaaaagggacatcgtgggagtggagggcaagacagacatgtctgaagattatgaaaagtttcatgaaattcctcccttcaaagtcaaggctgaccccagcatcctgataaacgatgaagattatccatggttacggcgcaataagcaaatgacacaagcgaagaaaaagtgaagactttctcccgcaactattatgatgataccatgccaactttgtaacagacgagtatgataccattgtccgttttgtacatgcacatgctatgtgggtgaatttatgataccatgccaactttcaactttttcagagttcatttgaaatgctttaatgtcttatggttcggccctcgtaataattataaatagcaacaataagtattttgttgtaagtagaaacaaaataaaataaataaagcaagaaagaaaacagaaatacaaaaaaagagttttcaaatttgaaatctaatggcactaacagaaagtttataattttccaaaaactaaaagcaaaaagaattgaaaaataaagcaaaaaacaaaagaaaataaataatgcagaaaacaaaacaaaaaaacaacaataagtatgttgttgtaagtagaaacaaaataaaataaataaagcaagaaaagaatacagaaaaacaaaaaaagtattttcaaatttgaaaactaatggcactaacagaaagtttataattttcctaaaactaaaagcttctgtccaaaatgtcttaacacgctcggacgcgtgggta

SEQ ID NO: 2179 - DNA, 765 bp, Triticum aestivum
  Clone ID: PAT_TA_2179
ctaaaagccgggggttcctcacacgaggggaaaaaaaaattaagggtttatgccctagggcaacatgtcctatagggcatcaggtccgaaaggttgaaacatccaggggtccatatatggatctctgatttattggaagtacaatataataccacccgtcacatcagtgtttaaattattattttcagacacacacacactataatgcatgcatgcatgcacgttgattattagttgatgccgccgttgtagagttcgcggccgtatccggtctgcttgtcgtagtacctgtcccagagcatgaccccgccgtagtttaccgcctgcttcacgctgggcattaggtcgtagttcatcgacggcaggccgaccttgtcgttcctccccggcacgttcgccgccggcagcccgatgtacaccttgctccgggggtacctcgccgtccacttgctccactgcgccatcaccccgtctttgtacacgtggttgtacgagcaccggtcctcgccgtagaacctgacgtggatccgctcgaacagccccgtgtccagcgccctctggacgtgccagtccgggtaaacgcaccgcgccgtcgccgtcagccgcaccccgggcgcgccgcggtagtaccggttgtagccggacaggcgcctggccagctcgtcgtagtggtccggcgcgccctggtcgatgaagaagtcgatgccgtcgaccacggcgtcgccgaacgggcggaacacgccgcgtcggccgcccacgcggccg

SEQ ID NO: 2180 - DNA, 897 bp, Triticum aestivum
  unsure (1)..(897): unsure at all n locations
  Clone ID: PAT_TA_2180
gntcaaactgctggnaaanaaatcttatacactggtcatgggacggcctaattctgctaagcttgccaattttcctgagtgtgaagtttttgtatatgtttcttgtgcccaaactgctttattggatagcaaagaatttttagccccagttatcacaccatttgaagctgtattagcttttagcagaggaagagaatggactggagaatatcttttggatttcaaggaattgatcagttcggagaaaccagaagttgcaagcaaaagtgaagaagcacgtttttcttttatcaaaggcggctatgtggaagatgattgtcctcaagaaaacgaggagcattcagaaacatcacttgcactggccgagctaacggagaaggccctaagcacccaaaaccaaaatagcgacgcagttctttaccaaggaggcgcgaagtctgcaatcgaatacctcaaggcccggtcctaccgtggtatgactggagaatatgagggtccagcaccagactcggtcttgataggcaggacagggagggctgctggttactctgatgagaaaacgaagagcccacaatgaaggaatgctgtgggcatttgcatactggatagttttgtggggaaagaaagcctgtgggttcattttagtggggaaaacgatacttttggatggcgttttactggcttagggcccagtttggctatcctttgggttttgtatactagaaattgctgtatttgcagggtcagttttgttgtgagccatgaggtatactagaaactgatgtatactagaaacacttgccccttgtggaaatctgtgtaaaactatggcactttgccaaatggagtagattttggtgcctgcctaaaaaaaaaaaaaaaaaaaaaaaaaaaaaa

SEQ ID NO: 2181 - DNA, 668 bp, Triticum aestivum
  Clone ID: PAT_TA_2181
gaaagatcgagcttttataacagcaaacatacgaaataactgagaaatacagcccaaagcattttccgccacgacctggtgctatttatacgccacggttaccatcccattgcgttgcttccaacagatcgtggcaagtggcatgcatcttgccgaacggtagtggtgcttcctcccagcttgactgactccaccaatttcgctgacaaagccaaatcagccatgtccggcgatggccagagcggctccgcaagggtgcacttcgtgctggtcccgatgatggcgcagggtcacaccattcccatgaccgacatggcacgcctgctggccgagcacggcgcgcaggtcaccttcatcaccacgccagtgaacgcgtccaggttggcaagctttgccgcccacgtggaggaggcaggcctggcggtccggctcgtggagctccatttcccggcagccgagtttggcctaccggacgggtgtgagaacgtcgacatgatccaatccaaggatctgctgtcgaacttcttggaggcatgcaccacgcttcgggagccgctcaaggcacacctccatgagcagcaacagtcgcctccgagctgcatcatatctgacacgatgcattggtggaccggtgacgtcgcaagagagcttggtatcccgaggctcgc

SEQ ID NO: 2182 - DNA, 1413 bp, Triticum aestivum
  Clone ID: PAT_TA_2182
gcggaactcgccgtcgcccgcacctgcatccccgctccgcccaacccccggccgcgtgaggagcgcgccgccgtctaccacgcgaccaggaccccaggccccctcagagcccacgacccgcgcccccacccccagcaccaccccgccggtaggcaggacccccccgcggcggaccagcaccagtgccggacgtcccccggcgctgcacccctgagtccgtggctacggcgccggccacgcgtacacgtgctggaacggacaggaggatgcgccggggggctccggcgcgcccgctgggctccctgggatgggtggtcggcgtccggatattgctttgaaggtcctgtgcgcgtctctttgtctcttccctttttctataagccgtacctacggatcgacaagcgcgcgcacaccacctcgtcggcggcctcgggcggaatcattaccaccacgcgcggcggcatcggctctaccgcgtgctcccgcgggcagacggcggggatgtcccccacagtcacgtctcgggcggccgcctccgtcaccttcgaccagttcgcggggacgacccccagcaagcaccggtcctactccgcgctgcacccgtgagtccgtggctcccagcagtcagcacggccggcgagggcaggcggtacccgtgctggaagacaagggggaatgtgctgtgcgtctcgtggcggctgcttgggtcgttgcgctggctggtttgtgctgatattgtttgcaagtcgtgtgtacttttctatttatgttccctttttcatactactaccagcaaggcgtgattaataagtactctctccgttccgatttacttgtcttgaatttatttagataagtaattcggaaaggagggagtaggaggtatgatggctggccagtgggcactactaggggagtgagcacatggccacttggcgttgctgattggcgggtgcgcccgcaactgcatcccctatgcgcccaaccagcggtcgcacgaggagtgcgccggcttcttccacaggaccaagacctactgccccgtcatgcacctacgtgccatgccaccaccccaaggactacggcgccggtaaggaggaagcctcggcggcggagtacaagtaccggacgtactcggcgctgcacccgtgagtccgtgactcccagcagtcagcacggccggcgagggcaggcgtacacgtgctggaagacaatggggaatgtgctgtgcgtctcgtcgcggctgcttgggtcgttgcgatggctggtttgtgttgacattgtttgcaaatcgtgtgtactacttttctatttgagaaaaattcctgtacctcactaaagttgagccgggtaacatttggtaccactacttcaatataccctaactacggtccaaaaaaaaaaaaaaaaaaa

SEQ ID NO: 2183 - DNA, 785 bp, Triticum aestivum
  Clone ID: PAT_TA_2183
tcgatttaggtttcagttcactttcccctgaacccgattatggggagtacggctctgatttcggtgaggaagaggagtgtttaccgaggcagaggaaacctcccgaagtaaggaatgcactccgtgagaagagagtcgcgtttaggcaaaagactgggcggcaccatgcaaaggtagccctgcgtaagtacaacagagcaaacaacaccaagtttgagctggtggaggtgccagtgatccgtgagttttgggagtttggagggggctgcatccattacaacttcacggctaagcaagcagaggatcatcgtcattctgctgatgcagacaacaccaagctcttcttctctgaggtcaactctgctttccatggcgacaaggatgtggtcctgtgctgtatcgttggagaacatgacaatgggcattgctatggctgtgaaggcttcaagccaaccgttgttcaccctagcagccaagcgtatggcggtggcagtagtacttgcattgattttgctggttcagatggaagctcggagagtgattaaaacgcaaaaacttccggtggttgagctcggtggttggatttggcttgcatgcatggctaatcttccagggtgtcttgtctcttagttcttaataatgccaagataaatgtacttttggtggttaatgcccttcttaaatactccgattacaaaatggcgaacatcttgcaattttgaacattttttgaactcgtcaacatttaatattttttgaaatcgcgaaaaaaaaaaaaaaaaaac

SEQ ID NO: 2184 - DNA, 574 bp, Triticum aestivum
  Clone ID: PAT_TA_2184
cacgtcagcagcagaactgcggcggccgccgccatcgctccccggcgaccgatctagattacatcttgcaccggccaacggatcggagagcacaagaccggccgaacctgagatttatgggcataagagatctgaaagaggcgcatgtggtcccgtcctggatctcattgtttgctgaatttttgtggacggaagaattttccggtgctttgtggatgttccttctggatgggggccgggtgtctcacgtggaagaatcgactcatatggcttctggcggtcaatgccgtcgtgtcgcatcgtcgatcccagctagccgtaaacagattgacatatatcttgaattattttgtttgtggacgtatgatcaaatggattcagagatactctttctgttccgaacggaggggggtagtgattcccgctgctatttcatctttggggaagcagtataccccgcaaaaagaaacagtagctctggtggctaatttaatcactctgtagaaacctttcattgaaggatcaagaaccgcaccttgcttccatctttctttatatgttcagtatcgtctcg

SEQ ID NO: 2185 - DNA, 922 bp, Triticum aestivum
  Clone ID: PAT_TA_2185
attattctttgcctcctctcctctccctttcctcttccccttcttctcctcgacacgaaagcaagcttggcgattgggattcaagcgccagcgctccaaatccggcggaggggtggcgcgcgccggcggcggcgatttcgatttgtggtagtcctcaccgctggaggcggctgcccgatccagccaccggtgaacaaactcccgaccatccctccttgcccgcgtctctagcccgtactcgttttcgccaccatcctcgacgcgtctggcgtaggaggctgggggtggtcgtggtggcggcacacatcccaggaaggagcgagtgggaggagaaggcagcggtggaggttttgatctatcgacatgggaggcggagcgatctggacgagatgactggtgcaggtttcctcaccatgctgcgaccagcacctacgcaggtgattggtgttgttgtccttttcgacagcggcagcggacggcgctgggcggcaagcccatcagtgcccgtgtgccccgaccggtgcggactgcttgcgtagggccacaacagctgcttgctcaagcctgcgtgtggactgcccgtgatcggctgccccgctgcctaaaatatacgtgcccttaaggcttggtgtccatggggatagaaaactgagttgatttcaagtggtacctgaacgtctacacaagatttgactaaaacttcctcctactagatttcacaagagagccttctattctcctttttagaactgaatatatttgatgtgccgttcaatagcaatgtagatacactgactctgctttttcactatcaaacagtcccaacaataggactctctgcaaaatcaattctggtgtcttgtactcttgtttaattgttttatttgatgcgaggtaatattttattttaatgtttagcatg

SEQ ID NO: 2186 - DNA, 583 bp, Triticum aestivum
  Clone ID: PAT_TA_2186
cggacgcgtgggcggacgcgtgggtctcggtgcttccatgtatcccgatcgcactaagacaattgctggttcataacgaggcaaaagatatggtggacttccttgtattgttaaaccaaataatatgcaagtttaattcttcagcaagtggcatactggaggatgtctttcctactattgcaagtcgtatgtctgtgatattgtcacaagatgccttttctactggtcctgcaggcaataccgaggaaatgcgtgaactgcaagagctgcagaggacattatacacattcctccatgggatggttacacatgatttgtctgcagttctccttgctcctacctgtaggcagtatttggaaaccataatgcagctacttttgtttacttcatgcagtcataaagatatactgctccggaaggcgtgtgtgcagatttttgtcaaacttataaaagactggtgcactacatccaaagctgatgataagcttcctggctttcgagtattcatgattgagaagtttgctactggttgctgtttatacagtgtccttgaaaaatcatttgatttacgtgatggcaatac

SEQ ID NO: 2187 - DNA, 717 bp, Triticum aestivum
  Clone ID: PAT_TA_2187
aggctaccgcgtcgccacggccgcgccaggcctgggcttcccggctagcgtgtgcccgaccgtgggcgtggggggcatcatcagcggcggcggcataggcctcatgatgcgcaagtatggactctcggccgacaacgtcctcgacgccagcatggtcgacgccgacgggaacctgctggcgaacaagaatgccatgggggacgacctcttttgggccatccgcggcggcggtggcgggaacttcggcatcgtgctggcgtggaagctaaggcttgtaccggtcccaccgaaggtgaccttcctcaaagtcgccaagtccatggaccagggcgccgtcgacgcggtgaccaaatggcaaacgctcgccccggtgctccccgacgacctcagcgtacgtgtcgtcatccagaagagccaggccaacttccagtccctgtacctcggcaactgcagcacggcggtggccacgatgcgcagccggctcccggagctcggggtgacgagcgccgactgcaaggagatgagctggctgcagtacacggtgtacatatacttgggcgacgccatcaacagcaagccgctggaggcgctcctcctcaaccggtccacgaccctgggccccttcgtcaagaacaagtcggactacgtcaagaaagccctcaccaaggagacctggaagaagatcttcctctggcccaacggcggcgggtcggggca

SEQ ID NO: 2188 - DNA, 699 bp, Triticum aestivum
  Clone ID: PAT_TA_2188
tcttcatactcagatggcccggcgcttggttcttctctcctgtccgggccctatccttagctccttggttcgggaggggcgcccccgttttccctcgccgctccagatctgtacacgctgggtcacggtgctcagtgcgggcaacgcgtgccaaggcgcgcttccgatctagtataggtggttgaaggcgcgatcgaggaaggcctggctcggtctcgggcggccatccgccgggcgacttctgcgcgcccagggacgagagcgtccgccggatacggagcttcagggacgtcggcgacgcttttgccgccgcgaggcgcaatctaccgcaacgccatggccttccacaggagctacgtggagatggagaggagaatgaagatatggacgtaccacggagggggagccgccgctggcgcacctcggcccgggctgccgggcaccgacatctactccatcgagggccagttcctgtacgagatagaggaccccggaaccgcttcgccggcgccgccccgtcgaggccaacgtcttcctgcttcccatcagcgtgtgcaacctcgtccactacgtctaccgcctcaaaccacgctacctcgcgccgctgcgccgcctggtcgcggactacgtccacgtcgtcgccgagaggcacccgtactggaaccggtccggcgggccgaccacgtcctcgtgtcgcgc

SEQ ID NO: 2189 - DNA, 520 bp, Triticum aestivum
  Clone ID: PAT_TA_2189
ccgccgcttgctcctccccttccgcgccctcgccccgggatccgaagccattaaaccgagcgccagtggatctctcctcgggcatcggcatcggagcggagagagagtgtgagagagccacccagccatgagatggtatgcatcggtaggctgagggcgctggtgcttcgtgcggcggcgggcgcgggcgcgggcaggcgccggtgggccagggtcctgtgcggtcgggcggtcgatgtgggcgggacaccccgtccgcgcgggcaccgttggcgtggattccgggcggtggctggcgccaggacgaagatgatgctcgattcctccgactctgactccggcgctccggcggggcagctgcagctgcagcgccgcgcggttgctgctgggacccatccgcaggatggagggtacgccagtgcggggtggcagagggaagatggtaaactgaaatgtgggtattcaagttttagagggaaaagggctacaatggaggatttctatgatgtaaaactaactg

SEQ ID NO: 2190 - DNA, 875 bp, Triticum aestivum
  unsure (1)..(875): unsure at all n locations
  Clone ID: PAT_TA_2190
cttactcgtccggaaaataatgcagagaaggctacggcggcagatggtcaagctaaaaagccagaagatccttatgcagagaaggctagggcgctcgaggttctgtttccttcaacggagaaggttgggaagattggagatgcaaatcctgttaaagattttgaagccatgctggcagagagatctagctcaacatgggttcagaaggcaattgaagagatgaagaagtacacgaccaatttggtacagaattctcttcaaggagattattacgaaaaggcactcgagtgttttgttgctctgcggaaggcctgtataatcgaacaggagccggaggaatataaccagtttgtgattaagctttatgagagactgaagaaggtgaatgatgtggtgaaattctttcagcttctttcatccaagaatgttttgcttatatgcaaagaagaagcgcctgacagcgatgtgactgaagagatggcgaggagcttcttcatgaaaaccgaaatatcctctgagtagcatgggtctggttcctcaaggcattgccagtagaaaattctaactgtaccacggctcatggttcatgttctgaagctctggtcatgatatggtatctgatttgatggtgtggcagacgagttgcgatgaacacactatcatctaagatattgttttggattcccagtatgtatgttaattcgcaaccgtcatgaaagggaaaatgctactagtggaatttagaaatcctctgtttctagtcccaggttgcgacggccgtcgtacccgacgtacctgtcctaaataccattttctttggctgccaggnatcaattttcagtgattaccaagtcactgaaacagtagncatgggt

SEQ ID NO: 2191 - DNA, 1246 bp, Triticum aestivum
  Clone ID: PAT_TA_2191
cgtccgcggacgcgtgggcggacgcgtgggcaagaagagaatgaaggattctcggagatataaggatctgaaggatttgagctggagtgatcaatacattgttctctaggacagtgcagatgaggaaacatcagagcaagctcagactcttgttgattgtgatgacttcgacggcaaactttcactaagtgatgagtactcaaatgaacaagaggaagagcataggcatagagtacaacttgaagcagaggaaagaaaactggaggaaactttggagtaccaaaggcggatagaggaggaggcaaagcagaagcatcttgccgaacagtccagaagtacttcgtcagctcctgatattggggcaaatggttattcaactgatgtaaattcaagcgtgcatcaggataaccatcaaagtgcacccaataatttctcacctgcttatcttgaaggcataaagtttggtgattttcgttttcctaaagttccttcacgggaaaagcattctagttctgatttttgtggtgtggacctgccacaaaagactgagaacaatcgcagggagaaaccgaatggactgcgctctccgggagcacatgcattaaccagcagcaatatggatttcactaagccagcattgaaaatgaacggagttgggaaatatgctcagaatacaaaactttcaactaatcctcttatccaaaggtctaagagcagtactagccaaccacataagaaatacatccaaggtgctgttcataatggtgatgatagtgcatctagtcgacaaaatggtacaacagctccaagatggagcagttctggcaaagtagctgacttttctagtaacagttatcaggatggaaaacaaaatgagttgccacctgtgctttcttcggatggtccatggaatgccaacaaagctgaggaagctgataagggggcaatctcacctgcaattgtatgtatcaaggatgattctgacaaaaggtttgaagaagaccttagaaaagcagtgcaccaaagccttgcaggcgcttcaaatgggaaagaagtgtatggggctggccttaaaaatgctgctggagaatacaactgtttcctgaatgtgattatccagtcattatggcatttgaagcggtttcgacacgagttccttaaaacatcatcactgcataagcatattgaggatccttgtgctgtctgtgcattatataatatattcgttgacttgagcaaagcatct

SEQ ID NO: 2192 - DNA, 1552 bp, Triticum aestivum
  Clone ID: PAT_TA_2192
tttttttttttaccgggagggctattcgatttcgtatttattgagccaacgctcttcatgtacggtgtacatacagtactgtactgttcgtttgcttctggttgctaacccagctaaatcactatgatacaaggctcttgtcccataaatatacaccaaggaaggataatgatggtaacatcatcaaaatgtaaagaggttggaagaattgacaatatcgatgcggtccaaaaatataagaggaaaacagctctatatgcagctcgagcaaacaaaaatgaaacggttacaaaccaccgccttcacctacgccgctgcctcgatcttctcaatggtttctaacctcgttttccttttccatcctttcatggtggccaccaggttaaccagcccgacaacctggctcttgctgtattctggatgagaccgtgcccagtggacatactccgtctctggcaaataataagccttcacaaaagtctccacaatttgtagcctcggcttaacatttgacgatactatgtgttgcagcccattgatcagtacctgaaggtcaagtgacatcaatgcacgcccttcatcagtgcaccttttcactctagacagaccttcaactaacacttctgcaatgctctctatgccatagtccagcaagaggtgttggagctccttagaaattcctccatgatccaatcttgttttgtaatgtttgaactcgcccaataataaatcaacgtaaccattgtggtctgtgccaagctccttgacctcccatttggcatttgctatcttatccggatacccattgatatgcaaaagcatccgtgcacttgttctatgaatgtgctcagccaagtctggaacggtgtccaccaatgtcccgaaaaactcttcaacaacagaagtattattttgagacaacacagaatgtagatgggctctagatctgttcaaaactcgagcaaccagtgatactgtttcggcagctgcgcatctctcctttaacccataggaggtgaacattgagcttgggggcgcagtaggcatcacatccatttgggcaatagttgaaccaattgataaagatgatgaagatggatacaaactgttctgtggtttaatccactgatcagagtcttgtgttatttttgataaagccgctttaagccgaaatgattgagaatcaggtagtggcttgccactttgactcctgtcctggtacccaaatgtctcgtatatgtggtgataaaagatgccaaaaagttggaacatgcccttaaaaagctcaacattgaccatttccagcttttgcataagtctagcatatttatccatcatccttaacaaagaaagcgatgatcctgtctgtgatgaaatgtctccatctttccaatgtgaagtattgcctttcacaatttttgttttcaatgtcctactgggcaattgactatcttcatcaatgaaatcagcaagaaggtcttcattctcttcatcaaatggtgaattatttccattgccaactgatgagttgaacagcacattgcccttcggc

SEQ ID NO: 2193 - DNA, 2299 bp, Triticum aestivum
  unsure (1)..(2299): unsure at all n locations
  Clone ID: PAT_TA_2193
gggatcctgaggaccctgntggggaggatgatcccgaggaagcggaggaggatgctgaggacgtggaggaggatcctgaggacccagaggaggaagccgacgcagtcgaggatgatgaggaggatacggtgctggcggctgggccggagaagacggtgactgtggagggcggtgctgaggaggaagcgatggtgaccgtatccaaggagggcggcggtgaagttacggggttagagtctgccgtggtagaggagcccgaggaggctgctaatgtggatgagggacaagaagaggcagaagaggaggaagctgaagaggatgcaatggaagaggatgctacagaggtcccgggagatggcgccaccccagatgacatgaatgaactatctgaagaagaacatgaagaatctgggcatgaaggtacacatgggaataacaacgagggtggtgttgcctgccagttgagtgtccattctgaggcgcagaatggtcaacttgactcctcattgcctacactaggttcagtttcagtgggcaatactaaagacttgcaagtatttcttcatggattgcctaaggattgtgctgagaaagacattacagaggtcttttctcaattcggagagattgagtctattaaaacaattagaaaaaagaacggcattgcattcgttcgttatatgagcactgaagctgcaaagaaggctcttgccgaatttaaggagggagcttgaggtgacagggggaagggttaaagtattagcttctagaggtgataataccctttaccttagcaacatctgcaagagctggacaaaagagcaggtgcgaacttccttgagaagtatcggaatcgatggatttgatatgagtttacccgttgatcctgaaactggaggacaaaaccgagggattacttttctcaaatttgcttcgcctgacaacgccaaagctgcatctcagctgctacagccacccgtcccattgattaccattgttggaagtgtgaaggaatctgctcaaatccctacagaatcaagtcaggagcttgctatgctgcaggttaaaacagtatacctcgaacatgttcctctttcttgggataagggcaaagttaaagaatgttgcaaagcatatggggtgattctggatgttcacactttaaagaagtcaaaaacgaaaacttcttttgtcgaattctcatccaggaagagtgcattagcttgtgtggaaggaataaacagtgccaattttggtggtgaagttaagctggctgcaagtcttgctcgaccacgtcgggaaatacaactggacaagaagagtgctaaaggtggggtcaaggtcaatagtgacgcaacttctaaagacaccaacaattctattaagaaaaagaaccagaatagggaggtcgaagtgaagaaggattcaccacataaattgcgaaaaggtgatgtgagcaagctgacctcacatgttgatgcgaaagtaccacaatcatccaacccatcgaaaggcaaacggaaagctggaaagactgaaaataccgctgtaaatgaaagggcaccgaagagagcacggaagaatcgtggtgttctgacaaaaccttccaacagaacatctcatggtggttatgctagagttccctatgcaggagaatcttctggaaacattaaacgccctgtgggacctcgatatgtaactggcaaccaatcttaccccattgcgggcgcatcttccagatctaaaccaaatgctcgtgacctggaacctcatgctggatacatccctcctacaaaccgtgttcgtgcacctgcaaatcatgttccagtcacctatgtgtatgatcatccgagaagcgcaccatccactatccatcacattgacggtcttccttatgctagagaaatagcagctccaccaccagcctatgggtacacaagcaatcctcaataccaggatggatatgcatacgcctacctccccccgcctcatccaagtggatcttaccactacccaggaaccggcgcatatagccctcgaaggagatactactgactaaaatcctagtgccaagtcaatgctttcatctcatgtaatactacaaatacagaacgtttgcagttttcagggaccctcatgttgttttgctagatggctgacgctggaaagnaagtaaagttcagttttgtcggcgcttaggtcttcggtttatatttgaatgaaagtgcatcattaggagaatggcgttttggatcttggcctccaggaggcctattttnaaaaattcaaaattaaaaaa

SEQ ID NO: 2194 - DNA, 727 bp, Triticum aestivum
  Clone ID: PAT_TA_2194
cccacgcgtccgcccacgcgtccgcggacgcgtggggtccgagtaaagtaccccgcgctgctcctcttctccttccattccccttcgcctttccccctccctcctcccctccctcccaaaaaccctaaaccctacctcgacgggatcggccgatcggcgccgcgtcctcgccgggttttacttagaacggcatgatctttgccttcccattgggagggtgagaagcaaccaagtatggcttcaagggcgatcattaggagaaggaagcgtctttttgataatgttaacacacatatcctgtcatcctccttctccaccttccagcatggggcatttggtttcaaggctcagccaagaatagcgcagcaatttctcgagcaaagcttaggggactcaaaatctgacaaggagaaagagcagtatagtgtgaatttgacaaagggtggtctgctaggtcttggtaatgggtttccgcagcgaccagctcatgtgatttctcttcatggttatggaattggaagaagtaacgaatttgcattgccttttggagctagaggtttgttgcagtcagtccgcagagcatcaactgcaactgctgggcaacctaagttggatatcgaagaagaacagagtgaggatcagaagcagaataaaaagaaaaaggaggcatccccagaagaatgtgaccaggctgtggaaggcctaagcacagcaaaagctaaagcca

SEQ ID NO: 2195 - DNA, 812 bp, Triticum aestivum
  Clone ID: PAT_TA_2195
tggcttgcgtccggccggccaccctccagcggctcaccggctcaccatggcgacaccgccaaggcatgggtgcatgctccgcgcggaggtggtcatgtgtatattcctcgtcatagcaccgttgagcacggcgatcggtgtcaactatggcaccaagggtgacaaccttccgtcaccggccaaggttgcggcattcctcgtgacccgcacaaacattgaccgtgtaaagctgtttgacaccaacccggacattgttcgggccttcgccggcacgggcatctcagtaatggtcacagcaggcaatggcgacatccctggcctcgccacccagaccggcgccgactcatgggtcgctaccaacatcgcgccatactaccccgcgacagatatatctctcgtcgccgtgggcaacgagatcatggacacggccgacaagaatctcatcggcaagctcgtccccgccatgcagatgctcaaggatgcgctcgtcacggctggctacaacaaaattcgtgtttccacgccaagctcactcagcatcctggttgactcccagccgccgtccgcggctcggtttcgcgacgtctgggatgacgccatcttcacgccgatgctccaatttctccggcagaccaagtcgccactcatcgtcaacatgtacccgtactttgggtacaacggtgacacgctaccgtacgcgctggcgcggccgaaccctggcgtgctagacgcgggctccggcatcacgtacacgagcatgcttgaggcacagcttgactcggtgtactctgcaatgaagaaacttgggtttg

SEQ ID NO: 2196 - DNA, 1354 bp, Triticum aestivum
  unsure (1)..(1354): unsure at all n locations
  Clone ID: PAT_TA_2196
ggggatatagggcggaccgccgggnataaggtatggcccaaggccgatcgatctggatattctcctgtatggcgactcccgtatcagtaccgagaccctgactgtgccacatgaacgcatccgtgagaggcaattcgttttagctcctcttgttgatcttctagggtcctcggctgacgatcctatggagaaaagctggcactccctctcgaagtgcagcggtggcttctttgatgtgtggaacgagcttggtggtgaatctttaattgggacacaaggtatcaagagggttatggctgttggaaatcgtctgttggattggagtgagaggacccttgtcatgggggtgcttaatttgacgccggacagctttagtgacggaggtaagtttcaagaagtggaggctgccgttgctcaggccaagttgttgatatcacaaggtgcagacataattgatattggtgctcaatccaccaggccctctgcaacaagactatctgcaaacgaagaacttgagaggctggtccctgttctggatgcaatcaccaaaatccccgagatggaagggaagctgatctcagtagacacattctacggacaagtcgctgctgaagctgtgaaaagaggagccaccatgattaatgatgtgtctggcggacagcttgacccaagtattcttgaagttgtagctgaacttggagttccatatgttaccatgcacatgagaggtgatccatcaactatgcagagtgaacagaatttacagtatgatgatgtctgcaaagaagttgcttctgaattatatgcacggttaagagaagctgagttgtctggaattcctttgtggaggatagttcttgatcccggcattgggttttcgaagaaatccaaacataatcttgaaataatcaacggcttgggatccattagaaaagagatgggtaaagtgagtttaggtgcttcacatgtgccaatattacttggactctcaaggaaaagattcttaggtgagatatgcaaccgtgccgatccagttgagagagatgccgctactgttgctgccaatgcagctgggattatgaatggtgctaatatattaagggtccataatgttcgttgtggcgtggatactgcaaaggtctctgatgcattgcgcatggtcaaatgaaaaggtacaccaccagaaaagtattgagaccagtctccagttttgtacaagagaatggtgatgtagatttgtagagtagttactgtcacatcattggcttcccagttcatacctcataccatatcgggtgtatnatcacttaataaagcaatgaaggcttgtgtataactttgccataaaccagat

SEQ ID NO: 2197 - DNA, 950 bp, Triticum aestivum
  Clone ID: PAT_TA_2197
cggccgccgtgggtacgtgtggtttatttagcagcaatcgccgttcccgactcggcgaaaggactgtctcgccgccgccgccgccgccacgaggaggaggagaggccgagatgttcttccacatcgtgctggagcggaacatgcaactgcacccgcggcacttcggcccgcacctccgcgacaagctcgtcgccaagctcatgaaggacgtcgagggcacctgcagcgggcggcacggcttcgtggtggcgatcacgggggtggaggacatcggcaaggggctcatccgggagggcacgggcttcgtcacgttccccgtcaagtaccagtgcgtcgtcttccgccccttcaagggcgagatcctcgaggccgtcgtcaccatggtcaacaagatggggttcttcgcagaggctgggcctgtgcagatctttgtgtcaaaccatttgattcctgacgatatggagttccagtctggtgatgtgccaaactacacaacttctgatggatcggtgaaaattcaaaaagaaagtgaggttcgtctgaagattataggcactcgtgttgacgcaacagaaattttttgcatcggcacgataaaagacgactttctgggcgttatcagtgatcctggtggagcgctgtaaatgatccaaacaagactcagcatggtctccaacttccgcatcatgatatatatctgggaagagtccccaaggaaggttgcgactggcctgtaatttgtgtcctgatgtaaaatgtgatgtcatgcttatctaatggaagccagggtcctaatacttttaagaaaaagtaactggcacctgtaatatcataactaggatcttttttaactgtggtggttgacatgtttggattcaagcagttgtctgaacttccagaccagattgtgcaaccatgcatcgcacctaaaaaaaaaaaacgcaaaaagc

SEQ ID NO: 2198 - DNA, 614 bp, Triticum aestivum
  unsure (1)..(614): unsure at all n locations
  Clone ID: PAT_TA_2198
gcacgagggctaggctccttcagttcagtctactacacaatttaacacgggaggaggtgagacatggaggccacgacgaagaaccaagaaacggccgccggcgacgagaccgcgcggcccgccccgccggtgctgccgtggtcggtgaggctccagctgttcgcgctcgtcaccgccaacgacatcgcgcagcgccgcgacgggaccgtcaaccgcttcctcttctccttcggcgaccggcagtcgcccgcgaggccgcgcccggacgcgcacggcgtccgctccgccgacgtcaccgtcgacgcctcccggaacctctgggcgcgcgtctactcccccgcggcggaggcggccgggccggccccgctccccgtcctcgtctacttccacggcggcggcttcacgctgctctccgcggcctccacgcccatcgacggcatgtgccgccgcttctgccgcgagctgggcgccgtggtcgtctccgtgaactaccgcctcgcgcccgagcaccgccacccggccgcctacgacgactgcgtggacgtgctccgctaccttggcgccaccggcctccccgcgnacgtctccgtcccggtcgacctctcccgctgctt

SEQ ID NO: 2199 - DNA, 932 bp, Triticum aestivum
  Clone ID: PAT_TA_2199
ggcatgcaagggtatccatggcacatgccagcactggaaggaatagattcgtagcataggagctcattccatttgatcgctgagacacagcgggttatgatggagcagttggctttctatcaacaatcaagacaagcagctgctgacccccacagggacttgagactgaacattgatgaaatgagttatgaggaactgttggccttggaggaatccataggtactgtgaacaccggccttgccgacgaaaagatttcaggttgtgtgaaagaagtggtctgttgcagttctgatgaggagcaagacgaggaagatgatgggcgctgtctagtctgcctggaggagtacaaagacaatgatctcctagggatactgaagtgcaggcacgacttccacaccgactgcatcaagaagtggttgcaagtgaagaacgcatgcccggtatgcaaatccgccgcggcttagggctggagaggaagcagaataaccgatgttcctctccattgattccagattgagattgagttatagggtccccggtccattgattggtgcctgagtcatggaaataaaaggccgcatgacgacttgttaagtccgccgcggcttaggggaggagaggaagcagtgtaaacgatttcattctccattcattctagattgagattgagttatgccggtcgccggtccattctttggtgcctgagccatggaaataagtgcgctaggacgacttgtttcgtgggttgctgtagctgtgttatgtcttgctgtaaaaactttcattcaacaagcaattggtagagatattctccagccatttatttttatttctatcacatgttgagccgttgtgaggtgtgatggcgaatcatccccttgtacattggtgcctgttaacttatatggtttggcgacgcggccgaaaaaaa

SEQ ID NO: 2200 - DNA, 663 bp, Triticum aestivum
  unsure (1)..(663): unsure at all n locations
  Clone ID: PAT_TA_2200
gccaagnaatctattgggagggccctatctttgagtgggacgtcgttttactctagagttctcacagtaatgcggaaagcagaagcacctcctggatttttggcgtctattcagcagattgggaggccgctgccatggaactcgccaccattccagaaaggggttagtccaaagcagtcctctggtcatcatctccagtggaaacgtgagcagtctgccatggaaaattcccctgccaattgccctaccgactgaatctaaggcagcgcttaagaatcaaaacctcaccaatggacatagctttactggatcaggtctgggcaagatgttatctttggcacctctttatcctcagaatgatactgttactgctgttcaaacatctacaggtttatttctttctgatgaggaattacaggctttccttgctgctggggtttggaactcgtgagatgaaacgggaattggttgcaaccctaaccaaagctatagacaagattctttggtcggacatgtgtgctatgtgtctagacccattcagaatatgtgtgatcctcaggatcgtagttgccgcacttgtcgaatatgctagtggcaaactggcaatatgaaatgtagttacagttcaacgaacatctttgagatggtgagcgagtacattcg

SEQ ID NO: 2201 - DNA, 1477 bp, Triticum aestivum
  Clone ID: PAT_TA_2201
gtcggttgaattttggtgatgtggagcgtaatcgtcatcaagttagagatgttattacccagaagtctacttcaactccgccagtgaaaagttttggttcacaaagtttgaatgagttcacatccaaggtgaagagctcacctgcatcagcttctgaaccagcacggcatgcaaactcgttaaaaggacatgtatcagcatctgacaaattgtcccagttaaatatgcggctaaattcaggaactgatgttttgcaaagtcagcaaattagcagccctgcacagtccaagagtgggtcttctgttcgtgaagatggtggcaattacagtaacaaaccagtaaaagatgagatgttggatgtgaaactaaagctaaagcaggtggaactagacatgctcaagcttcggtccaagcaggcgcagataaacaatgggaagcaaggagccctcccatcagggccccattcgaatttagaggaggatgccgatgccagaactgttcttgtgacaaatgtgcattttgcggcaaccaaggaagcattatcaacacattttatgaagtgtgggacagtgcttaagctcaatatgttgacagatgcaattactggccacccaaaaggggctgcatttgttacttttgctgacaaggaatctattgggagggccctatctttgagtgggacgtcgttttactctagagttctcacagtaatgcggaaagcagaagcacctcctggttttttggcgtctattcagcagattgggaggccgctgccatggaactcgccaccattccagaaaggggttagtccaaagcagtcctctggtcatcatctccagtggaaacgcgagcagtctgccatggaaaattcccctgccaattgccctaccgactgaatctaaggcagcgcttaagaatcaaaacctcaccaatggacatagctttactggatcaggtctgggcaagatgttatctttggcacctctttatcctcagaatgatactgttactgctgttcaaacatctacaggctttagttctaccagattttatttctttctgatgaggaattacaggctttctttgctgccggggtttggaactcgtgagatgaaacgggaattggttgcaaccctaaccaaagctatagacaagattctttggtcggacatgtgtgctatgtgtctagacccattcagaatatgtgtgatcctcaggatcatagttgccgcccttgtcgaatatgctagtggcaaactggcaatatgaaatgtagttacagttcaacgaacatctttgagatggtgagcgagtacatttgaatggaaatgtcagcgttggccagccttctcttgtgtgtcaagtggcacaattacatgtgtgacacttgtcgtgaccggtgagttttatgcttctttttatgttcattcggctttttaaaaacatttttgtctcttaaaccgtgcattcaaatcag

SEQ ID NO: 2202 - DNA, 424 bp, Triticum aestivum
  Clone ID: PAT_TA_2202
tcttctgtacaaaccattcagctcaaccaatttgagcagaattatatggaaatgcgcagtctgatgtctagcactgatggaaggaacgggcctccgagcaatgatcaccagtgcccacttggaacctaccctaattgccaagggatgtcccagaatacccaagaagcagctcaagctgttggaggaaactaaggcaaactgagggattatgagtatggaatgaataccctaagtttatattgcttttacttccacgtacagagtcatgtggcatgagatatgtatcatgtcgtcaatgtctctgcgtagtccggccgtagctccctagatgctacacaccatcaagatctcaggaatgtacttatcctatatgctactggtgtactggttgaatttacggactctcatatctgtgtgatacagt

SEQ ID NO: 2203 - DNA, 804 bp, Triticum aestivum
  Clone ID: PAT_TA_2203
aataaattcctatcgcaacttgacatcacgttcagaagagacccaaccaactataggccgcggataaacaagctggactctacgaaagacaaagaacaaaagtctgtagggtcctactactacctgtgatacaggcaccacggttgatactttggtaccgttgcaactgcaacgcactctgcctgggttgcttgttgctggagaagaaactgaactggatttgtccaaaggggaggcgagacacggcaagggagcgacggctggagcgtctggaggagcaagacaacatgggggacgtcggagcaaggagacaggccaacgccgccagcaggcggagcatgctaacctcccatggaatctggtgaaggaatgcagagaaagggaagcaggaagtgctgcaaggttggatcggatcaaggagcctgcgccagaagaagtaatcccaacctttggaacccctcctgaacctggagtgctctgtcgggcttcgcccacagtcattgcaggatgctgtgagatgaagcaacacgtttgatggtgtcgaagcctcggcaccgagctgagaactgcttgggcttttctctgaagaagaattgggtgttgcttgaacttacgagactactacgttttctgtaatagggttgtaccaggttttttgccccatagcttgtattcaggtatacaagcagtgggttttcctggtgaacatcgaacccacaacctacctactattttcaataaaaatcatataagaatttgccgtggggcaaggttcgcctcttaaaaaaaaaaaaaaaaaaaaaa

SEQ ID NO: 2204 - DNA, 389 bp, Triticum aestivum
  Clone ID: PAT_TA_2204
gcacgaggcactgagtgagattggagcagcaaccagagaagccaagaagctagctgctgggatctctggttgctgcttggcttctgtttttttttttttttggtttctttgagattttagcttgtggtgctggagtattacatatcttgtccaaaaaatttgtactatgactccatatatgaggccctcggttgcaggctagctagatggtggcttgtggcgttgtagtattacatatatctgtccaaaaaaatgtactactgagattggagcagtaaccagagatttcatctcatctaaaaaaaaggctaaaaaaaaaaaaaaaaaactaaaagagacaaaaaaaaaaaataaaaatctaaaaggaaaaaatgaaaaaagaagattga

SEQ ID NO: 2205 - DNA, 769 bp, Triticum aestivum
  Clone ID: PAT_TA_2205
ccgcgccatggacgacaagtacctccggcgagaagacaagagcttcctccaagacgggcgtgacacggtggcctccgcgctgaccacgctcttcctccacctgtccaagaaccctcaagtcgcggcagccattcgcgcggaagccggcggcgacaagccgtccacgtacgagcatctcaagagcctgcagtacacgcacgcggtgctgtacgagaacatgcgcctgttcccgcccgtgcagtttgactccaagttcagcgctgccgccgatgtgctcccggacggaacctacgtggaaggagactcgcgcgtgatgtaccacccgtacgccatgggccgcatgccgagcatctggggcgccgattacaaggcgttccgccccgaccggtggctcactggagccggtggttcgttcgcgccgcccagcctgtagaagtacccagtgttccaggccggcctccgggtcgccctcggcaaggagctcgccgtcacggacatgaaggcggtcagcgtggccgtggtcagagctttcgacgtggaggttgtcggagagaatggccgtagtggctgggcgccaagatttgtggcggggctcacggcgtccatcagcggcgggctcccagtgaggatcaagcgcgcttcgacgtcgggtgcagacttcaaataattactagtgataaattgggatgcgctaacaatgtacataagtaggagatatcagtaggatagttgtttctttaataagaaaatcaacgttttcatcatcgaa

SEQ ID NO: 2206 - DNA, 278 bp, Triticum aestivum
  Clone ID: PAT_TA_2206
tcttagggctcaccaatccaacccacgacgccaaggtcaaggaattgcttgtttcagtatgcaacggcgcagtggagactttggtgaagacctctcaccaagttatctccaaggccaatagtaaattggataacaatgccaatggcaacagcaatggaagtggcactggcagtagcagagctggggaagggtgggtggagacagtctctagcacattggcagtgccaagcaacaggaattttgtgcttgatgttactgggaggggtgacatttgagac

SEQ ID NO: 2207 - DNA, 704 bp, Triticum aestivum
  unsure (1)..(704): unsure at all n locations
  Clone ID: PAT_TA_2207
ggcggacacacgagaggggggtagggagaggggagaggggccgacgacgacggggggcgggaggcggaagcaggaggaaggaggcggagcagccttctgacgcggccgccggtggcggaggttcagcagccggaggcgaccgagggcagcaagcggcaggaagaatcagtcacgccaacaaacaaaacaaataaataacaaaaacaataaagcaaagataatctagctttaaggaagacactcgactcaattactagaattggataaaattgaaatccattgatgaaaaggaacgtgaaatcaccggcaattacacaaatatcactttgtccacttattgtttgtaagagaatgcatctgtgtcggttgccgtctataattttttcaacaaaagaaaaaaaatgttgtatctatattgccttgttctttcaagcttttgggctcactaatgatttatgtactacagttcatgttttgttcaaacatgtgagtttgaagtcctttgaaggtattaataaatactctaaatgtattaacttgtcgtccttaaaaagtcaatgtctccctctagccaaaaaaaactaataattctctcttgggggaggaacggcccagggaaaaaaagggncctccctcggntgatggccaanccctggggaaaattcngatnctcccgngaattcccagangnanaaggcccgggg

SEQ ID NO: 2208 - DNA, 491 bp, Triticum aestivum
  Clone ID: PAT_TA_2208
ccttcgggccggcgctggcctccggaaactgggccaaccactgggtctactgggtcggcccgctcgccggcgggcccctcgccgtggccgtctacgagttcatcttcaccgtcccggcgacgcaccagcagcttccgacggtggagtgaaaggagctcgtcctcctggggaagctctcgcccctcggtaagttgtgggccgttggatgatcgaccgctccgaccaaagctgttatctacggtatatgatacatcgagtgttcaagtgtgtttgccccgcgtgtttgagggctggcttgatttgtgcgtgatgggtcgtgtgaagaatatgcgtgcgtgcacgcatgtgcgtctcaatgtttcgttcggccaatgagccgtggaagtaacaacattgtttctttcaccgtaagtttgtaagtgtataaggcctccccgtgcatggaaatatacgtggaatatacatacctgttattactaaaaaaggggggg

SEQ ID NO: 2209 - DNA, 880 bp, Triticum aestivum
  Clone ID: PAT_TA_2209
ccggcggcggcgtgcgcctccgcgtgcgtcggcggcttgcttgtcgcttgccgcttgggggcttccccttggaggtctggtccgcgtgaactggcggtggctcgcttggcgttgtgggttcttcgtcggcccaggcctgtgcgcggcctcggggccggtgaggaagtcggagcggcggctccgaagagcattgtcgtggagtgtttcatctggtcgcgtgggcggcagcgtcatcagctcaggtggagccgcggcctcggggcccggcggggaagtcggagttgcgggctcccgggagagccacccatgtgcttgtggagtgtcggttctggtcgtgtggacggcggagtcgtcgactccgtatggagtgcgccctcggggccgatgtgtgtgagtttttttgtggtttgtaagccggagtggcggctccgggtcgtgtggtggagtggcaactctggttgtttgggcaacaggggagtcggctcgttaggtacgtagcctcggggctggtgtgtgtcgatgtatcggttttcggccaattttccttataaattggtcaattctcttcttcttaatgcaaaggcagagctcctgctgttttctcgaaaaaaaaaaaaaagggcccacgtgtctgggtctctctcctcggccggccggagtggcggctccgggtcgtgtggtggggtggcaactctggttgtgtgggcgacagggaagtcggctcgttaggtacgcagccccggggctggtgtgtgtcgttgtatcagttttcggctagttttccttataaactggtcaattctcttcttcttagtgcaaaggcagagctcctgctgtttcctcgattttttttgtatctcgacactagttctctcctcgg

SEQ ID NO: 2210 - DNA, 521 bp, Triticum aestivum
  Clone ID: PAT_TA_2210
gtgtctctctctctctctctctctctctctctctctctctctctctctctctctctctctctctctctctctctctctctctctctcggcagcggcaaccttctggcgccgcgttcgctttctggcgcgaacaacgtgatgcagcagcagcagcagcagagcgcggcgttcttcatgggcgacgacgcgccgttcggcatggcggcgccggagctgggcaggttcggcccggggttcgacctgtcagcggcggactacgccggcgccatgcagcagccgcagccgcagaagcacgttggacccaactggttctactgaacaaccaaggaggaaccacccatgattagcatgtagctctaggccattagaattcataaggcttccattctcgatcagtccatggcgtcttgcaacctgtaaggatcggtcaaatccaggccatgttgagaacactggaattttttcacaaatcacaccgaaatcgaagttctgtttccctttcgaaaaaaaaaaaaaaaaaa

SEQ ID NO: 2211 - DNA, 660 bp, Triticum aestivum
  unsure (1)..(660): unsure at all n locations
  Clone ID: PAT_TA_2211
tgtaanccggttttccgttagtctttaaacggcgccaggaggcccatccaatatttattcatagtcttagtagaaccgacgacacacgacacagaaatagaacatccatccaatttttattcataaaaccaaacacacacgagacggaaataatacacgcagcaatgtatgatacaaaagaatattaagcaacggagtcacgcccacgccccactcagacgaacacaacacaacacaagccatcactactcgttactactgctccccctaaactcagaagcgaagtgaccgtcgccgccgccggagggacgaggagcggcaacagcgccaccaccagcagcagctcaccgcctactgtgcgacgagcagggacagcacggcggagcaggccacggccagcgccgacgcggcggccccggcggccgcgcccgtgaccggggccggcgccggcggcatgctcgcgtccatctcctgcgcggacgccgccgcgaacagcagcgcggccacggccacgaccaccacggctgcgcgagacgccattgctgcggggatgcgagacggcgaggctggcttggcttggctgctaaggtggtctgtcaatcagagaggtggggagtgcggtgcaggctgcttatcgcctcgtgccgaattcggcacgag

SEQ ID NO: 2212 - DNA, 731 bp, Triticum aestivum
  Clone ID: PAT_TA_2212
gcgggggccgaccaaaattggccgctcccccgccgcgcccggccccccggcggcggcggcccgccgccggcgtcccgcgctgcgtcccccccccgcctccccgccctccccacgggccacagcccgcggccgccgcgggccggcgccgccgcttttttccggactccggacccccgtaggacagtttaatccggattctgaagcaatgagtacctgtaaaaaggccagggcggaatctacatctgttgtgagttcagacagactgagcagtctgcctccagagataaagggcgacatcctctcccgtttgaatgtcgaagaagcggttaggactagcaccttgtcaagtacttggagggatgcatggactaatatgccaaaaatatttctgcgtgatggaaattttgcaaaacccaagttcgtcacattagtcgatatggtgctatcactctacaacggaactgtagagaagttcgagatttcaggtagcaaaacttaccatgacgagttcggcaggtggatgctcatgctttctaggagatcaccaagatcagttataatcgagttgaactctgggccagggtataagattccctcatgtctattttctatcggcgatttggagcttctgcacctgcaaaactgcatcatcagcttgccccgggtattccaaggtttcaagagattaactcacctcagcctgataaaatttctctccacagacttggaca

SEQ ID NO: 2213 - DNA, 776 bp, Triticum aestivum
  Clone ID: PAT_TA_2213
ccatcgttgatatttgggtccctagaatttagggagacccctccgaaagagcaaacagaaaaaggaaagacccacttttcgtcactactgaaggtgccaaggaacatgctgaaatcaagagatttccaagagcattgcgttctttcagcaatcgaggttctatcggcacattttttccagtggagctatcatgtttcttttccagaagtagccaccattccgctcatcctcttgaaaagattgcaagagcagacaacgattgagtccctccgccgtcctcttaaacgaatgatagaccaggtgagcgagaacagggattttgtgcaaaggaagagggaggtggtctctttctcaccaaatgatgcgtcgtcagtcgagagcttcctccaggaggaggagatgaatggagacgcttccttcacgcagttctacgcatcagtggcaaagagtcgtcaatcgagagggagaaaattggtgtagagggcgatgctagggtgtgatagttgttgattggctagaggattatcacatggacgacaaactgaggaactgactccaatgtgcatgcagtggtatcgatgaccgacgtcggagtttatggttttcttgctgtttgtcggtgtagctctcaagtttgtcgaaacttgtaccgattgagtagatttggcgtgtgaatcgaaggatctttgtagcgctggaattctgcagctgtttgttatgagtatattgttccagctcatttatgttgcccaaaatttagtattactattatttac

SEQ ID NO: 2214 - DNA, 662 bp, Triticum aestivum
  unsure (1)..(662): unsure at all n locations
  Clone ID: PAT_TA_2214
caccccttccaccctcctcacttctcttacatcacctgtgttatcttcgggagctcgccgcagcagcatccttcgaggagcacgcagatgccgccgactctgaagctcgggatccccgccgcggctgccgctgccgccgtcatggtcagcacggcctccgcggccgcccgaccaccccccgcccctgcgtccgccgcggccgccgccgcccgttccttgccccagccgcccctgagcaacgcctatttcggctactctttatctgaggattttcgccggcgcgttttgctgccttcgttgtgtttgttcacggtttttgcggccgttggtacctgctccagctacatcctctgttttttcttgtttgtcgtctagatttttgacattgcttcccaaactacgcttgtctttggatacttcttcatggaggccatttccttgttctcgcaagttatttgggatttttatttggttcgtctccgtgttcatacatgatggagtacatattgtaaatttacatgttcttttctattcctataatagaaaaatgttgggctaaaaaaaaaaaaaaaacacccgcaccaagcgtccgtaattagccgcccagagganaatnntctgnggaacaggtgnaattcaancattccgtggntacaatccgc

SEQ ID NO: 2215 - DNA, 908 bp, Triticum aestivum
  unsure (1)..(908): unsure at all n locations
  Clone ID: PAT_TA_2215
gggaggcccaaggtttcggcgtcgatcctcggcgcggcgacggcggcgtgggctctgttcgaggtggcggagtaccacttcctgacgctggcgtgctacgccgccatgatcgccatgctcaccttcttcatctggaccaacgcctccgctttcatgaacctgccggttccaaggatccctgagacgatcctgtcggagaggacggcgaagcaggtgatcctgggcctgcaccggaggctcacctggttcgtgcaccggctgtacgccatcgcctgcggggaggacatcaagaagttcatcatgacggtggtgtccctgtacatcgcgtcggtcgtcgcgacctgcttcagctccctcaccctgctctacctcgttgtgctgtgcacgatgacggtgccggcgctgtacgagcggtacgagcacgaggtggaccacctggtggccacgggggcgcgcgacgtccgtacccacttcgccaagatggactccggcgtgctcaggaagatccccaggggcaaaggtgccaccaccgccgcacacgggacgacggccaacaacgtgcacgggtggcatcgctcacacgtcaactaaacctgcccagccaacaacatgtcactgctaactaacctgtaataaagtacagtacagagtgagcgagctgcagacagacgtaaatcaaggttcagaacaaggcctgaacgaaccaacatgcagagagcgagcagctctgcagacggatgtcgatttaggttcagaataagacctgaatgtaaggtgtttcgttattgttaccatcctacatgatgatgcgtacatgcatgcatccaatccgcccgtgcgaacacggtgattctgtnaatctacctatcaacgcatgcttcgctttacggtggtgcgaataaaaaaaa

SEQ ID NO: 2216 - DNA, 437 bp, Triticum aestivum
  Clone ID: PAT_TA_2216
ccacagctcagtatcccacaaacaaaactgtagatcgattccatcctccatgagttcaacttcaacttcaatctcggtcttatcccaaggcagcggcgtcgccgcctccgccgccggcgacatgaccgacctagagagcataacccacatgctgcagtgggtggtgccgttcgcctcgccgccggcggtagagcagctggggcgcgcgctgtgggggctgggctccctcacccttgtgctggccctcaccaccgtgctccaccagccggccgccggacctgtcttcgcccactacaaggccgcatactataccgtccttgccttcgtcctcttcgtcgccgtgccggtggagctggggatcgccttctgcctgccccgctgcagccacgggcgccggatccatcattttgccagggttctcgtcccctgcgcttacc

SEQ ID NO: 2217 - DNA, 337 bp, Triticum aestivum
  Clone ID: PAT_TA_2217
ttggggcacgagctcgacgtccctgctttccgctgcggcggagcttggagttggaagcaagagcggcgccaagaagatggaagccgacgctgcgttgtcagtgcactcctgagctgcatctcgccattgtcaagttattataggatttgtgttctgttccgtacaacaattcttttcaacagtcgataccaccatgtcgaagtagccaattcatccttgtaatatgatgctagcttatatataaacaatgaagtgtatctttggcgtcacttaaaaaaaaaaaaaaaaaaaaaaaaaaaaaaaaaaaaaaaaaaaaaaaaaaaaaaaaaaaaaaatc

SEQ ID NO: 2218 - DNA, 759 bp, Triticum aestivum
  unsure (1)..(759): unsure at all n locations
  Clone ID: PAT_TA_2218
gcacgagggaggtgccgttggccatcttcgagaagaagatcgacgcgctcttcatcaacaacaacaacttcgagttcacgctgccggccaacttcagcagctccacggcgtcggtgatcgtgctggccaacctgccgcgggtcggggggtgcctgcccagcagcatcggcgacatggccgggacgctcaacgagctgatcctcctcaacagcggcatctcctcctgcatcccgccgngagatcggcaagctggacaagctcaccgtgctcgacctcagctccaacggcatcgtcggcaagctgcccgacaccatcggcaacatgcgcgccctcgagcagctcaacgtcgccaacaacatgctcgccggcgagatccccgagagcatctgcgcgctgccaaacctcaagaacttcacctactcccacaacttcttctgcggcgagccgcaccggtgcctcgaggtgccccacatcgacgaccggcagaactgcatcgccggacgccccgaccagcggcctggcgagcagtgcatcgagttcctccaccggccgccggcacagtgtgctgcgcacgggcaatcgtcgccaccgccgatgtacgcgcctccaccgccgatgtactgatacgtggcagacggcaatactgcaatttgtaactgtttgctgcctttgtgccgtgagaaagggtaaaaatgcacacatttggtatatactgtaatctttatttttcggaaacaaatgaaataacaatggattggt

SEQ ID NO: 2219 - DNA, 685 bp, Triticum aestivum
  Clone ID: PAT_TA_2219
tttcttcaactagcatgattgcagcgggcatattgtcctatttttcgctcagctgcccagctgcggccttgcacaaatctcaagttccgttgaagtacatgagtgactgactcagatgatgaagctaattcttttgctgattgacttgccaacctgtggacaactcgcatgaagatgatcccgcaagactggatttacaaaggtaaacagaagacgctcttgctttgctgcagaatttaatggtttcaacatcgccagccataagcaaggtgcattactactgccaaggagctggcaataaacagagctggccaggaggaggttgaagaaagtgacagtcaaaataagtggaaaccatgaccaagaagcactcgctgcggagcctttttccgagtttgtgatatagtgtagtttctatctgtgcccgttttcccccttaaggctcacgcgtagcacgctcactcacagatcatcagtttcctgtaaatgtaattatatgtaatttttggcctcttccctaacctatcatttttttttcttgctttacttaattatagagtggggaatctgatgggtgcaaaacagtactgtcggacaattgattcataattatctctgtggttgtaagatattatctatagtaataaagtgaatagttgtttccctctttaaaaaaaaggggggg

SEQ ID NO: 2220 - DNA, 1570 bp, Triticum aestivum
  Clone ID: PAT_TA_2220
atttttagtactcctggagtcagtgcaatcctttttgatgcgctagcaaaggcaaacattaatgtacgagcaatagctcaaggctgcagggagtacaacactacggttgtattgaagcatgaagattgtgtcagggctctaagagctgctcactcaaggttcttcctctcaaaaaccacacttgctattggggtcattggacctggtttgattggggcaacactgctcaaccagctcagggaccaggtagcagtcctgaaggaaaatatgaatattgatgtgcgtgtcatcggaataactggcgcaagcacgatgcttttgagtgacacgggagtagacctaaccaggtggaaagaagaaatgcaaaaggaagcaaaaccagctgatcttgctaattttgttcgccatttgtctgaggaccatgtgtttccaaacaaagtattggtggactgcacagcagatacaaatgtggcatctcactactatgattggttgaagaagggtatccatgtcatcacaccgaataaaaaagcaaattctggtccacttgatcggtatctgaaactaaggactctacagcgtgcatcatatactcattacttttatgaagcaactgttggtgcaggcctgccaataattagcaccctgcgaggtcttctggagacaggtgacaagatattgcgtattgaaggcattttcagtggaactctgagttatattttcaacaattttgaaggaacaaggagctttagtgatgttgttgctgaagcaaaagaagctggatacactgagccagacccaagagatgatctatctggaacagatgttgccagaaaggtcattatccttgcaagggagtctggtttgagacttgagctttcaggatatcccggtagggagccttgtgccagaggcgctaaagtcatgctcgtcgccaaatgaattcatgcaaaagctaccatcgtttgaccaggattgggccagacagcgccatgaggctgaggctgcaggcgaagtactgcggtacgtgggagcggtggacgtgctgaacggaaagggaagggtagaactgcagaggtacaagagggaccacccattcgcccagctatctggttccgacaacatcatcgccttcaccacttcgaggtacaaggagcagccgctgatcgtgcgagggccgggcgcaggcgcggaggtgactgccggaggcgtcttctgcgacatcctgcggctggcgtcctacctcggcgccccctcatagacatctgcgcctgtattggtagattttctggggtagacggacggcaacttgtactcttcttgcacaatattggacttggtagcattttgttctgaatgcttgcgaggaaagcaaataaggtgttttgttttgtttgccagtgtgctgttccttgttagagggtgtagggatcaggtgttttgttttgttttgtttgccacccagtcccaggccatgccacaactgttactaaattatcaatgcaataataaagaagggaatgccttttttaccaaaaaaaaaaaaaaaaaaaagtcgacgcggccgcga

SEQ ID NO: 2221 - DNA, 521 bp, Triticum aestivum
  Clone ID: PAT_TA_2221
tcttttaattaaatacaagtaaacaaagaaaacatgcatcaaaccagtacttagtactccagttactagtaagtcgtgtaccaccagcaagtatgtctgtggatcgaggaggagtacgtacgtacgtgctagctcccggccggtcgtgtagaataaacggtggccaaagtgcatatcaatgtattagccaaaaaaatgctgctaaacttcaatatgaataataaagtccaaggtttaattccaaaaaaaacttgcatcaaaccagtacttagtacttactactggcttaatttacgatgtggtgtagttactagtaagtcgtgtaccaccagcaagtgtgtttgtggatcgaggaggagtacgtagtactacgtgctacctcccggccggtcgtgtagaataaacggtggctaaacttcaatatgaataataaagtccaaggtttaattccaaggaataagatggcaaaaaaaaaaaacccgaacaactccaaagagagggccatggcccgattttgaaca

SEQ ID NO: 2222 - DNA, 880 bp, Triticum aestivum
  Clone ID: PAT_TA_2222
gcgggccggtttagagtaccacttcagaatgatcagctgcagagcggcagagattgaggcatccaagctggggtgcgagcccggggaggcgctggccgtcaacctggccttcgcgctctcgcacgtgcctgacgagagcgtctcgccggcgaacccccgcgacgagcttctccgccgcgtgcgcgccctcggcccgcaggtggtggcactcgtggagcaggagctgaactccaacaccgccccgctggccacgcgcttctcggacgcgtacttgcactacggagccattctcgatgcactggactcgacggtcagccgggatagcgcggacagggcgcgggcagaggaggcggtggcaaacatgtcggccaacgcggttggccgggagggcgccgaccggctggagcggtgcgaggtcttcggcaaatggcgcgcgcggttcggcatggccgggttccggccggtggcgctggccgcgggcattgccgaccaggtcatggcgcgcgccggcgctcccccgccaggcctcgtcgtgaatccggagaacggcgtgctccggctcgggtggaagcagcgcgtggtgaccgtggcgtccgcctggcgctaatctggtgaggtcgcgccatcattgccggcaccagacaattgtttaattaattcgcacccgtcctctatttttatcgtttcttatttgttcgattggcaaggtgtgatgagttggttcttgatctagtagtaaagcttagctgtagcgactcataatcctcgtagctaatatatggaaagagtacattattccgctactgattgccgttgttgtttttgtcacctgttgcttggagaagttgtagatagcatcggctgatccaaaaaaaaaaaa

SEQ ID NO: 2223 - DNA, 196 bp, Triticum aestivum
  Clone ID: PAT_TA_2223
tttatgcgtccgcccacgcgtccggcggcctgccgatgcaggtcaagagcagaacaggggaggctaacgcctaggatgcttcatgcttggaggagtcacaaatcacaattgctctgtactccatttctgtagtgttcttgcttggttcgggaaataaatttcactagcgggtttaaaggttttcaaaaaaaaaaaa

SEQ ID NO: 2224 - DNA, 567 bp, Triticum aestivum
  Clone ID: PAT_TA_2224
gcacgaggagaactagtctgagtttttcaatggagaatccatttctaatactgttgagttggagaataggttgatgaacacatgcaagggcctttcagacaattataatgaccttattgaagttcatgtttctgttggggtgtttcacacgcttaaaaaacagcgaaggattggagagttgactgtaagtgtatccgatcttggagaagttattgcaagagatcctactgtctcatgaactcgctgccagaaaagggatgccaggctactagatgtttctgtgctgggcgtactgtgttggatacttgacctgtgaccatagccagtactctagatattagaaatgactttataatttctatatatgagtaaactgcacaatccgccggaaaagctttttgggtgtgtcgaatagcaacacaccacattgatccgttgcgtgttcttccacatcgcaagtggagctccgagtgcattcttcctttgtggtgtctctggtgggatgaacttgatcgacggcacatttggcagcttgaacttcgtctgccacacattcaaaaaaaaaaa

SEQ ID NO: 2225 - DNA, 541 bp, Triticum aestivum
  Clone ID: PAT_TA_2225
ggccgcctccctgtccaagttctaaccccggtaccaccgtgcccctcgccgcgatctcccgcccgatccgcatggctggaatcaggctgacgcccgaggagcctgagctgccgcagggcactccgccccgcccccagctgccgctccccgtcgccggctccggcgtcacagcgggcggcggcggcagcggtggcctggagatggcttcggacgacgagcggtcagtggcagcggactcgtggtccgtgcggagcgagtacgggagcacgctagacgatgaccagcgctacgccgacgctgccgatgtgctcgccgcggcggcggccgccgggaacttcccctccgctgcctctgattactgttctgacaaagatgaccaagatcctaatgaggaaggctcaatgttggggctacaaagttattgggatgcttcttattctgaagatctcccaaattttcaggaacaccgccatgctggagaaatatggtttggtgcagatgtaatggatactgttgccatttggacaaaaaaattgtgtgt

SEQ ID NO: 2226 - DNA, 677 bp, Triticum aestivum
  unsure (1)..(677): unsure at all n locations
  Clone ID: PAT_TA_2226
tggncacgtggaacactggaaaatgatccctgcgtgagtntncctaattcatgatntttgnaagagnttggacgcnttcacaacagattntgtgacccnccatttgacgncaatgcgntgtcaagaagatccgantcagtnacaggtttggaacccgangtaagtatatgcgcttatccatcactggagtgcgcttccngtncaacccanatatgacatgccatgctgcctgcagttacccaacgtgacagaaatcccattgccttcagtgtgaagacacacaaanggatgtatagcccacacccangcaanggaatcataccaccatgtnccaagtcatacatcnttgtaacnttgcgagcacaggaagaggcaccaccgaacatgcngtgcctngacacgttaattgtgcagagcacaagngtgagcgaggatttcacatcccaagagatcactcaacacttccttgaggaagcagaggtggatgaggtgatattgccaattgcttatgttgcattcgaaaaatctgacctcgatgtatctaaataggtagttaccgcaaagaacttctatctccggagtgtaattcattttgagtgttattttcggtggcaggatatttgtgaaaatttatattttataagtctatttatatttaataaatgttttacatgtnt

SEQ ID NO: 2227 - DNA, 919 bp, Triticum aestivum
  Clone ID: PAT_TA_2227
cccggcgcgtggcattgatgaaatagactccctatgcacatctcgtggagcttctggtgagcatgaatcatcgaggagggtaaagtctgaacttctagtgcaaatagatggtgttaacaatagctctaccaatgaagatggtcagccgaaaattgttatggttctggcagctaccaactttccatgggatattgatgaagcactcaggcggaggttggaaaagcgtatctacattccacttcctagttttgaaagcagaaaatcactcatcagcataaatcttagaacggttgaggtagctactgacgttaacatcgacgaagtcgcacgaaggacagaagggtatagtggggatgacctgacaaatgtttgtcgtgatgcttcgatgaatggtatgaggcgaaagattgcaggcaagacccgtgatgagatcaagaacatgtcaaaggatgatatctcaaaggacccggtagccatgtgtgactttgaagaagctttggtcaaggtccagaagagtgtgtcgccctctgatattgaacgtcacgagaagtggatggccgagtttggatctgcttaaaccttggttcccattgaagaagattgctggatcttgtccacccttttttgtttatttgtgttttattcctggcattttccttatttccaccttcccgtatgttgtttcaacggcggcagtatgtatgtatgttcaactatgtttcctgagccggtagtttatcacaagaggcagaccgtaaacttggaagcgaattattattcgtcgagtgtttgttgattgagtttcagtggtactggaagactggaactgtggaagtgaaattctttgtgttaatccccaaaaaaaaaaaaaaaaaaaaaaagggcgccgctcgcgatctagaactagtcggacgcgtgg

SEQ ID NO: 2228 - DNA, 1500 bp, Triticum aestivum
  Clone ID: PAT_TA_2228
gcttgtctggacgacatcttaaatagtgttgtctccgcagggcaagcacatatacttcgatttgttggtgacgcagtaatggaattttttgtggcacatgcatcttcaccttcagcccaacagcagcttctggaagtcatttcacagatgagtttgaagtgtccacaagaagatgctaagtggtggcacaaattttattttaggcttgaagttcttttgcatttcaagaagtcatttccttctgaagaagtgctgaatctagaagatatgaatgttgctgagtctatttgcaagattttgaggatgttttatcgtgtcattgaagtaatatcttgccctagctctgtcacagcaaatatatactttaatgaggtttggaaagtgaggacagtgttgcaagaagaagcatcaaatggtaatggagaattttctagaatggttatggagatgcaggaaacattccatgggtactggcaaaattcgtacttgtggttgtcaatacctgttgttctggatcctagatttaaaatcggtttcattgagtttcgtctgaagcgagcttttggcacaaattctgagagctacttatctgacatacgcgaaacagtccgcgaactcttcaatgaatactgcaaccctacagatctgccaagcgcagcttcaaatagtgcagctttggatgcggataatgatttattggaagattgggatcagcatctcaatgaacaagcaagttgtcagatatctacagaacttgatgactaccttgaagagggtctagttccaagaaaggatgagtttgacattctaaactggtggatgaatcataccacaaagtacccaacgctagcagctatggcacaggacatattagctatgccagcttctgctgtccaatctgaagcagcattcagcagcagcggacccgtaattccaaagcactacagcacattgaacatcaagactattgaagcgcttgtgtgtgctcgagactggatgagatagcctgggcaattgtacatgggaagcccagcttactggaataccgcctagtagatcagcgctctgctgctagctcataagagtgaagagtttatgacggcgtgaagaaggctcggagaattctcgccccaatgtacctgtgccatatgccgctacagttctgaacgatgaagatgccggacgtatgatttgtttcagacatctgtctaggtcgttttcgaccaaagaccggtcgccagccccgccgatgatgaccagcttggtggctgctgttgacatgccctgcttcctttcctgtggagatgtgttcatcggcgtgtaatttttgtacatatcgactccgtgccatttggtcgctgtaagacgcctcagtgcctatgcagctagtaggtggagtcgtgagtttctgaatgtgttgcgaatatgggtgtattgatgtcagcataagaatctcatcaatattgtcatgagagcagaagcgagttcctgcgaaaaaaa

SEQ ID NO: 2229 - DNA, 650 bp, Triticum aestivum
  unsure (1)..(650): unsure at all n locations
  Clone ID: PAT_TA_2229
cgtccgttacccgcgcgtttcgtttgccaaaaatggggcctaagccaacgctcgccgccaccgccgcgtccttgctcgccgtcctggccgccgtccaccttgccgtcgcggcgaccgcggtggacgacgccccgctgccgaggctcccgcagcacgacatcccggccgtgttcgcgttcggcgactccacgctcgacacgggcaacaacaacgtcctgcccaccatggtccgcgccgaccacgcgccctacggccgcgagttccccgggggcgcgcccacgggccgcttctccgacgggaagctcctcaccgactacctcgtggaggtgcttggcatcaaggagctcctcccggcgtaccgctccggcgccgccaacctcacgggcgcggacctagccacgggcgtctgcttcgcgtccgccggctcccggcctcgaacgacgccacggcaacaaacgccggcgcggcgacgttcggctcgcanctcgcggacttaaagcactccntggcaanatangcggccggaaggccggaangtggtgaagaagtcgtgtcctcgtgtcgccgcgaacaacgacatgatgataatacacatctgccntcgggangagaantcaccccagcantacataacnctatggaacttnant

SEQ ID NO: 2230 - DNA, 698 bp, Triticum aestivum
  Clone ID: PAT_TA_2230
cggaccgtggcggcctcacacgcctggactgtcgcggtgctcggctgcacctgctgtcacctccctacggtaggtgtcccgtccccttgcccgttgagacgtctgatttttttttggcccggccccgcgacttcactactgggaccgcgcttcttggtgttcccatctcactctgccgcgtcgtgggcggcgccttgcgagggccggggcgggccctcgtctagtacatgtgttgccccctcggttgtgcgcatgttctgctgatgtgagatcctttgcgatggtgcctctctctccagcgccgggtgggtagtctcctatgtggtgcctgcttggtgttgccggcaagctgttgtatctcggtgatgtcctgtgtcggcggccactctgcccccgctgttatgccgagatgataggcagttgatggaagcgtccaagtccagccaggtaagattatgtagcaagctacttggtgcgcttggtgctgcccatcacggcatgatcgttgccatcaagaacgtcgatggcaagagcttgaataacagcctcaatagtttatatgttctgttgatgtaaaatggattgtactggttcataactctgttgtgtgatatattttgtcaatctatgttgtatgtcatcatttcatagagattttataaactgcaatgttgtatttacatacgaaggctgcaaac

SEQ ID NO: 2231 - DNA, 566 bp, Triticum aestivum
  Clone ID: PAT_TA_2231
cccacgtgtctggaggttggatagcttggttgaaaaaagctcagacctgagtgctgcttcacagatgttctataagcaggcgaagaaaacaaacagttgttgtactatactttgaagtttgaagtgtgatcctgcaattatcttggaaggctccaggttaatgctgttttccgacaaagatcctgatactgttatacttgctccttgtaccttcagttacgcctctgctcccgtttctcagaaagaaaatcaaccggatattgttgtgctgtactaagtctggttgcccatgaaagtgtctgtgaggcacgggatcaatactgtaaatctgttattctttggtgacgccttcgaatagcaactaacatcacttagcaatggccaacatcattgtcttccctgcttagattgtcgctatctcatttctcaagtatgttggagcacagttgctgcccttacattatgtactgtatgttggaacactggttgctcataatttatgttgtgatattgttgaagattatgcttctgtgattataaaaaaaaaaaaaaaaaaactcgaccgc

SEQ ID NO: 2232 - DNA, 949 bp, Triticum aestivum
  unsure (1)..(949): unsure at all n locations
  Clone ID: PAT_TA_2232
ggnctgcaggnaattcggcacgaggcacatctcacctctctccctctccccatcttctccaccgccggccgccgccgcggccaggccagcatggcggcgcgccaccagcaccacttcatcaccatccatccatccgcatcaccacctcccactagccactccatcacccggcgccccacaccaccatcaccatctcgcgcacccttccagactatgggatcaaggttgactggtgcctcgcgcgaccatccccacgctgctgctgcttttccgacgtccctgctgattctctacttgcgcccgacatctgctgctccatcttctcttgcctcactgctgctcctccacctgtgaacttctcctctgctactcctcttcttccccatcgccaatctgctgctgcttcttctccttctccttctcctgtgcccttctgcttgcttcctctcctgcggctactgctactccctttctccacgtctttgccgctccttccctcgcccctgctgctgctctcccaacctcctcctactgcttcttatcctatccccacgctgctcctattccctttccttgctagtgttcctttactgaagaaaacaacctgctggtgttctttacctgttgttgatcctgtacttctctgaatcccaaactgctgcttctctctctctttttcttgcaaaaatattgtacgatgccttgtaagaattggtgaactgtccagtattaaagtggtttagtaatattctgttgatatgcgagtactagtttagtggcttgtgtaatttcgtttgtgttgtcactcgtgtaacctgaaccttggtgtagtaccttgtgcccatatgtgtggctatgtgtgtactgtagttccaacgtcaactatgttcatgtgaaaatatatatgtttgtgctgtgaaaaaaaaaaaaaaaaaaaaaaaaaaaaaaa

SEQ ID NO: 2233 - DNA, 450 bp, Triticum aestivum
  Clone ID: PAT_TA_2233
ggcgccaacccggcgagcttcggcgcgccggcgctccaggcgaccctcgtcggagatggcgcctgccggcgcgtacaggcagacgcactcgcagaggcggtcgtcggacgacgggtacaactggcgcaagtacgggcagaagcaggtgaaggggagcgagaacccccgcagctactacaagtgcaccttccccaactgccccaccaagaagaaggtggagacctccctggagggccagatcaccgagatcgtctacaagggcacgcacaaccacgccaagccgctcaacacgcgcaggggctccggcggcggcgcggccgcggcccaggtgctgcagagcggcggcgacgcgtccgagaattccttcggagggatggtcaccacgcccgagaactcctcggcgtccttcggggacgacgagaacggtgtaagctcgccgcggtctggcaa

SEQ ID NO: 2234 - DNA, 1119 bp, Triticum aestivum
  Clone ID: PAT_TA_2234
gcacgaggcccaagttgggcttttccttaggagcatcctgcccttccaaggaaggctttacgccaccgtcgccatgggtggctcaagagagatcatgcagctgtacccgagatcaccacatcctgtgcttgctcatgttccaaatgatttcggtaatccgagcctatgcaactacttcctcgtagagtccggtggacaagtgctgcttgctgtccaccatttaaccgggcaacattgtggcgtggagcccttacagcaaaatgcctataggctatttgcgttggacatcgaccgcggtgagctgatcccagtgaactgcctcggtggccgcgcgctgttcctcagcagggatcggtccctctctgtttcggccagggacctcccttctgtgagcagcaactccatttacttctctttgcgccgtgaccctgttgtggtgcactccataaggacaggtttctctgagcggctagcagtgtcatgccaaatacatgacgggaaggataggatccgaccctccgtgcgccccctcaccattgccgaccatcttctaacctactgccatcctcatgagtggacaaaaggactcatgtttcatgagtaccactccatacctgaatcttttgaggaattgacgaagaacatcaaggcaaaaaattccgaactacggattcctcgcattgcggctcgttgattggaaggaagaaacagggccacagcacttcacactagccagtgaataatgccaatagacagttgatgcatatttcccttgctggctcagttgggatctttgggtggctaggtcaattcattggtggctcccaacgcaacgcgcacgaatcttttggatttggcacgcgtccggtttgtctgtgctacacatatagtggtggttcatatctgaggtctggcaaatagattggatccgtcaaacatgggctcattgcaccctaaggatatacacaatgtgataattatcggatttacttcccctttaatctgcatgctgtttaggatcaaattgcatatgatgtttgtacttgaatgaggcaacttgcgattagcagaatcctactaatgtctctgttatcagcaaaaaaaaaaaaaaaaaaaaaa

SEQ ID NO: 2235 - DNA, 696 bp, Triticum aestivum
  Clone ID: PAT_TA_2235
gggtgcatgctttcagtgttgctgatctgccattgactccagctgagaggttcgcggcactattccgggagcggccaaggtgggaatggaaagacctgcagcccttcatcagggacctgcgcgtacctggtgcgtcttcagaagggttgctgatcaagtacgcaagaagaacgcaaccaagcgctgatgccgatcctattttcactgctagatagatgatcaacctaccctgctacataatccatgctctggttgtggcccttgccgctgctggtaaactgctggtgttgctgcacttggcccggatgttgtcgacaacagaagattgccgtgccggcatgccagccaagccgctcacgcgcgagggcgcctgtggtggtcctgtcccctacgttgcctctgtttctgctctgcgcccacactttgaggcgctctgtctgtcccttcgccctctgctcgtccggcaatatctgtacctgggtgcactgcacacttgttgcacatttactatatattttgtatttcagcatgtaagctcggttctagctagttatgttttccagatgttgccttcataatgagtagcagtggaagactcggtaggcgtctgaaaactgaaactgcgtcgcaggttttgggcaggctgcaaaactctattgtgggagtcaagtcatttctgttgtgattcaaaaaaaa

SEQ ID NO: 2236 - DNA, 2138 bp, Triticum aestivum
  Clone ID: PAT_TA_2236
ccatcctgcctttcttcgacagctcctgctagtagtacgttccaggatcgccggagccccggaggaagagcaaagcgtagcggaggagggagaggaagagagagatgaggtggacggcgttcgcgtgggagagcgcgtcccgggccttcaacaaccgccccaccttcaccggcctcgtcgtcgtcctcgccgcaagtagtggaggaggcctcgtcgcatatgcagactctcagccagaccagccccaaggatttaaaaagaagaaaatagtggttcttggaactggctgggctggcaccacattcctgaggaatcttgatagcaaactgtacgatgtccaggtcatttcacctcggaactactttgcattcacacccttgctcccaagtgttacctgtggaacagttgaaccaaggagcgttgttgagccaatccgtaggattctggagaagaaaggtggagacttcaaattctgggaagcagagtgcttcaagattgatccagcaaacaagaagattcattgccgctcaaatatggggacaaatcttgatggaaatggcgagttcttagttgactatgactatctggtggtagctgttggagctaggtctaacacattcaatactcccggtgtgacagagaattgccactttttgaaggaagtggaagatgcccaaaagatccgaaggagtgtgatggactgctttgagaaggcaagcctcccataccttaatgaagaagagaggaagaagaatcttcactttgttgttgtgggaggtggacctacaggcgttgaatttgcggcagagttgcatgattttgttactgaagatctatccaagctctatccttctattcagcatcttgtcaagatatcactgatcgaagctgcagatcacatactgactatgttcgacaagagaattaccaactttgctgaggacaaatttggaagggatggcattgatgtaaaaactggatataaagttgtgaaggtttctaaggatgcaattaccatgcaaaatccagctactggtgatattgcagttccttacggaatggctgtctggcactcccctagtgggacccgcccaaaattcgttgacttcatgaaacaaattggccaggctaatcgtcgtgtcctcgctactgatgaatggctaagggtgcgtgaatgtgatgatgtttatgcagtaggtgactgtgctaccataaaccagcggagagtaatggaggacatctcagaaatattcagagttgcagacaaagataaatctggaaccttgactgtgaaagaaatccaagacatcctggaggatatctacgtgagatatccacaagtaaagctatacatgaagagcaagcaactgaacggaattgcagatttaataagaactggcaaaggtgacaccgaaaaggaatctgtagagctgagcattgaagagtttaagaaggctctttcactcgtggattcacaagtcaagaatctacctgcaacagctcaggttgctgcacagcaaggacagtatcttgcgacgtgctttaacaagatgcaggctgctgaagaaaatcctgaaggaccaatccgcattaggggagaaggccgtcatcgtttcaaccccttcaggtacaggcatttaggccagtttgccccactaggaggggagcaaaccgctgcacagctccctggtgactgggtctccatcggtcacagctcacagtggctctggtattccgtctacgcaaccaaacaaataagctggcgcacgagggcactggtgatatctgactggggccgtcgcttcatcttcggtagagactcgagcggcatatagtcaaaggagatatgattttgtttgcggtatatacataggctaaggccagtagtggtaccttccacccaagtctgttcttgcagatgcatataatcttttttgtcggggaaagaataaaagtaaccctgcacttccctagtgctccacggagaaaattcctttgtacctttttactctcgagttatacttctgcggcacgttcaaactcgcagattaattttgtagtccttccaccacaaagataagcaaagggccagtttggacctgtttttgttctgaaaaaaaaaaaaaaaaagggcccta

SEQ ID NO: 2237 - DNA, 623 bp, Triticum aestivum
  unsure (1)..(623): unsure at all n locations
  Clone ID: PAT_TA_2237
ttgcgagcctcgggacggttnacagccncntcttgaagacgcttgcagcgcggtttttcgtcaanacgcgcggatcccggcccaggggcaacggntgggcacaggcagttacggtgatcaaccgccccttcaaggacgacatggntccctctccgtcggggaccacgggtcgtcgtgaccagccccgcgtccagcgtgcggaccttacacaacagcccaaggcccggaataacctgggctggtagccagccatacccatgtgcggaccgaccatgtctgtactcaaaatcttgggacgccaatgtcggaaaagtttatcgcatacctggaaactgggaaggggaagttgagatgtacatttcaggaactgaattcactgatagatactgtagtcaggagcctactgtgtagataatcggagctgttattttttcctggaatgctgtaattgtgtcttggtgtggatgctgcgctgcgttggcgggattattggtggccgaataatattggctgggtgtagggcaggagttcttcctggaattaatatgctgtgattgtgtctcgagtaacattttgctctttatatttggaaaaagatagcagtaacaaaaaaaaaaaaaaaa

SEQ ID NO: 2238 - DNA, 613 bp, Triticum aestivum
  unsure (1)..(613): unsure at all n locations
  Clone ID: PAT_TA_2238
cggagggtaagcggaaggtggcggtagagagaggatggatggactggggatggttcggtgggtacctaatttggcgtgggtttggctgattacctgattttttttgggcggacagttggtctgttttctgtagttatctgtactgcatgccatcaagcaccaggtgtcgatttctatgtcgccatggaaattaaggagagcatggaccacttggcgtgccagttgccccnttggatacattgaccattatcctttaataacaaagcggaccatgcctgccttcatatcattgaaaattgatccccatcggtgtccaaggaataccaagtttgaaccacctttccttccttggagtgaaaaataccgagttccctattttaaggggggaagcacccatatcaattttcgggtaccctaaactcaacctaatatatgggcaaaaaacccgaaaattacctccgcaaaatggggtgcctttagttacttggtgagacaactgtacntggaatgnaccntggttaaggtggattgtancctcantacatacaggntaagaatttcaanggagttttacaggctggtnatattaaaaanatactattgtccctttatt

SEQ ID NO: 2239 - DNA, 858 bp, Triticum aestivum
  Clone ID: PAT_TA_2239
aaatagaaagtgtatataaatagagatgtgggtcgaacggtaacaaggattgcagtagtaacttgacatgtaatcctaaacattcatggtcaatgcttcattgcagaaggaaccgaaggaaacctgctcccgacccgagcgcgccggcgccgcagcggccgagcaccggccggaacgcaccggcgtcggagcggctaggcgaaggcggggcccaacgccggcgagcggcggcagcgtgctcgccgccatggacgagcaggagttccggcgcatgctcgacctcttccccgtcgtccgatcccgcgactactgcaaggatgaagtggaatcatcaagcgaaggcaccacacagcaaacacgagctcaggagataaaaggaaaccaaaaagaatgctgcagaagctctattcctgcggaaattgaagatggctgctgagaaaaaggttggagcaacaaaggcagaactattctgcaaggacattcgaagaagctcacgagaaacttgtttacaaagaactggatctggatgctgctcaaaggttcctgaatgcctacaagagctgatgatgagctgttgctagatgcctagaagatttggtttttattcatcagaaactgctgaagatgtgatgatgttaagatttctgatatttcctttgtggttcccatcttctgcaaaaccatgtagacagccctggtcaatcagctacattattcagatgtactgtgttatccttaacatagaccacatgtatttttcttccagctgcgatctgttcgccctgttcttcagagatagaactagcatgtttcttctgtttccaatgacaaaaagtctgaatcggcaaaaaaaaaaaa

SEQ ID NO: 2240 - DNA, 545 bp, Triticum aestivum
  unsure (1)..(545): unsure at all n locations
  Clone ID: PAT_TA_2240
ctattctagccaccaccttgagcagctaccaaatcctcagccaagcaagcatggccagcgtgaattggagccgtgcagcggcggcgctcttgctggtagcagcgctggcggccgcgtcggcggcggtggcggtggcggcctgccccgaaacagatccctgtgtcgcttcaatcggcggcggtaacggcgatcctctggcaatcaggttctgctgccacactttaaccagatggggccaagagctgcttgtgtgaggtccgtngccaattccgcccggcggtggcgggtcagtctcttcggatacttcctgccgctaacaactgcgccaaccgcaactctcaccaatctgggttatcatatgttaccatcagatcccctttcaatttcatttccctccctgcaagttccttccctcgggcggggggccgggcgccgtctcaccctgtggtggccgccgtccccctcgcccggtcctttggtgnccgctccatcgcccctcctgtctatctccgtcgttggtttccgaacatctttttgtatgtttt

SEQ ID NO: 2241 - DNA, 921 bp, Triticum aestivum
  Clone ID: PAT_TA_2241
cggtggaatcattatgttgcgcgtaataaggaggaatttccttgcaagctgtcaggcatttagctgcgtgcggtcgtacacccagctgtcggcctctcctcgtacagtccacttcagatgcatgtcagtcgttgaccatgttgataaggccgcgccgagagcaccagggcggtggacgacggtgaggcctaggaaaggaacgacacggaggcagggaagactcggcagttgtttcccacgtggaggggagtacgactgtacgagggtttactggttcgtctgccgtcgccggagaataacagcaggtgtgggtgagtagagggatggctaggccagcgatgggagtacggtggggcggtgaggcctgcgcggcagcagagccggccgcggggaggagggagcaggcagtcccgccggcgcttgtttgagcggctggagcaggaagagcagagattgaagaagcacgacggccgttggatggacatccaacagtcactgcttgtgcgtcaaccttttttttaggaaagcctcaaatctgtggaaaacagcatacaacccatctgccattatttctaataatttacagcccatttgctaattcttaaggtttttttggagcccatattctttttgttagcattacagcccatattgtggccacggttaaaaaattatacgaaattttgcatatttcggtgcagtccgaactgtttttaatcccgaaatttcgactcacagtcaaactgattttaaaaataaatgtatatcaatataaaatccaacaaattgtccacgcataaaaatcaatgcaatttaaaaatctcaaaatgaagaaaagatatttgaaactcattaccagtttgatgtgttttaaaaatgtacagcccatttctcattactgataggccattttctcggcca

SEQ ID NO: 2242 - DNA, 2496 bp, Triticum aestivum
  Clone ID: PAT_TA_2242
gtgacctggcagccgtgtgctgaggccatacgtatcgcttgactcaggtggccattggcacccgcaggaacgcttgtccctgttccagaccgtcctttgttagacaggtcctcttgctgctgcccagggacgaaagagcctcatgatgggaaggaagacagtgctgtgatgcaaaccgggtggctctcagcaatatgtcaaaggaaagataggtgttttgcagtttttgcttggagcttttaacatcatcgcagctgcaattacaatggtggttgtggtcgtaatcccaaaggactaccattgggctgtcacattgacgctcgccattttcgctaccacaaaatgataagggataaagctccggtcgcgcccctgtcggcaagttagacactgggttctgcaacaacaattttcagggacaagactggcacacattaactctaaatcacatgactgctgttgaggtatactttggtagagagaagatggatcctccagataacactcagaagctatctgctgctgtatcaacaatgattattgaaggaattgctcagaatacatctggaagcatatttgagccggagggtggtcaagctccagaggtgactggatccccgactgaaaatgctatactgcattgggggtttgcagcttggtattcaattcagttttacatgatcgaaatcctccattcttcaagtcttcccattcaattcagagaaaaagcgaggcggcgttgcagtgcaactgggtgactctgaggttcatgtatactggaaaggagctgctgaacttattttgcagtcatgcactagttggattggcacggatggttcaaagcaatcaatgacccctgagaaagttggtgagttcaagaaattcattgaagacatggctgttgctagccttcgctgcgtcgcctttgcttacaggccttgtgagatgagtgatgttccaaaggaggaccagagggctgactgggtattacctgaggataacctgattatgcttgggattgtgggaataaaggatccctgccgccctggagttcaagattctattcgcttgtgtgccgcagctggcattaaggtccgcatggtcactggggataatcttcaaactgccagagcgattgccttggaatgtggtattcttactgatcctaacgtatcagagccaaccatcattgaagggaagaccttccgggagttgtcagatttggaaagggaggaagtcgccgacaaaatctctgttatggggaggtcttcaccaaacgataaacttctacttgttaaggcactcagaaacaaaggtcatgttgttgctgtaactggtgatggcacgaacgatgccccagcactgcatgaggccgacattggtctctcgatgggcatccagggaactgaagttgccaaggagagttctgatattattatcctggatgacaattttgcgacactcgtgagggttgtcagatggggacgttcagtttatgcaaacattcagaaattcattcagttccagctgactgtcaatgttgcagccttgataattaatgtagtttctgctgtcagttctggtgacgtgccactgaatgctgtccagttgctctgggttaatctaatcatggacacgctgggagcgcttgcattggcgactgagccaccaaacaaccatcttatgcagagaccaccagttgggcggagggagcctttgataacaaatatcatgtggagaaacttgctcataatggctttctatcaagttgcaatcctccttactctcacctttaagggcctgacccttctacggttggaacatgacaacccagcacatgctgaaattctgaaaaataccttcatattcaacacatttgttctctgtcaagtgttcagtgagttcaacgctcggaaaccagatgagctgaatattttcaagggtattgcagggaacaaactcttcattgccattatagccataacggttgttctccaggtgcttatcatcgagttccttggcaagttcacgacaacagtcaggttgagctggcagctgtggttggtgtccataggtcttgcttttgtcagctggccgttggcactggtaggaaagcttatccctgttccagaccgtccgttcttagacatgttcacttgctgctgcccagggaagaaagaggctgatgatgggaaggaagacagtggtgtgaagaacatcgaggtggtgtgaagtgatgggctgacatcgaggaggacctttgcagtttttgcttggagcttttaacatgatcggggctgtaattatctggtgatttggatttgtaaatacactaggtttggagtggatattaggtctctcacttttggagatttgatttgccacgctatctttaacatcacgcctgaccctggccactggtggctgacttggaagctggaatttagcttaaaatggatgttggaacttggccggacccctaaaaaaaaaaaaaaa

SEQ ID NO: 2243 - DNA, 521 bp, Triticum aestivum
  unsure (1)..(521): unsure at all n locations
  Clone ID: PAT_TA_2243
cccatttttccgcccacgcgtccgcccacgcgtccgcccacgcgtccgtgacgacgacgatgatgatggtggcgatgatgataatgatgatggtggcgacgatgatgacgacaatggccgatcccactcggaccacgactgtgactcgggctctgactgtgatggtgatgacgctaactcaaagggcaggaagaagaagccctcagctccagagaagaagggagtcctgggaggtaaccggtaagaagaacgacaagctgcctaaagtgacaatatatatgggcgtgcgagcttccatcgcccttcaagtcattacttgcttcaagatcatgagagcgagcttatctttaaacatgtattagccgtaaaactctgtacgcgcatgcactttaaagttatgtatctggctacagcctacagacaatgaagtccgcacacaaataagcgcatcactctgtattaaaccctctgtttctgaatataagatattttggcagttcanaaaaaanaaaaaaaaaaaa

SEQ ID NO: 2244 - DNA, 684 bp, Triticum aestivum
  Clone ID: PAT_TA_2244
caaacccaccaagcccccgcgtccgaagccaaccaaatcagcctcgactcgacgagggtttagggggaagaggcgcgcggagaaccctagccgccgccgccgccgccagatggggatcttcgacctgctcgacctggccgacggcgcctcgggggacgaggccgtagcccgcgtcgtcaagaaggtcgtcccgcccgacgaccccgacaagcccaccaaggccgccaagaaggccgccgccgccgccgccaaggacgcccccgccaaccccccccaaggacgaccacgccccaccaccacgaccagcagcagcactacccccaagagggtggaaactattaccaaagggagggcaactttggtggaggccggggcagaggccagggctactatggtggtggtggtggcagaggaggccgtggaaggggacgtggggccggatccagtcgtgtctttgaggatgccaacggtcgtttctatcacgatggctatcaacgtgtctacctcaccaacgaccgtccatactatggcaatggcaacggcaaccgcgactacaacaacaacaacggcaacggaggtggctacaaccaggcccccgactctaactaccgcaatggtggtgagggccagaggtacggcaatgatgacaggcagtacaggagggacaacatgaagtacgttcct

SEQ ID NO: 2245 - DNA, 1539 bp, Triticum aestivum
  unsure (1)..(1539): unsure at all n locations
  Clone ID: PAT_TA_2245
gcacgaggctagcttgagccatttctacttgaccagagcagagcaaagtctacacgtcccctcaacctcggcccggagtcccaaccaccaccgtaccgtcgccccgtcgcccagatctcgcccgcgcgcgcgatggccgccgccgtccccatcccggccccggcgcccgcggccgacgacgagatcgtctacgagtccatgccctgcatccgcatctacaaggaccgcgtcgagcgctacttcggctccgagttcgtcgccgcctccgcccacgccgacgccgccaccggggtcgcctcccgcgaccgcgtcatctcccccgaggtctccgcgcgcctctacctcccccacatcgaccccgccaagcccgacaacgccaagctccccgtcctcgtctactaccacggcggcggcttctgcctcggctccgccttcaaccccaccttccacgcctacttcaacaacctcgccgcgctcgccggcgtcctcgtcgtctccgtcgagtaccgcctcgcgcccgagcaccccgtccccgccgcctacgccgactcctcggacgcgctcgcctgggtcgtctcccacgccgcccccggngccgccgccgctggcttcgagccctggctcgccgaccacgccgacttcgcccgcctctacctcggcggcgaagagcgccggcgccaacatcgcgcaccacgtggcgatgcgggtcggcgcggaggggctgccccacggcgccgccatccacggcctcctcatgatccacccatacttcctcggcaccgataaggtggcctccgacgacctggacccggcggcgcgggagagcctggccagcctgtggcgcgtcatgtgcccgaccaccaccggggaggacgacccgctcatcaacccgttcgtggacggtgcgccggggctggacgccctggcgtgcgggcgcgtgctggtgtgcatcggcgagggcgacgtgctccgcgaccgcggccgcgcctactacgaccggctcagggccagcgggtggagcggggaggccgacatttggcaggcgccggggaagggccacaccttccacctcctcgagccctgctgcgaagaggccgtcgcccaggacaaggtcatcgccgagttcctcaaccattgattgcatctcatcaccatgtatactcaggaaatcgggaaataagcgcagcttcatcactcagtggatggatgctgctttaacatttcgggttcaggattcagatttgtgttggtgttgttcacccattgttcagaattcaggtattgggtttacggatggaagggagtcgccattgtttgtggcaatgggtgctgtatcagaattgctggaggatatatggtacattcatagtttcatacagagatgatattagtatacttgttgtattgggtccaaggtttactttgcggtatatgtatttcgggagttcaaagttcaggaattctttctcttcgctaatttatttatatatgtactacaagtttctgaaaaaaaaaaaaaaaaaaaaaaaaaaactcgag

SEQ ID NO: 2246 - DNA, 806 bp, Triticum aestivum
  Clone ID: PAT_TA_2246
ttttccaccagcccactacacacacatgcccgcgatggggatcttgaccggctggacggcgagcggcgcggatggcgactggcgccagggagctctgtggcggagcgcggctgggcgccggcacggcgagcagggcatggcggccgcgggatcctcttcctccatcttgccgttgacctcccctcctctgtgctcacgctcgacggccttgtctacatcgtctaaggacggggcggcggtcgcgtcggtgcgtggcttggctgcggcggccgcgacggagcacggctgggtgccggcacggcgagcagggcatggcggccgcgggatcctcttcctccatcttgccgcagacctcccctcctctgcgctcatgctcgaggacctcgtctatggaccggctgtggccatggcaggggaacggagccctccacctccacggccccttgtgcgctggcggcgcggacctcgacctcgccagcagcgtggagtcaaccacctcccggccgcgcgtgcgctgcaagggccatttacccagttcgtcaaatagagtagtcttttttacaagttgaaatagagtttgtttgttcgtggatgagtgagtgatgatggatatgtactgtaaatagactagttctatcatgtaaaataagttcgttcatcatcgattcttctactggttgttgcgaaattgctatgaaagattttgcctacgccttcgaccaagtacggcctctgcactagcacttggtcctattttctttaaataatataaagattctttgccaaaaaaaaaaaaaaaaaaaaaa

SEQ ID NO: 2247 - DNA, 731 bp, Triticum aestivum
  unsure (1)..(731): unsure at all n locations
  Clone ID: PAT_TA_2247
ttggaaggagcanttggantcctaatcccgttgggaagtgcagaatttgcttttgttcgctttgccggcaaaatttgcattttccaccgcgcttactagcaacaatttcctacttacagttacaggagcgcactcccagccactcaatcccaccggcttatcgctcaccacgccgccgccagaccgcctcccccgcgctcccccgggcaaccgccacccctgggtttcgctgctgttagctgccgcgtgcggcgccgtcttcacattcgtcctgctcttcgtctggtactccatggggaagcgccgcccggtcgcgccggtggagtaccccatgcacccgtcctccgccgacatcgtctacgagaagattgtgctggtcggagtcaaggacctccctgccgatgtcaccgcagctgctcacaagtagccgctatcctctcctctagattctactgcaagtgtgctcctgtaactgtaagtaggaaattgttgctagcaagcgcggtggaaaatgcagattttgccggcaaacgcgtccgcgcaaattctgcacttcccaccgggattaggattcgattgctctttctaaattgtaacttgtcaattgtcatgttatccaccactgctaccaattcttctttgtatgcttattagtccatgtcctagtactattcaagagctctcttatcatctctaatggacagagtaacatgatgtttgttttttcggcg

SEQ ID NO: 2248 - DNA, 583 bp, Triticum aestivum
  Clone ID: PAT_TA_2248
ggtttcaaccacgcggcgcgccgaggaggatctcgtgggggtcaaggcagagccggtcgaccgagaggagcgccattcgacgcgtcttccgcaatatgttcgcctgcttcggccgcggccattcggcgggctcccacgcttcgtcctcccacatgaggcccgaggagatgaccgaggcgtcggatcactccgccgcgttcagccatggctcgagaagccggagcatgagctggaggctggaagacggccacgccgccgacacgatggtgcagagatagtcctcaactctgaaccgaaagaaaaaaaaaggttgctgattgcttctgtttcatgtttttatgtatttatagaagaaaagaaagggaacacgacgatttgtagaacagaattggtgttgtacataggagcagagcaacatctgctatattagttacaggggagagatgtccactgtgattctgaatcgagcatttggaacctaggtgatgaattgttttgttggtactagcaaacaatgtgtttgatgatttttgattcatttaattcaatttggcctggtctttacaaaaaaaaaaaaaaaaaa

SEQ ID NO: 2249 - DNA, 335 bp, Triticum aestivum
  Clone ID: PAT_TA_2249
agatggccgtggacgacgaggcggctgcggcggagatcggggagctcaagcaacggattagcggcggccgcttgtcgaggcggcggccgacgttggagaccatacacgaggagagctacgccgcgctagcatgctaatgctacaagtcaagtggccatctaacagaccgagagatggcaaaggccttctctcgtattcttttttcccctttttttgaccatgtgtaaatttgctgcctctttttcatgtatttttgagcgatgaaagggcaattgaacccaaaaatatggtggacaagtgattaatgaatcaaggagattcatcatttttttgtc

SEQ ID NO: 2250 - DNA, 725 bp, Triticum aestivum
  unsure (1)..(725): unsure at all n locations
  Clone ID: PAT_TA_2250
gtcatccgatccacccgcccccagccaggtcgtactccgcctcctcctcatcatcatctacgggattctgctcgctgcctctatcgcgaccttctcctccgtgccccaggccgcgcgaacgctgttcccctcctcaccgacgggatctcaaccgccggcctcacccgcgagagcgccgccacctaccttagagggaacggcgccaccggccgcaagatcatcacaggttattgggtcaatgttaggccccgggcggcgatttcatatgagcgaaatatgaaatcaataggacacctacgagactggttctgaaaaacagtaagttaaaggatgagggccgggctcctgtgaggcaacgcggtgcttaacgatggggtgctggggcggaagcaattggatactctgagctggagcagatggtatgcggtgctcgacgaccacacgccggagtgcgagggatgagccagatgctggagcagagacgatgtcggatcacggccgtggcgactgatcagctcgtgctcggcgctgtcgtccggctgcttgagctccttgcagtgccttccatcttgggttgtgatgtccaggcgcttcccttgctcgcccgcttttcttcgttgcaccttcacgggcagtttagtcttggcacttaattaggatggctaaattatatttgagtttcatttgaggatatttactgtagaattatatttttanaatctaca

SEQ ID NO: 2251 - DNA, 992 bp, Triticum aestivum
  Clone ID: PAT_TA_2251
ggaggaggtggacgatgacggctcgcgtccggacggttgggaattcaaggccgccccctcctctgatgccggccaggatggagccggacaagcggacggaggtggaattgagggtgtgccaaaatcattgggcggcgaccagaaagattggtcactatttactggggtcaataatgaactgaacctccagactacagatcatgtcagaaatcatgagtccacaggacaaagtgtgaagaccttcagctattctccagataatagttcatccatactcaacttgtacaaagaatctaaatttgtcgatgctgttcacgttcctcaaagttgttccgaaagtgtagtcagctcttctgatatgttctctagcaatgaagtgaactcttcgtttggaacagatgaaaaccattccattaaatcaggaagcgacaatattttggttgatttctaccataagctgagagaagaatccatggcaatgatattccggtataataaggatattaaggaggcccagaagagttctgcacattctgatggaaacaaaaaagagactccacgcggccgcgagttccaggaaatctgggagaaactacgagattcttcgctggcagaaggatttcgcatccacgcgcccccttcgagggatgagagtatttctggactgcttaacagtaccaaagaggaacacataaaggattttgagcagcactatcatttagcagagaaaatagcactggcacagcatgacatgagtttggcagttgaactttacaagcatagtgtgtcaaccctacataccttgggactagcatccaaagaggagcaatgcgattatgtcgccgcatggtacagtatgtttctttcctgtgctcaggaactgcagcatggagcagtgctttggcaagaatcttgtcatccgaaagtccatgatctagtaatttctgaaggtgcaaattggtttgttgctcttggggagatctacagagttg

SEQ ID NO: 2252 - DNA, 571 bp, Triticum aestivum
  Clone ID: PAT_TA_2252
tttttcacccgcgccatctcctggcgccgctgaccgcctcctcccggcgcgcctccgccccaccttgccttctcctggcgagtccttgccccgactccccccaatgaactgcccccgcctcctcctagcgtcgccgcccctgcatcctcctggcccgcagctgatctcgcctctttccgacgagagtccaacccgcaactattcgtcgcgctgccttttccatgtcggccgcctccttctcccccctccactacgcgccactgccgccgcccatgcgcggcctcgatccggtgccgccgcccaccactaccaagaccccggcccatcgccgcccaccagcacaatgcccctctgcgcacgaatccgaccttccctctgctccggcgcaaccttccatcccctccggtgcggcctgccctctcatccggtgtgccctcctccagcgcgcctgcactctgctccgtcggcacagagaccgagcacctcctcctccagcgagctcctccatccccaaacttgtccttgaatgcggacgctgcaccgcgcagattcctacccaccgttcctcctc

SEQ ID NO: 2253 - DNA, 1596 bp, Triticum aestivum
  Clone ID: PAT_TA_2253
aagccacaccaaccacacacacacttcttcaacctctcggcgctccagtcctttccgcctcactgcccctccggcgcgcttccttctcctccgcctcctcgacccgatcccactcgcggcatcctccgccgccgcggagcgatggcagcccgctccccttacttcgcccccgaggaaggcgcccggtgcatccgcccaggggagtcacctgccgcggcgctccgccggatcctggcgacgccaggcgcccaccaggcgccctgctgcttcgacgcgctcggcgcccgccttgtcgagcgcgcggggttcccgatctgcttcatgggcggtttctgtgtttctgcctcacgacttggattgccagatgttggattaatctcctatggagaaatggttgatcaagggcgtctaatcaccgaagcagtttcggttcccgtgattggtgatggagacaatggttacggaaattctatgaacatcaagagaactgtaaaaggatatattaatgctgggttggctggaatcatgcttgaagatcaggtggcaccaaaagcatgtggacacactgaaggaaggaaagtcatctcgagggaggaagcggtcatgcacataaaagctgctatagacactaggaaggagagtgcctctgacattgttattgtggcgaggacagattcccgtcaagctgtttctcttgatgaagcattatggagagttcaggcttttgctgatgctggagtagatgttctattagattcccgtcaacctgtttctcttgatgaagcattatggagagttcaggcctttgctgatgctggagcagatgttctatttattgatgcccttgcttcaatagaagagatgaaggcattctgtggggttgcacctggagtaccaaagatggcaaacatgttagaaggtggtggtaaaactcccatattgacccctgctgaactcaaggagattggttttagccttgtagtctatccgttgtccctaattggggtggcaatgcgtgcaatggaggatgctctactcgccataaaaggtggtggcgtacccccacctgccagcctgccatcttttcaggagatcaaggatactctagggttcaaccgctattaccaggaagataaacagtacactgtcccgcaagccgagccatcaatgccaactggtaacccgtagaaaggagcgaccctgttcaattctcaggagctatatggaaatgggatccaggtgtccactgagcgatcagtatccatttgctttcgagaatttgagatttgtgcctccgggcaatgaggcagagcaatcgcgtttatcctgaggcagacgattttagcaagttgtaaatgaggcggtgtgacgaaatgtttgtaaacgatgctgcttttggtgtcagcaaacctggattcttggtgtcactttcaataaaataaaccaactttgaggtagttgagaaatgtttctcaccagtgtttgtagtaagtcgaagaaaaatagtaaaaaattgtcggcatgacagatttactacattactgtatttaaggggggggctctttaaaggatccaatctaaattacgcgggattgc

SEQ ID NO: 2254 - DNA, 981 bp, Triticum aestivum
  unsure (1)..(981): unsure at all n locations
  Clone ID: PAT_TA_2254
ttcttaaaaaaaagatggcccggtggtcgtcgtgcatggcgctgctcgtcctcgccgtcgccgcgcagctcggcgcgtccgacctgtcgccgggctactacggcagcagctgccccagcctggagagcatcgtgcgcggcgtggtgacgcagaagatggacgacaccatccgcaccatcggctccaccatccgcctcttcttccacgactgcttcgtcgagggctgcgacgcgtcggtcctgatccgggtcgacgccggggaacccgacggagatggacgccgacgacaacaagtcgctggcgttcgagggctacgagacggtgaggatcgccaaggaggccgtggaggccgcgtgccccgacctggtctcctgcgccgacatactcaccatcgccacacgggacgccatcgccctgagcggcgggcccttctacccagtggagctgggcaggctggacggcctgagctccacggccagcagcgtggccggcaagctgccgcagcccaccagcaccctcaaccagatggtcgccatgttcagggcgcacgggctcaacatgtccgacatcgtcgccctctcagcggcgcacaccgtggggctcgcgcaactgccgcaagtccagggccgcggtgtacggcagcccggcggacgcgacgctgaacccaaagtacgcggngttccngaggacaaantgcccgccgacggtcgtcggaccgatgtgtaatggacaaagcangccggnntcttcgaaacaatatacggaactgcaagacgggggggctgtcnctcgacaagtctntanaaganacgaagcggcctcgnaacgntgggcaanaaanggcgctnaaccgggttctgcccatggaaaccggcgttcggtaaatcggaanangaaatccaanatggantctaatatggaaggatntctnatcttggtacggttaacngtaatagnctaatgcaagnanttacaattttn

SEQ ID NO: 2255 - DNA, 1346 bp, Triticum aestivum
  Clone ID: PAT_TA_2255
ccgaagcacgctccaccgtcgcggacgcacaagcgcactgcaccgacgccctccccgtcaacagcaccgacgacctcgccgtgctcgacgccgagcacgtgctctgggccaccgccttctcctacaccgactccatccccctccaggccgcccccgacctccgcctcgccgacgccacccacctccccgggggcgccgccaccctccctcagctacccgccagggtccccgtgctcccctccaagatcccctgcctccgccgcctcatgcgcacgctcgccgtcccgggcgtcttcggcgtcgtccagcctgccgccgtcagcgtcgccgccgcccccggcagcgtcgccgccgagccctgctacgccctcgccccgctgtcccgcctcctcgtcggctcgcggaacctggtctcgatcatcaccatgctcctcagccccatcttcgtcacctccttcctcgggctcgccgcccccttcctgctcgcgctggcgcaccccgagccgctgtgggagatgtccgggcacgacgcggcgctggacgcgctgatcaacagcgccatggtctcggacagccgcttcatcgtggacatcgccgtcagggagagcggcgacgttttccgggggataagctccctggtcgacgtcggcggtggcctcggcgcggcggcccaagtcatctcggaggcgttcccgcacctgcagtgcagcgtgctggagctcgagcacgtcgtcagcaaggcgcccgccggcaccagcgtcaagtacgtcgccggcgacatgttcgagagcgttccaccggcagacgccgtcttcctcaagtcggttcttcatgactgggacgacgagaagtgtgtcaaaatactgaagacttgcagaaaggccgttcctccaagagaggcgggagggaaggtgataatcatcgatatagtggtcggagcggacaagaagcacggggaggtgcatgccttgctcgatctgtacatcatgtttatcaatggcgttgagcgagatgagcaagagtggagcaagatcttcctggaagctgggtttagcgactacaagattataccggttctagggttccggtcgatcatcgaggtctatccgtgaaatgtttggtgattacgtacttttgtgtcgatgtgtgtgtgtgcgcatttaaattcagactttgacaataggttgatggatacattttcctatctacgattggggctatgtagactgtggagatattaataacggtttggctagaactcagctagctgagtttttagtttggcatcaatcaccatgtcagccgctggatgtaccaggcagtgattcgctctgaaaaaaaaaaaa

SEQ ID NO: 2256 - DNA, 358 bp, Triticum aestivum
  Clone ID: PAT_TA_2256
catggtacccatggatcaaccgaaggccgccttggagatgctcaagaggtggacttcaggaaacctctcagatgcctccttgctctctcagaggcttgacttcgccatataatccgtgctcgcgctctctgcgctagacccccgagcgctagacccccttggactagtgtaatgtatgcgcatataccttggtccctgggatgaacttaggtgatgagaagctcgttggtgaccatacatatgatatttccttgtatggtgctcgaggttagacgagcgtgtaataaaaggctttcagaggattgtggcgtatggataatggataatgcgaatgtctccaatgagtgacttgtggact

SEQ ID NO: 2257 - DNA, 1243 bp, Triticum aestivum
  unsure (1)..(1243): unsure at all n locations
  Clone ID: PAT_TA_2257
ccccccgcctcggcgcctccggcggccacggccgatctggctccctgcgggccttctcctcggtctgaagggttttgcccttggtaacggacttacagatccagcgatacagtacaaggcatacaccgattgtccttgcgatatgggtttactcacacagtcagaattttccaagatttctaatctagttgcagcttgttgcttttggctctaggcgtgcggaacctccggcactgtatctggcattcccccctttttcgttggctatggagtttgatgacccattaggaagatactcggatacaaaaattagttccacgtcaggaacccatgcgtgagcagcgtgtgacctctggcactgtacctggccttgctgcctattttgtttgcaatacaatattcagttccagccggtggctaagcgggagcttccatcattatgacatcaggtagccctgtgtggtgagcctatgctatgatttctctaattgtggagaagtttctcaacctgaaatctgtcagacagagcctaggagttggagacatagagtttgtttcatgcagcccgactgtctatcaggctatgctcttagattggatgaggaaccttgaagttgggatccctgaactccttgagaacgacatcaaagtgctgatttatgctggggagtatgatctcatatgcaactggctagggaactcaagatgggtagactctatggaatggtctggaaagaaagccttcgtgtcctcaactgagaagcccttcatggttgatgggaaagaagccggcgttctaaaaagccacgggccattgagtttcttgaaggtccatgattctggtcacatggtacccatggatcaaccgaaggccgccttggagatgctcaagaggtggacttcaggaaacctctcagatgcctcgggctctcagaggcttgacttcgccatgtaatccatccttgcgctctctgcactagacccccttggactagtgtaatgtatctagtggcgcatatgccttgggatgatcttaggtgatgagaagctcgttggtgaccatacatatgatatttcccttgtatggtgctcgaggttagacgagcgtgtaataaaaggctttcagaggattgtggcgtacggataatggataatgcgaatgtgtcatgaaaaatgtctcctatgagtgacgtggggactagttcatgcttcgccctatantggagcctatacgccncnncac

SEQ ID NO: 2258 - DNA, 410 bp, Triticum aestivum
  Clone ID: PAT_TA_2258
tcgtacagattagtttcgtcgacatccacgactccatcaggttccaccgttgttgggtctcgagcactgcatttgatcctgtcttattctgcagcaacgagtttcgaggtactggcgcggatcgcgttggtgttgccgcgcaggtcggcgcagaattcttccatggacgcggtgatcttctccaggtagtccttgatggacggatccatcgcttcaagttggagacgaacctgccgcacgccgcgggtctcgatgaattgcgccagatcgaactaggggaaggagtggtggctggtctttgataccagatgtgaggagctagatatggcggtgcctcgattactcacttgctcacgcaatatcggattcgagtctcaattacagttgctatacaagaatggagaaagggg

SEQ ID NO: 2259 - DNA, 941 bp, Triticum aestivum
  unsure (1)..(941): unsure at all n locations
  Clone ID: PAT_TA_2259
tctgacgcgtgggtttcaggactataccgccaagctatcttacttcggcctcgccaaggatgggcccaacggcgacgccacccatgtcacgacacgtatcatggggacacatggatatgccgcaccagagtacatcatgacggggcacctgaccgccaagagcgacgtctatagcttcggcgtggtgctcctcgagctattatcgggccggcggtccattgaccgtgctcggcgttccagggagcaaagcttggtcgactatgccaggccgtacctcaagaagcaggacaagctgcaccgggtcatggatccggctttggaatgccagtactcgtgccagggggccgaactggccgcacgagtggcgtacaaatgcttgagccaaaactcaaagttgaggcccaccatgaaagaggtcgttcaggccctagagcccatactcaagatggacgactacctacaagtgggtccattcgtgttcacagtcgtagtggaaaataccgagaaaaacgttgggagcaaaggaaagcttattggtgacgagtggaaggctgacatgaaggttgagaagattgtagaggacaagcagcagagccaccaagatcggcaccggcaaaagttcccaaactcaacgatacacgccgacattttgctgcaacgggatggtgccatcgggccttataccaccgcgctacaacgtcaccgaagagcatcaagttacaccgaggaaaggggtgcatagtgttgatcatcacagagcttagttaggaccgctgtaaaggagtaagagtagcaaaatggaagattgtacatatttgaactagatcctgtaggggtgtaacacaagtcacggatagtgaagctgggtgtaaatgccaaaagttttattncttttatgtttttttttgcgtatgctattantncttttcatgntgcagcag

SEQ ID NO: 2260 - DNA, 504 bp, Triticum aestivum
  unsure (1)..(504): unsure at all n locations
  Clone ID: PAT_TA_2260
tcttcacgcgtccggttttgcatatacttatataggtagtgtgcttagcttgtgagcagaagatacaccacgatggctccaccggcgaaactgacccagtatacccagctgatcctactcctccttgcagcagcagtagctagtgatcacttgaccctgcagcaggctgcggctgccgccgatgaattacaaggccgaccgcagcaggggctggggcgtccgggttgccgggacaagtgcggcgacatgagcatcccgttccccttcggcatggacaaagcccggctgcttcctacccggcttcgaggtcacctgcaacacctcctccactccgcctcgcgccttcctcgcctacaaccacagcgagccaccataccaggtgatttaccagtatgcattcggcactggggagtggggctacaagccaaatagaggggcgtcaaggcggtncnagctgttccaaaatatcaactcctagaacaagccanggtacgttgtgttaaa

SEQ ID NO: 2261 - DNA, 814 bp, Triticum aestivum
  unsure (1)..(814): unsure at all n locations
  Clone ID: PAT_TA_2261
gttctaggaatatatttgacaaaaccctaatattattcccaccttttcttacagcattctgtcggatccccataagaagcggcagtacgacacgtcaggattcgaggccatcgaaactgatagccaggaattgggagctggacctatccagtctcaataccgtaaacaccatgtttgcagctattttcagcaagcttggtgtaccaattaagacaactgttccagcaactgttttggaggaagcattaaatgggtctattgtggtttcgcagctccagctaggaaaccctgtgcgcaagaaggtggaaaggcaaacaggctcatttttattcttgtagacatcacagaacaggaagctaagaaggggctagtttgccgtgtgcattcaactgcaaaaaagcaaatttaagctgctttattttgagctcgaagaaaatggtgggttgagccttgcacttaaggaacatagtgtaaaagccagcaaagtttcttctgcaggaatgtattttctcgggttcgcaacgtatacgctagaaactgattgccccggatctttccctgctgaaaacgagaagcgactgagtgttgaggcaaagatgctcacaaaaagagctgagctgtctaaattcgagacagagtaccgtgaagtcttggcaaagttacagaaatgactagcaatacacacaggaaatgcaaacgaatgacgagcttcttaatgaaaggaatgtaattcatgcttcctataccaacaatccacctttaaaacgacttcnagcaggaataaatctaattcattaccttcttcaaatttgaa

SEQ ID NO: 2262 - DNA, 576 bp, Triticum aestivum
  Clone ID: PAT_TA_2262
gcttgcggctttctcacctcttcttgttttactcaccagtctctgatgttcgcaggccactacccacaagcattcgcatctggctgctcaattcggtgttcttcgtgaaagcaattgctcaccactctgctgcaatccaatttcttgtccttccctgcgcaccaatttccccatttttgcgcggaaaggttcaggcggccttcgatcgatttgatgttcttgcccaagcgctgaatttcttggggtttctgaggctttagaagcttgttagatcgacggagatgcacctagctctcagctccgatcactcagctgtctcgccggcgctcaggattcaagaaaccccgccgaatctgccgttcttgggcgtccaggctccagatccagcccggagcgcctcgtcgagtggcagtgcgggatccaagctctagcgcgcgatctccgagcgcccgcgcgcccgctgcagatctcgcgcgggagcggccaagccaagaagatgtcgcctcagccgccccgcgacctccccgaggacaggggggaggccaatgtgctcatcgaggaggccccggggtcgcc

SEQ ID NO: 2263 - DNA, 1491 bp, Triticum aestivum
  unsure (1)..(1491): unsure at all n locations
  Clone ID: PAT_TA_2263
gccgccccccctcgccccgctctcccctccctctcttgcgtgcccacccacccccctcacccccaccccccacccaaggtcgcccctcccccgccgcctcttcgccctcccctggcttccgcttgcgccgcgccaccccgcggccacacccgccccgctccttggccgacccccccaccactcatcgtcgccacgtgcgtcgcggtgtcttgggggagtcctcggatcagtttgcgctttgggatcttcgccgttgcttctccgtgcgcgcggccggccgcgcggcggcctctccgcctctcgtgcctctctgtgcctctgggccctgctgccgtgggtttctcttgggtgttcatcctttccagagatcacgttgagcagcgttctccgcacctttggggagacctttgcagacctcgcatggcgcggttggcgaggcgggaatcgcatccggcccaagcctgacggtcctcacagtaggtcgtcgcttgagggtgcgattgggctccctgtcaaggcggaatttcgaggcgaaagtctcaggcgtcccaagcctgtcgggccttcacagggggaaatcgcttgaatcggcaactgatctgcaggatagtcttgtcacaaacctgcaaggcaattgggctagccttcctcctgaattacttcgggatgtgatgaaaaggttggaggaagacgacagcaattggccatcccgcaaggatgttgttgcttgcgcttctgtctgtacaacttggagagagatgtgcaaggatatagtgaggaatccagaattctgtggaaagctcacctttcctgtgtcccttaagcagcctggatctcgagatggattgatccagtgtttcatcaaaagggacaagtcaaagctaacttatcgtctctacctgtcccttacttctgctgtgcttgatgataatggcaagttcctactgtcagctaaaaggagtcggagaacaacttacaccgactatgccatttctatggatcctaaaaatatatcccggtcaagtagtggctacatcgggaaattgaggtcaaatttcctcggcaccaaattcatcatctacgacacgcagccgccctacaatgccagtaaactctgcccgcaggaacggaccagccggcggttctcctccaggaaagtttccccgaaagttcctgcggcgaccggtagctaccccatcgctcaggtgaactacgagctgaacgtgctcggcacccgcgggccaaggcggatgcagtgcaccatgaactccatcccgacatcagcggtagaccccgacggcgttgtgcctgggccaaccgaaggagctcctcccccggctattcgaggaatccttccgcaccacagcaattccaggtacccacggacttcagcagtgtntcccttttggggnnnaaaaagggcctctgaganaanaaggcggcgatgaaaatgcnggggacaaggaaaacccgctggttctcaaagaacaa

SEQ ID NO: 2264 - DNA, 633 bp, Triticum aestivum
  Clone ID: PAT_TA_2264
tggctactacggcccgacgatcatcatgggtgcgatggatgagaggtcgctgacgttccacactaaccggcggcgctacggcccctacggcgacgagtacggcacctacttctccaccagcttcgccgacgggcgcgtcgtggggttccacggccgggagggctggtacatcgacggcatcggcgtgcacgtccagcggggcaaggtgccgtcgtcctccctcaggcgggccgccagcaggagcccgtcgccggcgccgcggtccgactacgacccgggcgacgtggacgaggaggtgccctacgcggccatggtgaaggagccggcggcggcggggccgggtccctggggcgggccggggggccgggcgtgggacgacggcgtgtacgccggcgtgaaccaggtgtacgtgacgcggggcgccctcatcggctccatccagatccagtacgaccgcggcgaccggtcggagtggtcggccaggcacggcacctccggccacatcacgcaccgggtgaagctggacgcgccgcacgaggtgctcacctgcgtgcgcggctactacaacgccgacccggccgaggggccccgcgcgctgcgctccatcaccttcgtcagcaaccgcggcaggta

SEQ ID NO: 2265 - DNA, 443 bp, Triticum aestivum
  unsure (1)..(443): unsure at all n locations
  Clone ID: PAT_TA_2265
ttgttcgacgcgcagcagcagtgcgtcaaggtccagttcgaggtggacgagccctcgtcctccgtcgactccatgatcggggccctcacgcgcctcaagagcatgaacgtcaagaccagggggatccactccatcttgtccggccagcggttgacgacggagatgaatgtcgaaaccacgattgcggcctgcgaggtagaaaaggcagtggaggaggctctccaaggaagtagagaggaatcagctgcctgacagcgaggccccgtttcccggaagcaggaccgcctggcctcaaacatcacacgtgcaaaatgtgtgctgagcggtttctgaccacaagggtcatgagaccctccgttcattggtttttcncccctttttcnctcctttttttccgatgatgggncaagtgaagatntcaaatgccttgccngcntangggg

SEQ ID NO: 2266 - DNA, 548 bp, Triticum aestivum
  Clone ID: PAT_TA_2266
tcttcttcccgaggcgccgtgtgcgcgccggccatggcgaccgcgatactatccatcgccgccgttgtcctcctcctcgccgtccaggacagccatggcgcgaaactgtgcatggactcgacgttcccgagggcggtcaacgggtccctttccttctgcggctacaacggcactgcttgctgcaacacgacggacgacgccgctgtccggaggcagtttgccgccatgaacatctcaggcacgccgtgcggcgacctcgtcaagtccatcctttgcgcgagatgcaacccgtacgccggcgagctcttcaccgtccggacaagccctcggacggtgccactgctatgcaacagcaccggcgtgtcgagccgtgtcagcggcgtggccgcggcgacggggtactgcgcgaaggtgtgggatacctgcaaggacgtgtccatcccggggtcgccgttccagccgcccaagggcggcgcatcggcgccgaagctcgccgaggtgtgggagtcagagggcgacttctgcggcgcgctgggcggcgagtccat

SEQ ID NO: 2267 - DNA, 1305 bp, Triticum aestivum
  Clone ID: PAT_TA_2267
ggatccaaatacttctcatcatcaaaggtcgacaccaaggaagacttcctttccagttccaacttctgggaaaactttgatttgcgaagagatcacattaaattttctgaaactgcagaagcttctaagtcgaggggcccatggttctacttccagattgtttgataatggtgtctctatattatcgccgggtactcgtgatgaagttggacagaatgtacagggttatgaaggttctgataaagttgctgcagcagaaccagccaatgagtgctccttacctgtttcaccaactaaagatggaaaccatggtgctgttgattctgtggacgctgcaccgaaggaaagtggaaatcttgtccaagaatgccatgttgcatctgatgttcatcctgatgaggtaccacaggggaatgcagatgaggtgcctcacgggtttcccgtgcctctctcgagtccatggggcggggctgtcggccgctcctgcaccgaatgacagtggcaatcttgtccaagaatgccatgctgcatctgatgttcatcctgatgaggtaccacaggggaatgcagatgaggtaccacatgggaaccctgtgcctctcacaagtgctacggaagaggctgccgaccacagtggagataaatctgtgcccgcagaaccagaaattcacgaagaattgcatatgaactcaacttcagaatcaagagcaaaggatgctgcccccccgcgcccggtgcggttccgccccccaatgatgagggtccccacgcggctgctggcgcctcccctgataaccccctccatcgggccgtgggatcggtctcacggcaactcgcggatggtatccccgggcaatgataatcccagctgcactaactcgagcagtgctgtgcctcccaacaataatgagttgatcaactctgcagctgatgcttcagctgataactccctcgatgagggccgtaggagcaagcatttgttataccaggtcgcagtgtactaatattaacgggccccaagaaggggcggtttaactagagctagtattcatttgatgggatatctcaggtaagtaacgcatcatgtacccacgcccgtatcaatgttgtatcactgtaggctagatgtgattactaggttcagtagctgctctcatccagtctcatctagatgtgatctgtattatcattattgttatttaggtagtttgtgaaagacggtagaacaattcttcatcactactactatttgatgattgacagtgcatgttatgcttgcatttgccacaaaaaaaaaaaaaaaaa

SEQ ID NO: 2268 - DNA, 748 bp, Triticum aestivum
  unsure (1)..(748): unsure at all n locations
  Clone ID: PAT_TA_2268
tcttttcgcatgggcggacgcgtgggcggacgcgtggcacacgccccggggcaaaggcagcagcactgcagcattgcgctagtgtcatagctcgatcggcgcaggctatctagctagtagcgtcgacccccgccctcccggagcgcagcgtctggcagggtgcgcgagatggcgccgccgctgccgagccgcgccgcacttgcgctcatcgtcgccgttgccgcgctcctcgtcctcgtcgtcgcagccgagctagacgcgggcagcagcacgtgggcagcggaggattacggcggcggcgccgtcaccgccatgcgggcggcgtgcagggtggaggacgaggaggggtgcggcggggaggcgacgctgcggaggcatctgggagggggcggctacatcggctacgacgcgctgcggcgcaacgccgtgccgtgctcggtccgcggcgcgtcctactacaactgccgccccggcgggcaggccaacccctactcccgcggctgctcctccatcacccgctgcagaggctagctatccacgcgtacctcgccgtcgccgccgtcggtcgactgctcgcccggtggttcttgtaggatcttgtaagttgtaagacatgttcgattgattttcttcttcttcttcttccagtcggtgatccttgtttggggtttcattataccggattcagtccgagaatgattcgttgagcaaatcatccatggntacttctgtaattggaggccatgta

SEQ ID NO: 2269 - DNA, 1294 bp, Triticum aestivum
  Clone ID: PAT_TA_2269
accggtccggaatcccgggccgaccccgccccccggcagagcatcccaacccccgagacaactctccggcccgaacacgctcccatctcttttctcgccgccgatccagccggggaaaattactaccccacagtcacgaccgcgcacggcgacggcggccacacagcataccccgccgccacgatgccgtccgcctccagcgccgtcccacccgccgcggcgccgggagacgagtcccaatcccagaaggtcctcctcggcaggtacgagctgggcgggctcctcggccgcggcgcctccgccaaggtgtaccgggccagggacctcctcacgggccgggacgtggccatcaagtccttccccaacccgcgcgccggcgcgcgcgacggcgagggctccgccgggtccgccgccattgagcgggaggcggccatcctcgcccgcctgcgccaccgccacgtcgtgaggctgcacgagattctcgggacccgcaagaaggtccacttcggcctcgacctcgccgccggcggcgagctcttctcgctcgtcgactccgacggccgcatgacggaggacctcgcgcggcattacttccgccagctcgtgtccgccgtccggtactgccactcccgcggcgtgtaccaccgcgacatcaagccggagaacctcttgctcgacggcgacggcgacctcaaggtcgccgacttccggctcggcgccgtcgcggacgagagcctccaccacaccctctgcggcaccccggcctacgtcgcgccggagatcctctcgaagcaggggtaccacccggccaaggtcgacatctggtcctgcggcgtggtgctcttcgtgctcgccgccggctacctccccttcaacgacgccagcctcatcaacatgtaccgcaagatctacgccggccggttccggtgcccgaactggttctcgccggcgctccgccacctgctgcgccgcatcctcgaccccaacccgtcgacgcgcatcgacacggacggcatcatggagcacccctggttccgccacggcgcgagcggtgacggcgagctggaggagctgatgcgcgggcacgaggaggaggcgtggttcaagacggagttcaaggaggacatggcgcgggacatgaccgcgttcgacatcctggccttctcgcccggctcggacctctccgggctgttcggcgccgggccgggcacggagcgggtgtttcgtgggcgagcccgccgcggccgtgctggcccgggtcgaggacgccgggaagaagcaggggcaccgcgtg

SEQ ID NO: 2270 - DNA, 619 bp, Triticum aestivum
  Clone ID: PAT_TA_2270
acctgttcaaatcttgttgagctatcctgaaagcattgttgaattggagcagcaagaaccaggaacacctgaaccaagagcatcaaccaaatttatctcagattgttcccccgagttaagccatgacaaacaagaacagcccagtcctatatctgttcttgattcattctatgaagatgttgcagatcctgaatgcgaaaacattaaacaatgtgatctgcatgaagaattgcgcggagccctgtacttcccagataacgaatcaaatctcctggcctccggggaggacaagagcgtccggttggattatataaagttggttttggtgctctcacaattatgtgctgaacagaatttagaggtatggcatctggaggatgagttaatcagcccttgcctgttggaagaactaccgaaccaaggtgatcaaatagacgatctgaaaattctgttcgactgtatctgcgaagctctaacagagatccaggagagatattttagactctcttcttggttgtcgtttctcaaacacgacatacgggcacctccagtgggagaagacctcgtcgcagaagttgacaaatatgttgacgattacctccgacatagttttcaaagg

SEQ ID NO: 2271 - DNA, 422 bp, Triticum aestivum
  Clone ID: PAT_TA_2271
tttgacgcgtggaaaaaaagttcgcacatcaactatttgaaagggcatggcatccctttcatttagtctgttattcttatcatctgctttcctaaccacgaaactgagactatgtattttatttgtcctttttacacacccttattgtgttattcactcccttttagttgttgatttatttgaaaatgtattgcttgccagcttttgcattgtcattatcttgaaatcatcttaaatgtgtgtgtgaactgctaacttggttcttcctcccggatgtgattccttagacctttcatcatcatattcatttcattgtatattgcaagactcgcattcaaatgttgaatttgttattcgattgttcttgttctggcattttgattgaaaaactggaatcctttgaaaacatccacccaagccca

SEQ ID NO: 2272 - DNA, 550 bp, Triticum aestivum
  Clone ID: PAT_TA_2272
tttttacgcgtgggtaccactggtgagaccatttgctctttacgaccaatactgcatcgcacacattatgtgtgcgcgctgacagctggatcgagcattggaaatatccaacatatgatcacaaagaattactattatcccattcctccgggaattgggcgcacaactcagagcgctcaaattggatatggtaaagccactgtagcggcttatggctacaattggaatgcaaataatccaatagactggatttccgatatgtttgtcggagtccgagggtctacggttttgcatgccaatgttgtgggacaaagcggtaacacagtccaggtgaattccttttctgctgcacgtgcttatgtcccactgcccaatcttccgggaaactccaatacgatttccacttcggtttccgtcactgctggtctcattaatgacatcagtcgcgacgcattatcgaatgcaccatctaccggaagtgggctcagtctcactaactgtgcaacacagtcagctctgtctgtgaatgttcctcagtttttaccacacc

SEQ ID NO: 2273 - DNA, 599 bp, Triticum aestivum
  unsure (1)..(599): unsure at all n locations
  Clone ID: PAT_TA_2273
gcctctcctccccttgttggcagcaccttctgcccatcttggggagcagctctcacagtttggctccgcgacgaagaagctcctaagcctgcgtggcgacggctgacactggttcgtgccagcttcctacaggttttcagccagcacggtgcgatgtcaaccaccatgaggaatctgcgctcggcgcggttctgctccgtggtgagagacgggatctacaaactgaatctggctcccccgttagagaaccgtctcatgttactcgactcactggcaagaaacagatcggtacagcctagttaccgactcccccttcttacccaatataagaactttttagagtactgtcgtgagaaacatgcgctgcacgccggttccacccaccatccccctcgaggcatggcatacccctccgttgtgcaatggacaacaacagcctccggtcaggtcctggatacatctccgccgtccatcggacatcatggcgcttgggtctttgcctggcattttccgtcctgctaacccagcttgaaatcggttgtaanaangnatgggaattaattcgttcntgcaacaacctgntttaaagtatttagtta

SEQ ID NO: 2274 - DNA, 334 bp, Triticum aestivum
  Clone ID: PAT_TA_2274
tccacgcgtccgcgccgtctactgagtcactcctcgctcctcactcaacggccagcatctctgtctcgctggaaagaaagccttcaacatggtggccaggaccagagaccagacagggaaggaggtgctgtgtgctctacctgtactgtaaaagattcatcccatggccgcggagtctgcctggtgctggccgtggctcagctccggcacggcgtggttcctcttcttcaacgtcttcgtcggcgccgtggccgtcctgtcctggcggcagggcagcgacccggagatgtcgaggcggaggaggctcacccggagcgcgtcgtccatggtcatg

SEQ ID NO: 2275 - DNA, 609 bp, Triticum aestivum
  unsure (1)..(609): unsure at all n locations
  Clone ID: PAT_TA_2275
ttctcctactctcctctcccatccctccccccccctcctcgccgcaagctctaatccccccaagattagctccaacgaacacgaattactgtggattagtgcgaggctttggccgcggcaaatctggggcggggcggttggaagagtcgcggccgaattgtttggtcgagcagatgatgacggcgaacgcgaaactccagaagcaggcgctgctgccgccgcgtagcccgttcccgacggcagcgtcgccgtccccgtacgcagaccatggcccgatcgcccggccacagggcgccacgcaccaccgctttggccatggccacggccatgggcatcaccagcgcacgtcgtctgagagcatcattgaggagcagccgtcgtggctcgacgacctgctcgacgagcctgagacgcccgtgcgccgcgcggggcaccgcaggtcgtcgagcgactcttttgctctgttcgacggaagcgctgcctccggcgcatttgccaatggttttgaggagatggggggaggagggcaggctgccccatggggtggtgtgcnnnagtactatgccaagccaagctcatacgngnnnctgcagggccggccgtgggaac

SEQ ID NO: 2276 - DNA, 524 bp, Triticum aestivum
  Clone ID: PAT_TA_2276
cacggatctggcaggcgctgggctgtgtgcttcccgctcggcggctgtgccctggtggcgcggtgatggcctcgggcgtcccggtggtgcgtgcacggaggttctggtggctccgcgtcgacgctccggctcgtgcggtcggtggcgtcacgggcatcctgtgtcgctcggctgcggggatggtccgacggcggtggcctctgtgcggcgcgggtggtggtcccaggcggcggtgcttccccgggctcgccccgatctgtctccgcctgggtgtgctgcggcatgcgcagctggttctgggcggttccgtctcagatccgctaggggcgtccctttcctgcacctgctgcagctcggctccccctctcgcttgcgtgtgtacggcgtgggtgccctggagcttcccgttctggcgttggccggcgtggtgccgggcgatgctgttggtcactacttctccggtctattgacctgttgcggtagcgcaggtcggcaggtctttggcatgcagatggcagccatgg

SEQ ID NO: 2277 - DNA, 887 bp, Triticum aestivum
  Clone ID: PAT_TA_2277
gcgcgcatatataccatacctgtgatctgccacaacccccaccgagatgctgtgtgtgtggacgacgctgctggtcgctccaagcacgggaggatccatgggcgtggtgcgagccgtgtgatccacaagagtgtgcgtgcacgtaaggatgtgcttcggctgccgtgtccccgccaagctctggtggtgagagttcgaggacaggccgcgcacgtacgtacgtgtgatcagtacattccatactgctgtgccgcccgtgtctagcttcttgccggcggtcgacatgtggggcgacgtggtggcgctcgtccggcagggcctgcggtggcggcggcgcagggggaggaggtctacggcgcgggtggtggacgagagcgcgctcggcctcggcgatgccggccccgcccgcggcggtggcgccgagcgtgggcggcgccctggccagggcgctcctggcactagcgtgcgccgtccgcttcgacggcgaggacctgccgacggaggaagcctgggcggcgagcgtatggcggccacgggccgacgaggtcagccacctcatggtgcgcgagagcatgcgctatgccatctacgcgtaggattgtgtaagtatgtacgattggggttgcgtataactagctgtgtatggtgtataactagtagagtattagagtgatgtatcttggatgtacgtaaaggtcaccaccaccaccgccaccagtccaccaccactactagagagtagagatgccatgccgattggcttctcttagcctatgttatgtactgtagcgttctcggttaatctcaacttctgaaggtcactgcaatttactctacatgtcaacaaagatcatctcttccttttttttaaaaaaaaaaaaaaaaaa

SEQ ID NO: 2278 - DNA, 714 bp, Triticum aestivum
  Clone ID: PAT_TA_2278
gaaccatggtagaggccacatgggagcttcactagcatttgagatgagtatgtcctcccgctgtgggtttctcactgctcgccggcgtgggggtgccggttcatggccgcagtggccacctgctctccgcttgccttgttcttgcccgggccgcccccccggtccaccctcccgccgcggggctcggctttggggcttccgccaggtggccggctcgccggctgcacatgtcgggtgccttcggaggggccagccgcccctcgtccagggcggctgtggggccccggccatcacggcgcgggccgcgcccggtgccggagggcttgcagttcgtgctcaacactttaccggttgacccaagctgcattggggatggtgatggcttcactgctcatgtgaaggagatggcaggtgatacaaacaaccgagatccaaagcaataccgaataagaatgagagggattgatgcaccggagctgaacatggaatatgggaagaagtcaaagaaagggttggtgaagcttattggagagaaatgcgttgagattcatgtgtatgggatggaccactttgatcgatatattggcgacatctactgtgacggcgtctttatccaagaacaaatgctgaaaaggggcttggcctggcacttcaaaaaatatgacaaacgtcctgaattcgcacaatgggagagagaagcaaaaatggcacgtg

SEQ ID NO: 2279 - DNA, 524 bp, Triticum aestivum
  Clone ID: PAT_TA_2279
ttcggcacgaggcgccgccgccctcccctgtgctcgtgccctctcctctcccgccccgagctccactgcctccagcctacgctcgcgctccgtcccttcctcctcgttggcgctcaatcggacgagcgtgagctgcggcaaacggcagcggagggaaacgtggatgaggagatcaagccaagccggaggggacaactggtgcacgagctcgcactgccctggcgccgatctcgcgccggtcctacgccctgccaccctctctcgggacgccatggagatcaacaaggtgcgcccccacccccctccctctgtcggggtatggtaggttcgtactgaccgcctccggctcgagcaaggatctgctgcacctccggccccttttgcttgcagattgaggagaagagaacacatgtagatagttcatcaaagttccttaactgcggctgatcttcttcgtcagcgcccgcaatggccacctcggcacaaggaacacaggttgcagagatagacgtgcgggctgcaga

SEQ ID NO: 2280 - DNA, 713 bp, Triticum aestivum
  Clone ID: PAT_TA_2280
cagtcgcaaggacaaatatctcgattggcgcaagagggtacttgttgcaatggatgccgccattggaatggaatatctgcactccaaggacattgtccattttgatctgaaatgcgataacttgctagtgaatgttaaggatccctctcgtccaatatgcaaggttgctgattttggtttatcaaagatgaaacaagccaccatggtttctggtggaatgagaggaactcttccatggatggccccagaattgttgacaatgagcggcaccaaagtatctgaaaaggtcgatgtctattcttttggtgttgtgatgtgggaaattctcactggtgaggatccatatgatggcatgcactatggaggagttatagggggcattttgagtgacacactgaggccgccagtgcccacttcatgtaacccggaatggaagaaactcatggagcaatgctggtcaactgagcctgagcgaagaccttcgttcactgaagtcgcaacttgtcttcgttctatgctgcaagcgcaaaaatgaatctcagttaatatgcaagaactgaagaacaccactctatgcatgcttgtgtatatatatatccttcttgcacatgatcgagacaaacatgaatatttgtttgagtttcatatctgctttgttttgagaaaagtgtatattgtggtccctcaagtttacaagaagtagacatcggatc

SEQ ID NO: 2281 - DNA, 552 bp, Triticum aestivum
  Clone ID: PAT_TA_2281
ggtcatttctccttcggcggccgccgcctgttgttccccttccgtgttcatcgtccgtctccaactgatccgcccggcgatcgtcagatccatctgagaaaatccgctccagttaaatccaatccagatggagctagctaggatggatccacccggcgtcgagctccccaagagctgcctcctcgctatcaagcctgtggtcgccgattccaccaacgccacctaccagacggagcacccggatgactctcgcgcgatctccattcaggtgcaaagggagacctggaatggctaggaacgcaccgtgaacagcaaggcggcgtgggagcttatgatgcggatcacaaggagctggaacatgtgaagccgtgtctgatttagtttaacactgatgaatgcctacatcgatttgcattgtgtttgtcaaagtttgattgtgagagttttattaacatattggtgtgcaccgatccaggattgttgttatatggaagaaaaaccaccgacattgtgtttgtccatcctttatgtattaagaggtttcagtactcg

SEQ ID NO: 2282 - DNA, 905 bp, Triticum aestivum
  unsure (1)..(905): unsure at all n locations
  Clone ID: PAT_TA_2282
gcagnagactgatgctcgtgctctgctttggggcttttgtcgctcttctctaaaatactaccccttcttatcttcaggttcttgattggattacgtattttgcgcactttgttggtgccatcttccttgaggcgagagttgataatgatatattgccttgaacgtcctacaaggaagttgctcctgatgcctgtaaaaccttttgaacctaataaatcatgctatgtatgctctgagacccctcttctgctggatgttagcactaaggcacaaagcttagggaggttattgacaagattataaaaattaacttggaatgaacctcctgttgggaagtttgatgaggagaaagagactgacggaatggttttatctggatggtctgctccggtggagaaacagattaatagcaacggggagagcaagtcggcagcttcttcatccagtgcgcatgccactgatgacaccgttgaggatccatctaaacctgggatgaagcgcaagctggatgaactgttggaaacaaaggaaaactgtgatgcatccagtagtgctcaggttgttgaagacgatgatgattgtgtgatgcttgacgggaacccagcgttaatcaagaaaaagagattgcaatagcagtcgatcctgtcttgctcgtctagagataatagctgttgacccctgctgtcatggctaactcattgttccaacgtagcatctttggtaacttatctatgtggtgatgtgctgatgatgatattgagctatcagtgactacccctgggacatattttttggctntagataccgcgccgtaggaatgtaatttgtagttgagtttgtaggcacaggagcgactaatgccctgctgacagtcagctgtaagggtaaaatttgtgtttctctgc

SEQ ID NO: 2283 - DNA, 1615 bp, Triticum aestivum
  Clone ID: PAT_TA_2283
aatcccttccatcccgcacccttcgtctaatcgcccccagcccatggaggattccaaggggagcgacggcggcggcggcgagaggcccggcgccgaccacaaccctagcccggatcagcccccgccggtcgccgctcccggaggaggggacgatgccgctgcggctgctgctgctgcggcggccttggccgaggacgaggcgcggcgcccgttcacggccctcagccaggtcgacgccgacctcgccctggcgcgcgtcctccaggagcaggaacgggcgtatatgatgctccggatgaacggagtcggcggcggcggcggccggggcgacggctactggaacgccgggagctagaggtacgacgaggatgccgaggaggactacgaggaggagctcgagaaccacctccgcgtccaccaccacgagcacccaggcggtggcgaggttgatggggacgatgatctcgaggctgatggcgagggcgagggtgagggtgagggcgaggatgaaggcgaggatgacggttctgaagagagcgagtacgaggaggaggggtttgatgaggacgaggaggtggaggatgtggatctagacccggcagagtacgaggacgacgaggcttatgcacgggcgcttcaggacgctgaggagcgtgaggttgccgcgcggcttatggctctcgctgggatcagcgattggcgggccgtggagcatgttgaggatcacataaacgacgcccatttttgtatgcagaaggagtcatgtcgattagaatacaatccagcatatgctcttgctgagcatttggaatcattggcttaatgaactactgtcctcccaataactatttatgattggattagagcttttataaattttatattactgcttctggagcaaattctcatttataaatttccaaaaaaggagttgtttttaatggtagacagggtgtctcttcactctcctgaggatgagcatctgagattatcctgttgggattatcgaccggaatcttgggttcatggcaagagattgatccagatgagtactcatacgaggaattagttgcattgggcggagtggttggtacagaaagtagaggtctctctgctgatacacttgcttccttaccttcagtaacttacaagacaaaagatatgcaagatggcaacacagaacaatgtgtaatttgtcgtgtggaatttgaggaaggtgaatctttggttgcacttccctgcaatcattcataccatcctgactgcattaatcagtggcttcaaataaataaggtatgccctatgtgtagcgcagaagtttctacctcagcaagcaagcaggcatgaccaacagtcgttggtaaaccaacttcatcttcagaaaagaaaagaaaaggaaaaaaccagttgttggcacttggtaggagtatgtagtggcatcattctagtatccctgatgtttaaaccaaaagcaaggcagcagaaacttctacagtacaaacttgcgaggggaccagggacatggagcattttttttatgccttgccgctgatgctctgcgttctcttactcttgtacactaactgtgttattaccgtcgatcaattttttcttt

SEQ ID NO: 2284 - DNA, 569 bp, Triticum aestivum
  Clone ID: PAT_TA_2284
ccccgcgtccgtctccctccccaacgcattgggcaacccaccccttccaaccctctcccactgattcgctcgccgcgcccgcgcgagatccagccgcgccccccgccgagatctcccggcggatcactaggacggcgccgccgaggacttcggagccatggaggcgtcgtcctgggacgcccttcgcaagcaggcgaggaggttggaagctcagttagacgaccaaatgattgcataccgtaaattggtttctatgaaatcggatggttcagagaatgatatcgagactgatatagaaagatcactaaagcaacttcagcaagttaattctcaaatgcaaacctgggtatcatcaggaggctcggaagttctatctcatacattgacccgtcatatggagattttgcaagacctgacgcaggaattctatcggcttcgatctagtctcagagtgaagcaacagcatgcttccctccttgacttgagagactttgacagagcaaagttcgacgtggaagagtctggagactcagaacaagctcttcttagagaacaagctgcaatcagca

SEQ ID NO: 2285 - DNA, 2079 bp, Triticum aestivum
  Clone ID: PAT_TA_2285
gcgcacgcgtgcgtaaatggagcagatgactgatgctcgtgctctgctttggggcttttggcgctcttctgtggaatgagctaccccttcttatcttcagggtcttgagtggattacgtattttgcgcactttggtggtgccatcttccttgaggcgagagtggataatgatatattggcttggacgtacgaggacgcgtcgggagagcccgcactccggaccttggttcccgacccgcacgaccgcttcccacaggagtgcgcaacccacccctctcaaacctcttcccccgcttctcgcgcgccaccatcgagccacgccgccgccagagctgccgcggtagaccgactacgcagtaggacggcaccagctgggactgctgcgggcgtggaagtgtctcgccgtaacgacccgggcaaggaggcaggaagctcagtaggtcagctagacgaccatataactgcatacggtcaatctgatactaggatgttgaggagcttggaaactgaattggaaaacaaagatagctaagacgactccagcaagtccatgcttgttgattaacatgatgataatctgggggttaatcagggcgattccgtaaattaaatcgccatatagcgatcccggcagatcgtgtattggaaatctatggggtacgatttttacccggagtggagctagcgcaagcgtgaatccatggcatgatattctctaacacttgaaagtgctgcgaggaagagtatgtagacgtagaagaagctcttttcagagaacaagctgctattagcagaaatgccggaaacatggagaacgtgatagcagttgctcaggcgagactgggcgatggcatggctcagcgttgatggtctggttgggtgaagaatcagattaatagtgtcaggaggaacaaatcgacaacttgctccttccgcgcgcctgcccactaataacaatgtggtggacccaacaattcaaaccttggtggaagcgcaatctcggtttatcttgtggaaatacaggagaacaaagatgtatgatgtcgcgcccaggtaataggagtcagtggatgtggagtgtgtatcgaaggggacgtattgtttgtacttacctcgaaatgttaatagcaacctgaatgctcttttcgtcgagttaaagaaaatatgcagtaacttatttttaatgcaaaaagttttttctaaaaatgctatcaggactgataaagaaacatcagtaaaccaacttcagcttgtaaaatctcaaaaaaaaacctgggtatcatcaggaggctcagaagttatatctcatacattgacccgtcatatggagattttgcaagaccttacacaggaattctatcggcttcaatctagtctcagagtgaagcaacagcatgcttctctccttgacttgagagactttgacagagcaaagtttgacgtggaagagtctggggactcagaacaagctcttcttagagaacaagctgcaatcagcaggaattctggacaggtggacactgtgatatcacaagctcaagcaacactgggcgctctcatgtcccagcgttcaacgtttggtggcatcactaccaaaataagcaacgtcagcagccggatccccacgattaaccacatcctcgcgtcgatcagaagaaagaaatcgatggacacgataattctctcgctcgtggcgtcggtctgcgcgtttcttatgttcatctactggttgtcaaagtagtaggatgtggttggccacagcgaaaaggcatcatagtgttgtaagtttggatcacagtgccggtacagataatgatatgatgattggtgtttgtacaatattgattcaatggtattacgttttcacatcgctcctcagcctcattcacctgttgtaccttttgtgcatataatataataaataaaaatcctatgtatgctctgagacccctcttctggtggatggtagcactaaggcacaaagcttagggagggtattggcaagattataaaaattaacttgggatggacctcctggtggtaatggttggctctacacttggttttgatgatgctgat

SEQ ID NO: 2286 - DNA, 435 bp, Triticum aestivum
  Clone ID: PAT_TA_2286
tttggccttcttcctctcgaaagctcttctgggttccagctcccttgagagtctccctcggtggaccgggctgatctgatgcccttctcggcggcgatgccggccggaagaggctaaggagaggcgccggatataggtctgtacatagtagttccaataaaagtagtttagtgatgtgtttcaggagtagtagtgcctccgtggcgactggcgtgatgtcgtcaggaagcgtgccgccggcgtcttcgagcaacgctcggtggcttcaggttgctgccctgctgtttctgctgttctggggagagctagcacatggcggtggcagagctgacgcttccccaaataagctcggtgagttccctgacccggcggaggaccctctcgtcgttcttgtctctggcggccaccacggtggtggaagcagggagaaggcga

SEQ ID NO: 2287 - DNA, 674 bp, Triticum aestivum
  Clone ID: PAT_TA_2287
gaccccgcgtccgattgcgattgccgcgcaccacacgacctcgccaacccctcttcctcctccctctctcttcgcactaaccaatccgagtacaactcgccgtactcgcacgcacacataggcagatccaatccgactgtacaaaagcgccgccgtccgccgctcacgtggaagagggagagggagcagcggagaggagaaggacttccacgactacatgcaacctcctggaacagtctagttcctaaatccttcttccattctggcagatatcaagagatcattcaggtctcgcacctctgagtgggtgtggatttgcaacaattctgcgatcaacttatcgctgcctctgggagtaatcccatcatacatctggagattacggcgagcactggagggactttttgttgattacggttaattgaggaaagcagctgagatgtaacaatttttttgagctgagctctcttccaagacaggcctgtgatttagcaatgtgattggatcaactctgtttttggatctggtgttagctcagttgacactagagttgacttatggttaggtttttctgcttttcatcctctactacacaacagaaaccgaaggaggcctttctgctagcagataagaccatgctcactgtttcaaagaaagattctcaggaacaaaca

SEQ ID NO: 2288 - DNA, 697 bp, Triticum aestivum
  Clone ID: PAT_TA_2288
ggttctgataaattgtgctctttcaagaccacccctggccgtggaggttacataaaggaagtggtcatctcagatgtagaaatggatggtatccgtgtggccattgaattcataggtaatttatcaagccatccagatgatgattttgatccctctgagctcccggtgattgatcaaatcacccttaaaggaatatggtgggaacaaacatctcggttgcaggaattttattgggaattgacagtgatccatttactgcgatttgcctttccaatctcagtttctcgataactgattcgctccattctagtccctggtcttgttcccaatgtttctggatactcggaatcggtcttgcctgagccttgctcggaactgtatgcaccatcctcaaattcttcaatttgcttctcccttcctagttacagtgcacttgatgtggcatagtcacatatatattcttgtgttcatacttcgcttttcttgtcgcagtccttgtacaattcagaaacattaaaccttcaccaccatattttttctatttttttcccaataaatgtgtcaagaagaatcatatcagggtacaccacaagatgcataatgatcatgaggaagaatcaagtggggttgtggacagctatgtgcttgcttgtacagctacatttcttcattcaatcagtaagaaattttctttttg

SEQ ID NO: 2289 - DNA, 1003 bp, Triticum aestivum
  Clone ID: PAT_TA_2289
cacatcaaatcacgagagtgattcgtgtctaccttactacgtaaattgtctttcttcattcagtctgccttcagggtgtaaaaaatctgaaggtcatagtgatgcacaaccatccattgttggtgatttcgatggtatggctaggtctagccaccctagttatgtatctgtagatcaaggcaccagaagagaaaaccatgtgatctgtaagacaggagacaattccgaaaatggagtaacaccaggtcaacagggaggtgtttttcttggcaaaagaacatttgaacccatagtgttaggcagagacttcgccgggcctgttgtgggcatgaatgaagattctggtaagaaagtttcaagcaatgtggacgcagctccaattgcaaaggctaggagtttaacaaaagagagtctacaaggaaatacttgtgtccataaagctgtggcaacattggaaggtctgtactcggagatgcctgtgaagataggtctggagcatttatcccattgcagtgctggtgttgaggagtcggtgaagatatcttcagataaagttaccagcagatccaagactcaggaagacttaatcaagtcaatttataatttctcagtagtgcttctatctacttgcgatggcggttatgagttggaggaatctgaacatgcacttgttcaatctacaatacacaatctcagttctttgagttccaagataagcaaggctgcattaaaaaatgatgatgtaaatggaaactgctgccaaacaaaatcagatacaaggtgccatggaaagaatcatcagcctcagaagtttgatggacttgactgggagaacattggtgcagattttaaaacatttattttggaggatcttactaaacttccagaagagaatgccattggtgatactaaagatgcgcaaatgctgatatataagaatctatggattgaagctgaagcttccatgtgtaaactcaagtatgaactgcaacttgcccgcatg

SEQ ID NO: 2290 - DNA, 1360 bp, Triticum aestivum
  Clone ID: PAT_TA_2290
tcttttttctttaaagaaatgatcatcctcatcttcatatatcatggcaatttaaagcttgcctcgtacctctttacttctactaccaaatgttatgcttgcctagactttttctttggattaaaagaacatgtcgatcttcatgtgtcattgaaattaggagcgtgcctcatacctcgtgaattcaactaccagtacgtatgcaaacctagactcttgcacaggttggcattaacctcacaactcccaggagaaaatgaaaaaaaaaaggaaccaaaattcaaaccggctccagcccttttatggcggcgtttcttccatccaaagaaaaaaacttggagaaaggaacataaaataaaatgaaataaaaatgaacccggcagaggcagttgtcgactcgacgtcggtgaaggtgtccaggaccagctacaccgtgcatggccccgcgacctgggtggcggccgccctgtcgagggagaaggtgggcaggggcaggctgctgggaggcggtgcgagcgcgtgcagcaggtcctccacgaagccccgtgtcacctcgcgctccaggtcgtccagcgcctccgtgaccgccgacgtcgcgggcagcggcgccgccctcggccgcggcttcctccgctgcgccctcggaggctcctctgcggacctcggtgtcctcggcttcttgctcttgccctccagcatcttcctcggctccgacaccgtcatcccggtcgccgtggtctgtttgaccttggtgacggcggccggacgaggaggcggagtcaacggctggtatgggaacgtggcgtgcttggccctggtcgccggagggcgcggtgggagaccggggtggttgaacggcaggggagggagagagccacacgagtagaagttatacggcgggtatagaaatggacccggaggagccgaggaataagggaagaaaccgtaggcgctcggaggcaacggtggcgagctcatgggggcgaccctccggccgcctccgccggcagacctccggcggaagttgtggccgcctgctgatcggtggacgagaacatcatccatatccaatctaggagagagagagagagtacgcacggccaaacaatattaggcaagaaggaaattctactaaaacaacatgcagaagttttccagcaagttgatcataaaaagattgatcgtgcaaggatgttcaacggaggaaatgaagaagatgatcaagggatctaacagaaagaaaagaaaccaagatgtaaaatagagatagacagtcggggatcgagaagggaaaccggccgaggccacagccgctctctagagcagagagacgtacagtccgatcacctccgcctcgtgc

SEQ ID NO: 2291 - DNA, 489 bp, Triticum aestivum
  Clone ID: PAT_TA_2291
cacgaccaacgaggcaacgaccaaacgtccaaacccttccccctccctagctccgtgctccagcgggagtccgcggcggcggtgaagatgattatcccagtgcgctgcttcacctgcggcaaggttattgggaacaagtgggatctatacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttggcagtatcatagagcttaggtagtatgttgtctcttctctatcagtagaaatgggttgtgagtgtgaacatgcttttcaaggacttttcatgcgacagtgcttgttgccacctatgcaacgatgttggatattttaagtgatataattgct

SEQ ID NO: 2292 - DNA, 585 bp, Triticum aestivum
  Clone ID: PAT_TA_2292
cggacgcgtgggcggacgcgtgggggccactcgtcgctcgtcaaccctagccgccagcgacgaggccgtcccgacgccgccatctctcgtcgccggtgaacttcgtccggcgaccccctcaccaccccgactaccgtctggtcctcgagccgcccttccccgacaccgcgagtccgtccttcttcccaacctgccagcagccgacccctgccgccggcgacgctgctcttctcccccgccgtcgccacttcagaggctcaagcggcggcggcaaaggcggaggcagaggatccaagatgatcatcccggttcgctgcttcacctgcggcaaggtgatcgggaacaagtgggaccactacctcgatcttctccaggccgattacactgagggggatgctctggatgccttgggtttggtacgctactgctgccgccgtatgctcatgacccatgttgacctcatcgagaagttgctcaactacaacaccctggagaagacggagacaagttgagttaattgaacccattctgcctcgaaacccttggtcctttgtagttttcaagatggatggtatgctgtttctt

SEQ ID NO: 2293 - DNA, 690 bp, Triticum aestivum
  unsure (1)..(690): unsure at all n locations
  Clone ID: PAT_TA_2293
cccacgcgtccgcccacgcgtccgcccacgcgttcgcgccggctggccccaaaaaccttgttccccttccttctccagcggcggcggcaaaggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaagcctttgttcctttgtactttccaagatgctgtttcttatgtcagtgcttaggaggtgcaaaatgcgaggtcctgaaatgaagttggtttgttcatgaatctccaaggactgttagtgtgaccatgcgtttctactatgtgatagagtatattaaccaacaagtctatgcattctccagtttcaaacttattaagctccaagcgttgaacatgttattcctgtgctttctgttggatgttgttggttgtgggcacccattatcttaacattgaatcgtcactagtgatatgcattgaacttccacaaaaaaaaaaaaaaagggnnnnnnnnnnnn

SEQ ID NO: 2294 - DNA, 881 bp, Triticum aestivum
  unsure (1)..(881): unsure at all n locations
  Clone ID: PAT_TA_2294
gttccccgtccccgccttcccctgtcctgccccgggccacgcgccgtccccggccccggggcggcagccacgcggccccgccggcgccgccgcctcccctgcggcaccagcttcgatcaccgctgggcacagtcccgcgctcctcacgacgctcttgcccgcgagcggccctcccccggctcctctggctgcctccgcctccgagcgggccgcccgcgccggcatcctcttgacccctttgggcagccgccgaaagtccatcacctacagcacccggggagaagacggagtcaagtgaaactagatggcctcgaagctgatatgcttatcttggttccaagatgcttttcctgacgcctttgcttacgagatgggttatgaggcacaagtatgatgtctgtgtctatgtgattctgcaaggtcagtttgaggggccatttgtttcgatccgtctggtctttttcgctattgcaacccactagtgttcatgacctaaaattatatcaatcgagaagttcctcaactacaacaccttgtacgaatacggagacaaattgaacccattctgcctcgaaacctttgttcctttgtcttttcaagatggatgatatgctgtttcttatgtcagtgcttaggaggtgcaaagtgtgaggtcctgaaatgaagttggtttgttcatgaatctccaaggactgttagtgtgaccatccgtttctagtatgtaatcttcagggctatattaaccaacaagtctatgcattatccagtttaaaacttataaagataaaaaaaaaaaaacaattaatcaaagggaggggccgcgcgaccgggggccccctacccgggtcgccctattgcgcgcccctctntngggcgttcgt

SEQ ID NO: 2295 - DNA, 691 bp, Triticum aestivum
  unsure (1)..(691): unsure at all n locations
  Clone ID: PAT_TA_2295
ttgcctgttcatggggctcaacaacaacctcggactggtcaacagcgggataccatacaatttcaccggcgagtcatggaataacagcagtgtgcaccagagcggcggcgctggctcggcgcaggtctcgatcgctgccgccgccgcggctcaccactcggcattcccagcgttactctccttggctccaaggtcgcatcagctggtttactactcgtccgaggccgatcagttcccagttgatgacctgggctcccaaagcttatccttgagctcggcgagagctttccatgaccagacaggaagctagctgccacctagctagctagtacaacgctggatcgatcgatatcctgaagaagatggagctgatcgatcggtggtatggattgcaacttttatcctcaaggtaggacttaataatgctctcccaaagcgcaaaatagctagctagtagaagtgtgtgtgtatgcattggttttttcagatatacttcttcctatgggtcaagcctaaccgcgcgttctaaaaatgttttatgcttttaaacatatgcttaatttggctttggaggttgagcaatgctagctggcgggcttgctgtgtgtgccatacgaatttgttacttcttttcatatacaaagaagtaagcggtgtaangtttattgtgcaaaatatttttatttttttt

SEQ ID NO: 2296 - DNA, 681 bp, Triticum aestivum
  Clone ID: PAT_TA_2296
ctccccctccacaggagcgcactttcgccgtgccgcccctccggcgtcgacgccagcgcgggttccggcccgtcccccccccacggcgccgtcgtcgccttcaggaacgcggttcaggaggcactgcgggttccaggtcgggtgggcggcccctgacggtggaccgagctcccgccgacgaaccccaccaaggacaagctcatggacaggtactggtcgcacgtcgcgacggtcgaccagctgccggcgacccccaccaaggacaagctcatggacaggtactggtcgcacgtggcgcagtgcacgagctgcagcgccgccctcaaggccatgaaggcgctcgaggtggccctgcaggtggcgtcgatcgccgtcgtcgggctcctcgcggtggccaaggggacacttctcacgtcggtcgtccagcgggccgtcatcgtgtccgcggctgtcctgtgcttcgcggcctcccggtggctcgcggacttcatccagaagaacttctattttgaggactatgtccatgcttacaagtgacttagcaaatcatccagtagggaaaattatctgtagggatatacgtagaaaatacatctaggcccgttgtttctagtccaaagatcaagtttgaacacagaacaacacgcttctatcaggtaccacacgttctgaaaaaaaaaa

SEQ ID NO: 2297 - DNA, 823 bp, Triticum aestivum
  Clone ID: PAT_TA_2297
gacaccactcgccctctggtgtctcaagctcgccggcggcaagagaaagccacagaagtacaagctgccccctgggccatggactctcccggtcatcggcagcctacaccacctcgccagcggcgttccgcaccggaagatcacggagctgtgtcgccgtttcgggccgctgatgctcctcaggctaggggaggtccccgccgtggtggtctccagcgccgaggcagcggcgctggtgatgaagaccaacgaccccgtgttcgcggaccggccgagcagcgccacggtggacatcgccggctgcggcggcaggggcatcatcttcgccccctacggcgaccactggcgccagatgcgcaaggtgtgcatcatggagctcctcggctccacgcaggtgaaccgcatggagggcatcagggccgaggagacgggcaacctcctccgctccatcaccgcctccgccggcgccgccaccatcaacgtcacacagatcgtgatggcgctcagcaacgacgtcgtgacgagggcggttttcggcggcaggttcgagcagcaggacgagtacctcggtgagttgcacaaggcgtttgagctgctgggtgccttctgcctcgtcgacctctttccgtcgtccaggttggtcaggtggctgaccaacgacgagcgccgcatgaaaagaagctacggccgcacccagcgcatcatcgccaaggccatcgagggtcgcaaggccaccagagctgccggcgtcggcgcttccggcgcctacgacgaggacctcctggacgtgctgctcaggctgcagctggaggactcgttagag

SEQ ID NO: 2298 - DNA, 754 bp, Triticum aestivum
  Clone ID: PAT_TA_2298
ccacgcgtccgaaacagaaaaaacgaagaaccctcttccctccccactcctgctgctccgtggccatggcgaaggcgaggccgcactcggggcgatccggtcaccgccgccgcaacctcctcctcgcagctgctctcctgtcggcggctctgctccttccggcggcgatggcctccgcggcggtggcggcggcggcggagggggacggggagaacaggtcgcggggggcggcgacgcagtgggcgacggggaaggacgagggggagctggccgcggagcgggaggccgctggcgggggctcggtggtggaggacgacttcgcgggcggcttcggctccctcgacagcatgctgcagtgggccatcggaaattcagatccaggaaggctgaaagaagaggcggcggatgtgcagaagttatctgaggatgagctgctcaagcggcggcatgagattaaggacttgatggagaagttaaagatgccatcagatgctgacttaatgaagattgcaattgctgacttaaacaatgcgtcaatttcactggaggatcgccagcgtgcattgcaagagcttttaattcttgttgagcccattgataatgccaatgaccttgacaaaattgggggccttgttcctgtgattcaagatcttaacaatgcaaatgaagaaatacggatcacctctgcatggatcctgggtacagccagtcagaataatgcccttgtccaaagccagattcttggttatggagc

SEQ ID NO: 2299 - DNA, 596 bp, Triticum aestivum
  Clone ID: PAT_TA_2299
cccacgcgcaccggcgtccgccggagaacctccccgccggccgccgccatgccgccgcctctccaggcccaccgcatactcctctcccaccgccgcgcatcccctatccctcgccgccgcttcaccgcggtctcttccctctcctccgcccccgccaagaccgtggccccgggcccgcccgcggacgcgtgggtctccatccgcgagtcgctcctgtccggcgagaggaccgccgccgacatcacctccgagtacctctcccgcctccgccgcaccgagacgagcctgcgcagcttcatccacgtggccgacgccgccgccgagcgggaggccgaggagctcgaccggaggatcgcctccggcgggcgggatgcggtggggccgctcgccggggtgctcgtgggcgtcaaggacaacctctgcaccgccagcatgccctccaccggcgggtcgcggatactggacgggttccagcccgcgtacgacgccacggccgtgcggcggctgcgcgaggccggcgccattgtggtggggaagactaacctcgatgagttcggcatggggagcaccaccgagggctctgggttttaggtgac

SEQ ID NO: 2300 - DNA, 118 bp, Triticum aestivum
  Clone ID: PAT_TA_2300
ttttctgtctctctctcaaatttctgtaaccttggggggtgttttgatcagaattgcgttttgttcagggttgtgtaatattcagacttgactagttctaatcacttgttattcgttc

SEQ ID NO: 2301 - DNA, 942 bp, Triticum aestivum
  unsure (1)..(942): unsure at all n locations
  Clone ID: PAT_TA_2301
aaaaanaaatccttnnacatncgtgctgtcggcataacgcactccatcagcattcttggtaatcttttaggatcncccaatgtatgttttatgataggttttatcaggcatggggggggcggcgccccgcccgggccgggggggtccagcagggcctccctcccgccgttgtcggccgcaggcccgcactgcccctcctgggcggctgcgccgccgatcgccccctgctgcgccgctgctgcttcggcacggtgcggccccccaccgtctgtcgttggtggtatgctctccctgccaaactatgctctgccaacctaccggtggaaaggcgaggctcaccaagggatgccttattatggaaaaaatgaagcccttcttaagattgtttactactacttatcctcgatgtggggagacagaccaaaagaggagtccgcaaccaccagatggccttgccttttaccctcaattgactagaggttctgggtgtctttcttccccaatgcattgccttccatgacctaccttggtctattctcatgggtgatctgctaactcattttaattcggtgcctangggtgcagtagaggagcaccagtaccggtgtagaatgcatctgcagtggtgcgggttggggaccgagtgacggattcaagtcaagggggttttcggctancgcagaagcaagctgcataagaatgcaataatgtgattaaacaaggcaagctctgggaaacaagaatggtgatggctgctcaactagaattcacaataaatggatgatattttggggggcccgtaccaattcncctatatgatctatacnccgccacggcctctttaaactctgacgggaaacctgcgtaccaataacccttcacaacccttccaacggctatacaaagcccacgttcctcaaatnccacnaagnaaggaccctt

SEQ ID NO: 2302 - DNA, 643 bp, Triticum aestivum
  unsure (1)..(643): unsure at all n locations
  Clone ID: PAT_TA_2302
gcacgaggcacaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagtgtcgcgcattccatcatcatgcaacaagaacaacaacaaggcgtgccgatcctgcggccactatttcagctcgcccagggtctgggtatcatccaacctcaacaaccagctcaattggaggggattcaggtcattggtattgaaaactcttccaaccatgtngcaacgtgtatggtgccaacctgactgcttcaacancaacat

SEQ ID NO: 2303 - DNA, 722 bp, Triticum aestivum
  Clone ID: PAT_TA_2303
cactaaagggaacaaaagctggagctccaccgcggtggcggccgctctagaactagtggatcccccgggctgcaggaattcggcaccagaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggagggatcaggcattggattgaaactttcacctggcacggatgctactgctgtcacaaaccacattgcacatagcgcggattggggcaatgaaaatcaagagtatgctataggagatggacatcgtgcttactgatgcaccaatcgttgtagcgatgacaaataaagtggcgtacgccatcatgtgtgaccccgaccagtgctagttcaagcttgggaataaaagacaaacaaagttcttgtttgctaaaaaaaaaaaaaaaaaa

SEQ ID NO: 2304 - DNA, 523 bp, Triticum aestivum
  Clone ID: PAT_TA_2304
cacaactcgagcacaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacatttcccccatcaaccacaacaacaatttccccagccccagcaaccacaacaaccatttccgcagcaaccacaacaacaatttccccagccgcaacaaccacaacaaccatgtgcgcaacaaccacaacaacaatttccgcagccccaacaaccacaacaacatgtgcccaggccccaacaacccaactaccatttgcgaaacaccaacatcaccatttcccccagcctcaacatcccaaacacca

SEQ ID NO: 2305 - DNA, 653 bp, Triticum aestivum
  unsure (1)..(653): unsure at all n locations
  Clone ID: PAT_TA_2305
agagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaatttccccagccccaacaaccacaacaaccatttccccagccccaacaaccccaactaccatttccgcaacaaccacaacaaccattccccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcgtcgtgcattccatcatcatgcagcaggaancaacatcaacatcaacaacaacaacaacaacaaccaacaacaacaaaggcttacagatcattgcggncactatttta

SEQ ID NO: 2306 - DNA, 553 bp, Triticum aestivum
  Clone ID: PAT_TA_2306
gacaactcgagctctatcatcaaatgcaagtaagtaatagttcacataaatccaccatgaagaccttactcatgctgacaattattgcggtggcactaactaccaccaccggcaatatacaggtcgaccctagggggcaagtgcaatggccacgacaacgacagccattaccacagccccaacatccattatctcaatatccacagcgcatttttccgcaaccccaacaatacatttctcatcaaccacaacaagcattatgacatccccaacaaacattatctcatgaaccacaacaacaatgtccgcagagctagcaaccacaacaacgatgttcacagctaccacaccaacaatttcaacagtcccatcgactagaacaaccattgaccatcaaccacatcatcaatttccggagaccaaagaacgacaacaaccattctcatagcccgaacatccttaagtaccatttccgtaacatccactataactattccgcgaacctcatcaacccgatcaccgatttcccgagttacagtacctgacaccaacg

SEQ ID NO: 2307 - DNA, 755 bp, Triticum aestivum
  Clone ID: PAT_TA_2307
agcaaccacaacaaccatttccccagccccaacaaacattcccccaacaaccacaactaccatttccccagccacaacaaccacaacaaccttttccccagccccaacaacaattcccacagccccaacaaccccaaaaatcaatcccccagcaacaacaaccattgattcagtcttctctacaacaacagatgaacccatgcaagaactttctcttgcagcaatgcaaccctgtgtcattggtgtcatcccttgtgtcattgatcttgccacgaagtgattgccaggtgatgcagcaacaatgttgccaacaactagcacagattccgcagcatctccagtgtgcagccatccatagtgtcgcgcattccatcatcatgcaacaacaacaccaaggcatacagatcctacggccactctttcagattgtccagggtcaaagcatcatccaacaacaaccagctcaattagaggtgattaggtcattggtgttgaaaactcttccaaccatgtgcaatgtgtatgttcgacctgactgctccaacatcaggacaccatttgccagcacggtcgccggcattggtggccaatgaaaatgttggtgttatgccaataggtggatggatcatcgttgcttagttgatgaaccaatcgttgtaacgatgacaaataatgtggcgtgccccgtcatgtgtgacgccgaccagtgctagttcaagctttggaataaaagacaaacaaattacttgtttgct

SEQ ID NO: 2308 - DNA, 593 bp, Triticum aestivum
  unsure (1)..(593): unsure at all n locations
  Clone ID: PAT_TA_2308
gcacgaggcacacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatccaacctcaacaaccagctcaatatgaggtgatcagatcattggtattgagaacccttcnaaacatgtgcaacgtgtatgt

SEQ ID NO: 2309 - DNA, 840 bp, Triticum aestivum
  unsure (1)..(840): unsure at all n locations
  Clone ID: PAT_TA_2309
aagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaacaacaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcaccatttgccagcatagtcgccgacattggtggccaatgaaaaatgcaagcattatgctaataggtagatggatcatcgttgcttagttgatgcaccaatcgttgtaacgatgaaaaataaagtggtgtgcaccatcatgtgtgaccccgaccagtgctagttcaagnctnggaataaaagacaaacaaag

SEQ ID NO: 2310 - DNA, 744 bp, Triticum aestivum
  unsure (1)..(744): unsure at all n locations
  Clone ID: PAT_TA_2310
ttaaccctactaaagggaacaaaagctggagctccaccgcggtggcggccgctctagaactagtggatcccccgggctgcaggaattcggcacgagcacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacaacaatttccgcagccccagcaaccacaacaaccatttccccagccccaacaagcccaactaccatttcccaacaaccacaacaaccattcccccagcctcaacaaccccaacaaccattttcccagtcacaggaaccacaacaaactttttcccaggccccacaaccggaacaattatttccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagncatccatagcgtcgtgcattccatcgtcatgcagcaagaacaacaacatggcatacagat

SEQ ID NO: 2311 - DNA, 656 bp, Triticum aestivum
  unsure (1)..(656): unsure at all n locations
  Clone ID: PAT_TA_2311
gcacgaggcacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacaaacatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccannntcnnnncatcatccaacctcaacaaccagctcaatatgaggtgatcaggtcattggtattgagaacccttccaaacatgtgca

SEQ ID NO: 2312 - DNA, 750 bp, Triticum aestivum
  unsure (1)..(750): unsure at all n locations
  Clone ID: PAT_TA_2312
ttaaccctcactaaagggaacaaaagctggagctccaccgcggtggcggccgctctagaactagtggatcccccgggctgcaggaattcggcacgagcttttccccagccccaacaaccgaaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatccaacctcaacaaccagctcaatatgaggtgatcaggtcattggtattgagaacccttccaaacatgtgcaacgtgtatgtccgacctgactgctccaccatcaacgcaccatttgccagcatagtcgccggcatcagtggacaatgaaaaatgaagagttatgctaataggtagatggatcatcgtgcttaactgatgcaccagtctttgtagcgatgaggaataaagtggcgtgcaccatcatgtgtgacctcgaccagaactagttcaagcttcacaatatggcacataccaaagttctgctngctaaaa

SEQ ID NO: 2313 - DNA, 1007 bp, Triticum aestivum
  Clone ID: PAT_TA_2313
ctcgagcacaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacggattcctcagcagctccagtgcgcagccatccatggcatcgtgcattccatcatcatgcagcaagaacaacaacaacaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcaccatttgccagcatagtcgccgacattggtggccaatgaaaaatgcaagcattatgctaataggtagatggatcatcgttgcttagttgatgcaccaatcgttgtaacgatgaaaaataaagtggtgtgcaccatcatgtgtgaccccgaccagtgctagttcaagcttgggaataaaagacaaacaaagttcttgtttgctagcattgcttgtcacctcgtgc

SEQ ID NO: 2314 - DNA, 698 bp, Triticum aestivum
  Clone ID: PAT_TA_2314
gcacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccaagcaaccacaacaaacatttccccaaccccaacaagcattcccccatcaaccacaacaacaatttccccaagccccaagcaaccacaacaacaatttccgcaagccccaagcaaccacaacaaccatttccccaagccccaacaaagcccaactaccatttccccaacaaccacaacaaccattcccccaagcctcaacaaccccaaacaaccatttccccagtcacaagcaaccacaacaaccttttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatct

SEQ ID NO: 2315 - DNA, 1372 bp, Triticum aestivum
  Clone ID: PAT_TA_2315
gagtagcagtttgatcccctgctcgaaattaaccctcactaaagggaacaaaagctggagctccaccgcggtggcggccgctctagaactagtggatcccccgggctgcaggaattcggcacgagctcgagcacaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacggattcctcagcagctccagtgcgcagccatccatggcatcgtgcattccatcatcatgcagcaagaacaacaacaacaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcaccatttgccagcatagtcgccgacattggtggccaatgaaaaatgcaagcattatgctaataggtagatggatcatcgttgcttagttgatgcaccaatcgttgtaacgatgaaaaataaagtggtgtgcaccatcatgtgtgaccccgaccagtgctagttcaagcttgggaataaaagacaaacaaagttcttgtttgctaaaaaaaaaaaaaaaaaaa

SEQ ID NO: 2316 - DNA, 1375 bp, Triticum aestivum
  unsure (1)..(1375): unsure at all n locations
  Clone ID: PAT_TA_2316
ttaaccctactaaagggaacaaaagctggagctccaccgcggtggcggccgctctagaactagtggatcccccgggctgcaggaattcggcacgaggcacaactagagcacaagcatcaaatccaagtaagtagtatttaacgaaaatccaccatgaagaccttactcatcctaacaatccttgcgatggcaacaacaatcgccactgccaatatgcaggtcgaccctagcagccgagtacaatggccacaagaacaaccacccccccagtcccaacaaccattctcccagcaaccacaacaaatatttccccaaccccaacaaacattcccccatcaaccacaacaagcatttctccaacctcaacaaacattcccccgtcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaaccttttccccagccccaacaacaatttccgcagccccaacaaccacaacaatcattcccccaacaacaacaatggatgattcagtcatttctacaacaacagatgaacccctgcaagaatttcctcttgcagcaatgcaaccctgtgtcattggtgtcatctctcgtgtcaataatcttgccacgaagtgattgccagctgatgcagcaacaatgttgccaacaactagcacaaattcctcaacaactccagtgcgcagccatccacaacgtcgcgcattccatcatcatgcagcaagaacaacaacgaggcgtgcagatcctgcggccactatttcagctcgcccagggtctgggtatcatccaacctcaacaaccagctcaattggaggggatcaggtcattggtattgaaaactcttccaaccatgtgcaacgtgtatgtcccacctgactgctccaccatcaacatgccatatgccaacatagacgctgtcattggtggccaatgaaaaattcaagagttatgctaataggtagatgaatcatcgttgcttagcttatgcaccgatcgttgtaacgatgacaaataaagtggcgtgcaccatcgtgtgtgaccccgacatgtgctagttcaagcttgggaataaaagacaaataaagttctagtttgctagccaaaaaaaaaaaaaaaaaaaaaacctggtgccgaattcctgcagcccgggggatccactagttctagagcggccgccaccgcggtggagctccagcttttgttccctttagtgagggttaatttcgagctngcgnaatcaaaannaaagggntttaatattt

SEQ ID NO: 2317 - DNA, 1100 bp, Triticum aestivum
  Clone ID: PAT_TA_2317
tatttaacgcaaatccccatgaagaccttactcatcctaacaatccttgcgatggcaacaacaatcgccactgccaatatgcaggtcgaccctagcagccgagtacaatggccacaagaacgacctttcccccagtcccaacaaccattctcccagcaaccacaacaaatatttccccaaccccaacaaacattcccccatcaaccacaacaagcatttccccaacctcaacaaacattcccccatcgaccacaacaacaatttccccagccccagcaaccacaacaaccatttccccagccccaacaaccccaactaccatttccccgacaaccacaacaaccattcccccagcctcaacaaccccaacaaccatttccccagtcacagcaaccacaacaaccttttccccaaccccaacaacaatttccgcagccccaacaaccacaacaatcattcccccaacaacaacaactgatgattcagtcatttctacaacaacagatgaacccctgcaagaattttctcttgcagcaatgcaaccctatgtcattggtgtcatctctcgtgtcaataatcttgccacgaagtgattgccaggtgatgcagcaacaatgttgccaacaactagcacaaattcctcaacagctccagtgcgcagccatccacagcgtcgcgcattccatcatcatgcagcaagaacaacaacaaggcgtgcagatcctgcgaccactatttcagctcgcccagggtctgggtatcatccaacctcaacaaccagctcaattggaggggatcaggtcattggtattgaaaactcttccaaccatgtgcaacgtgtatgtcccacctgactgctccaccatcaacgtaccatatgccagcatagacgccggcattggtggccaatgaaaaatgcaagagttatgctaataggtagatgaatcatcgttgcttagcttatgcaccaatcgttgtaacgatgacaaataaagtggcgtgcaccatcatgtgtgaccccgagcctgtgctagttcaagcttgggaataaaagacaaataaagttctagtttgctaaaaaaaaaaaaaaaaaaaaaaaa

SEQ ID NO: 2318 - DNA, 1289 bp, Triticum aestivum
  Clone ID: PAT_TA_2318
ccatccttcacacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcatcgtgcattccatcatcatgcagcaagaacaacaacaacaacaacaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcaccatttgccagcatagtcgccgacattggtggccaatgaaaaatgcaagcattatgctaataggtagatggatcatcgttgcttagttgatgcaccaatcgttgtaacgatgaaaaataaagtggtgtgcaccatcatgtgtgaccccgaccagtgctagttcaagcttgggaataaaagacaaacaaagttcttgtttgctaaaaaaaaaaaaaaaaaaaaaaaaactcgagactagttctctc

SEQ ID NO: 2319 - DNA, 1170 bp, Triticum aestivum
  Clone ID: PAT_TA_2319
taagtagtagccacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatccaacctcaacaaccagctcaatatgaggtgatcaggtcattggtattgagaacccttccaaacatgtgcaacgtgtatgtccgacctgactgctccaccatcaacgcaccatttgccagcatagtcgccggcatcagtggacaatgaaaaatggaagagttatgctaataggtagatggatcatcgttgcttagctgatgcaccagtatttgtagcgatgaggaataaagtggcgtgcaccatcatgtgtgaccccgaccagagctagttcaagcttcagaataagacacaaacaaagttcttgtttgctagcttcgcttttcactgttccattcactttttattttcatgttcgttcctaaccgcaatcctagccttacacatcaatagctagctacttctgctggcaggttactatttaatctatcgattaatggtcgatgtattaatccagttaataggttgattgatatattagttactgctcc

SEQ ID NO: 2320 - DNA, 1230 bp, Triticum aestivum
  Clone ID: PAT_TA_2320
tacccacgcgtccgaacaactatagcacaatcatgcatccttcacacaactcgagcacaatcatccaccatgaagaccttactcatcctgacaatcattgcggtggcactaactaccaccaccgccaatatacaggtcgaccctagtggccaagtacaatggccacaacaacgacaaccatgctcccacccccaacaaccattctcccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtcattggtgtcatccctcgtgtcaatgatcttgccacgaagtgattgccaggtgatgcggcaacaatgttgccaacaactagcacagattcctcagcagctccagtgcgcagccatccatggtgtcgtgcattccatcatcatgcagcaagaacaacaacaacaacaaggcatacagatcatgcggccacttttccagctcatccagggtcagggcatcatccaacctcaacaaccagctcaattggaggtgatcaggtcattggtattgggaactcttccaaccatgtgcaatgtatttgttccacctgagtgctccaccaccaaggcaccatttgccagcatagttgccgacattggtggccaatgaaaaatgcaagcattatgctaataggtagatggatcatcgttgcttagctgatgcaccaatcgttgtaacgatgaaaaataaagtggtgtgcaccatcatgtatgaccccgaccagtgctagttcaagcttgggaataaaagacaaacaaagttcttgtttgctagcattgcttg

SEQ ID NO: 2321 - DNA, 1322 bp, Triticum aestivum
  Clone ID: PAT_TA_2321
gggaacaaaagctggagctccaccgcggtggcggccgctctagaactagtggatcccccgggctgcaggaattcggcacgagaactcgagcacaatcatcaaatccaagtaagtaatagttaacataaatccaccatgaagaccttactcatcctgacaatcattgcggtggcactaactaccaccaccgccaatatacaggtcgaccctagtgggccaagtacaatggccacaacaacaacaaccattcccccagccccaacaaccacaacaaatttttccccaaccccaacaaacattcccccatcaaccagcaacaagcatttcctcaaccccaacaaacattcctccatcaaccacaacaacaatttccccaagccccaagcaaccacaacaaccatttccccagcaaccacaacaacaatttccccagccccaacaaccacaacaaccattttcccccagcaaccacaacaacaattttccccaagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacgctacaacaacagatgaacccctgcaagaattacctcttgcaacaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcgtcgtgcattccatcatcatgcagcaagaacaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcaccatttgccagcatagtcgccgacattggtggccaatgaaaaatgcaagcgttatgctaataggtagatggatcatcgttgcttagttgatgcaccaatcgttgtaacgatgaaaaataaagtggtgtgcaccatcatgtgtgaccccgaccagtgctagttcaagcttgggaataaaagacaaacaaagttcttgtttgctaaaaaaaaaaaaaaaaaaaaaaaaa

SEQ ID NO: 2322 - DNA, 968 bp, Triticum aestivum
  Clone ID: PAT_TA_2322
tcggcacgaggcattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttccccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgccgatcctgcggccactatttcagctcgcccagggtctgggtatcatccaacctcaacaaccagctcaattggaggggatcaggtcattggtattgaaaactcttccaaccatgtgcaacgtgtatgtgccacctgactgctccaccatcaacgtaccatatgccaacatagacgctggcattggtggccaatgaaaaatgcaagatcatcattgcttagctgatgcaccaatcgttgtagcgatgacaaataaagtggtgtgcaccatcatgtgtgaccccgaccagtgctagttcaagcttgggaataaaagacaaacaaagttcttgtttgctaaaaaaaaacctg

SEQ ID NO: 2323 - DNA, 1232 bp, Triticum aestivum
  Clone ID: PAT_TA_2323
attcggcacgaggagcacaagaatcaaatccaagtaagtagtacctaacgcaaatccaccatgaagaccttactcatcgtaacaatccttgcgatggcaacaaccatcgccaccgccaatatgcaagtcgacccctggctaccaagtacattgggccacaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggaggtgatcaggtcattggtattgagaactcttccaaccatgtgcaacgtgtatgtctcacctgactgctccaccatcaacgcaccatttgccaacatagtcgtcggcattggtggccaatgaaaaatgcaagagttatgctaataggtagatggatcatcgttgcttagctgatgcaccaatcgttgtagcgatgacaaataaagtggcgtacgccatcatgtgtgaccccgaccagtgctagttcaagcttgggaataaaagacaaacaaagttcttgtttgctagcaaaaaaaaaaaaaaactcgagggggggcccggtacccaattcgccctatagtgagtcgtattacaattcactggccgtcgttttacaacgtcgtg

SEQ ID NO: 2324 - DNA, 1132 bp, Triticum aestivum
  Clone ID: PAT_TA_2324
gaggacacaactagagcacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacaaacatttccccaaccccaacaagcattcccccatcaaccacaacaacaatttccccagccccagcaaccaccacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatccaacctcaacaaccagctcaatatgaggtgatcaggtcattggtattgagaacccttccaaacatgtgcaaacgtgtatgtccgacctgactgctccaccatcaacgcaccatttgccagcatagtcgcccgggcatcagtggacaatgaaaaatgaagagttatgctaataggtagatggatcatcgttgcttagctgatgcactagtctttgtagcgatgaggaataaagtggcgtgcaccatcatgtgtgaccccgaccagagctagttcaagcttcagaataaaacacaaacaaagttcttgtttgctagcttcgcttttcaaaaaaaaaaaaaaaaaactcgagactagttctct

SEQ ID NO: 2325 - DNA, 618 bp, Triticum aestivum
  unsure (1)..(618): unsure at all n locations
  Clone ID: PAT_TA_2325
ctacgcggacgcgtgggcggacgcgtggggcaaaaatcaacaaatcctttctttttcgtcataagcaacgaacgcccttattcattcatggagcccacggcaaagctttaagcgcaagccaaaggctgcaaaaggggggaacagagagggaaaccttagctggatgtgcgctgggactccttggcaaagcggcaaagccatggacggagacggagagataacatgggccttttatttctgctccttcaagattagccacatttcacttccaacattatcatctatcatctcgcttgctacaaacagctaacacatctctctcgtctccggaagcaccccacttattgtttctaacaaaccgactactagacatggatttcttgtttcttcattcatctccaccgcttatcgccggcaccccaaaaccaatgtgtcaccaatccaaaatacacacntgctaaaactgacgctgctaatantgctcttctacttctattantaggatatgaccactacaacctagtacaaattactgttgatactaatttttattttcgagattaaacggagccaagaacgcggaatgttccggcaggagactgggttcacgaactgtgg

SEQ ID NO: 2326 - DNA, 1270 bp, Triticum aestivum
  unsure (1)..(1270): unsure at all n locations
  Clone ID: PAT_TA_2326
gcgggcgcccccacgtgcgcgggcggccactggcgctcgggccggtccccgaccccccggtcggcttccagtgggaccccaagaagttctgctggtacctctacttcatgtacttcactctgctctacttcacctactacggcatgctcgccgtggggctcacccccagctacaacatcgcctccatcgtctcctccttcttctacggcgtgtggaacctcttctcgggctgcgtcatctcacagccgacaatgccggtgtggtggaggtggtactcgtgggcgtgcccagtgtcatggacgctctacgggctggtggcctcgcagttcggcgacctcacggagccactccaagacaccggcgagcccatcaacgccttcctcaagagcttcttcggattccgccacgacttcctgggcgtcgtcgccgttgtcaccgccggcttcgccatcttcttcgctgtcgccttcggcctctccatcaaggtgctcaacttccagagaagatgatacatcacacagtgcagggatggaccaacgggtcaatcggatctgcacatgtttacattcacgctgctctgctgcaactgcttacgcaggcccgccgaaatgctcacccccagctacaacatcgcctccatcgtctcgtccttcttctacggcgtgtggaacctcttctcgggcttcgtcatctcgcggccaacaatgcccgtgtggtggaggtggtactcgtgggtgtgcccggtgtcatggacgctctatgggctggtggcctcacagttcggtgacctcacggagcctctccaggacagcggcgtgcccatcgacgccttcctcaagagcttcttcggattccagcacgacttcctgggcgtcgtcgccgtcgtcactgccgggttcgccgtcctgttcgccgtcgcctttggtctctccatcaaggtgctcaacttccagagaaggtgattcatcatgcagtggcagtgcacgggcggaccaacggctcaatttcagccagccggaaacgaatgctccgcatgtgtttgtagtttgtactagtagttcctaagtaggagtacatatgtgctcggcacgtcgcatattctttttctctcggttccattgatttttttcccttagttttgttttgcgcttattagttgcatcaatctgatctgcacatgtatacatgaacattgcatagcaatggtttactcacttgccggaaaggcattcgtttactcagtagcaagtaaaattanacaagtatatag

SEQ ID NO: 2327 - DNA, 649 bp, Triticum aestivum
  Clone ID: PAT_TA_2327
attcactcgccatgagcgtcatgcaaccagccatacggtgtctctctcatcgctcctcctctgtcctctcctgtgtctttctcgccaaccacagagtggcactgtgatcgcaatccagctggaagaccatcctactgtctgcagcattgccatggacgccacaaagacagcagccaaggctgtggcggcaggcaacggcgacgcagacgccgcgccgtcgacccggcggacggcggcgccgaggccagtacctcggcgggacgaaccgctggcaggagaaggcggggctgcggccgacccggcgcctgcgacggcaacaacaggcgctactgttgcggagagcggcgtggaggacgagcaggtggagaggttctacgcgctgttggccaacatccgggccatgaggggcatgaacgagagcgggggcgacgacgccggcgcgagcacggagggtgccagcgaggtctgcggcggcgggaggaagcgcgcgcgctgggcagagccgccgtggaggccggctttcaggctggaggacttccaggacgccagcgcgtccaagaaggacatgaatgacgacggtgccgccagccatcggcggccgggcaaggagaccaaggacgaagcggcggatggcgggaaggaggacgac

SEQ ID NO: 2328 - DNA, 1573 bp, Triticum aestivum
  Clone ID: PAT_TA_2328
gtccacctctacccctaccctcagcaacgcggaggcgacctcgcgatgccgccgccgccgccgcacccaaacgggggcaaagtaacgccgaacctggccatggacgccgagggcacgcgcctgcttaacctcaccgtcctgcagcgcctcgaccccgccgtcgaagacatcctcatcaccgccgcgcacgtcacgctctacgacttcaacatcgacctgaaccagtggagccggaaggacgtggagggatcgctcttcgtggtgaagacgaactcacagccgaggttccagttcatcgtcactgaacaggcgcaattacggataatctcgtgggaggatttgttgagttgattttgaatatgaactccagcctccatactttgttgctatcggagtgccacacaaggaattaaatggcatttggtttaacaaccaataggagtgccaagctgttgctagtttagtttggtgggatactgaatgcttacgcgaaagtgcccccaaagccgaaagtgccatctagaaaaagtgagattgcggaattcgaggctgctcctaaatcctaagccaccctccatcaaacatcagtttgaggaattggtgggctctccgttcgttcgttgctctggttggccaccctgatcccccgcctgcttccactcccaactccgtcaacccctgccaaaacccacgctacttgcatcgctgacgcttcaaccctacgtagcgtatcatgttttccactggtgggaagaaacattccatccatggaccctccccccgctccctgcccctccatcattatccctcatgctggcccctcgaccgacctagtccctcctgcagtctttgtgtctccctcacccacttccactcctttggcgctaccggttttgttatgcatgcctacaatttcgcctcttcatccacccttccacatccagccaacgcctaccatttggtaccctccttcttcaaccctttccgccaccaactccgcctgcatcccttacccctgcacacaatgatggacctgctatttcgagggataaagttaaggatgccctcctgagacttgttcagagtgacgagttccccgatttaatctaccgggagttgctgaatgctagctagtccttgtgaagtatttgtttgtgacaaacatgaaaggagtgcttctgttcttgtgagttttgtatgcctcttagcctttagtcctcaaactactgtatagctttgtcctaaggcgttgatgtagagtccttcactccttgatagcaatggttggttgtatattgcggtatcccttgtttccaagatctttgttgtcgtagagtatatttatgtaattgaatacaccgagatcaaacaggtcatgtgacagacggtggtacataacagccacattgtttacaaatgactatgtcaatgtcattacatttatgtaattgaaaaaagggagtttgtaaggatgttatggtatcatcattttcgtgtgttttaaaaaaaaaaaaaaaaaaaaaaactcgagactagacctgcccgggcggcccccggattcattagtgaattc

SEQ ID NO: 2329 - DNA, 653 bp, Triticum aestivum
  Clone ID: PAT_TA_2329
cctcgtgccgcccagccccggacgcgtgggtctcatcccccctgcctgtctcctcctccgctccgctcgctccctccgcagatccgcgccagcgaggacccggggagacgaattcccccgccgatggcggtgaacgggtcggccaacgggtcgtcgggggccaacgggtcggcggggccgaccaggaccgtgctggtgaccggcggggcgggctacatcggcagccacgccgtgctgcagctgctcgccgcgggcttccgcgccgtcgtcgtcgacagcctcgagaactcctccgagctcgccgtccgccgcgtcgccgcgctcgccggggaccacgcgcggaacctctccttccacaaggttgatatccgtgacgaggatgcactggatgctgtttttgcttccacaagatttgatgctgttattcactttgctggactgaaagctgtcggtgaaagtgtacagaagccgttgttttactatgaccataacattgctggcacaattaatcttttgaaagtcatggcagcccatgaatgcaagaagttggtgttctcatcatcagctgcagtttatatatcacggcatatctcctcagccataagcttggttctgccatatggattgtgcggaaggagaggaaactcctctgt

SEQ ID NO: 2330 - DNA, 669 bp, Triticum aestivum
  unsure (1)..(669): unsure at all n locations
  Clone ID: PAT_TA_2330
ggcttcaacactagtgcgaactgggtttgtccgtggatctatacccagggaaatggctgttatcagcatcgctgcacaaataactccttagaggttgctgttgacggcgtctggaagtcatgtccagaatctggtggcccagttcagttcccaggcttcaatggggacttgatttgcccggcatatcatgaattatgcaacaccgtaccagtccaaataagcggccagtgccccaagtcgtgcagtttcaatggtgattgcattgctggaacctgccactgcttccctgggttccatgaccatgactgcagtagaagatcttgcccagacgagtgcagtggtcatggtatatgcaaagcttatgggatctgtgaatgcgaaagtggctggacgggaattgactgctcaacagcggtttgtgatgagcagtgtagttngcatggaggggtntgggacaatggtaaatgtgagtttcgatgttcagattatgcgggctacacttgtcaaaagggttcgacaatactgcccagcctgtcaatgtgtcatgatgtaccggttcgggattctgatgggcagcattgtgcaccaagtgaactcagcatactacagcaactcgaagcagtagttcttgtgccaaattacaatagattgatgccaagtgggcggacc

SEQ ID NO: 2331 - DNA, 1891 bp, Triticum aestivum
  unsure (1)..(1891): unsure at all n locations
  Clone ID: PAT_TA_2331
gggatttaaaggccctcctcctcctcccgctaggtgtgccgattataattttcgtcatatatgttcatggccagaaggtcacttatttcctcagaccaatctgggagaagcccccgaagcctttcactgtacttcctcactactcgcgccgtgtcgtctccatgccattcccctgcaccttgcgggcaccggcgctccgacaccccccgccgccgggccgtgccgcggtcctccgcagcagcccgctcggcgctcctgtggtgccgtgccccccccttcgcccgcacccgcccgtacgggcgctgctccagtccaattcagcagtccctggcctcgagaaggtgcccgccccctagcacaccctcccgcggtggagtccgccggctactacaccaactgcaagaagaccgacggagtctgcgagggcatctgcgacggcgagcatggttcaaaggctgttctgagcatctcaaggctgaagtgtaaagatcgccgggatcaccgacgatgacctgttgattatgtctgaggtggacgggatcccatctggttcatctatcttcatggtgagaaggtcccttatttcctcagagccactccgcctgcagccccagaaccctctctccgcgcttcctcactactatcatgaaaatgcttcgatggcaaacctctgcaagttgcatggatggaaggtccgggaggctccacggcgtgtctttgacgcggtgcttttcagcaacgagctcgacattcttgatatccgttggcacgagcttagcccgtatgtgtcagaatttgtgctgctcgagtccaattcaacatttaccggccttgtcctgaaccccaaaagaatgcagcatgtgatatgccaaggggctgatctctttgatatgcttccggatggagtacacgttccaagagatcaatcgccaagcttggtccattcccaagtacgtattcagcggttcatcttcccgcctatctcctcgagaaggttgatccgtacaggaatccctgtcctggcaactgcatgaggaagagtgcgtaaccggccatacatccatcctgatgagatggtgcgatggtacgcccgagatacttcaccttcagctgaagaactatctctactcgtttcaatttatgcttgatgataagagttggagggcttcggtacacagataccgagcggggaagacgaggtatgcccattaccggcaaactgatgaccttctggcagactcagggtggcactgcagcttttgctttcggtacataaatgattttgtcttcaaaatgaaagcctacagccatgtggaccggatcaggttcagctacttcttgaaccccaaaagaattcagcatgtgatatgccaaggggctgatctctttgatatgcttccggaggagtacacgttccaagagatcatcgccaagcttgggccgatcccaagtacgtattcggcggttcatcttcccgcctatctgctcgagaaggctgatcagtacagatatcttcttcctggcaactgcatgagagaaagtgggtagcctccgctgtttgcatcaagatgtgatgccccccttggggaagagcgtggcttagcggttgtatttgataccagtggctggctgacttagttggaatggcggttgtgttgggttcatgattttgtaccatgtaattcaaaacaatggaaggagggcctgacagcatagcgcatgctccgtcggccgctgcgtgcttgttttatttttggaagaggagcttagcagcccacctgagtctcttgttgattcattgcttccatgattgatttatgaactcagaaaatctattgtagattaaaaaaaaaaaaaaaaaaaaaaagtccagactagttctctnnctctg

SEQ ID NO: 2332 - DNA, 939 bp, Triticum aestivum
  Clone ID: PAT_TA_2332
ggccgggtcgtgtgtccccccctcaccctcctcccacctcctctgccgcagcctcgccgccgccaggacgctctctgtcgccgccgccggatcctcctcctcctcctctcccgtcaagatggcgcgctcggcgctggacgaggtcaccgacaccggcgccttcgaccggacgccgtccaccttccggagcttcgtgttcagggacgcctccgcccgcttccccgcggtggcgggtaggtaccacctctacgtctcctacgcctgcccctgggccgtcccgctgcctcgcctacctcaagctcaagggcctcgaccacgccatcaggcttctcgtccgtgaagcccatcttcgagcgggaccaggggagtccgacgaccacctggggtgggtgttcccggccaccgccgacgaggtgccccggcgccggccccgaccccttcaaccgcgccaagagcgtcagggatctgtacgagatcgcgagcaccaactacaccggcagagccaactgttcccgtgctgtgggacaagcagctgaagacggtggagaacaacgagagaagcgagatcatcgcgatgctcaacgccgagttccacggcctcgcggagaaccccgggctggacctcaacccggcgcacctccaggtctccatcgacgaggtcaacggcctggtctacgacgccatcaacaacggcgtctacaagtgcggcttcgccaagaagcaggggccatacgcccagcccggcccgacgctgtacgaggctctggacaagtgcgaggagatcctgggcaagcagcggtacatgtgcggcaaccagctcacggaggccgacgtccgcctcttcgtcacgctcataagatttgacgaggtttacgccgttcacttcaagtgcaacaagaagctcctgagagagtaccctaacctgttcaactacaccaa

SEQ ID NO: 2333 - DNA, 889 bp, Triticum aestivum
  Clone ID: PAT_TA_2333
ttgttacgcgtccgctccaccctctccagcgcatcgcctacctcaacatgtcgacctacccgatcgtcacggtgttcatcctggcctacaacctcttccccgtcctctggctcttctcagagcagttctacatccagaggccgttcggcacgtacatcatgtacctcgtcgccgtcatatccatcattcacgtgatcggcatgttcgaggtgaaatgggcggggatcacgctgctcgactggtgccgcaacgagcagttctacatgatcggggccacgggcgtgtacccgacggcggtgctttacatggcgctcaagctcgtcaccgggaaggggatatacttcaggctcacgtccaagcagacggacgcctgctccaatgacaagttcgccgacctgtacaccgtgcggtgggtgccgctgctgctcccgaccatcgtggtgctcgtcgtgaacgtcgcggccgtcggggcagcgataggcaaggcggcggcatgggggttcttcacggaccaggcgcggcacgtgctgctcgggatgctgttcaacgtgtggatcatcgtgctcctctacccgtttgcgctcgggatcatggggaaatgggggaagaggcccgtcatcctgttcgtcatgttggtcatggccattggcgccgtcgcgctcgtgtatgtcaccttccatgctccgtacccagctgatttttcagaagctgcagcttctcttggtgaagcatcggtgaccggaccatctgggtagacacgtacggctcattctttttacaagtacagtcacagtcactactgcaataatttgagtgtgtgtattcgtgtctatatagcatgagaactggtcattgtgtgccactcctctacttatagagatgtacctat

SEQ ID NO: 2334 - DNA, 889 bp, Triticum aestivum
  unsure (1)..(889): unsure at all n locations
  Clone ID: PAT_TA_2334
cttcttttccgcccgccgtcatccagtccgccatccggatcccccagcatcgcagccgaaatcaaatctgccctccccatcccatctccactccccatcccatctcatctccacccacgatggccaatatccaccacgtcaacaacgttgcacagatgctcggtgtcgtagtccagttcgttggagtcgacctcaatgcagcagccggccacaccgtgtttatccacggcgtgaactccatcaacgactgcgctgagatgctgcgccacgctgagtacctcgaagacagaggtgcagtcgtctccaacgtagattcactccgtctgctggttcgtgccaacgatctcatccttgacgtctctgatcatctggtggggagcctcgtcttcgatccgatccacgacgtcaacgaccttcgccttcgacgccttggagcattcgccacttgcatcgacgatctggcgaccggccttcaagcgggcgtcttccacgacttcgccaatgtcttcgccgccaggatcactgaggccatcgctggattcggggacggcctcttgacagctcaacaggtcatcatagaggcggtgggtgcgtctgccaatcttgaccatgacactttccacacatatattccaatcccgtagagataagttatctgtgctatttaggtgttgtattaagttaatgaacagaccagtaatctgtgacttggtgctgtatcaggtgctatattaagttagtgaagtgcttagtaatctgtgactttggtgtcgtatcaagtgctatattaagttgtgtggtgtttccctacttggngcgacagtgcatanaattaagaatgtcgtacgtaaaaatcaatgaatttcagangcanttaaanattatttgt

SEQ ID NO: 2335 - DNA, 562 bp, Triticum aestivum
  unsure (1)..(562): unsure at all n locations
  Clone ID: PAT_TA_2335
ccctgctctctctctctctctctctctgccggtccctctctctctccttttattctgcaaccaatcttgggttgcgccggcgggctccagtacggccgccggggccggggaaagcgaagcggcagcagctcgccagtgctgcgggaaaggaaacgcgaagacgctgaatataaaatctacagaatgatggctcctgagttagataagcaatgctcaaacatccagctgggagaagaactggagatatgtgacatcaagcttgcgctcaaggcactgcgaaagaagatccttagtttggattttcataactccttgcatgttcatgatccacagaactcatttgagtacttagaagtgttgtacaaattgcggcagctgtctgagaagttaggtaatttggaccctggtggagaagccaaagagcacaaggaactcaccgtatatgctgatgacctttttgaaatggcgatggcaaggctccangaggaatttgttaccttctacgtactacaaacagccgttngaacatgagcttctctccttccgttctaaagaggatgga

SEQ ID NO: 2336 - DNA, 680 bp, Triticum aestivum
  Clone ID: PAT_TA_2336
tcggcacgagggtcgaccgccgggtcgaagaagctgatctacttcgggccgatggcggcggccccgccgttcgacctggaggacctgctgcgcgcgtcggcggaggtgctgggcaagggcgcgttcggcacggcgtacaaggcggtgatggagagcggcgcggcggtggccgtgaagcggctcaaggacgtggacctccccgagccggagttccgcgagcgcatcgcggccatcggcgccgtgcagcacgagctggtggtgcccctccgcgcctactacttcagcaaggacgagaagctgctcgtctacgactacatgtccatgggcagcctctccgccctcctccacgggaaccggtcgtcggggcggacgccgctggactgggaggcgcggtcggcgatcgcgctatcgacggcgcgcggggtggcgcacatccactccacgggcccgacggcgtcgcacggcaacatcaagtcctccaacgtgctgctcaccaagagctacgaggcccgggtgtcggaccacggcctgcccacgctcgtcggcccgtccttctcccccaccgggtgtccggctaccgcgccccggaggtgaccgacatccggcgcgtctcgcagaaggccgacgtctacagcttcggcgtgctgctgctggagctgctcacgggcaaggcgcccacc

SEQ ID NO: 2337 - DNA, 445 bp, Triticum aestivum
  Clone ID: PAT_TA_2337
tcgatcatcgcgtcccaatcactcgagcaaaatgaatcccatagccaaatgttacctgatgttcttcctccttttggcagttctcttgcccgaggcgcgcgcgaattcgtgccaccccggcgacctccgtgcgctgctggactttgccgggagcctcaatggtcgggatgtcctcctccgtgccacgtggtccggcgccgcatgctgcagctgggaaggcgtgggttgtgacgccgccaacggccgtgtcacggcactacgcctccccgggcgaggccttgagggggccatcccaggaacctcacttgcaggccttgcgcagctcgaggaactcgacctcggctccaacaactttcacaacatctcaggggtgctcaccgtgttgcatgggtgccagaacctcgccacgttgattctcacaagaattttgatggtgaagagctac

SEQ ID NO: 2338 - DNA, 554 bp, Triticum aestivum
  Clone ID: PAT_TA_2338
ccacgcgtccgcgaaagcaagagactgggccgccccgggcgaaaccttgcgcgccgccgcccccctccacttagcccccgcccccctcgccgccgtcgggcgtcaccgccgggcaaagcccgtgcggcagccggcggcggcgggcctctccttgctctgccgtgtgcgctggacggccctggacggctcggcgtgcttcgcggggccgcgcgccggggcggatctggcctcctggcctcttctgctgcgcggtggcgctgggcgctggggcggcggccccagactgcgacagcgtcgtcctcccctcctcctcgcagtggagtcgtggcggcgtgccggttggcggtggatgcgggcttcgtgcccggatccggcggggcgcaggccgtcggcgggatgcggcggcgctggccgtcctgggccccgcgggcggcagggcggacgcgcgtggtggtgggccggtggctcggggcggccgtgggtggatctggagctgcagcttccggcctccctagcttggcggagctgtttggcagagccggccctctgggaag

SEQ ID NO: 2339 - DNA, 690 bp, Triticum aestivum
  Clone ID: PAT_TA_2339
ttcggcacgaggcgcattctggactataaatagggcatccgatgaactgatttgagtcaccattcctacccgcactgccacacatagcaaccctcgaatatggatttgtttctgccactcgtctcattgattttgattgccggaggacaaggtagccagcatgcttgttttgccgatgcggccaagatgcccctgacaaacatgcagacactcacggcgtattgggaggccgcgcttccaggaattcccaattcccccggctatcagcgacctgttagcccaaccaaaagggcagcaaaaaattggaccgaactatgaaagagtcaactcagagggtggtcacggggacaaccatgttcatatcatatcacaggttaaagatgatttaaaagaggcccatgggtctcatggtgaagaaagtagaaagaaggtcatgatggcacttgagccaaaaatcggtaaggatctgaagggacaaccattgtcacatgggttacaagctaataattatgtagaagaaaaaaatgatgcgcatagagcaaaaatcgcagaaaatctgaaggaaatatcagtgccatatggttcagaaagtgacaacaattttaagaaagtttcattaaatttgaagaagatccttgcagcatatacaacactgaaagatgaaaaacttatggaaatatcagtgtcata

SEQ ID NO: 2340 - DNA, 595 bp, Triticum aestivum
  unsure (1)..(595): unsure at all n locations
  Clone ID: PAT_TA_2340
gcacgaggaagccatgtagccgagtgactgagtacgtnnntcannnnaagaaagaatacgccgttcgcgcggcggggcggagttcgtgctccgggcaaaaacctctgtccatctcccttcctcgttggtttgagcctccgcgcctccgacgcgtccggagagagtagagagcgagggcgagggtagcgcggcaacaacaatacgctaggttgatctggagacctcacgtgtgctcatcctgctgtacgagcagacgatgcgcgcgatccgtgccgggcgactcacacagggcggcagagatgaccaggaagcggcgagttgctcggaagtgaagcgctaaaaggagggctcgaaagcaggggagactcggagacgagcactttgaaacaggtggctcaaagaactgtcgtgggctcgtggcatggttgctgcggatataaggcagcggaaataacccggccgcaggtggtggtgccaggggaggagagccggcgtggcggctggccgcagaagcgggcagggtggctcgannnccctggagctgcttnnnngtagcggagtttggcatgtgtccgcgacgacagnnnnncacaag

SEQ ID NO: 2341 - DNA, 611 bp, Triticum aestivum
  Clone ID: PAT_TA_2341
cgcgcctcctcttccgctccctaaaccctagcctcgccatgtctccggccgacgccgccgccgcccacctgaccacggcccccgaccccgacgaggacatatgccccagccccgctgcctccgctgcctccggtgcccccgctgcccccgaggagatcgcaccgcccgtgcccacgcccctgcctcctccgccggcgtccgcggtcgacgcggccgagcgcgcgtgggcgcactggaggcggctggggtccccgaggctggtggtggcgcccatggtggacaactcggagctgcccttccgcatgctctgccgccgctacggcgccgacgccgcctacacgcccatgctccactcccgcatcttctccgagaacgagaagcacagggacatggagttcactacctgcaaggaggaccgcccactttttgttcagttttgtgcgaacgatcctgacattttgttacaagctgcaaagctggtggaagcacactgcgactatgttgatttgaattttggatgtccacagcgcattgctaaacggggatactatggggcatttctcatggacaaccttccactcgttaaatcgcttgtgcaaaatctgtcagag

SEQ ID NO: 2342 - DNA, 423 bp, Triticum aestivum
  Clone ID: PAT_TA_2342
ttcccgccgtccaccccctccgtccgccccgcggggtcctgcgggccgcagcggagcgccgaggcgcgcgaggcggcagccatggggttcaggaagggcctgctggcgtgcttcggcccgggcggcggcggcgacgaggaggagacggagcaggaggcgcgggcgacgccgggggcgcggcggcggcgcacggtgatgaacctgcggtcgctgtcgctggaggacctgtcgcggacgctggccaccaccaccctgcacgccttcaccctcgacgagctcaagtccgtcaccaagaacttctccaccgccaacttcctcggcgagggcggcttcggccccgtctacaagggctgcgtcggcggcgccctccgccccggcctcgccgcgcagcaggtcgccgtcaagtacctggacctcgacagc

SEQ ID NO: 2343 - DNA, 929 bp, Triticum aestivum
  unsure (1)..(929): unsure at all n locations
  Clone ID: PAT_TA_2343
ttccctctgctacgctcccttgcatctgtcccactgcacaaaagcaaatccacgcttcatgagtagctgataggacaaatcggcaagaggttgtgtgagtggtggtgcaaatcgcaagatggttgagcaaaagggtggccgcaagttagctctggacgacgtgcgggacagggggggggccctcgaggccccccttcggatacggggcgggacatccgcaacgatgcagggggacacggcgatgaccggcggacgcggagcccacccgatcgccgtgaccaggatgctccggcgcagcctgggctgccgcccgctcccgacacggcggcggcgcgacgacgggacgccggcccgcagcgtagcggtacgggggtggggagaagaagaaaggagggtaggggtacggcgggggcgagggtggggggaggggcatgagattaggtggcaaggcgggtggcggttcccccgcggcggccggagccggccgagccgccgcccccggtcggctcccggctgccccggtgtcgtccgccgcgtgccagcggtccagcccgctgccgtccgtcccagttgcctcctctactgctccggcttagcagcagcatgaaccggagcccgcctgcagcatgctgtagatgttctggtatagttattcattaccgggagctgatgcgccggcgagacccggccggagggtggcgagctgtgtttaggccagggttgatggcctgtccagatgtgggctcagagagcagagagaggttggctgcccgtgcactcagtggtacctgtgtacagtacaagttgcttgcatcagcgatgctggcttgggcccgtcgtatctgctggtccgggtggctggatcagcaggggtcgcggggggcgtggtaacagattgtacaggaggaanaataaaaggaaactcaggt

SEQ ID NO: 2344 - DNA, 1164 bp, Triticum aestivum
  unsure (1)..(1164): unsure at all n locations
  Clone ID: PAT_TA_2344
gtccatggcggaggcgccgccgcccaanctgctctacattgccgtcgccgacggcggcggccggcgggcgttccggtacacccgccccgtcctgcagagcaccctccagctcatgggctgcaaggctcgccacgccttcaagattagcaagagagtgttcagtgtgatgaggagtgaattcttggatgcatcaaggtcagacagggctgttaaagaagaaaatgcctctagcctgggcattggagaagatgctgagatgcttaacacagatattctagacgcaactggcagcagcttgcccttcgaattgtacaagacgcagacaacgattcttgtttcaagagagaggtttctgaatatcgtgtgtgatgcactctcttcttacaagtatgttggaccaaaccagaaggctgacttgcttcttgcttgcagaattaaggagaaaaaggaatcggtgacagtactcttgtgtgggacaagcgggtgcggcaagtccaccctatcgtctctgttgggtagtagattgggcattacgacagtggtttctactgattccatacgccatatgatgagaagctttgcggatgaaaagcaaaatcctcttctctatgcgtcaacctaccatgcaggcgaatacttggaccctgttgcagttgctaagtcaaaggcaaagaagctagcaacggtttctcataccaatggaggcaaagatggcacttcagatgttaaatctcatcatggctcctnagatttacctcctaggaccgagctggtgggcagcaaacaaatggcgatagaagggttcaaggcgcaaagcgagatggtcatcgacagcctggacagattaattacatcctgggaagagcagaagcaatctgttattgttgaaggagttcatttgagcctcaattttgtgatggggctaatgaagaaacatccttccataataccatttatggtctacattgcaaatgaggagaagcacatggaacggtttgctgtacgcgcaaagtacatgacactggacccagcaaagaacagatatatcaagtacatccggaacatcagggctatccaggagtacctttgcaaccgagcagacaagcatcttgtacccaaaattaacaacactaacgttgaccagagcgtggcagcgatacatgc

SEQ ID NO: 2345 - DNA, 1561 bp, Triticum aestivum
  unsure (1)..(1561): unsure at all n locations
  Clone ID: PAT_TA_2345
tgcaggnaattcggcacgaggctcctccccgtcccccgtcgtcggcctgcggggcgtggtcagctccctcgtcgccttcttcatcgtcgtcagctccgtctccctgctcttcgaccgcggccacgagtcgcaggtgcagctggcggtgcagcaccggcaccaggaggtgaaggtggccgcggccggccgccgcgaggcgcaggtgcagtggacggacgagctcatgggcgaggctgtaaggggctctggcgaggagtgcaactggtccgtggggcgttgggtgtacgacaacgcctcccagccgctctactccggcctcaactgctccttcatcttcgacgaggtcgcctgcgagaagtatggccggaatgacaccaggtaccagtattggagatggcagcccgatggatgtgatcttccaaggttcaatgccacaaaactgctcgaaaaactgaggaacaagaggatggtcttcgtcggcgactcaatcaacaggaaccaatgggtctccatggtgtgcatggtggaggcctccatccctgaaggccagaagatgcgcgtttacaacggctcgctcatctccttcacggcattcgaatacaatgcgacaatcgacttctacgggccgccgctgatactggaatccaacagcgacaacccgataattcaccgggttgagtaccggatcatacgggcggagaagattgagaagcatgcccgtgcctggggcaatgctgacgttattgttttcaactcttacctttggtggaggaagcagaagcccgatatgaagatgaaggtcatgtatggttcattcgaggatggtgatgcaaagctagacgaagtggagatggtggaaggttttgagattgctctcaagaaactaacggagtgggtgggagcgaacgtcaacaacaagactaaaatctatttcgcaggctcgtcgcctacccatacctgggcgagcgactggggcggagacgacagcaacaagtgcctgaacgagtcggagccgatccagaaggtcgggtacaaaggcgcgaccacggactacagcatgatggacatggcgaagcagatcttcaggccactggagcagaaaggcataaacgttcagatactcaacttcacccagctgaccgactaccgcatcgacgcgcaccccaccgtgttccggcggcagttcacccccctcacgaaggagcagatcgccaacccgagcagctacgccgactgcacgcactggtgcctccccggcgtcccggacgtgtggaaccacttcctctactcgtatctcgtgcagaaatgatgtaaatatacatatgcaaaccatttcttgttcgttcggggttttgttgttgcggttgtgggagggtctagattaggccgccgctgcctttatgtataggacatgccccgcgtcaaaaaagaaagaagaagggtttctctgcacttgcttgtaaagagccaaggaagtgtatatgagtactcctacgtgaaagggattaaggagatgttcattttggaggcgtggaacatatatataatccagcctgcaaat

SEQ ID NO: 2346 - DNA, 741 bp, Triticum aestivum
  Clone ID: PAT_TA_2346
tgggactccgatacggcatcttgcgcctctcccctgctgctggcggcgctgctgccccttcccgcgaaagcgtcgagcaaactctacatcgtgtatatgggggagaagaagcatgatgacccgtccatggtcaccgcgtcgcaccatgacatgctaacctctgtttttgggagcaaggatgaagccttgaggtcgatagtttacagttacaagcatggattttctgggttcgcagcgatgctcaccgagtctcaagctgagacaattgcaaaattccccgaagttgtcactgtgaagcctaacacttatcacgaaacgcacacaactcggagctgggactttctcggccttgaccacgaccgaccacgacaacagccgggccttctgcagaagagcaaagtacggtgaagacgtcatcgtcggggtgatcgattcaggcatatggcctgaatcacgaagctttgatgacaccgggtatggccctgtgccggcacggtggagaggcgtgtgccagactgggcaggcgtgcaacgccacgagttgcaacaggaagatcatcggggcccggtggtacgggcgtggcatcagcgccgacgtgcttaacagggactacaagtcccctagggacctcgctggccatggcacgcacgtcgcctcgaccatcgccggcagccaagtgcggggcgtgagccacggaggccgtggcctgggcgtcgctcgcgcccgcgcgccacgtgcgcg

SEQ ID NO: 2347 - DNA, 1680 bp, Triticum aestivum
  unsure (1)..(1680): unsure at all n locations
  Clone ID: PAT_TA_2347
ccatttccatgcctctctgagtcttggtgttggcccaatccgggagttcacgttcacagataactctagctgggttaggagtaggaatgtcagtcttggtgtgggaattgcccccgggttccctgagcctgtgcgcatccgtgcggcaaaaactgaagctttcatggttaaggaccatagaggagaattgtacaagaagcattatccacctgcattgaaggatgaggtctggaggttagagaaaataggaaaagatgggtcgttccataagaggctgaataaatctggaattttaactgttgaagatttgcttaggcttgtggttcacgacccacagtaagctgcgtactatcctcggaagtggtctaatcagggaacagcaggtgatggcatgggtctggaactcggccagttgcatcacgcaatttctcaaggccatccaattcagccagcaaatttcggctacgataattggcatcacaaccgtgatggtcagtatgctgatgatttcactgaagacattcgcctgaaaagccacgaactgctcgagggtgacgacatgcagcagctgctcagggtcttcaatatgggcggagcttctactggtttgccagacgaaacgttttccttcccttgaatgcaatctccattgccaaacccagacttggaaggtgagcccagccgtccatcgggcaaagccgttgtcgggtggctcaagataaaggctgctatgagatggggaatatttgtcaggaagaaagctgccgaaagaagggcgcagattgttgagctggaggattaagatcttggcgtgtgctcaccgttagacgttactgttgaaatctcaaatacctagctgctgttgctgcgaactagttcgttggctctcgcatgcgtcgtgattgccatcagaaccagctttctgtatctctacagcaaccagttcaggccccctgaagtagaaatatgttaattcgcatcactgccgtgttgctccgtatgctgatgatttcactgttgccattcgcctgaaatgccgccgactgctcctgggtgacgacatgcagcagctgctcaggatcttcaatatgggcggagcttctactggtttgccagacgaaacattttccttccctgacattccatctccattcccaaacccagactctgaaggtgagcccagccgtccatcgggcaaagccgttgtcgggtggctcaagataaaggctgctatgagatggggaatatttgtcaggaagaaagctgccgagagaagggcgcagattgttgagctggaggattaagattttggcgtgtgctcgccattagatgttactgttgaaatctcaaataccagctgctgttgctgcgaactagttctttggttctcacatattcgtcgtgattgccattggaactagttttctgtaaatctacagcgagtagctctgctaccttgtaaaaaaaaatgtcgacttgcttccttgtttaatttcaacataaattcttgtttagcttgtttccgtttagcttaatttgtgcagaatattactgtagaagatggtgtgaattgatgttgacagtattatgcatttgtggctattaatcggttggagtccagaacttctgggagaacgttcttgcaaaaaaaaaaaaaaaaaaaaaaaaaaaaancctcgg

SEQ ID NO: 2348 - DNA, 553 bp, Triticum aestivum
  Clone ID: PAT_TA_2348
tccacgcgtccgccctcgcgtccggcttgttattgatcgtgccatctctactgcgagtgtgatcgagctagtgatcaaacgcgagaagatggcgttgcactggagcggcggcctcgcggtcgccgtcgcggcggcgctggccgtgtccgcgctcttcccggcgggcgctgcgggtcacccgccgctcccaggcccgttggtcccgcagttctacgagcacacgtgcccgcagatgcaggcgttggtgggcgccatcgtggccaaggagcacgccaaggacccccgcatggcggcgtccctgctccggctgcacttccacgactgcttcgtgcagggctgcgacgcgtcggtgctgctcgacgccgacggcagcggcaggttcaccaccgagaagcggtccaacccgaaccgcgactcgctgaggggctacgaggtcatcgacgagatcaaggccgccctcgagcacgcctgcccccacaccgtctcctgcgccgacatcgccgccgtcgccgccagggactccaccgtgctgacgggtgggccgggctgggag

SEQ ID NO: 2349 - DNA, 681 bp, Triticum aestivum
  Clone ID: PAT_TA_2349
cggccgcgtgggccgctgcgtgggtttgttcttcgctacaccatattgcactaggtagctcgctcaatacatactacagtactactgtagtatccctctctctactttatccaatttatggtcgtacgttagttctctcgggttcagttatggagtaggataggagtagaaggaagacgactatggcaggcagcagcagcatcccagccaccaccgtccgtgagatccgtgttgtgcagcgcgcggacggggccgcggcggtactggccatcggcacggcgaacccgcaccactgcgtgccccagggcgactaccccgactactacttccgcgtcaccaacagcgaccacctcaccgacctcaagcccaccttcgccaagctatgcgggatgacgggcatcggcaggcgtttcttccaccacaccgacgaaatgctcgccacgcacccgaacttgtccctcgacgcccggctggacgtcgtggctaccgctgcgccggaactcgccgcgtcggctgccgcgaaggccatagccgaatggggccgtccggtgggcgacatcacccatctcgtcgtcagcaccaacgcgggatcgcacgccccgggcaccgatgtccgcttggtctccctcctcggcctcagccatgatgtcctgcgcaccgtgctccagctcaacggctgcg

SEQ ID NO: 2350 - DNA, 1884 bp, Triticum aestivum
  Clone ID: PAT_TA_2350
cgtgcgcgccacgcgtacgctctcgccttgtttgctttgttcttcacaaggtacctcgatcgtgcccacttcatacaactctcgggttcagctatctatctatcaagtggaataagagtagaaagtgaaggggtttttgaacctaaaaaacgatcgcttttcaacgatctgattctacttaatattgcatgcaggaaagtcaccatggcaagcagcagcagcatcccacccaccaccgtccgtgagatccgtgttgcgcaacgtgcggacaggcccgcgtccccacgcgcattaatcatttgatcagcctctcgccttgtttgctttgttctttgtaaggtggagtaggtagctcgctcaatacatacctctctcgatcgtctctgctttatccaatttaggcacttgtgttcagctatctatcgagtaggataggagtacaaggaaagcgaccatgtcaagctggcaagccacagcagcatcccagctaccaccgtccgtgagatccgtgttggcgaacgtgcggacggcgctgcgccggtgcgggccagcggcaccgccaacccgcgccactgcgtgcgccaacgcgacctccccctttaccacttccgagtgcccaacagcgaccacccccccgaccaccagcgcccacctgtccggctttacgggctgacaggcatcggcaggcgtttcttccaccacaccgacgaactcctcgccgcacacccccccatgtccctcgacgcccggctggacgtcgtggctaccgccgccccggagctcggcgcgtcggctgccccgagccccgtcggcccggcgggggcgtgcggtcagcgacatcacccatctcgtcgtcagcaccaacgcggggtcgcacgccccgggcaccgatgtccgcttggtctccctcctcggcctccgccatgatgtcctgcgcaccgtgctccagctcaacggctgcgcttccgggtgtgccgccctgcgcctagccaaggacctcgccgagaacaaccgcggcgcgcgcgtcctcgtggtctgcgtcgagctcaccatcaccgccttccgcggccccgacgagggggacaccttcgacaccctcatcccccaagggctgttcggtgacggcgccggcgcggtcatcgtcggtgccgaccccaacgcccacgagcgcccgctgtttgagatggtgtcggcctcgcagtacgtgataccggacaccgagcacatgctcaccatgcagctcggcaatggtggcatcggcgggaccatcgccaccggactgccaagactggcggcgggcatcgttgagcggtgcctgctggatgcgttcggcaaccacctagccgtcatcggaggcgtcgtcgaatggaacaacctcttctgggccgtgcatcccggcagcagtgtgatgttggaccacatcgtcagggcactccggcttgctccggggaagctggcggcgagcagaaccgtggtgagagagtatgggaacatgctgggcgccacggtgatcttcgtgctcgatgaggtcaggcgccaaagagaagatcctcaaggagagggagctggccatgatgaaggctggggggtgatgatgggatttggaccggggttcactgtggaggcgatgctgctgcacgccgctacctaggtaattagaaagaacaaataaaaaacacatggcatatatattcaataaagtgcatgaaatgcaaccttttatatttccatatccacatatcacctatatatacgtaagtgtaagaaatgtgaacatgtggtgtgagagtggttaagtcctgtaagagtgatctacaatatatggttataaataaaattttagctacttgcaagttgcatcaaaaaaaaaaaaaaaaaaaaaaa

SEQ ID NO: 2351 - DNA, 307 bp, Triticum aestivum
  unsure (1)..(307): unsure at all n locations
  Clone ID: PAT_TA_2351
tcacgcgtccgcccacgcgtccgcccacgcgtccgtgaatcgggagcctaaatcatcggccgcgatttgagactctttttcgcgagggctggtcccgagtgggtcttgtctgtgttgtttctttccttttgtttctatttgaagccacttgcttcctggcagtgttataagaagagtggcatggggtttccccacttattatttcccttctagcttcaatctgtagtacgctgtttctgaatgtacgaaaacaggccaattttttgcattcgatcttctcanttgtggacatgttaaaaaaaaaaaa

SEQ ID NO: 2352 - DNA, 1080 bp, Triticum aestivum
  unsure (1)..(1080): unsure at all n locations
  Clone ID: PAT_TA_2352
cctaatgctcctactagctttctgacgttggcaaatgatctgactcctctcacttggcctaggaggaacaccactgatgatgagagcagatcctttcccttaatagattagcatcattccattcttactttgtagtagaattggtagtgatagagtgggtgaatctatgtgatgtagagatacactaagatcatgcaaaaatatatattagttctgctaatgcttaccagtgaattcaagtctgcttatttgaaggtccaacgcttgtgcatactgatttgtgtcctctgtgatttggggagaggaaatagtaatgttgccaattgatgtagtggtttgcgattcggatcaactaaagtgaaagtgagatattgagatgtggatcacactagtgctatttcagtatttcttgcttgcttgtttgcttcttctttctgctgaagcaggtgagctgattttctgcttttggtttctgcagcaattggaggaattggtgtcgaggactggaccagatgtgccttgatgcgtgatctacagcgcccttgatctcaggaccatgagcggaggctggagcagatccgaagggcgttctagggcctcgagggctcccacatatgtcccttccagtatgcttcgacaggagcatctgcggagagggtcatggagtgggtctcagagctggctcatccacttggaggttatgagatatgctgcttgagagatgacgttagcaaactggaagggctgcaaccaaatccaatcaacaacatggtagtggtctctgaatatctaagctagtgataatcttttcagcgattccttttttgtttggccttcttgtagtgtatattagtagttgctggagctgtgatggtgatctttttttctgactggctgtttgttatagatgacaaatcttttagttgccgcttcttatgtattgataatgtgatgaagatgtaactgcaacaaatgatgtctgattgtacagagaaacaaatgtggctttgatggcaaaactgaaaaacaccgccctgggccgccagagaacaattcnacntccnggcccaaattcccccc

SEQ ID NO: 2353 - DNA, 864 bp, Triticum aestivum
  unsure (1)..(864): unsure at all n locations
  Clone ID: PAT_TA_2353
cccatccctgcagcaggtggccatggccgacccccccgcgttagcgcgtgctcggcacgtcccgagcctgcaccccgtggccatcgccggcgcccccgagctagctcgcgctcgggccgtcccgcgcgcgcccgccgacacgcacccgtcgccgagctcgctctcggcatccgcgtcgccgagggcaggcattccctcttccgtaacatgaataagtcgccgctactccagcgagcgcccgctactcacaggcgccacttgcggcgacccctctgcctgctcctactccgccactctcgtctgtattcgcatcaccggctccatccccgcaggcctcaacgacaatggcggttttcgccctgctggcgcctacccgcttctcccccgccccccccggaggggccacatccgcacagcgccccgcgcactcggacgtcgcctctcccactcccccccactcgtccgcccgagcaacccccggaccagaaacgtcagcgcccacggacgccaggccgtctactccggcacacacgtgctcttcaccaacgccggcaccggcaacgtcgtcgccgagggcaggcactccctcttcggtaacatgctgaagtcgcctccacccaagccagcagccactactcacaggagcaacttgtgatgatgcctctgcctgcctgctcctactccactattctattctgtattctgatgaagagtacttgtcatcagacttcaagtataaagaaaatatgttctgaacgggcgcctactccaagttcggcttgtatatgtaaccttgattcagagcagcgcgatgtatgatgtgtattatgcaactcaactttggtaatcanagctactatnatt

SEQ ID NO: 2354 - DNA, 978 bp, Triticum aestivum
  Clone ID: PAT_TA_2354
ctgcaggtaccggtccggaatttccgggtcgacccacgcgtccgtcttcctttagtacgatctcccatcaaactatgaagatactggcaaaaggttgctgatcagcgagggttattctaaatgaggaagtctggcggcagattgaagatatgtgtgggatgacaaaggctgctgctgttcctgtaattcctgattctgaaggcaccgattcaaatccattctctcttgaagctcttgctgttttcatgtttcgtgtactccaacgggtcaatcttccgggaaatctggacaaagcatcaccaaatgctggctatattttgctaatgttttacaacctctatgatggcaagtcccgaagagaatttgaaagtgaattatatgagcgttttggctctttggttaagatgcctctcctgaagccagagagagctccattgcctggtgatgtcaaaactatcttagatgagggaatgagcttattcagactgcatcaaagcaggcatgggagagtggagccatcaaaaggttcatatgcccaagaatgggctcagtgggagaaaagactacgtgtggtcttgtcaaggaatgctaattatcttacatccattcaggttccatttgatgttgcggtgaaagaagtactggaacagttgaaggctgttgcaaaaggtgatgtcaaaactcctgatactgcaaagcgaaggtttgggaatatcatttttgctgcggttacagtaccccaggcagatatattgagccttcttcgaaagttggtccagaatgatggtgatgtaaacaatgttctcaacggcattaaagtggtggataacctaagcaaggcttatgtcactcttgcccacaaaagagcccatggggtagctgcatttgctagctatggagtttaccacaatcaggaagtcctagcgttatttaacgtccttctctacactgataagaaggctgttcttgatgcacatc

SEQ ID NO: 2355 - DNA, 439 bp, Triticum aestivum
  Clone ID: PAT_TA_2355
gttgacatgccctggtatacgcggtaggcttccaagtcttgggcttgggccgccccatggtggttgggccgactcttccttccattgctataccctgggggcttaacatcgtccatagcccttgagtcccaccctgcgccttagtaacgggaaaaaccgagaaaaaatatatgcctaaaccatcggaacggagggagtacaattcccgtatattaagcatgctttgtgagattaagtctagagtctagacctttataatatgggctcaccacataatctgacagatcatattttttagtttatatggaagaacagggtgtggctcatttgcctcttgttttaataacatatactccctccgtcccctaatgtaggacgttttttgacactaatgtagtggtcaagaaacatcttacattatgagacagagggagtattg

SEQ ID NO: 2356 - DNA, 554 bp, Triticum aestivum
  Clone ID: PAT_TA_2356
aagaagtggttcagtgatcacccacgctatatttcaaatcctttttaccttggaggaagttcatatgctggaaagatgattccagtcatcgcacaatacatctcacaaggaaacgaacaaagaaggcaacctgagattaatctcaagggctatctagttggcaaccctattacaggctccgcatttgatgatttcaacaccaaaataccatatgctcatggtgttggaattatatcagatcaactatatgaggctgcaatggcgagctgtgatggagactatgtaacctcagtgactaaaatgtgcgcgggggttctaaataccattcaaaaactcatttctgaagttgacgagggatatatcttagatgatagatgtgtacgtgctgctcccaaacctgtgaaggatgatcctccaagaagtaggtttctatcagaagaacagattcagccaaccgaatcatctgctgatcccactatcaattgtttctcatatcggtactacctatctaacatttgggcgaattacaacaggactagagatgctcttaagat

SEQ ID NO: 2357 - DNA, 859 bp, Triticum aestivum
  Clone ID: PAT_TA_2357
tgcccgactctaatcaggtcatctaatcctgaaacagaagcacttcggaagagcagccaggcctactgtgctcaaccagcttgtgcagagccatcctgcatgatacagccatcgtgcacagcccccacaacatgctttggccctcggttcttctcgaagtcgaagaaagatcgaaagccaaagcctgaagttgtcaaccaggtccgcccatggccggagctcatggcagaacctagtgatgctcgatcaatgtcatttgttggcacacacgagtacttggcccctgagattatcaaaggggagggccatggcagtgctgttgactggtggacctttggtatattcttatatgagcttctgttcggcaaaacacctttcaaaggttcaggaaaccgagcgacactgttcaatgtcatcggtcagccgttgcgtttcccggaatacccagttgtgagcttctcagcaagagatttaataaggggcctacttgttaaggagccccaacaacgattgggttgcaagcgtggcgccactgagataaaacagcatccattttttgagggtgtgaattgggcgttgatacgctgtgcgagccctccagaggttccgaagcctgttgagattgagaggcagactacaaagctgcctgtgtcaacatctgaggctagtgcagcacctactggtgcatcccagaaaggctcggataactatttagagtttgatttcttttagtgaacagaatgttcattttctccatttgtttgcataattagaagttgtaggcttttcgcatttatgtgtctgacagatgagtcgtatgtagatttttgtgtctgtcaagctattttctgttttgtag

SEQ ID NO: 2358 - DNA, 367 bp, Triticum aestivum
  Clone ID: PAT_TA_2358
ttcgtatccgggcatcgatcagcgcgcgcgcgcgcacagacttcgataatcatcgtcggcttccgagcgagaccggtccaatcttccaagaaaacgccggaggggatgagggaggaggggctgcggatggcggaggacgcgccgggcaccaccggccggccgcggcggctgacgcgcgtccgcacgctcggccggggcgcgtccggcgccgtcgtgtcgctcttcgcggccggcgacggcgacggcgacgagctgctcgcggtcaagtcggccggggccgtcgacgcgcaggcgctgctgcggcgggagggcggcatcctggcctcgctctgctccccgtacgtgctcccctgcctcggctctcggt

SEQ ID NO: 2359 - DNA, 843 bp, Triticum aestivum
  unsure (1)..(843): unsure at all n locations
  Clone ID: PAT_TA_2359
tgttccagctagctacctagctacgggtacagcagctcagtcgcgatggctcacatcctgggcatccactcacttgtcctcctcctcctcctggcctcttcggcggcgtctaccgacatcgtacttggccagaaggccggcgcggctgtggaggcacggccaggaccggggaagtacgcggtgatcatggatgccggcagcactggcacccgcgtccacgtcttcaggttcgacaagaggatggagctcgtcgacgttggcggcgacattgaggtcttcgccacggtgaatccgggactgagctcgtacgccggacggccacaggacgctgccaactccatcatgcctctgcttgagaaggccaacaccgctgtgcctcggtcactcatgaggagaacacccattaaacttggggcgaccgctggactcagactcataggagacgagcacgcggagcaaattcttgaagcggtcaggagtgttgtccacaccaagagcaagtttcagtacaatcctagttggatcaatgtgctccacggatctcaggaaggatcttacttatgggttgcgctaaactatctgttggacaaattgggaggagagtacgccaagacagtaggtgtgattgaccttggaggtgggtccgtgcaaatggcatatgccatttctgcagatgctgctgctgccgctcccgtggttaaggatcagtacgttacgaaagagtatctcaaaggaagagatnacaacgtatatgctcacagctacttgcactacggcgcaatggctgctcgaggagagatcttcaaggcaaagaatggaccagtcagctactgcatgctgcgt

SEQ ID NO: 2360 - DNA, 449 bp, Triticum aestivum
  unsure (1)..(449): unsure at all n locations
  Clone ID: PAT_TA_2360
cccgcgggtacgcgcaggcccggccccactggctcgacttcacgactggcgacgccaccgtcgaatacgacgtcgacgtcacgcactaccatgaaaatgcttcaaaggcttttattttcctcgtttgtttacttccggttatgctttgctttgagatttgggcgttttctttgtcctaaatatcggtgcctttttttttgggttaactgcctgtcaagttgcaagaataagtggccctatgtgaaacagtgaaaggcgtatactttttttattaattgaaacttttctatcgtacttttttttttgctcgagagatgcaaaaaccttgcattttgaaattttgangcattgatgtgtaagatcaangacacacatttgcatgggcaaatacaactgntanacgccacatcaatggccnaaccctagggggggccnggtnccaattccnc

SEQ ID NO: 2361 - DNA, 666 bp, Triticum aestivum
  Clone ID: PAT_TA_2361
gctagcgaagacagaaccctcctatggccgtccactccaatagcaatccaatagaaaactaaatacatcaccagcatcaatggccaagtcacaggcattggctgcaacattgttgcccgtcccgctggtgtccctggccgcggcggtggcggctcgtcgcgtgtccggttcgtcctttgtcggcctccggcggcggcggccagccccgccagtggaccacccgccgagcggtccgccgcccgagggttgtcccgcctttcggtgcgccatcccgctacgcatcgcacgccccgcaggcggcgccggatgatgcctattgacgcacctccttgccatgggcactaccatggcaatgtgcggcacttaccacgccaaccaactgagcctcggatgatttggaagtactacccataacatcaacgtgtgtgtcaagatgtggggggtcatatgatcctacactttctctctaattaataaaggacactggaaaggattgagcacttggcctaatggtgttttgtcgttgaggggtctggccatgaacttggcgcactttcctgtgcggagctgtgggcttgtaagagcttgttatccgtgccgtacgcgcagtcccataaactggtaaccgaatgtggtatcttatactggtaaccttgtatgtgtctt

SEQ ID NO: 2362 - DNA, 424 bp, Triticum aestivum
  Clone ID: PAT_TA_2362
tgtcacacgaggcttgagagagagagagggagagagagagagagattaccatgtgaacaggcccttctttcccctgcttcgggccaagcttaccgcgacgacgatggcgaggctgctgcttctcgggttctccctgctgctgctcacggggctcaggcccggccgcgctttcctcgtcgcggaccctcagcccgacgtctcagacgacgtgccggcgctgctcgccttcaagaaggccatctacgacgacccactcgcgaggctgtcggactggaactccagcgacccggatccctgcctgtggttcggcgtcacctgctcggatttcgacgcccgcgtggtgactctggacttatccaattcatctctcgtggggttcctggcaacaaggattggattcttgacttctttgcaaaaactcaaa

SEQ ID NO: 2363 - DNA, 683 bp, Triticum aestivum
  Clone ID: PAT_TA_2363
ttgtccacgcgtccgcccacgcgtccgcccgcgcggccgcgcccgcgtcgctccgtttggagttcgagaggacggcaagtcgaaggcgtcgatttcgagccaaattcacatgtccaaagatttgtggacggttgcaatcagatgagataccaattggtagcaaagatggcagtgcagttactgttgcggcggagaacattgtttttcacgatgcagcagtttctgaaaaagtaacactgggttcatttgctggagactacgaccaagatgatgacaatgcggcagctttaggtgaataccttaagcgaccagtgcgcttggcgagttatgcgtgggctcaaggaggaggttttgcacagagcatcaccccttgggcggcatatttttccgacaccttcatccgtaggaagttggagaactacggcaaaattcggtgcaagttacatctgaagttcatggtaaacgcttcacccttccattatggaagtttgcgtgcgtgctatttccctatgggggatgcgcgctcgacgttcgtgaattcagcagatttgcttccattctcgcagacaccaggtgtgtatatcgagccgcagaatatgacatctgcggagcttgttttgccttttgtttggcaacacaactggcttgagatcactaagcttagtgattttcagcgtatgggc

SEQ ID NO: 2364 - DNA, 1237 bp, Triticum aestivum
  Clone ID: PAT_TA_2364
ctcctcctcagcccgtctgcttgactggcgcggagtggggggcagatccagccgggccgacgattctaggagcttcgaggatgaggagctgggctaaccgcccccactcatcccttctcgcctctttcctcgcggcctcttgccttctcgtggccggatcgcctcaggatttgcatgaagcatctggatccagaattctgcatcaaacaaagccacacacacatgagatgcattgttcaagggaaaggagccgtgcagcttggaaagctgttgatgagtacttgatgccctttgtggagaaggagaaatatgaactcccaagcaaatgcaggcttcgtcctgaaaatgacatgtttcgggaacaagagcaacataagatccattttgatgttaatgagtggcgttgtggcttctgcaagaaatcatttcgagcagaaaaatttatcgatcagcattttgcaaaccggcacaataatttgttggataatactcaaggaagatgctcggccgagctttgtgaagcacttcactgtgatctgacaatggagttcaagaaaccaaagagtaaatgcaatgctgctgcagctgcaaggaaccgtcatctttgtgagaaccttgcggacagttgctttcctattaatcaagggcattctgccatgccgccttcatgaatttcccttgcccctgtgcgggcctgcccgtccgtgccttgccggctcctcaccggccccctgccggccctcgtcacgaactttccgtgccccccttccgcgctgctccctctcgctgcggcgcctccctgcctttccccaaaggtggcaggaaacaaacaaacagattctacctggctctctgcatcttgacgatgctgcttttgcctgtgttctatctcatagtatttttacaccagagggaaatgaagaaaggagatcaagttttcaaacgaattggaaaaaccgtgcacaagaaaaagccgtcctacgttgtaagatccctcgctacccattacccaagctccttgagatgaactcaccattttgctccttagtggcaattagctatgcatgtcatgttgtcccttcatacgtctctcttcccttccccttgatgactcaagttcctgcaacatatcctgttgccttcgctagttcggcttctggccctcctctgtccctatacggccgtgcctggcgcaccgatcaatacatcgcgattgcataaaaaaaaaaaaaaaaaa

SEQ ID NO: 2365 - DNA, 1072 bp, Triticum aestivum
  unsure (1)..(1072): unsure at all n locations
  Clone ID: PAT_TA_2365
ccgcctccctcggcgccgcctacttccaggacccgcacgacctctgcgagtgccacccggacgtcgtcctcctcgccacctccatcctctccgccgaggccgtgctccgctcgctcccgctccaccgcctccgccgcagcacgctcttcgtcgacgtcctctccgtcaaggagttccccaagaacctcctcctcacctccctcccggagggattcgacatcctctgcacccaccccatgttcggcccggagtcggcccgcgacggctgggacggcctccccttcgtcttcgacagggtccgcgtcggcgactccccggcccgccgcgcccgcgccaacgccttcctcaacatattcgagcgcgaggggtgccgcatggtggagatgtgctgcgccgagcacgacgcgcacgccgccgagacgcagttcctcacccacaccgtcggccggatgctcgccacgctcgagctcagctccaccccaatcaacaccaagggctacgagacgctgctccgcctcgtcgacaacacctgcagcgacagcttcgacctctacaacggcctcttcatgtacaacaagaactccaccgacctgctcaaccgcctcgagtccgccatggactccgtcaagaagaggctcttcgacggcctccacgaggtgctccggaagcagctcttcgagggcaaggcctcgccgcccaacaccgccaccaccggccaccacgccgacgtgcaccggaggcagctcctcctggagggcaagcccccctcaccctcagtgcccacccccaacaacgttaccgtccccaagtagcctcctctctccctcccctcccctcccccatgcctggcttgctctgctcctgtgctccatggtgatgtactatgatcaatttcacttctttgctggtcttatacattgtgttgtattctattgtaccagtttgtatttctgccaagagtgattcccccatacggggaaagaaaagcttgcaccgaattatggatgtatatgggaatgatgaaataaacttgaattgacattggagtgtcatcaaagaaaaaaaaanaaaa

SEQ ID NO: 2366 - DNA, 939 bp, Triticum aestivum
  Clone ID: PAT_TA_2366
aaaatataacaaaccccaaaagcttatttacagtccagtccatcaaccaccgccggtcagcttctccggccaccgtgcatcgcgcaaacttggcctgacagaatcccgtgttcttctccggcggtggctggagagatggggttctctctgtaccccatgaagacgtcgacgcgcatgctgtggagcaccagcttctaccgccacaagttcccggccgccgccgcctcctccttctaatcaagcaagctccggcccgcccgccgcccccctccggggttccggaggaggcgggggagcgcgtggtgcgcacacgtatatgtaataattttagtgccgcaagatagggtcttcttctttggttcttgatagagttttctatggaatccggccgcctcattttcggttcggccgcgccgtgccgcgctgccggcggcggaggaggtcagatgatgctctttggcggcagtgggagcttccttggaggctcgccggtggtggccggcgtggaggacgggcggcgtaagaggccgttcttgacaacggtggacgaggagctccagatggacgaggagatgtacgggtactacggcctcgacgagcacgcgcccgagaggaagcgccggctgacggcggagcaggtgcgcgcgctggagcggagcttcgaggaggagaagcggaagctggagccggagcggaagagcgagctggcgcggcggctgggaatcgcgccgcggcaggtggccgtgtggttccagaaccgccgcgcgcgctggaaggcgaagcagctcgagcaggacttcgatgctctcagggccgcccacgacgagctgctcgccggacgcgacgcgctcctcgccgacaaccaccgactacgatcgcaggtgacatcactgaccgagaaactgcaagccaaggagtcgtcggagctagaggagcgaa

SEQ ID NO: 2367 - DNA, 822 bp, Triticum aestivum
  Clone ID: PAT_TA_2367
tcacgcgtccgggcacagatgcggttttcctctctcttatacgtgcattcagctggaatcccgctacatttcttcatgcataccctccccttccccttgcccaagcaacaagacaggctgctaccgcagttttgcaggacattgctgattcgggagttctgtttgcactgttgatgtgtgatcacaaggttattagtcttgtgggagcacaaaaggcaactttgcatcctgatgatatattactacttgcaaatttcatattgtcctccgaatcttttaggacttcggagtctttttcacccatatgcttgccaagatacaatcctatggccttcctatacgcttatgttcatttttttgatgaaaatacttacttgactcttcttactccgagatcagatgccttctttgatttgaaagattcaagggcccgcattcaggatgttctatcgaaatccaatgtccttctcgaagtccaaaggtctttgcatgagaatgttctgcgtgttgaagatgtccccattgatcctacttctcaatctacatcagctcctgcacagtcttctcaaggcctaaattcccaaccgttgtcttctgatgaggcaattggtggaccagctggactttggcattttatatacaaaagtgtctaccttgaccagtatgtatcgtctgagtttgccttgcccataagaaatcccaagcaacagaagagattgtacaaggcttatcaaaaggtttatgcttccatgcatgataaagcaactggtccgcacaaaactcaattcagaagaactgaggattatgttatgttgagctgga

SEQ ID NO: 2368 - DNA, 800 bp, Triticum aestivum
  unsure (1)..(800): unsure at all n locations
  Clone ID: PAT_TA_2368
ccacgcgtccgatagcatggcaacaccaactgttgatggagctatacacagggtatccatccaccttgataacatgtgtatagcatggcaacaccaactgttgatggagctagagaagttctgtcgtacttgggctgtaaggatgcaactggaagagacattattcagaaggtggtcatcacggatcttagggaggaagtggtagtttacatcaagggaacaccgtttgttttgagagagttagatcaacctgttgatacactgaagcatgtgggaataagtggcccaatggtagagaacatagaggcaaggctgaaggaggatatactttctgaagttaaacagctagaaggtcggctgcttctgcatcaagaagaatttaacacagccacaaatcaatgcagtgtactaggttattgggagcacatagatctggaggacgtaatgacaccggctgaagtgtacagcacattgagggatcaggggtattgtattgactacaaaaggatacctctgaccagggaaagagaagcattagctgctgatgttgattcaatacagtcatcaatcaatgaatcttctaggtactatctctttgtttcacacacgggatatggtgggtgttgcttatgcaatggccattacatgcctgagacttggtgcagatgncaaagtttgtcatggaacaaacagcagaaacacacttcgtatcaagttctcttacaaaaagtgtacctgtgaaaaccttcactgacatagccctcaggcagggggactaccgtgacatactaaaccttact

SEQ ID NO: 2369 - DNA, 1452 bp, Triticum aestivum
  Clone ID: PAT_TA_2369
gagcgcccgctccctttgggagttgcaaccctcaggcgccgccgtcgcaacgacccaccagcccctctctccgccgcctccaacctagtgctccggcgagcttgccggcggaggagcgatgggtgagcggaaggtgctgaacaagtactacccgccggatttcgacccggcgaagatcccgcggcggaagcagcccaagaacaagcagatcaccgtgcgcatgatgcttcccatgagcatccgctgtggcacttgcgggacctacatctacaagggcaccaagttcaactcgcgcaaggaggactgcatcggcgagacatacttgggcatacaactatttaggttttacttcaagtgtactaggtgctcagctgagatgaccttcaaaacagaccctcagaattcagactacacggtggaatctcggggcttaggcgcgaagttagtaccttggcggaaaagaggatgaggtggtggggcataatggaaggagaaaccaggagaggaggggaagggccatgcaatgggagcactggggaacagaggcattggatcaaaggaggaccatgaaattcttgccgctttagaagaaatgcggtccatgaagtctagacattgtggagtcttcctttgcccagaggcttgaaatttggaaccattccgctcatcgaaaggaggaaaaaacggtagcagaactagatgaagaagacgaagaactcatcaaatcaatcactttcggaaccccgaagagtttatgttaaacagatcgaagacgatgacgaaggaggcgactttgatgacaattttggtataccaggacagtcaagtgtcacgttaaagatcaatggatcttctgaatcaatgtcgaatccaacagatgtcttgaccaaagctaatggacctgagagtaataaagaaggaaacaagagctctgttgcatctaagatgcccaaattcatagtaaaaccaaagcccgctgctgcaactgcaaatcctcagaagaaacagaagactgaatccacagctgtccaagataacggcaaagcaccggctgctgaggaaaaaattgaagcttcagaagggaagaagaccaatgttcttcagtccctctgccagtatgacagcgacgaaagtgattgactgaagacaactcttcttggagtcataactgcgctggagtagacaaagcccctgcctggaacacgaccgtgtaacccaagcctgtaaattgtctcctcccgcaaagactttggtgccaaatgtatgtccttcgtgctaaaaatccgtgccagctaatttaatccatagactccagatctatggacgatttgaaggcttggttcccggaagcagcattgagattattgttgtattcatgccttcctcctgtgagttgatttttctgcacatttattgattattcagcccgtcctctaatcattcaaaaaaaaa

SEQ ID NO: 2370 - DNA, 971 bp, Triticum aestivum
  unsure (1)..(971): unsure at all n locations
  Clone ID: PAT_TA_2370
gcacgaggctacaatagcatgtcatgtgctatctgcaacagtaaagggccaaggttattccttaccagctgatatccaatatgttgatacacggtgggaagtgcctgtcgttcttccacttcgtgattgcctggcccaagagcttagcctgctctgtgaatttgatagtttaaagacacaggaacttcttgataggccttgcagtggcatcaatggcttagtcgcatcttttgttgcacgactaagggaggagaatccttctcgtgagcatactattgtaagaactgcacaaaaacttaagccattcccttttaacaagttctcagcaaatggctatcatgatttcctgccgtcgcggctgcgtcccaagttccaggatgttgatagcgatgagtctgcttcctctgaggttctctgcctgatatgtcgaagtccattcagtgaatcagaactccagaattttgaaagcacaaggcgcaagtctcagaagaaaattgatctgtatactgcttattgctgtcaaagctgtcatttccagattctaccaggaggtagagacctgtatgaccatttcttttcactaataccaaggttctggactgagagagcagatactgcatctgccagccatagctcgctaagagatcaaatagaagactatcttcttgaagacgatgatgatgggaactgacacttgttcattgagtgagtcccaaacttacttgccagaagcctacagagattccttcctagttgggcctcacaaatcatgacataaaccaaacttgcttgggataacagtgtttgcatctagtaaggcactggttttttcagacttctgccatattcttagaattaccctgcactatatatttttatttaattttctggtgtacctgtaagtcctccctcaagttaaaacatgtctnanncttgtagagtganaaaggaanccatcaccntgccagcag

SEQ ID NO: 2371 - DNA, 644 bp, Triticum aestivum
  Clone ID: PAT_TA_2371
actactcctacagcttcagccatggcgtccaaggcctgcatcctgatcctgctcctcgttgcagctcttctccatacaggtcatgctagtggcgacgccgggccgtgccaactggaggacatccgcgtctcgtcggtgttgacggggcggctggtcctgaatgtgccggagtacagcgtgacggtggagaacacgtgctcgtgcccgcaggcgggcgtggtgatgtactgcaacctcggcgaggtgaacgcggtgatcccggacacgaccaagctccgcctgctgagccggaagcaaggccactgcctcatcaacagcggctggccgatcttcaacggcaagcccatataacgttcacctacgccgccaagacgcagctcgacttcaccctcgataacccctcgccggagtgccgggtgtgatcgtagcttttctttacgcaaacgcacgcaactttattacgttcttggaagtaagaatgtttaaaggtacagaaatagggtcgtaggaatgaccgggccaaatatggcgtcctgtacctaaagacgacgtgtcctttgcaaggctatgcgccttgaaattaaagtttgtacgctcatgaataaagcggcaactatcaaaagatgatttctactcggcaaaaa

SEQ ID NO: 2372 - DNA, 622 bp, Triticum aestivum
  unsure (1)..(622): unsure at all n locations
  Clone ID: PAT_TA_2372
cccacccccccgcgccccctctcgcgggacggccaccaccccacgctcacgccgagcggccgagccgtgcccacctcgcccccgtttgactccgacgcgcacgcgcacgcatggatgtgcggcagaggcagaggagggtggcgccgccggcagtgggccaggcgggggcgccccgggtgctgcaggcgggggacgcgctgccgctcccgatccggcacacgaacctcatcttctcggcgctcttcgcggcctcgctcgcctacctgatgcggcggtggcgcgagaagatccgctccgcctcgccgcgccccgcccccgcccccgccgcgtcgcctccctcatccgcccccgccgcctcgcccgcctccccgccctcctgccccgcctccccctccgccccgtccagcgcctcgtcctccgccgcgcccccgcccagcctgggcccccccccccccccgcccccgcccccgcgctgcgggcgccgcggcggcgcccccgccccgctgtccgagtaaatgcccgggggggccggggggtcggtgccctcggccgtccccggaagatcccctcgtacgttctggagacgaagttgggcgactnnngccgggcnnnnnggannngn

SEQ ID NO: 2373 - DNA, 448 bp, Triticum aestivum
  Clone ID: PAT_TA_2373
tcggggcgcctcgggcgtcgtctacaaggcgcgggaccgccgcacgggcgccaccgtcgccgtcaagcgcctccgcggcggcggcttcggcgaccacgacggcagccggctctccgaggacctcctccgcgaggccgcgtgcctcgaggcctgccgcggccacccgtccgtcgtcgagctgcgggccgcgcaccgtgacggcgcgggcggcgcgttcctcgtgatggagtacgtcgggcccagcgtggcgcaggtcatgcgggagcgcggccggcccttccccgaggccgacgcgcgccggctcatgcgccagctcctggacggcgccagggcgatgcacgacctcggggtcctgcaccgcgacctcaagccggacaacgtcctcgtcgacgcccacggcgacctcaagatctgcgacttcgggatgtcgcgcttcgcagccgcgacg

SEQ ID NO: 2374 - DNA, 1144 bp, Triticum aestivum
  Clone ID: PAT_TA_2374
gcttggccccgtccggggcggccatcgcgcgcaagagacgggattcgcctttaagacactgcctcacaaagccccacagcgcttcatcgctcataacaataaacccccgctcatagctgggccccaacttgtgacgctgctcacgcgactgggatgttgctctcaagaagaggagaaaatactggtctatgaatacttgccaaacaaaagcttggatttcttcatctttgatgagaataaaagagctttgctggattggacaaaacttgcagcaataattgtaggggcagctaatgctcttctctacttacctaggcgttctcgtttgcttgtcttacatcgagatcttaaaccaagctacatcctcttggtacagtgaaatgaacccaaaaatttcagatttcgtgggctagcaaaaatattcagctcgaaatgacacctgaagggagacattacaagaagagtggttggcacatatgggctacatggcccctgagtatgcttcagagaggaaacttcgcctattaaatccgacgtcttcagctttggtgttgtcatccttgagatccctaagcgggaaacggaattctggtacccaacaatgtggaggtttcctcaatctgcttggatatgcatggcaagtatgggtagagggaaagtgggttgaccttgttgatgcgtcattggtttctgatactcactccacaaagatgagggggtgcattaacatagccttgttgtgcgtacaagaagaatgcagttgatcgacccaaccatgggagacattgtttcaatgctaagcaatgagactatgatcttggctgagccaaagcagcctgcatatatcaatgtaagagtaggaaatgaagagacgtccactgctcttgagtcatacagtatcaatgatgtgagcatatctatcacaagtccaagatagtgttttcccccgtgtattgtccgtttgtagtacattcacaccaacataaatggtgtataatgtgtttgtttaagtggtatcccaaatgtgtggtttatgtaccctaaaaagtataagagaaggcttgagaagctacttagagtaaaaaaaaaaaaaaaaaaaactcgagacctgcccgggcggccgctcgaaatcactagtgaattc

SEQ ID NO: 2375 - DNA, 563 bp, Triticum aestivum
  Clone ID: PAT_TA_2375
cgtccggctcgccctctcttcgcttcctcacaaaaacatccagtcatccgtcctacgatcccaatggcccacgtcctcgccgccgccgagcccctcaccctcctcaagcgcccgccgccgcagaacgacggcttcggcgacgacaacggcagcacggaggagaaggcgcccaaggcgcgccgccgggagtccgacccggcggtggcactggccgcggcgcggcacgagttcggggagcacggcggcgtgaacatgtccatcgaggcctcagccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcctgcgtgctgatgcagctggtgggcgccggcggccacgtggtggggtcttgctgactgttccgcggcccccacgcgcctgctgtcccggttcctgccgcgca

SEQ ID NO: 2376 - DNA, 2257 bp, Triticum aestivum
  Clone ID: PAT_TA_2376
cgtccggctgccagtgcaattgaagttaaagagaaagatatcactactcttatgaatgacattacgatcctgaggaatgaagtttcccagaaagtatcgcggattgagaacttagaagttgaattggcttcctcaaagagtgctcttgatgagcagtgtaagcgttggcgtagcgcgcaagacaactacgagcggcaggttatcctgcaatctgaaacaatacaggagctgacaaatacttctaagcaactgtcttcattgcagcaagaaatggcaatgcttcgtcaaacagcagatgcacacaaggctgaaaatgatgctctaagaacgtctggtgagcaagaaaagatagagttggtgaaagaaaaggatgaagcccttccgaagtatagccggccgggccgggggcaacgggaagagggtcaacgtggcgccgccgtcgaggaggtgacaccgctcttgatcgtcgcgctcgcgctatcttctcggcaaaaacatccagtcatccatcctacgatcccaatggcccacgtcatcgccgccgcggtgccccccacgcacctcaagcgcgccccccctccgaccgtccccatcggccacgacatcggcagcaccgaggccatggcgccccacaagcgcccgcccccgcaggacgatgcgttcggcgacgacaagggcagcccggaggacaaggcgcccaaggcgggccgccgggagtccgaccccgcggcggcactggccgcgggcccggcacgagttcggcgagcacggcggcgtgaacatgtccatctaaggcctcggccacgttcaccgtgatgggagccggacaacctgagggggctcgtcgccggggcggctagacccgcgagcgctggagacgtgtagagctgcctcctccactgcatccggcatgttggtgaccgcctgcgtgctaatgcagctcggtggagcgcaggcgggcacgtggtggcagtcgcgctggcctgtacggcggcacccacgcgctgctgtcccggttcctgccgcgcacctctggcgtgcaggcgacgttcgtggacacggacgacgaggcggccgtgcgcgcggccataaaggccgggggagacgcggctggtgtacgtggagacgatgtcgaacccgacgctggccgtcgccgacatcccgatgctggcgcgggtggcgcacgaagccggggccaagctggtggtggacaacaccttcacccccgtggtcgtctcgcccgcgcggctcggcgccgacgtcgtcgtccacagcgtgtccaagttcatcagcgggcggcgcagacatcatcgccggtgcgatctgcgggccggcgagcctggtgaacctccatgatggacctgcaggacggcgcactgactgctgctgggccccacgatgaacgccaaggtggcgtccgagctggcgggcccgcctcccgcacctgccgctgcggatgcaggagcactcgcgccgcgccgccgagttcgccgcccggatgcgccgcccgggccgccacgtcccctacgtacccagtcccgaccacccgcaccacgcccggcctgcgcgccatgggcaacccgggctacggcgccggcggcatgctctgcctcgacatgggcaccgaggagcgggccaaccgcctcatgtaccacctgcagaacaccacccagttcggcctcatggccgtcagcctcggctactacgacaccctcatgtcctgctccggcaatagcaccagcagcgagatggaccccgaggaccgcgcccgcgccggcatctccccgggcctcatccgcatgtccgtcggctacaacggcaccctggagcagcgctggacgcagttcgagcgcgccctcgcgctcatgcagcagcaggacacccccgccgccgccgccaagtacggcaaggccgtctgacgacggaagagtctgagtaaaccaagccctgatcctcatggcgtgtaatatattatatgctcctacatttactagctaagtaagtacggttaagcgccatctggaccagatcagatggatggacatgccagtgtgttaagcagcacgcctgattagtctttggggagcgtactgcgagatgcatcatgcatgtgttatcggaataaattgtcgtcattttctgtcaaaaaaaaaaaaaaaaaacctcgagccgaatgatcagaataagattctacacaaccgattagaagctttggacattcgattagcttaacaagaaccgggtattgtttgtcttt

SEQ ID NO: 2377 - DNA, 1092 bp, Triticum aestivum
  unsure (1)..(1092): unsure at all n locations
  Clone ID: PAT_TA_2377
ggcaggaattcggcacgagggtacatgcggtccatggagagcaccgggcaccttcggccccgccccctacctctccatccacagcatgtggggcgcggcggccctcggcccggttccacccggcccacctcgcgtcggcctccggccggctccacgccggctaagaggcctctgcagaccatgccttccgcttccgaggtagcaccccagttctgcctccgtccgtagcatatggtggtctcgtctcgtggatgtgatagttgctgcgggagacacgccccgcgttgttccccggcctcgccgcgagtggccctggggcgagggggctacgccacacatgccgggctgctggatcgaggagatcgtggaccctggcataaaggggcagtactgctcggaggccatgtggagggtgctggaggtggtccacggcgtgcacccggtccctcccggccccccgcccctgcatggaggacatcgcgcgggagctggaggacgcgctcatcatcgagaacaacgcttccgagtacatgcggtccatggagagcaccggcaccttcggctccaaccgctacctgtccatcgaccggaagatgttcgcgtcgggctcggcccggatagacccggccaagttcgcgtcgggctccggccggatcgacgccggcaaagggcctctgcagaccatgccttcgcttccgaggtagcagctctgcctccgttcgtaatatatggtggtctcagaaggcccatggtctcgtctcatggatgtgatggttgctgaagaagacacaaccggagtttgttcccgcagatggcatgaatggccgaagggagaggaggcatggagaggggacacaggccatgcagttaccacggcagttgcagcgagggaagttttcccctagagacaaagcatgggcagttttgcctgtaaaatttgtatgttgaattcgatgcctatatgtaccatgcgtgtgtgcaatgcaactattctttggactactgttgatgtattctttggccaactataaggctaggcagcataagttcattatttcgggcattaaaaagttcnaaaancacnntttaaac

SEQ ID NO: 2378 - DNA, 339 bp, Triticum aestivum
  Clone ID: PAT_TA_2378
ttgtgcgtggacgaggcgctcctcgccgccgccgcctacatgcagatccccacgggcttgccgaggctgcaagtggggcccgagggcaataaacaaatcgttcgttcgggttcaagcagacgggttggattaatcagaccaaattcacccaagtccccttttgctagtgcaagtactttagagagtgcagaggggtctgatgaggatgccgcgacgaaaggcggcggcggacttgataatggccatgcgagcacaaacggaaatcttgagggagaacacaaaggaaattcacttgtggagaatggggctggaacaccattatatgcaaaaaacatgact

SEQ ID NO: 2379 - DNA, 937 bp, Triticum aestivum
  Clone ID: PAT_TA_2379
gccggggccgccccccatccccactacttgcgctcgagcggccgcccgggcgaatcaaaaacagagggcgcagcggccgcccgggcaggtcgaaaacagagggagcaaagaccccgagcggaaaaggagcgagggcctctctctccatcccgacctctcgtggccgccgcgaagaaaaggagcttatcatggcttcaaaacgtatcctgaaggaactgaaggacttgcagaaagatcctccgacatcatgcagtgcaggtccttctggcgaggatatgttccattggcaggcaaccattatgggtcctcctgatagtccctatgctggaggtgttttcttagtgaatatccatttccccccggactaccccttcaagcctccgaaggtatcgttcaagacaaaggtcttccatccgaacatcaatagcaatggaagcatatgcctcgacattctgaaggagcaatggagtcctgctttgacaatctctaaggttctgctttcaatctgctcgctgcttaccgaccctaacccggacgaccctctcgtccccgagattgcccacatgtacaagacggatcggtccaagtatgagacgacagcccgcagctggacgcagaagtatgccatgggatgatacgaagcccatgctcgtatccactgcttgcatgcagaagattgtgttgctgtcccgagaaactatctctgggccattattttctttgattacttgtcggtcgcgtgtgtctccctgatccatgtaggatcgcgtcgtagtcaaaacatcaacctatcattgccaaagtccataatgaaattgacatatgcttctcgtgataaaaaaaaaaaagaattttctcccacacaataaaaaaatagtgcctctggctggaaaactttgctctgtgcccgctctagctcctctgggcattcaaaaaa

SEQ ID NO: 2380 - DNA, 814 bp, Triticum aestivum
  Clone ID: PAT_TA_2380
cggaagcccgcatgaggggctcccctacagggatgatggtgctatctcattgcctggccgcccttcgcgccccgtgaccgcacatccagcaagccccggccggtcttagatccttgagccctgcttcccgcttttgggccagcctgactgctcctcccctactatcctcctggtccaactgtgttgggcggctcttgcggtctttggcctccccagtttgggcctgcccggcttccctcatgtcacagcggagctggtcggttcggggggttacctcccacccgagtatgggcaatcatgggttgctacgctgagaggtgatatatacagtttcggagtagtcctgcttgagctgctcacaggaaggcgacctgtttcagtgttttgtacaccaaaagaacttgtcccaatgggttttacagatgaggtctgagggaaagcagattgaggtcttggatccaacacttcgaggaacaggttatgaagagcaaatgttgaaggtgcttgaagccgcttgcaagtgtgttgaccataatcaattcaggcgaccaactatcatggaagtagtctcctgcctgtcccagtatgaacgctgagccagagatgcaaagatcagccaacatatagtgaactacaaatgatagataatcctgtatttttgtgcacaatgtagttgcaacttttttagttccactagaactactgcttctggtaatcatacagtttgttttgtacatagcctgacaagacagccattctgatctttgtaagtcttcaaggaaagagttttgtaaaattcatcttaaaaaaaaaa

SEQ ID NO: 2381 - DNA, 1781 bp, Triticum aestivum
  Clone ID: PAT_TA_2381
acgcgtccggagatcgggacgaggcaatggcgtctccgagattcaagcccgtggaggagtgcagctccgaggggaggtcggggcagacggtggccgcagacttcgacggcacgctgctccgctcctccaacgccttcccctactacctcctggtggcgctggaggccggcagcgtcctccgcgccgtggcgctgctcctgtcggtgcccttcgtgtacgtgacctacatcttcttctccgagtcgctggccatcagcaccctggtgtacatctccgtggccgggctcaaggtgcggagcatcgagatggcggcgcggtcggtgctgcccaagttctacgcgcaggacgtgcacccagagagctggcgggtgttccggtccttcggcaagcggtacatcatcacggccagccccagggtcatggtggagcccttcgccagggagttcctcggcgccgaccgggtggtgggcacggagctggaggtgggcaagtccggcaaggccacggggttcatggtgaagcccggggtgctcgtcggggagcacaagaagcaggccgtggtgaaggagctgggcgacgcggtgcccgacgtcggcatgggcgacagggccaccgatttcaacttcatgtccatatgcatggccgcctgcctggacgcctaccgggtgtcgtcgagggtgcccagccccctgcccctgacccccctcctcccccccctcggccgcctcgtgcagcgcccgacgccgctggtggcgctcgtcaccttcctctggatgccgttcggcttcgccctcgccctcctccgcgtgtacatcaacctgcccctcccggagcgcatcgtcttctacatctaccacatgatgggcatccggctcatcgtgaagggaaacccgccgccgccgcccaagaaggggagcccgggcgtgctcttcgtgtgcaaccaccgcaccgtgctggaccccatcgaggtcgccgtcgcgctcggccgcaaggtgagctgcgtgacctacagcatctccaagttctcggagctcatctcgccgatcaaggcggtggcgctgacgcgggagcgcgacaaggacgccgagaacatccggcggctgctggaggagggcgacctggtgatctgccccgagggcaccacctgccgggagccctacctgctgcgcttcagcgcgctcttcgccgagctcaccgaccgcatcgtgccggtggcgatcaacaccagggagcacatgttccacggctccaccgtgcgcgggttcaagctcatggacccctacttcttcttcatgaacccgcggccggtctacgaggtcaccttcctcaacatgctgcccaaggagctcacctgcggcgggggcaagtcgcccatcgaggtcgccaactacatccagaagacgctcagcgaccagctcggcttcgagtgcaccaccatcacccgcaaggagaagtacggcatactggccggcaccgacgggcgcgtcccgtccaagaacaaggagaaggagaagaactagcggatctcgggctggactgcctcgcgccggctacagtggttgatcgtggttgttattgtttacagtttactatgattaattgtttgttatttgtcagatcactcaccgtttccaggaaactaaaaggaccgtgtcgtgtattagcttgaggtcacaattgtcttgtaccaataattgtttcttcgccaaaaggatgagtaattatatggatgattttcagaatcttgtctgcacaaatgaatgattactccttttggaaaa

SEQ ID NO: 2382 - DNA, 978 bp, Triticum aestivum
  Clone ID: PAT_TA_2382
ttctttctggacgagctcgctctcgggctcgaggcctcagggatggcgttcctgtgggtggtgaggacggacaagtggtctcccccggagcggtggcacgagcgtgttggaggcaggggaatggtggccaccgcctgggctccgcaaagggctatcctggggcaccgggcggtgggggccttcgtgacgcactgcggatggaactccgtcctggagacggtggcggcgggcgtgccggtgctcacatggcccatagtgttcgagcagttcatcaccgagaggctgctcacgcaggtcctagggatccgggagcggctgtggccggacggcgccggcgttcggagcacgaggtatgaagaaaacgaggtaatccccgcccaagatgtggcacgggcattgacgaccttcatgcagcctggagggccgggggatgcggcgaggagaagagtcatggaactggccgccaaggttcacgccgcggtggcggaaggaggatcctccgaccgtgatctgcaccgcttgatagatgacctcatggaagctgccggtgccggtgccggaaggacgacgatatgaagtcagacttgctcaaaatccttactattgaatggtcggtcagtctcatcagctatcttatctcacctgtatgcctgagttcgtataattttgtaagttgtttgcttttcatcttttcttttctgggctgtagcccggtggcaaggacacagttgtgcatccttacggatcgaggttctacaaccgtccgaagcgaattttcacgaaatcacccggatcagcttcttctataaaaatatgtcgtgggtagtgtccatggatctttttttcttcttttctttacaatcacctttttccttgtaagaaatccaaacgaagccttaataaatgttttgtctgccagaatgaattggccgtgaaaaaaaaaaaaaaaaaaaaaaactcgagactagctcgtgccga

SEQ ID NO: 2383 - DNA, 1015 bp, Triticum aestivum
  Clone ID: PAT_TA_2383
gacggataactccaccgttgcttctgatgggaagtcacctgctcctgaaaaactgaagctggtctcaggttcttgttacctgcctcatcctgctaaggaggcgactggcggcgaagatggccacttcatttgcattgatgaacaggcgattggtgtggcagatggtgttggtggttgggcagatcacggtgttgatgctggactatatgcgaaagaactaatgagtaaatcaatgagtgctatcaaggatgaaccagaaggtgcaattgacccatcaagagttctggagaaagcttttacaggcaccaaagcaaggggatcatcaactgcttgcatcatcactcttaaagaacagggtcttcatgctgtaaatcttgtggacagtggcttcatagtggtcagagatggccgcactgttctcaaatcaccttcgcagcagggccgggttaattttacttatcagctcgagagtgggggtggcagtgctcttccaagttctgccgacgtatttcactactcggttgcttctggtgatgttatcattgccggcacggatgggcttttcgacaacctgtacgacaacgaaatcactgccgtcgttgtcgaggccctcaggagtggcctcggtgcccagggcacagctcaaaaaatcgcggcccttgctcgggagagagcggaggataagcacaggcagtcgccctttgcagccgctgctcaggaggctgggtacaggtactatggagggaagcttgacgacatcacggtcgtggtgtcgtacgtgacgagtgccgcagccgtttaatgcgatgatgcttccattttctgttgtaatgtacataacctttgccccaaactcatgggagctcctacgccccggggagtagattcctaggctggtttattctgagtgttgggggatcccctggcaccttaatgtttttagagtattgacattgcgctttgcctcgggaaatcctcggcgaataaccctgtctgcccccctgttcatttggcc

SEQ ID NO: 2384 - DNA, 1960 bp, Triticum aestivum
  Clone ID: PAT_TA_2384
gaattcggcacgaggtccaatccccacctccgcgagcaaaccctaatcgactgccacggaggaggcaggatcgaaggtgcgcgaccgagcgggagctggccgtaccggagatccgagcctccggagctcaaaatcccccccgtcgccgccgccgtcgctctcgcgccgcggcaggagggtgatgagctctttgcgggcgggcctcgctcggtcataagatgctagccggcggcgttggcagcaacagaagctgcggttctgagcagtcgaccccttccgccgagggggacctacgctgagcccgtcgctttctcgtcggtgacccctgggttcaagctctcctcctacccggcgcgcctgctatacaccgcggaccgccgggcgcccgctgccgccctcgtcgccgccgccatccatctgccgccaccggtcgcgcgcgcgcaaggcggcacttgcatcggcctgctgcaagagggcagcctcaaggccgtaaaccgttgcggcacagggcgctccatactgggtccaggagacgagacgcactgttctcaaagcaccttcagcagcagcatgattttaattttacttatcagctcgagagtgggggtggcagtgatcttcccagttctgctgacgtatttcactactcggttgctcctggtgatgttatcattgctggcacggatgggctttttgacaacctgtacgacaacgaaatcactgccgtcgttgtcgaggccctcaggagtggcctcggtgcccagggcacagttcagaagagcgccgccccacgtcgtgtgcgagccgagaatctgctggggctacagccatttacctgaccctggaagaggcattacaggagaagcagacggataaatccaccggtgattctgatgggagtgtcgttcctgccgagcgcctgaagctgttctcaggtccttgttatcttctgcattattctacataaccttgccccaaagaaatgggagacctcacgccccgtgatggtcaattcctaggttgtgttagttggagttggtggttggatctccctgacaccttaatgtgttagagtagttgagattgcgctttggctctgggaaatcgtggcgaaaaacgatgtctgccccactgctcatttagcaactacactgagatgctccttgtaaaccaacaatgggaggaaggagaacaaccgcttgctgcctcactcttgttgaactcgctcttcatgctgtaaatcttggggaccgtggcttcatagtggtcagagatggccgcactgttctcaaatcaccttcacagcagcatgattttaattttacttatcagctcgagagtgggggtggcagtgatcttccaagttctgccgacgtatttcactactcaacctgtacgacaacgaaatcactgccgtcgttgtcgaggccctcaggagtggcctcggtgcccagggcacagctcagaaaatcgccgcccttgctcgggagagagcagaggataagcacaggcagtcaccctttgcagccgctgctcaggaggctgggtacaggtactatggagggaagctcgacgacatcacggtcgtggtgtcatacgtgatgagcgcagcagctgtttaatgcgatgatgcttctattttctgttgtaatgtacataacctttgccccaaactcatgggagctcctacgccccggggagtagattcctaggctggtttattcgagtgttggggatctcctgacaccttaatgttttagagtattgagattgcgctttggctcgggaaattgtggcgaaaaaccatgtctgccccccttctcatttggcactacatgagatgcttcttgtaaacccatccttggtggaaggagaaccaccacctgctggcaaagttttgttgtattcaaaaattcagtgctagttgctgaacatgtttgcctaaaaaaaaaaaaaaaaa

SEQ ID NO: 2385 - DNA, 1028 bp, Triticum aestivum
  Clone ID: PAT_TA_2385
gcacgaggctccagcctcgccggtactagcagtccagcagcgcagaaccagcatcaacgccggcggccggcgcgacatacggccaaggcgcagccgacacgcccctttcctcacccctatcccgcctagcccgtgttcctctccgtccccggctgcacccctctctccttccgcgatcgaggcccgtaggcacccctctgtccgccgcatctcaggcgacgtcagcgacgaccaaggacagcagcagcgccacaagaacacttcctcagtaatacattgttcagtagttcctgaggtgcaccatggaaattatcatcctcatctcacttgttgtgcttcttgtactgggagcactctttgttatcccaagatccaaaaacaaaggtgaaggaaaggatgcacgttcagccggaaatggaacgacatctacgagctattcaaagaaagaggtgtcaacacacaacacaaggaaggattgttggatcataatcaaggacaaggtttacgatgtaactccatacgtggaggaacatccaggtggtgatgccattctaaacaatgctggtggcgattcgacagagggatttttcggcccgcagcatggcacacgagtcttcgacatcatcgaggatttctgcatcggcaaattggaagactgatgatggggaggagaggccgtaaaagctcccaagtgtgaacccatgcgctcgtctgcaattttctgaagatgacgacgacgaacggaaccgtttcctaatcgtgatcatgacagctccagggcccccagctgtgtggttctggtttcatgtttgacctcctgcttattcatactagtagcagtgtgtgacccgaccatggactatttctgtgtcctgaatgttttccgagatttatctcttcattcgagaagatacgttttcttagacttatttatggaactttctcagagcagacaaggaaccgggccaacttttcgtattgattccttgcatgacaatgagaggcttgctatacattcaaaaaaaaaa

SEQ ID NO: 2386 - DNA, 328 bp, Triticum aestivum
  unsure (1)..(328): unsure at all n locations
  Clone ID: PAT_TA_2386
ttttcgccggagcaccccacccaaccgcctcggtcgtcggcgaggaacctgctccggtaggcggagatgggcgggcacggcgggctgaacatcctgccgcagaagcggtggaacgtctacaggttcgacaaccaggagaaggtccgcgtcgacgaggccgaggccgcccgccaggaccagctccagcgcgaggccacccgccgccgcgagtcgcacgcccgcctcgtcgcgctccgccgcaaccggggcctccagtccgactcgcgcctccccttcccccngtcccccatccttcccccccccccttccccccggccccgcgggatca

SEQ ID NO: 2387 - DNA, 866 bp, Triticum aestivum
  Clone ID: PAT_TA_2387
ccgacaccctcgttctctcggtctcgcgaatgagaggcggcggcggcaagatccaagagcgacgctccgccctcctccgtccaaggctccgcccggcaaccggaggcgacgcaccaccgcctacacctccacgaactgctcctccggcgggggcaacggcaaccggggtcatcatcctccctctccccggatctcggtctctgcccagagatcgaaggaccttctctgtcgtctgaaatttgttacccaagtgaagcggctgtactgcaagaacagctgaacgttttgcatgtgcatctaactaacctgaatctaacaaatcgcacgttttgcagtgtctgttctgaaattgagcacactagttctatctggaaactttggtgtaaaattgttagttgcctttctctaatgatcttactcaaagttcattgaagctgttcaatagtgatcacttaattttgtgaagttgttcagtgataatcaagttgcggtacctcatgtcgatgcgaagtggagagaagacccgagtagggctagtggttgttgccttgcaattaatcttattcaaaagtccctctgcctctgacatggcaattgataattcaagtttttttgttgttgtgaacaaagttgaacgatgatggcacatgaaaacggtttaggccaacacatgtcgcagtgaaatgtggaccggacggtatttgaaccttggtgaactgatggttatcaattgtaatatttctttctagtttacaggaattctgaaaaaaaaaaacctcggccgcgaccacgctagaaattaatacctttcctcagttattatctgtagaattttctatgaaggctgtgaaattttgtatgtacaa

SEQ ID NO: 2388 - DNA, 427 bp, Triticum aestivum
  Clone ID: PAT_TA_2388
tggggccacggcgccgtcgtggaggagatacacgggctcatccgcgtgtacaaggacgggcacgtggagcgcctcccggcgatccccgacgtgccctgcacgtggggctcgacggccgccgggagcggcgtcctcgcgcgcgacgtggcggtcgaccgcgccacgggggtgtgggcgcgcctgtacgcgccggccgccgcggcggggaaggtccccgtggtggtctacttccacggcggcgggttcagcgtcggctccgcggcgtggagctgctaccacgagttcgtcgcccagctccccgcgcgggcgggctgcgccgtgatgtccgtcgactaccgcctggcgccggagaaccggctgcccgcggccttcgacgacgggctcacggcgctgcggtggctgcggcagcaggcgggcagaaacaacg

SEQ ID NO: 2389 - DNA, 717 bp, Triticum aestivum
  Clone ID: PAT_TA_2389
cggcacgaggagaggtttgtctgtagataagatagaggcggaataaagaaaaaagcaagagaaacgagagagagctgagcaagaaaggataacctagctagctaggtcgggagcatggatccggttactgcatccatccacggtcaccatcttcctccaccgttcaatacccgtgatttccatcaccatctccagcagcagcagctgcatctcaagtcggaggacgaccatggcggcggctctccgtttggcggccacggcaccaagcacggccacgaggatgacgagaacagtggcaacggccacggcagcggcggtgagcttgctctgatttccccttcaggtggcggccttcaggatggaggcgagaacggatcgcgccgaccgaggggccgcccggccgggtccaagaacaagccgaagcctccaatcatcattacgcgggacagcgctaacacactccggacgcacgtcatggaggtcgcgggcgggtgcgacatctccgagagcatcacggcgttcgcccgccgccggcaacgcggggtctgcgtgctgagcggcgcgggcaccgtgaccaacgtcacgctgcggcagcctgcctcgcaggcgcggttgtcgccctccacggccggttcgagatactctcactgtctggctccttcctaccccctccagcaccaccggaagccacggggctcaccgtctaccttgccggcg

SEQ ID NO: 2390 - DNA, 755 bp, Triticum aestivum
  Clone ID: PAT_TA_2390
gccctcggccaccttctccctcccttgcgtcgtttcttttcctccgtctgcccgtcggcgtcatcctcagcacccgaatcccgcaaccaaatttcgaactcgccaccggccgaaaaaggattccacggggatcgaaagcaacagcctcgatccatacatccagcttttctgaaagcacaagggggttaaaaccctagctggattgggcggcggggcccttccgccatttgcccgctgctagagtagttgcgtgctccagagacttccagttcgtgttcgtggggcggcggcggcggattgcgtggggagccaggctctccggcgatcctgggagcggcgcatgagagtaccacagatgacgagggtcatccatgactccggagaaggcatgcagaaagaatttgcacttgacatggtatcctctgatgttaacttccccaagggccactttccggactacaggattgggccaaacaaccaaatcattgacccagaggagacgcacgaggttgtgcctttgaaggagattgttgagaaagaaacaacacaactgctagagcagcgaaagcggctgtcagtgcgtgatctcagggagaagtttgagaagggtctgactggtgcctccaagttgtctgaagaggctaagcggcgagaagcagcttcattggacaggcaggttcttctgaagaagctcagagatgttctagacacactgaaaggccgtgtggctggtcgaaacagagatgatgctgatg

SEQ ID NO: 2391 - DNA, 696 bp, Triticum aestivum
  Clone ID: PAT_TA_2391
atgcatactgcaaagcccttctgcaacttgattttatcaagtggaatagtaaccctgaagaagttctaaaacggatcaatgagtcaactagatggtctgatgagctgcatgattatgagctacaacgcggtttatagtttgataaggtagctctggaggaagacatcaactatggtatgagttcagaattagagaagcatctacaattccctgaccagttgctcatgcgagaatatttcaatagtgtgaaaataaggaaccttgccagggaggctggagtcattcttgtcgaagagtttctacccgtacgaaatttggaagaacagatattacccaaaagtttgccccagaattttggacaacagctgttacccagaaatttgccccagatgaaaaagagagttaagcagtcacttgactcaaccagggcttacctgcatcgacagggcgctactcgtgctaggggtttgaagtatgtggttggtgcagtttctcttgcttgtatcatcatggctggccaacgcgagagtaattaagactgtcaactgcatccatggttggcctttgcccgcgaaaaaaaaggttggcctttggatagacagtaatttgtatataaataatgttgtactcgtgtttgaagcatgtttgtcctgctatgcattacagatgatatttaacaaaaaaaaaaaaaaaaaa

SEQ ID NO: 2392 - DNA, 860 bp, Triticum aestivum
  unsure (1)..(860): unsure at all n locations
  Clone ID: PAT_TA_2392
gcggggtgtacctggtgctgacgtcgccagaggtccacgtggagaacttctgcgggcaggtgtgcgggttccactacttcaccttcccgtcggtggtcgggtacacgctcccctacgcgtgggtgggcaactcggcggggcggtgcccggaggtgtgcgcctacccgttcgccatcccggcctgggcgccggcgcggcggcccgaggcgccgcccaacggcgacgcgggggtggacggcatggtgagcgtcatcgcgcacgagctggccgagatggcctccaacccgctggccaacgcgtggtacgccggcggggacccctcgttccccaccgagatcgccgacctctgcgagggcatctacggcaccggcggcggcggcgcgtacaccggccagctgctcaccgacggcaggtccggcgcggcctacaacctcaacggcgtcggcgggcgcaggttcctggtgcagtgggtctgggacccctaccgcagctactgctccggccccaacgcgctcgaccaccagtagctagtagcttttcgttcgtttcaccgccgccgcaccctcgccgcatctcgcgctaccggtagaagtattcctcccactccctccagcattggtttccttcctcgggagttccatggccggccatgggagcgtgtcatgtatagagtcagtgagccgaagcatggtggtccggtccggtgagcccagcttggtcctcgggacatacggctggttcattgttggtatggctgcgtgcggacaatgttttggactttcaaatttgatgtcattttgtccatttcccgctcnnnnntcgttcaaatttgattagcattactacgtaaaaaaaaaaaa

SEQ ID NO: 2393 - DNA, 674 bp, Triticum aestivum
  Clone ID: PAT_TA_2393
cttgccatgaagctgtcttcagatcaaatgaagagtttaagaaggcgatctcactgagagaattggatgatgttacatctcttgaagacaagctaggaaggtcacttacaagggaggagaagaacaggataggagtgagtaacttaagattatttttggaagaattgctgcagaacaggtacatagagagtgttccgtcgattactccacttcttgagaaggaacatcgcgctgcatcgaggaagttgcgcaaagtcacacaagaaatcagtgatttggacgaagcaaaactaaaggagaaagctcgcctgttccatgattcatttttgacaaagttatctttgctactgaaaggcatggtggtggcacctcctgataagtttggagaaactttaattaatgagaggatcaatggaggaacatttactggaagcgagaatttccagctcccaaacaagatgatggctaatgctggaatgcgtctttacggtggtgcacaataccatcgggcaatggctgaatttcgtctggttgttggaagtattcaagtgccccccgattactagggaggaaatagtcaacgcctgtggtgttgaagattttcatgatgggacgaattactccaggactgcttgtgtaattgctgtggcaaaagcatgcgacacatttgagcc

SEQ ID NO: 2394 - DNA, 955 bp, Triticum aestivum
  Clone ID: PAT_TA_2394
cttcgtgacccaaggcgggccgggactgatgtgatagagaagtcacatcatgtaccgtttctggttttctcagggtagggactgggtgcttttcgcttgggtgcttccgcatatagcctcttcgtgtcttccttgatgtaaactgtgcttgcaggtggcgggattaggttcctctcagggtatgcgttagcgtgtctttaggtttgcttaggggcaagacaccttacgtgtcgtaattccgccgaagactgttccattcgattgtcgtagtttgagttgctattggtcacagcttgtgggaaacaatgccgctgcaccttccagtctcctcgtttctttgatcctcggggtgtcttccttatttggggcgttggtgatattattttccctggattgctcgttgcattcagctacagatttgacagggcaggcaaaaagggtatcttgaatggatattttctgtggctgaccgtgggatatgctgtcggccttttccttacctatcttgcgcttttcctgatggatggacatggtcagcccgcgctgctgtacctagttccttgcacgttaggggttattgtggtgcttggttggataagaggcgagctgcctcacttgtggaactacggaagaagaccagaaaattcagtcggcgaagaagtctgaaatgtaacctgacaggattatttgtacttggaaaccgttgacatccttcgatctaatcagttaatggatctcaacatgatgctccatatccgtgagaactgtgcggcttcgaggaaatgtaaacttagctgtagccagatttgtgtttggtataggttgtacttcgtcggccttgaaacgtgtgagttgaggttcgatgcgggagttaactttgtatccacaacagagattacatattattttacataaggctgagctaatggtattctattcttaacaaaaaaaaaaa

SEQ ID NO: 2395 - DNA, 2490 bp, Triticum aestivum
  Clone ID: PAT_TA_2395
ttgggtcgacggacgcgtgggaacccgcactgcgcccactccgatctccccaatcccctccaaatccctcgccggaaccctagccccgcgccgccaccatgcctccgcgccgctctaagggagggggcgggggcaaacccgaccccgaagccaccgacgccgagcctgtggagaccgcggtcgacgccatgtccgaagacgaggccgacgacgacaactccaaggaggagtccgctgagagcggagctgaggatacggacggcgaggactccaaggaggaagccgccgagaccaaggccgaggagatggatacggagcatcaagaggaagccgccgagaccaaggccgaggagacagtcgccgaacctgaagccaatggtgcagatgcggagaccaaagtcgaggcggcggaggccaacgtcgaagcggaagccgccgccgagagcgactctgagcgcgaggcagatgccgggaaggccgatccagaagcggaagcagaggaaaccgacggcgagaatgacaagcaagccgctcgggccgacggcgagagtggagaggaagctgctgggtctggtggcgaggatgaagaagaagccgccggcacagacggcgacaacgccgctgaggttggtggcgagaaagtagatgcggattctgaagccgaaggtgagggtactgacgccgagcctgatgctcgggaggaatcccctcctccctcccctccagcccgcagccgccgccgcaagcgagtggtcaaacccgacccgcccactgaggatgacgaggaagaggagacccctctgcccccacgtcggcgccgacgtcgcaaagcaggagaacgtggcgactctccaccgccactgccggacaacctccggtgccgcagaagtgatggtaagaagtggcgctgctcagctcgtgcactccccactgtcagcttttgcgagtatcactatgccaaggctagcaagggcaagaaaccgccagccgatggggaggtccttgccgtggctctccaacggcaaaagaagaacaagagaaagggaagaaggcgcttaaatctggcgccagaatcaccaaaggccacaagggatctcccgaatggattgatgacaatctcaccggggagcagtggggcggtaggctctcctgtgacaacaaaggttggagtggatattcctgcaccacttcggcggtgctaccgttccaagaatgctgagccagtgcctgttggccctgtgaaggtcgttcctcatgcaatgagtaaagcaaaggcagcacagatgtcagtccgccgttgtgggttgaagaaggttgcacgcgttgtcaagtgcaagaactgtgaaaacaagtacttctgcaacagctgcatcaataaatggtattctgggatgtccaggaatgatataaagatccaatgcccggtttgccgtggctgctgtgattgcaaaaaatgcacccttggtcagaccaagggaggtatgcagaaggaatcaccagctggtcaagggaaactaatcaggatcaaaatctgcaatcaccaattttacaagcttttaccattgaaacttgaccaggaacagcttgatgaattggaaatagaagctaaaatacaaggaacaaaattatccaatatccgcgtccaggtagctgaagacgaccagagcgggtcactttactgtaataactgtaagctgtccgtacaccaagtcttgagaagctgcccaagatgcccttttaagctttgcctaagttgctgtcagaagatacgcgaagggaatatgtcaggcagcacccctgaagataaatttacacagcgacttttgcagcaagagtcagctcatgaggatggtagcataagttgcccttccattgagttgggtggctgtggcgactctctgctaaacttgatatatgcaactccgtccgatgaccagtcggaggaactcagctcaggagacgagttagatgctccaggcaatgactctggagttaaagatgcacaagctcattcctcgcctttagctgagagtaatggcagccttgccagattatccggtggtcagcaggaatccatgtccacataatctctggtgattttgcagcagatacccacccatgcatctttggggtgcgagatgggatatggtctgaggtgggtagaggttagagtggcttgtttagtgtgattatcggctgattttaggtctgtgacctacctggggatattctcgagtaattgtttggtgttgttcatctttgatttagacattatgtttgttgtcagtgtaaatagggtatgactatttatcatccatgagtcggaagcttgtatcggttcggtcgtactgtggttaatttagaaaactgtctgtactctatcggctattgcagtgttccagaaagtgagggattctattggattagtcgtctgaaataaaagtgacttttgggtaaaaaaaaaaaaaaaaaaactcgagactagttctc

SEQ ID NO: 2396 - DNA, 731 bp, Triticum aestivum
  unsure (1)..(731): unsure at all n locations
  Clone ID: PAT_TA_2396
tttttgaccaagataattgctgggcctaacggccagacaatatacgctgaaattccgtacaaacagtttcttgatcaagtacaaggaaattggagaaaaaggttgcaaacaccatggagttctcccgagtcactagaggcactgtgccagcaagtgaaaagatgcactgagattgcactgacctgcatggagatcgacagacacaaaaggcctagcatagtggatatcatacacgaccttgaccagaccgaaaaaaatattgaaaatattaattcttatgaacaagatccatcaccgccacttgattcctcttcaaatgttgttgaacctgtagcatcagctccacctacaactccatctccaccacctttcctaacccaatcttatattggatcttcaacaccatgtccgcgtccacctccaaaaaatagtccggttatgacgccgccaccaccaccaccaccagtcccacgcggtggcatcatggaactcttcggcacgttcatgcatcgcaaggccaagatatccggacatggtcaaaggtcacttacaatgaattggcgtcagaacacatgactctcgaaaaccaaaacttgaagagggtgcntttggcatcataaagnacattaacttgcaagacaacaagnaagaacaanatgtcgtggtataanagataaatggattagtaagcaggagcttaaatggatgtatagagccctgaacacacattn

SEQ ID NO: 2397 - DNA, 699 bp, Triticum aestivum
  Clone ID: PAT_TA_2397
tttctcgtccgcggacgcgtgggcggacgcgtgggctctgcgccgccggccacctaccgctctcccttccgcagatcttccggtcttcgatctcgccggtcgccacgacgccacaccgtgcttgccagcagaagagacgttatcaaggcgctatggctgagccggcggcggcggcgagcacaaggaagctgtacgggtacgagctgtcgtccaattcggtgcgcatcgcggcgctgctcaacgagaaggggctcgactacgagctcgtcgtcgtcgacgacaccaagtcgccggagttcctcgccatcaaccccttgggccaggtcccggcgttccaggacggcgacgacatcctcttcgagtctcgcgccataagtaggtacatcgccgccaagtaccggtcaacgggcacggacctgctgccggcgacgccgtcggcgaagctggaggtgtggctggaggtggagtcgcaccacttctacccggccgtggccgacctggtgtacgagctccgcgtcagcccggccatgcccgggcggcgcgccgcccgaccctggccgtggttgacgcgctcgcccgcaaggtcgccgacgtgctcgacatctacgacgcccacctcgccgccgggaacaggtacctcgccggcgacgccttcacgctcgccgacgtgaaccacatggcgcagctgttcgccatgag

SEQ ID NO: 2398 - DNA, 710 bp, Triticum aestivum
  Clone ID: PAT_TA_2398
gggtcgacgggaggttcaaaggagagaagcgacggagttagaagttgtaaatatgcattgttgtatcgcgacctgaatgaatgaaataaacgaaataacgctcttgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggccgcccaaaaggatcaaacctaacgtacccttgaatgaaacttcaaacccctccaaaagtgtcaccaaaattaaattaacgggccgtcgtttaaaaatatcctaactggaaaacgggtcgacgggaggttcaagggagagaagcgacggagttagaagttgtaaatatgcattgttgtatcgcgacctgaatgaaataaacgaaataatgctcttgttcaaacatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccccccaaaagattaaaatctaatttacccttaaaggaaaattaaaaccccttcaaaaatatcccaaaattaaaattaaaggcccttcttttaaaaattccctaacgggaaaaacccggggttaaccaaattaaacccctttgaaaaaaacccccttt

SEQ ID NO: 2399 - DNA, 399 bp, Triticum aestivum
  Clone ID: PAT_TA_2399
gggtcgacgggagtgaggaagccgacgggaggttcacgtacgggagagaagcgacggagttagaagttgtaaatatgcattgttgtatcgcgacctgaatgaaataaacgaaataatgctcttgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaactaaaaaaaaaaaaaaaaaaaaaaaaaaaaaaaaaaaaaaaaaaaaaaaaaaaaaaaaaagagcccacaaaaaaattaataaataaagtgaaaagataaaaaaaacaattaaaagggctttattaaaagcaaagaaaaacctgctttcaccaactgtagtagtattgaaaaaaaacccccttt

SEQ ID NO: 2400 - DNA, 781 bp, Triticum aestivum
  unsure (1)..(781): unsure at all n locations
  Clone ID: PAT_TA_2400
gtgatgctggccacccacaacgtgaagtccgggcagctgncgncggcgagggcgcaggagctgggcatcggcaagggcgaccggaacctgcagttcgcgcagctgatgggcatggccgacgggctgtccctggggctccgcaacgccggtttccaggtgagcaagtacctgccctacggccccgtggagcacatcatcccctacctcatcaggcgggccgaggagaacagaggactgctctccgcttccgccttcgaccggcagctgctccggaaggagctggttaggaggttcaagaacgcggtgatgggacgggagtgagatggccgacgggaggttcacgggagagaagcgacggagttagaagttgtaaatatgcattgttgtatcgcgacctgaatgaaataaacgaaataatgctcttgttcaatcgtcagcctccggttcaagtactgcaccaagctgttattttttacctttttgaaaagaagcacgtgttgctgtgtttattttatatttttatctagggatccagacatctacaaacacacccagtgaaccaccaaatggtcatatactcctagaacgcctttgcgggctatggtccatatagttaaatcatgcaaatatgcattgttgtatcgcgacctgaatgaatgaaataaacgaaataacgctcttgttcaaccgtcaggctccggttcagtactgcaccaagctgttatttttttgcctttttgaaaagaagcacgtgttgctgtgtttattaatgttttcatct

SEQ ID NO: 2401 - DNA, 2018 bp, Triticum aestivum
  Clone ID: PAT_TA_2401
ctcggcccctcccaacgtggaggccaggcgcccgctcccagcttcccagcgtcacaccccctccccagccaggacctcccctcactgcaccgcatcaatcccatgcgtcgtctccgacttctccttgctcctccgcctacccggtttttgattcatcgtctccgtccttcggtagctcgtcaggcgtctcatcccgcgtccggtcacagggaccagaacggccacgcgtctctttccatcgcctcctagcgaaccctccgcccccccccctccatcgccatcgcctcccgcatcacggcgggcgggcgccgcgcctgcgacggccgacgcgaggtccccggaggcggccgcgccggggcggcggcggggagtcggtgtcccgtgccgtcgtccggcgcgagccggagaggcgatcacgtgctggagtttggaagcacacgggggaggctcttcaccgcgcggagccgtccacggctctggtgcgcgcgctcgcgccgctgcagtcgatggccgccggccccctggtggacgtgggccccggggccacgccgtcccaggacgtcggcgcgagggcagtcggccggggaggcgccggcccgggggcggcgccgcaggtcggcgccggatggaccgccgttgaggccgaggccatcgagcaacgccgctggcgcgcgggcatgggcgcggtcctctcgccggcttcctcgccgccgtcgacgtcgccgccgcgctgccgccgggatcgggggtcgcgcgtcgctgtatacgtcgcctccgccctgcccccgggatcggcaagcgtgtgtactagcatcagcgcgcgcatccggatcgcgctgctggagaagacgagcgacctgctgcggtggcagcacaagaacccgtcggtgcacctgccgtggaagcagcacgccttcccgatcctgtccgactcgagcccgctgtacctgacgccgtcggagccggcggcgctgacggcggaggaggagcgcgagctgcagctggcgcacgaccggctgctggccgtgggcgcgcggtgcgcggagcacgacatcccgctgctggtggacgccgagtacgcgtcggtacagccgtccatcgactacttcacgttcgtgggcgcgctggcgtgcaacggcggcgggcggcctatcgtgcacggcaccgtccaggcgtacctccgcgacgcgcgcgaccggctggaggccatggtgcgcgcggccgaggaggagcgcgtgtgcctcggggtcaagatcgtccgcggcgcctacctcacccgggaggcccggctggcggagtcgctgggcgtgccgtcgcccatccacggcagcatccaggacacccacgactgctacaacggctgcgcggccttcctcctggagcgcgtccgccgcgggtcggcgtccgtgatgctggccacccacaacgtggagtccgggcagctggcggcggcgagggcgcaggagctgggcatcggcaagggcgaccggaacctgcagttcgcgcagctgatgggcatggcggacgggctgtccctggggctccgcaacgcggggttccaggtgagcaagtacctgccctacggccccgtggagcacatcatcccctacctcatccggcgggccgaggagaacagaggactgctctccgcttccgccttcgaccggcagctgctccggaaggagctcgtcaggaggttcaagaacgcggtgatgggacgggagtgagggggccgacgggaggttcacgtacgggagagaagcgacggagttagaagttgtaaatatgcattgttgtatcgcgacctgaatgaatggaataaacgaaataacgctgttgttcaatcgtcaggctccggttcagtactgcaccaagctgttatttttgcctttttgaaaagaagcacgtgctgctgtgtttatttatgtttttatctacggaaaggaccaaacaccaacaaaaaaaaaaaaaaaaaaaaaacaaaaaaaaatacaaaaaataaaaaaaaaaaaaaaaaa

SEQ ID NO: 2402 - DNA, 736 bp, Triticum aestivum
  Clone ID: PAT_TA_2402
tcgacccacgcgtccgcgcaaatcgaggccttccgctggccctcctcacccgcgccccgcccctgcccgccaccgcggccggcggccgcccggcccgcgccggctctcccccgcccgccgcccgcgctcgggctccccgccgatccgtgcgcccaacagaactaggattttttgtggtccttcatgaatcttgaggacagtctatactaggggggcagtaggttactactactaggatctagtatcctccgaaatgagggggagaaatgacggggggcagagcaaggtccccgtcgtgctcttctgcgtcatggtcgtgtgcctctgcctcctcttcctctatttctcgggctccaatgggcaggctgggagcgcggcactagagtatggcaccaagttttctcgctcgcttgggtggggcagcgatggagatggcgacgatggctcagacgagtcgatttttgggactggcgatgcaaatgacgttaagctcaagagcttcccggtatgcgatgatcggcattctgagctgatcccctgcttggataggaatttgatatatcagatgaggttgaagctggatctaaacttgatggagcattatgagcggcattgccctcctcctgagaggcgatttaattgcctgattccaccgccacatggctataaggttcccataaaatggccaaaaagtcgcgatttagtgtggaaagcaaatattcctcacactcacctt

SEQ ID NO: 2403 - DNA, 1083 bp, Triticum aestivum
  Clone ID: PAT_TA_2403
gcacgaggcggaagcctgcgcctgtaaggcgacgaagaaagcgatctgtcatcgagcactacgaggatgatgacgacgacttcatcgtggaggatgaacaggtcaaggtaaaccgtaattcaaggaagaaggccaggtttgggaggcaggtggcggtagaccggccagtgccagttgccgaggcagatatatggccagctattgattcagactcatcagaatttgagtttggaacatctgaagacgaacctgagggtgagccagtgagagctgcagttaggaaggggaggaaaaggaggggggtatcggggtcatcctcagattctgaattccatgtctcggataaggaattgagcgatgtcagagaagaggttaagacgaagaaaagggtcgtcttgcagtcatccacagattctgaattccatgtctcggataaggaattgagcgatgtcagagaagaagaggttaagacgaagaaaagggtacgcgtcttgcagtcatcctcagattcagaattccatatatcagataaggaattaagcgatgtcagagaagaagaagttaagaggaagaaaaggacatgtgtcttgcagtcatcctcagagtctgaattccatgcctcagacaaggaattgggtgataacaggatagaagaggccaggaggaagaagaggttactcgtctcgcaatcatcctcagattctgaattccatgtctcagataaggatgtcagggacttgggagaggctaaatctctggtggctcagcccatgctgtctgtgtccccgaggaggctttcttttacaaggaatggatgggacaaaggaaaggagaaaaaagaactagtagatgctgggaagccctggtgtgggatatgcctctctgaggatcagaggacgactctacagggagtgctgaattgttgctcacactacttttgcttcgcgtgcatcatggagtggtctaacgtcgagtcaaggtgtccattgtgtaagaggcggttcaccacgattaccaagtcatcaaaagtggatcttgatttggagctgaaaaagtctgtaattaaggttgaagagcgtgatc

SEQ ID NO: 2404 - DNA, 1089 bp, Triticum aestivum
  Clone ID: PAT_TA_2404
acccgcgtccaccaccgccgctttccccctcgccccctcaccgcgcggcgacgccgagcgacccagcggcgagcccggcatgcatcacgaccccaaccccttcgacgagggcaccgccggcgacgaaaaccccttctccaatggaggaggccgcggcgggaagcagcagcacggcttccggcccaccgagcccgtcggcttcggcggcggcggcagcaggggcgacgccaccgtcgacgtgcccctcggcaacatgggcgactcgaatggcaaggcgagggagctctcgtcgtgggaatcagatctgaggcgtcgtgaggcggatatcaaaaggagggaggaatcgctgaagaatgctggagtgcccatggaggagaagaattggccgccttttttcccgattatccaccatgacatcgccaatgagatacctgcaaacgtgcagaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttacctgatccacattggtttttgcataattgctgccattgctccaccaattgtattccaagggaaatcattaacgggcatattggccgcgatcgacactttctctgagcatttgataattgggatcttttacttcgtggggtttgcactattttgcttggagacactgctgagcatcggggttcttcagaaagtatacatgtacttccgagggcataagtgaagcggtcatggatggaaaaatttcggaagtctacaagcagcagtgattctgttcatatgtgtcagtacaccttgagtctatgttctgttctgccaaaggttagcaaagaatacttctgagcctgaatggagtatgtaagggtagccctgctactatatgatgttctctaagatggggtgttgagattcttt

SEQ ID NO: 2405 - DNA, 1374 bp, Triticum aestivum
  Clone ID: PAT_TA_2405
cgtccgcggacgcgtgggcaagaagggaacgcactccttaccccgcgggcgacccgggacgcccagcgccgctttccccgtctccccctcaccgcgcggcgacgccgagcgacccagcggcgagcccggcatgcatcacgaccccaaccccttcgacgagggcaccgccggcgacgagaaccccttctcgaatggaggaggccgcggcgggaagcagcagcacggcttccggcccaccgagcccgtcggcttcggcggcggcggcagcaggggcgacgccaccgtcgacgtgccgctcggcaacatgggcgactcgaatggcaatgcgagggagctctcgtcgtgggaatcagatctgaggcggcccaaggcggatatcaaaaggccgcagtatttcccgattatccaccaagacatcgccaatgagatacctgcaaacgtgctgaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcaaagctgttcttccttgctacaatctatgctttgcttggaattcccctttcttacttgatgtggtatcgacccctctatcgtgcaatgaggactaacagtgcattcagttttggatggtttttcctgtgttatctgatccacattggtttttgcataattgctgccattgctccgccaattgtattccaagggaaatcattaacgggcatattggccgcgatcgacactttctctgagcatttgataattgggatcttctacttcgtggggtttgcactattttgcttggagacactgctgagcatcggggttcttcagaaagtatacatgtacttccgagggcataagtgaagcggtctgggatggaaagttttccgaagtctataagcagcagtgattgtgtccatatgtgtcagtacaccttgagtctgttctgttctgccaaaggttgtcgaaaaatgcttctgagcctgaatggagtatggaaggtagccctgctactataggatgttctctatggggtgttgagattctttatatgctgtacttcgtgtgttatctggtagatctcctgcaagtttggcatgtcggtgaacattacaagtagtcagtagttaaacgaagaatatgaacaactaggcaggaatcatgttctttcgagaattagtggcgatgctctgctatgtgctttggatgactagatgtttgttaaattgcccagttatagcaaattcgtccggtgtcacttgatgcgatgctattactgaatatttcct

SEQ ID NO: 2406 - DNA, 462 bp, Triticum aestivum
  Clone ID: PAT_TA_2406
cagcttcgcggcccgcggcctagagctgagcattgcatttggtgatagactggcgcttgctcaccctgccatgacgtccaaggtagccaacagctccggcagcgacaatgcggatgccaagctatcgccgtcggggctccccgtccgggaggtcccgggcggctacggcgttcccttcttgtcgccgctgcgcgaccgccttgactactactacttccagggcgcggaggagtacttccgctcccgcatcgcccggaacggcggcgccaccgtgctgcgcgtcaacatgccccccgggccgttcatcaccgccgactcccgcgtcgttgccttcctcgacgcgcgcagcttcagcgtgctcctcgacgaagccaaggtcgacaagaccgacacactcgaacggggaccttcatgccctccctcgcgctcttcggcggctaacgcccgctcgccttcctcgac

SEQ ID NO: 2407 - DNA, 637 bp, Triticum aestivum
  unsure (1)..(637): unsure at all n locations
  Clone ID: PAT_TA_2407
cgccgatctcgaggccgccctggcctccatcgccgcggagccgagcgacggcgaaggtgacggcgcggaggctgtcgatgaggaagccaataggtggagggaagggctcgacaggaaacctgtgacatcgccgatgccctcaaaattcttccaacaaagtccgttatcttgtaacagaaagcgcaagacggtcgtgtatatctttggaggagtttatatgtgatcactttttacctgagacccctgttataatcagtggctgcatcgatcattggcctgcaatgacaaaatggaagaacatccagtacctgaagaagattgctggggatcggactgttcctgttgaggttgggaagagctatgtgtgcagtgagtggaagcaggagctaatcacgttctcccagttccttgagaggatgtggtcaaccgcctgtccttcaccttcgacctcccttgctccccatccattcttcgtgcagataagtccccttccggtacacgtgaggggtccccacccctgtgctgctgggccagcggaactccactcacccaatccctcgtttggtccccaccggccgggtctccatcccaccacgtcccccatctctccattttatntttaaaaaaccgggtttna

SEQ ID NO: 2408 - DNA, 1139 bp, Triticum aestivum
  unsure (1)..(1139): unsure at all n locations
  Clone ID: PAT_TA_2408
ccgtccggcgcccggctgctgtttccctcctgagaaaagagaaagtatccttccacccctccacttgctttgattcttggcctgcctccgttccatagcatcctcatagctgcgtgcaagcaggtttgagcagctagctataagaactccctcatcgcatcggctcttgtttcttgccatgaccggaggggattccatggatgcgatcagcctggacgagtgggagctcctgcctgacctcgggagctccttcttcatggaggagtgcgctgctggtggtggtgatgattaggcctggaggagtgcggtgctggttgtggtgatgaagaagatgccccacgtccatctgggccacgtctctctcccctgcacctacctgaggtgaagctcgagcacagaggtggcgaccgggccaccggtgcacgctgcctctgcacagcagcagcgtgggggcgaattcgaggccatggacgtcgtgcaggccgagccgaggcgaggggagctcacgatgatggtgaccgaggtgctggtgtccggtgcagaggaggaggaagagatggcgaactcccctgttgccgaagatgaagctgctgaggaggacgaggtgatggtggaagcggcacctgatcatctacctcatgaggtggaagaaggtgcggagagagacagggcagggatggacgctgctggcttcagcgtcgggaaactgagggtgaacggcgtcggggcgctctgctccttcggggtcgccgctgccaccttctgcatcctggtgcttggcggcaggccgcagcagcagcggcagctgcgggacctcatggcccaggtccaggtgtcccccgatgatgaggtcgatcactctttccttctgttcgtgaactaaatttcttcacttctactgattgatcttctctttgttccctaaaggcatgctctagcaaattactgctatagtttttaaacatcatttattatacttgggtccaaaaaagaaaaggaaaaaacattggatgagttcagcaactctgcatcatgatgatgatgcctccttttaaagattaaaatcctccttctataaaaaaaanaaaanaaanctccaaggggggcccggtaccaattcccctaaanggatcgtnttn

SEQ ID NO: 2409 - DNA, 2171 bp, Triticum aestivum
  Clone ID: PAT_TA_2409
gcgagctgcggggccccctaggtgcgcggtcgcctgaaaggcctacggagttctgttgctgccgacgatcgctgcccggcctgtccgtgtgcccagtctcccctctctccagtccagttgtgggcggtcgagaagttgtctgtgctgcttctgctcggctctgtgggtccccgggggttgggggctttcgttgcggccgccatgcttactaggcgaatccttggtgaagaaaatgacaaggcaatggagtcacctgatcgagaccagattgaccgttacatcacttcttctgtcaaaagtgctttcatgaagattgcacatttcgtagagattaaagcagacacatcacatgagcatgttttagcatctctagctgaggagacgaagaagcttttgaagatagagacaaacattttttccccagttttgtcaagatggcatccacaggcagcagtgctttcttcatatcctgcggaataaactgtatgcgtacaaattgggaacctttgcttgcagcattcctgagcatcttacatctgacgtagcaagagaaccgtgtgcttattgatctttggagcagtaacataataagggggatggcttccgttgtgggaggtgactgtttggacactctatgtagacaaaagctagtgccttagtgagattgaaatcacaccgggcacggtagttatttcctgggtgaatgggcaagcgcagagagaccaaccttggttacagagagaaatcgggcaacggacttgggatcctatatacccctcaacaacgccatgggggttctattgttgaagtctatagaatcatagaagagactgcagatcaattttttgcatttaaggttcctatgcgaattggggaattaaatagcttctgtcgtggtatcgacaaggcatttcaaatttatacacaacttgttactcaacccatagttgacaaagaagatttagttccacctgttcctgtccttactcgatataaaaaggagcttggaatcaaagctttcgtaaaaaaggaaatccaagaagtcagacctgttgatgagagaaaatcgagtgaaatagttcaacttacaatgtcaaagctatgtgtgcggcttaacagtctatattatgctataagccagctaggcaagttggaggacagcataagtgagcggtgggctaaaaggcaaagtgacaaaattaacatcagacgatcaatgaacggcaagtcaaagggtgtagtctccaatcagaagaatcaatttgatggcagtagaaaagaaatcaatgctgctattgatcgggtatgtgaatttacagggttaaaggtcatattttgggacctccaacagccattcatcgacaatatgtacaaaaacaatgttttacaagctcgattggacactattgtcgaagtgcttgatttggtgcttgctcaactctgtgacgtcattgtggagcaactgcgagatcgtgtggttacagggcttctgcaagcatccctggatggcttagttcgggtaatactagatggaggtcctacacgcgtcttctctccgaatgatgcccctcttttggaggaagatcttgaaattctgaaggaattcttcatatctggtggagatgggctgcctcgtggaactgttgagaatttggtctcgcgtgttcgtcctgtaataaatctgatcaagcaagagacccgtgtgcttattgatgatctgcgcgaagttactcaagggggcaaaagcaaattcggaagcgactccaaaaccctgctgagggtcctgtgccacagaaatgattcagaggcatcacactatgtgaagaagcatttcaagatacccagttcagctcccccgagcacctgatttatggggaaaatctggaaacacctcaaaggtacatataatggatggaacggtgctcggccttgcaacctaggaagcttattttgtaataattgtgcattattagcagtcggagctagggaaccataggctagttttgattcatgggcattgtcttgattgattgcttctccccaggaaagatttagatgtcttacctttgtttctttggggagtttttagctggattttgatggcgtttctgtctgatgggaatgttggtctgtttgcgtggtttcagaagtgatgcttacaattctgtagg

SEQ ID NO: 2410 - DNA, 685 bp, Triticum aestivum
  Clone ID: PAT_TA_2410
tcggcccgaggccggggcggcccagctacccatatcactgactaatattagatcgcatggggaacatacaccaggccggcgtcaagaaagatgaccatgggcggcggtgacaaccagcagctacaggtggtctccgttctcgagctccaggccggcgttgtggaagaccagccgcagcctctcggcggatggcatgccgtcgaggcaacctccatgttggaaaattgcaaggcaaacagtactgctacagatggaggcaccagcagcaggatagatatccccggccctgcaaccgaacagaacatcccgaaacccagtgatcctcttcatccatgcccgccgccacagtcgctgccggagggtgtgcagtccgtgctcaacacgtcacgggttaaccgaaagtgcattggagacggtgatggcttcactgcttatgaggagaggattgcaggtgatacggacctccgtgtgccaccgggcttcgagtctagggtggagggggtggggcctccggggcggggcgtggttcgtggcttggggtcgggccaggcattggtgggccttctcggggggacgcctgctgcgacgccggcgtttgccccgggcgaatgtggacctgctcttggtgccatctactgtgtcggcgtccttgcccaggttctttcgctgaaagggggctttgcct

SEQ ID NO: 2411 - DNA, 558 bp, Triticum aestivum
  unsure (1)..(558): unsure at all n locations
  Clone ID: PAT_TA_2411
tgccgaggaacgcctccgccgcgccggagatcctgtccccgagcgtcctggacttcccgtccctcaagctcagcagcccggtgacgccgctcaccggcgaccccttcttcccctcgccggcgtcgtcctcgggggatgccgccgagcgcgcggccatcgccgacaagggcttcttcttccacccttcgccgcggggcgccgagccgccgcggctcctcccgctcttccccgtgagctcgcccaggatggccgccgcgtccgcgacggcggcgccggccgagtgagtgacccaaagcctccgcctttgcgcgcgcatcctgctcagccagccatgaagtaatctacgacttctaccatcgccaccgccctcgctgtatcatcgccgtcctttgggtcgcagttctagtttcatactgtagtaagtagcaaggtgtttgctgtgtccttcttccgccgggcgccggcgctgctgttgtaattttgctcccntcttgaaaaggaagaggggagttggtctccttttgangttgcgacccnntaatcgattaattacaagtt

SEQ ID NO: 2412 - DNA, 1218 bp, Triticum aestivum
  unsure (1)..(1218): unsure at all n locations
  Clone ID: PAT_TA_2412
tcagaagccaatgcttctctcgaaggcaagctggcatccatgnaagcagagcttaagcaagcttatcccacgagggcagaagaacaaatgaacagcgagaaacatatttctgagctgaatcaagaccttgccaatcttacaagcaagcttgaactgatattatcagagaaagacacagttgataacaagctggccactctactaactgacatcacagcacgtgatgaaaagatgaaacagatggatggccaccttagtcagcttcaacttgagcatgccaagatatcagcagagtccgctattgtgcatgagtccctgtcggagctgcgtgctcgggtttctgagctcgaggaacttgtggagaagcagaacctcgcgatctctgagggcgccgaggggaagcgtgaggcgattaggcagctgtgcttcacccttgagcattaccgcagcgggtaccagcagctgcgtgagatgctgcagcagggccacaggagaccgccgatgctgatggcagcctgaccaagtgcatccttcttgttcccaatatccttttgtgcttacgaattgggttatgcagctttttcaattgagaagaactctgttatgtctgtgtgcaactacaatgtaatgtgaggatcatgtcagtcatggctggctggaaaaaaaaaaaacatgtccgtcgtcgtttgctcttgttacttctgttacattcttgtcatatattcaagagggtgttctctgtgttttggtctttgaaacggcgatgttagttcgccgagctatggcatgtcctagtcagtcttatatctttgaatcaaagttgagtttgtcaagatacatgaattttcctgcgtatgcctcaagaaagtattatgattcagatgtgatgaggaagctgcaggaagaaattcatcattcgtaatctcactgagtcggaggcagatgctgaagccagacccggtacaactacaagggaggtctagcgcatctttcattcgtggattcctagcagaggtgaactgtttctacaaaattgctgcaaattcctatgaagttcacgccaaaaaggccattgactaatttctatccttttctgtaagttttttcttgatcaagtctgaagccattgattctgtgaatattctgaagtgttttttctctcaaaaacatcagaacattctgtttctgttcatgcctaaaaaaaaaaaaaaaaaaaaa

SEQ ID NO: 2413 - DNA, 962 bp, Triticum aestivum
  unsure (1)..(962): unsure at all n locations
  Clone ID: PAT_TA_2413
cggaaccactccacataaaagaccacagagtcagtcatcgttcctggggaggatggtatttcgtacttcaaacattactgtcgatatggatcttgtgcgtcaaatcgaagccaagtatcctgcttttcttttcaagcagcatcttacagcatttgtggaaggcttatatggaatgatccgtgacaatgtcaagaaagaattatctgcattgctcttgcatgctattcaggtcccgagaattatgaaagccagtatggtaagacgttcatttgggtcatcaagtttgagggggcgttcattttcaaatcaaggtagctattggctggcgatagttgacaatttgaatgaactcttgaatatcttgcgagaaaattgtgtccctgctatttttattcggaagatatttacccagattttctcatttatcaacgctcaacttttcaatagtcttcttgtgcgccatgagtgctgctcttttagcaacggagaatatgtaaaacaaggattggcacaactagaggtgtggtgtggagaagtgaaaccagagtatgcaggatctgcattgcatgaactcacggcacataaggcaagctgttggtttcttggtcatattcaaagaagtccaggatttcatatgatgagatagtcaatgatctctgcccagtgctaagtgtccagcagctctacaaaatatgcacccagttactggggtgggacaaatataacacagagagtgttacctgaagaaatccttggacgaaatggagaactttggatgacaagangaatgnggcataaatgctcaaaaagggcccnttttaccgggtgatgaaataagcatgccgatatcacttgagggagatagcagantcatggatgctaaggganttcaaaactgggcccacatcagaactcgtccaatgtctgccttcagttcctgaaagttaccgggccncnccant

SEQ ID NO: 2414 - DNA, 538 bp, Triticum aestivum
  Clone ID: PAT_TA_2414
gcgtccatcgcgtccggcgattccaaccgctccacggcctctgatcgcgagcagaccagccaagtccgcaggaagaggggaaagatcgcccagggcatcaaagttcccgtgactctggggccaaagctgtcggagacggtcaaggggaagctcacgctgggcgccaggatcctgcaggccggcggcgtcgagaaggtgttccggcagtgggtctccgtggacaagaacgagcggctggtgagggcgtcgcagtgctacctgtccaccacggcgggtcccatcgccgggatgctcttcgtctccacggagcgcgtcgccttccgcagcgaccgctcgctggccgtggccgcccccgacggcgccaagctccgcgtgccgtacaaggtgacgataccgctgcgcaaggtgcggcgcgccgtgcccaccgagaacaagcacaagccggagcagcgctacatcgaggtggtcaccaacgacggcttcgagttctggttcatgggcttcgtcagctaccaccggtcgctgcagcacctggagc

SEQ ID NO: 2415 - DNA, 714 bp, Triticum aestivum
  Clone ID: PAT_TA_2415
tcggctcgcggcagccgccggtcccgccgtcgccgtccccgccctcgctgcggcgggtctctccgccctccaccccctccccgccgccccgcccgcgccctcccgccccgcccccctccccgccccgcccgcccccccggccgcgggctccgcgcgcgcggtcgcgcccggcgggggcaggccctgctggagcgggagccgcggcctcaggtcctcccccgcgggcgcccctagccgccgccccccgctcgccctcgcgccccccgccccgcccccccccgcccgcggccgcggccgcggcctcgtcgcggccgcgcgcggcaccggcgagggcggccgggcgccagcggccgggggcgcccggccgcgcccccgcccccccgggcccgccggcccccgcctcgttcccgaggacgacatggacacccccagcttcctcttcgagtccgtcgagcaggggctcgaggggaccaccaacccgggtcggtgcgcctcggggcgggcccccccgcccccgggcgccccggccgaggcctccttccccaccgtcgtcgtccgccagccccccgtgccgccgccgaggatcatggatgatcctatgcaggttcccaggagcataatggagggatggcacccgcaggagatcgaccagctccctgaggccttcagcggtggatgggttgggttcttttcctatgatacagtccgctatgt

SEQ ID NO: 2416 - DNA, 872 bp, Triticum aestivum
  unsure (1)..(872): unsure at all n locations
  Clone ID: PAT_TA_2416
gtcgcggtcgcctccagcgccttcatcggcgccagcttcatcctcaagaagatcggcctcatgcgcgccggcaagtgcggcgtccgcgcaggcggaggaggatacacgtatcttctggagcctctctggtgggctggcctgctccccgtgctgcttggggaggtcgccaactttgtcgcctatgtcttcgcaccagctgtcctcgtgactcctcttggagcactgagcataatcgtcagttcagtgttagcgcactttgtgctgaaggagcggcttaacaagctcggcgttcttggttgtatatcgtgcatagtaggttcagttgttgtcgttctacatgcccctgaagagcacatgcccgattccgttgaagaaatctgggatctagctactcaaccaggatttctagcatatgcgggaacaacattgttactcatggcaatagtagtagtgttcatcgaacctcgatatggtcagaagaacatactgatatatctgggtatctgctcttcaatgggatcattaactgttgttagcatcaaagccgttggtgttgccataaagcttacgctggatggaatgaaccagcttgcctatccgcacacatggctttttattcctggtccgcagttatctgtggggttctcagctaaattacctcaaacaaggcactggatactttgatttaactatggtgtccccaatttattaatgtnatgtttaacaaccttacaatagtggcgattcaaattaagttcaaaggacggggctgggacaaacttaantagtaccgcttccggaatgctgcngccnggtaacaacccttccggggaacaatttgccgcacgcaagnaaagcaaaaagaaactcna

SEQ ID NO: 2417 - DNA, 1147 bp, Triticum aestivum
  Clone ID: PAT_TA_2417
gcaacatcatgttctcaccattctacttggtcccgcggcccccctcccgcccgcctgaccagttaactaggcagatccccttgttaaggcacatggagtttgcagcgtgctacttcatggcaggaagctttagggctaacccatatgagacttgtactaccagccagcagtacaaacacctggcctatgtcatctcttttctcccttactattggagagctatgcagtgtttaagaaggtacatagaggaacatgacattaatcagctcgccaacgccgggaagtacgtgtcggcgatggtggcggctgccgtcaggttcaagtacaatgtcacaccgacaccattctggatgtggatggtcctcatctcgtcctcaggcgccaccgtttaccagctctactgggactttgtcaaggattggggctttttcactcccaaatctaagaacctatggctcagggatgatctcatcctgaagaacaagttcacctactacatttccatgatgctaaatctacgtgcttcggctagcatgggctcaaagtgtgatgaagattccgtattcaataagaatgagactcgcctgctggatttctccctcgcctccttggagataatccggcgaggacattggaatttctacaggctggagaacgaacacctgaacaatgttggcaagttcagagcagtgaagactgtcccaattgccatttcgtgaactcgaaacggattgatgattagacggagagaatagtgtgacagcatgctcccaataccaagggaatttaggttcagagttccaggaatggttgagctgaccctagtagtgcttgctgctagatttggtgtcgaggtggtaataaagccttcagagagcatatccacaagatcacaatgttgctgatcttaagatggaataagctcagatggcgcattgtatcaagttcgccagggcacagctagctgaggcattctggtcaagaaagaggggggtaggatcctcattgtccattgaagattgatgtgcatagatcagcaaagattttagctttgttgatgattaagctgtgtgtgtgtgtgtgtgtgtgtgtgttgtgtgtgctagggattgatgctaagataatattgcacgtgttaaaaaaaaaa

SEQ ID NO: 2418 - DNA, 972 bp, Triticum aestivum
  Clone ID: PAT_TA_2418
tcggcaagctcctaagttgcaccgcaggttgtcatcaggcgggcgcgcgcctagctagctaacatggtggcagcatcaagaagagcatcctcgatgcgtgtaagagctgccatgaagatggcatacctcccggccttcgccgtcgtcttgctctccggcgtgcggcctcgcctcctccgaggtccgctgccctccggtcaccacccatgggcgcccgacgcacagctggaaggttggcccgagccggcgccccgccaagctcgagcctccaaccgcgaatgctgataaaccgccggagctcggcatccgcgacaacggttccattcagtctgagaagaaaaagcgccatgccaaggcgccgcccaagcaccacgggcctggcaaacacgctcccccggccgacccttcgccgccggcgcctgatccggacggcggccagcccccgggggtacctgttcccggagggcccccccgcccaccgcccgccggcctgcccgttcccgtgcccgccgccgccccccggccccctcccgccccccctccccccgttcccgtgccgccccccgccacctcctgcgcccccgcggccggcgcccggccagcagtggcccccgccgccgccgcggccgcagcctgccccacgatgccactgccccccgcttcctgcatggccggagccaggaccaggagagcagtggccgccgttcccggcatggccgcagccagaaccaggaaagcagtggccgccgttcccggcatggccgcagccagaaccaggaaagcagtggctgccgttcccggcatggccacaaccggagccaggaaagcagtggcctcccttcccgttctacccgccgccgatgccgtcatggcagtggccgccatcaccgtctttccacggcgaggaggaagaacacgcatctaggctggcgccgcctgttccagcgcacaactgatgcatgcgtacagcgc

SEQ ID NO: 2419 - DNA, 707 bp, Triticum aestivum
  Clone ID: PAT_TA_2419
cgcgtccgtctcgcttctccaggcgaacctctagggttcgtcacgatccccgttgccgcccgccggattcgaccgtcggcaagacccgccggattccggcccgacgccggtgctgctgccactactcctccctccctccctccctccctcccgtaatccgactctccgcctccgcattcaccaggcgcagcccccgtcgacccgcagcagatccgccgcctcgaatcgcacccaagacgcgtgagccgagagctcgatggggaagtcggagccggagtgcgacaactatgcggacccggcccacgagtgcaaggactactgccgcaaccagaccgccgaagccaacagccactaccgccaacagcaacgctccccgtagaacaacccgccgcctccctccaccgtagcacctgcgactcgtggcagcggccaccccggacggtgcgcaccttgcagtcctgatctgaatagattgcccccgccactgcagcggcggcgcggggggcgcgagagagccctgctcgaaggcctgccttgcccggaggcgcccgaaaccaggcagacgctgttgaggctcccgcgcaccaggagcccccccaggccgcgccggtcgcgttccccctgctggccggcaagcagaagaagctgtttgagctgcagcttaagatgaacgaagctaggaaggcgaatcagcaggcgatggttgc

SEQ ID NO: 2420 - DNA, 725 bp, Triticum aestivum
  Clone ID: PAT_TA_2420
ttcacgcgtccgctccgcaccatgggttaactaggcgccttaatctggccaggccggctgcaaacgaggtctgagacggcagcctgcagagcggcgacggcagtgagcatggtgggagcggcggaggggaagctggcgctgggagacatgagggtgctcaagccattggcccacctgctggtcgggctggtgctgtactgggtggccgaggagatgacggtgcctgtgctggtcgacgtcaccaccgccgccctctgccccggcgacggcagcacctcctgcccggaggccatctacctcaccggcctccaccaaacggttggaggcattttcagggctgtgggattcactctgatggggcagctcgccgacgagtacggccggaagcctctcctcatcctcgccgctggcacctccatcatcccttacagtgtgcttgctctgagcagcaccaaggtcgccgtttacgtctaccttgtcacacgcacgctctcattcatgatcggccaagggaccataacctgcctcgcattggcgtacacggcggatttggtagaaccgtccaagagggcgttcgcgtttggctgcatgaccgggatcctgtcggcttcgcactccctggggaacgtcttctccaggtttctgcccgagcactggatttttcaggtctcggttcttctgctggtctgttccgtggtctacatgaagatttgtctggtcgagac

SEQ ID NO: 2421 - DNA, 1508 bp, Triticum aestivum
  unsure (1)..(1508): unsure at all n locations
  Clone ID: PAT_TA_2421
gcgcgtgcgccacccaccttacgctctctcatctctctctgtctccctctctctgttctctcgatacggagggaggtgtgccgttcttcgaggagacgaagcagcagctgtcggaacgttcggcctctcatcctctctctgtctctctccccctctctattctcgcgatacggagggaggcgttccgttcttcgaggacacgaagaagcagctgtcggaaagataagcaaggtaacatcagctggtcaaggatgacagctggtttacagctcggcgtgatcgggtctctcgcgctctccgttgcatcttcagttgccattgtcatctgcaacaaagctctcaccaacacacttggtttcccaatagctaccacattaacaagctggcaactcaaggtgaactactgcaccctccatgtggcacaaagcctacatttttttgagcccaaaggcaattgatgggcatacaatgctcctctttgtgggtttctgaacggtaccccaattggactttttaaccgaagttatcaagccctctcttatggtctctcttcttggacgaggctgcccatcagtccctgctctcggccgttggctacttgcgtccggcccttctggccccgccagcctatcaagctctctcttatggtcttgcttcttggagtaggcatcgcatcagttacagatctcgagctaaatctacttgggtccgtcctttctggcctcgccatcggcaccacttgtgttggccaaattctcacaaacacaatacagaagaaactgaaggtctcctcaacgcagcttctgtaccaatctgcgccataccaagcagcaattttgtttgcgaccggcccgtttgtggatcgactccttacaaaccgcagtgtcttcgcccacaaatacaccactccagttgtgggtttcatcatcctatcttgcttgattgcggtgtctgtgaacttcagtacatttcttgtgattggaacgacgtctccagtcacataccaggtgcttggccaccttaagacatgcctggttctctcttttggctacactctactacacgatcctttcaccatgaagaacatattaggcattctggtcgccatatttggtatggcattgtattccttcttctcagtcagggagagcaagaagaagtcaacaaatgatgctctgccagtttcacagatgccagataaggagactgaaccacttttggcaaccaaagacggcagtgatatcaagaaggcaaatggtgtatctcacggctgctaagacttcccttgcttagtgtagatatagtatgcacgtctgctcttcgagtttcaaggatctggaaagccatttctttccgttcttaaatttcttttgtagagaaggaaaagatttccatatcgtagagtgtatattttgacacaacaattattatttgcttatcctttttcgcactaaaaaaaaaaatcaaaaaaactccagggggggccggtaccaaatcncctanagnag

SEQ ID NO: 2422 - DNA, 360 bp, Triticum aestivum
  Clone ID: PAT_TA_2422
cggacgcgtggggcatggccctgttggcctccaccggcgacagccatgcaagtttagctcgcctgtgtcagcgcatgcatggctgcatgctaccggccgatgctggtgtggccgtccgtcgatgggtcgatggtgcatgaaggcatgcttgtagacctgaactgcgcaacacggagcaggatggctaccgtctacgtgtgagatatactaatattgttccttccattgcatgatttgtctctcgtccgaaccgctggcttcagtacttgcgtgtcctccatcgatcgttcgttcgtcatcgtcactggatgtaatgtatgtaaaatgccgtgacgttcggaatataatataatatttttc

SEQ ID NO: 2423 - DNA, 894 bp, Triticum aestivum
  Clone ID: PAT_TA_2423
ggcccgcgcatggcctccctgtctcccctccccccctcccttccttccatccatcgttcgggatcctcctcctctcgcgcgcttctaggaccggtccctcgaagcttcttcttctccttggactcgtgcttggcgtggcgcagacggccggggtggggccggaggtgggcatgacggcgcccgcgcccacggcgtgcccctgcccggggtccctgttcccgtgcccaccgccccgtgcccgccgccccgtgccccgctggccccggcccgccgcgcccgccgggcggcgcgcccggagcctcggtgcccgggtcctctcctggccgggcctgcgtccccgcgcgcgctccgcccccccccgcccccgccccccgcgccgacgccccgcccgccgcctggacggcgaggcacccctccccccggagcggcttcggcgaccccgtccccccgtccaagagggttcgaggcgtccggttcctggactacgacggcacgctgtcccccatcgtcgatgaccccgacgccgccttcatgcaccgtccgttgcggatgcccgtcctccacgtgcgccaagcactgcccggcggcgcgcagcctgccggtccgcgccccgacagcgtgcgtgagctcgcgaagctggcggagctctactacgccggcagccacggcatggacatcctacgcccccgcccacggcctcgaccgtccagggccccgccaggtcgttctccttccaaccacgcaaagcgagtttcctgcccctggtagaagcggtgcggcgccggctggcagggctgtcgtagcaccgggccgcggccgcgctggaggccaacggggcctgcgggtccgtccactccagatgcgtcgacgaaaagagctggggcgcgctggcgg

SEQ ID NO: 2424 - DNA, 603 bp, Triticum aestivum
  unsure (1)..(603): unsure at all n locations
  Clone ID: PAT_TA_2424
tcgttagcgcgcgaaccaccaccatgtgcccttgtcccgtatgagccagaatcgttgtcgcaagctcacgggcgcccgcaccaccaatccaccacagcacagcgcaggcggctttcagattcggctggcgctcggagcactgaagagcacagggaagaagaagaagaataagaagaagagctctgggagagcgggggcgatggtggcccagaatcagaggacgccgggagaccaggtgttctggcccaaggtggtgctcaagaaatggctcaacctcaggagcaaggacgccaagttcaacgccgacgaggacgacggcgacgacgacggggagcaagaggagagctgcggctgcgacggcgccgaggcggagcgcgaggccggaggcgtggacatcgccgaggagagcctggacgccgcgccgtacaagctgcggcggcggaactcggagacgatgcgcgcgcagtacatcagcaccaaggagctcaggatctgcattggcacgtacaacgccgccggcatagagccgccggaaggcctcgacatgncgagtggctcggcaccaccggcggcgagcaggccgactggtacgtgttcgggttc

SEQ ID NO: 2425 - DNA, 1051 bp, Triticum aestivum
  unsure (1)..(1051): unsure at all n locations
  Clone ID: PAT_TA_2425
gcacgaggccccgcgccgactcactccccggccacagccagcctctcgcgtagagacgcccccacgcctgtctccccacctcctccccagctcctccccagactagcaataagggatcgggagaagggagaccatgatggccatcgcccgctagcccccctccgtctcctccctgcccgcttggtatggccatcgcccccatcatggagaacatccagagggcgcgctccccgccgacgagcccgctccgcgaccccccgccccccgtccggggcggcgggggcggccagcgggaggagagccacctcatgggcctgcgcaagcgccgctccagcttccccggcaagtcccagcccgcctcctccgcgtccgccgggtcggcgtccccgcccacccgctcggcgccgtccccggccgccccgttcgccggcggcccgctcaagcgctggtgggactgggtccccggctagctccgctccaccaagctcggcttcgccggcgacctggagatgaacgacgaggggccggccgcgcccggccgcccaagcccgggcacccggccccacgtcctctacaaggcgcgctccggggtccgccgcctcgtcgcgtccgaccactccgctgcccaccacccacccccgcaaggcctcgctgcccccctcctcctccgcgcaccagcactgcaagccccgcgccccagttccgcctacaccctagagttccaattacggccaagcaatggcgcactaagcagttgctttgcacttgttctgggtggtgtccgcgagattccaaatagacacgacgacgggaaggaactccntgaagaaggagaaatcaagtctcaaggnagattcnatgggnaagatggtccctacacaattatatctggggaatttagattgttatttaccgtgctgcttcctttttgtgggtantctaattctctacgtataatanatacgagtgtatctggtggtcttcaatctttgagtctgggtgcattaatgttgtggatcctaagttttgctctgcgtaataaanctaatca

SEQ ID NO: 2426 - DNA, 1395 bp, Triticum aestivum
  unsure (1)..(1395): unsure at all n locations
  Clone ID: PAT_TA_2426
cccagccctacaactacccgcccgcgccacccgaccgaggcaaacagcacgcccgaaccctactgctgctgcgggcacgcaccactagcacaccccgcatcgtcgccggatcggaaggacaggggggagagccgaggaggaagaaggccgaggatgttccgcaaccagtacgacaccgatgtcaccacctggagcccgcaggggcggctgttccaggtggagtacgccatggaggcggtgaagcagggctcggcctgcgtcggcctccgctccgccacccacgccgtcctcgccgccgccaacaagtccgccaacgagctctcctcccaccacgcgcaaggtcttccgcgtcgccgaccacgccggggtcgccgctcgccggcctcaccgccgacggccgcgtcctctcccgcttcctccgcaacgagtgcatcaaccacgccttcgtctacgacgcgccgctccccgtctccaggctcgcgctccgcctcgccgacaaggcgcaggtttgcacacagcgttcatggaagaggtcttatggtgtcggtctccttgttgcgcttctagatgagtctggagcccatctctactacaactgccccagggggaactactttggagtaccaggcattcgccattccctcccgctcgcaggcagcgatgacttacctcgaacgcagattcgatgaaattcaacgcctacaccccggacgagctcatcaaggatgcgctctcagccataaaggagaccctccaaggtgagaagctgaccagctccaactgcaccattgccattgtcggcagaacggaggacggcaccgtcgagcccttctccatgatcgactccaagaggatccaggaaatcatcgactccatggaggccgccgatgaggcgccagcggccgacggaccggctgaatcaagctcgatgcaggaggacaggggcgatgcgcctgcggcaggggatgccccggcggcggacgagccggcagcaccggacgccccggcgcccatggacatctaggcgtcgtctgatggtctcaacatgtcatgtccgtccccccccgttgccgcagcgctattcggaatttcaaaaagactagtctgttgttttagaaaggttgccccactttgtgtgtactctgtgtttctgcgccactacagctttgtggtgcctgcctcgggactgattgatttttatctatcatgtgatgatgtcgcggacagaatcgtctggttgggggaacagatttacgttttatttatcataaaatcctgctaccactcggacgggtaacctgcgttaccaactaacgcctganaaatccctttcaactgntatacaaaggcccacgttgccttcaanttccactatgaatggacccccntcgccat

SEQ ID NO: 2427 - DNA, 697 bp, Triticum aestivum
  Clone ID: PAT_TA_2427
tctctaatctggtgtacatttccaaccttgccatgacagagttcatatccctctcgctgtccctttgactgactggaattattgatacgcgtagaaatctctctcagccttcaattttctttctttgtttgttggccgctcgcgtggtagttggcgagcggggctccagctccatccaggggccacgaacgtgggtctggaggagatctgagcctcctccgtgaggaaggaaatttgctaagtccacctaagatttcatcgacgatcacttcgacacatgagatgaaggcaagaagcagcttctacgctcagtgacagctcggtccttccatcccattcccaggtgaagatcaatggctactactagtagtacggccgggggatctcaccgcccttctccgccctgctatcctcggcggtctggaatgggtgctgatcctgctgatgctgcccggggggccgcctcttcccgccggggcagcgcggtccgcccgcccctgcccctgcccgccgcctgccccgcctacgcgcagtacggcctggggatctcaccggcagttctcggccctgctatcctcggcggtcctggaatgggtgctgatcctgctgatgctgctggagggcctgctgtcccgcctggccacggcgttcgcgcgcctctgcaacctcccgccgccctgcccggcgtgcgcgcggc

SEQ ID NO: 2428 - DNA, 1150 bp, Triticum aestivum
  Clone ID: PAT_TA_2428
gtgcctccggtgctcacgtccccgcgccacgacgccatcgccctccacagggccttcaaaggttctgggtgcgacagcacgacggtgatcaacatcctggcgcaccgcgacgcggcgcagcgcgcgctcatcatgcaggagtaccgggccatctaccaccaggacctctaccaccgcctgtccaccgagctcagcgggaaccacaagaaggcgatgctgctgtgggtgctggaccccgtgggccgcgacgccgccatcctgaaccagtccctcaacggcgacatcaccgacctgcgcgccgccacggaggtcatctgctcccggacgccgtcgcagctgcagatcatgaagcagacctaccgcgcccgcttcggctgctacctcgagcaggacatcaccgagcgcacctacggcgaccaccacaagcttctgctggcgtacttggggatcccgcggtacgagggcccggaggtggacccggcggcggcggcgcgcgacgcgagggagctgtaccgcgccggcgagaagcggctcggcaccgacgagcgcgccttcatccgcgtcttcaccgagcgcagctgggcgcacctcgccgccgtcgccggcgcctaccaccacctgtacgcgcgctccctggagaaggccgtgaagagcgagacgtcggggaccttcgagttcgggctgctgacgatcctccggtgcgccgagagcccggcgaggtacttcgccaaggcgctgcacaaggcgatgaaggggctgggcaccagcgacacgacgctgatacgggtggtggtcaccagggcggaggtggacatgcagtacatcaaggccgagtaccacaagaagtacaagcgctcgctggccgacgccatccactccgagacctccgggaactaccggcccctcccccccccccgcccccgccgcgcccgccacgaggcgctgcccgttcctcgatctcgacgccacatggtggtccgcaccgccaagaccgccttgcgtgatcgattggtcggtcagtctacctgtgtatatacatctgtttcctctattcaagtggccaagaagccaggtctgaatgcaatggctactgctcagtatgttcatgttaccactgaaatgaaattggcaactactgtctttatttatt

SEQ ID NO: 2429 - DNA, 1239 bp, Triticum aestivum
  Clone ID: PAT_TA_2429
tcggcacgagggaacgacggcaacaggacgctgttgtgtagagcagagcagtacgctcccgggcgatggacgtgcggttccgagacgcattgacgaagcgggtgttgtcatcttcgagggcaatggacgcgtggattcgaatggcttgatgagctggttggtgtcgagcttcagcagctgatggacattgtactgtctgtcaggcttcggctgctgccaatgaagccggcggcagggtgagtgcgggaaaaagtgaaagagagagcgaggaataaaacagagatggcatgtgggcccaaatgatcagggagaggagtgagtaatcccggttgggaaccgggatcgcccgtaacccggtgcaacaaacaggtctggggtgaacatcggctgggattgataaaaatagggtgttgatttcaaggatttcgaggtaagggttcgattcagggggtgtttggttccagagatttttttgtgttgggactagaaaaagtccctagtaaaccaaacagggtgggacttttttgggactttttgctaaaagtctttagaagcacctccttaagagtctttttcaaaaagtcgtagggactagaaaaagtcctaggtctcgtcgccctcccaccgcctccgtcctcgggttcaacttcgcgccttttttcagactgctcgcagcccttcccgtactgtgtaaaagttgatggcgtcattgccttacactggccaatcacaaagtcccccaccttactttgatctgtcactttttcgttattgtgagaagctgttttcagcaattgatcggcataggcattgcacagagcatccgataaaatttatatcagtgaggcaaccaaatgtcgtcaaatttaagataaaaccagggtcagattctggtgcttccgacagccgaggaaaaagaatctcttccttgtttcacccatttttcccgcttgcactgtcgattcagcagacaaatatgcagccaactgttgtcaatgtacatttcaggagatagaaatattatagtcgttgcctcaattgtgtttggctcaatagaaattttggtcatctgcagtacatgttttatctgctgatcttactataggagaaaaagaagtggtttttgcttgttcacgtgttaataccgaaattgtcggattaaatgagccccgttgattgaagaggaatcttaagaaacaaaaggaatttttgttcaaaaaaaaaaaaaaaaaaaaaact

SEQ ID NO: 2430 - DNA, 1546 bp, Triticum aestivum
  unsure (1)..(1546): unsure at all n locations
  Clone ID: PAT_TA_2430
gaggcatgcggccgagggtccactctaagctaccccggcttatggggctgagcacgaggaggatccccatacggcttcttcgtctcatggggctgggatggaggcggagccgcacacagctactttgtcatatggatccgaacatgaagaggatccacataaagctacaatgtcatatgtattagaacatgaagaggttccgcttcaatgtcatatgggatctggaaatgaagaggatccacataaagctacaatgtcatatggatctgaacatggagaggatccgcataaagcgacaatgtcatctggattagaacatgaagaggatccacataaagctacaatggcatattgtcccgagcatgaggaggatccgcaataaagccaccatgtcatctgcgtcaggacacgaaaaggatctaaagacatttttaacaggacatgagacacatttaaaagtaaaaggagaggggagtcaccatgctcattctcacaagcacgggaacaaaaagcaggcagccgttttcttcttccacgacatgttgcggctgggttctgtgataattccaaccatcccactgacaacctccttgccggcccttcttccccacaacattgccaaatccatcccgttctccacggagcgcctctccgccgtgatcgcgacatcccttcagcgggacctagaacgtccgtgcgttctccgctgccagcccgacccttgggtccccccgcggcacccttcccggccaaaaagcaggttgcgccacctcccttgagtccctcactgagctagcatcatcccttcacgggacgcacaacgtccatgcgttctcggccgccaatctacccattgatgccgcacggcacgccggcgctgcagcgggatgtacaacatgacagccgtggcgaaagctctctgactcacacgagatcgtcacctgccatgatctgacggaccgatacacggtgtcacgattgccacaccgcccaaccttaagcccggggatgcggccatccttgagactgtaggatgcttgcaacgatgccgcaagctgatggaggatctagccgtgtgccacgttgacacctcgcggatggtgacccgcataacctgtctggtctgattctctaacccgaagacacggacatcggtaccttatatgggtgactcttcgtaaattgcatgatggtggttacggaataagtggtctgggcggaagtacatcgaataaccttcatgatatgtgagtaaaatgtgtcttgtggtttgcagttgttgtaagaacatcacccatctattgtgtgttgtgggttgtccttctatcaaatgcatgatggtgttaatgaaataaatggtgtgcggaagtcatcgtacaatcttctggatgtgaggggggggggggcgtgccctgtcgctgttgctctcccaccatctccccctcttgggtccacattgtgtctactcctagagtctgccttctttgaggtgtcctcccgacggtaaaaatacccaacataaagttttaattantnacactacgcg

SEQ ID NO: 2431 - DNA, 435 bp, Triticum aestivum
  Clone ID: PAT_TA_2431
gttgcaactcgtcgacgcagagcggaggagcgaagcgggccggccggcgagatcgacgcaaatgcagatggactcctactacttccacgacgacgcccacttcttcgccggctgcggcgtccccggctcgccggacctgcccttcgccgacctcattgcgtcgctctcggagccgctgcctgaggtggccagccagagcgcgttccgggagtaccgcggcgtcgggctggagcttccgggcacggcgcggggcgggacggggaacgggatcaacacccaccggaggatgatgggcgtgctgggcaggaatggggccggccaccgaggaggagcagcggccgcagcaccagcaccagcagccgccccgcccggccgagagcagccgcggggtccggcacatgatgcgcgagcgccagcgccgcgagaagctcacca

SEQ ID NO: 2432 - DNA, 1138 bp, Triticum aestivum
  Clone ID: PAT_TA_2432
cggacgcgtgggttttttttttcaagaaaagtatccctgattccgagggacttaaaaaaatacacaatagcatctcctctgttttgttgaataacaaggtacatgtatcaagatatcccagcctaacgggttgagggaaaaatggtgatttcgagaccacctcaacttggggggaatatgtcagcggttcatatatatttacacagtagaaacacgagcgatggtacaactttccaaagaataatacacactacctacattctttctttcctttaagaaaaataagaacaatgcctatctactcacccctagaagaaatagctggccaacagcaaacgaagagggttttacacttcgctagaggactagttggatggctgtgacaatgcgagatcacaaatcacagtgattatgctaatggcttctcctcgcaatagtcttataaagtgttgggagccatcctgtagcttgaatatacatgatatgatatcagtaccaaaaagcctctccctcatcaacccattgcaggaaattgtgagataacccctgagcgtgtatctctgccaggtcaccttccgttatcccaggggttacaccacgtgcaccattatcattcacgttaggagtacttacggctcttgatctgctcaaacttccattgtctgaagctgaaagccagtcaagatcaaggaaatttgaatccccagaaaagttgccatagtcaagctcgcaactggtatacttagtatgaggcactgttggagtataccttaattttgacacagcatcatgcaccgaaccagaccggcagttaggaggttgtagctcattttcggacgcaccaaatcctggtgtcgaaattccatttgggccattgctggacagagaagtgttgcttttacgaagaatgctgccatctgatcttgccctttttatcagttgacttgttttgtcatcaaggacgttctccccagcaacagactctgactcccaaggtgcaaatttttcctgctcccgtcggtggtaacccaagaataaatttattgctgcctgtttgtaagcatccatataggcattactgtagtatcgctgtagtgtcctgaagaactcttgagactgaatagcaaacttaaggtgc

SEQ ID NO: 2433 - DNA, 350 bp, Triticum aestivum
  Clone ID: PAT_TA_2433
tacacttcaagctcccagctcccagctcagctagttgactacctgcaaatttggtgacaaggttgctaggtggatgaacagtcactcgaccatggtggtaccgtcggtgttcgccgccttcgacaaggacggcgaccgcaaggtgtccgtgtccgagctgcgctgctgcatggcggcgtccttgggcgaggacatatccgaggaggaggcggccgtggtcctcgcggcggcggatgccgacggtgacgggctgctaaaccaagaagagttctcgaggctagccgccggtgcccatgaagaggacgacgtgaggcgaagatgcctgagggaggcgttcgggatgtacgcgt

SEQ ID NO: 2434 - DNA, 377 bp, Triticum aestivum
  Clone ID: PAT_TA_2434
ggtcaccgcccctcccgccctcctccggctaccgcccatccaccccgggcggcaccaggaggggcacaaccgccgccggcggcaccggcgggggcacgccgtccacgccccggggctcgccccgccccggcggccccttcaggtccgagcccaactcgccgccggccgccgcggcggcccggccgcgcctctccttcgaccgctccccgagatccgccgacgccaagcccgtcgccgagcgccgggtgcccaagatcggcacgcctccccccgaccagaagcagctgcggagggagatcgagctgcagtcgcggctcgagtccgcgcacgaggacctcaagaaggccaaggaccagctctccttcgtcgtcggcgag

SEQ ID NO: 2435 - DNA, 456 bp, Triticum aestivum
  Clone ID: PAT_TA_2435
cgttataccacttctagggtttcccttccagctgcacgatgaagcttcttcctctgtttgtccttgccatggtaatggttaacgcttgcgccgtgtcttctcgcacggggccgcgtggccgggcgcgtgggggagtagtgaagatggcagcgacgggagaggggacggcgatcgacaatcaccatgcgataccgaggacggagtatagcagctggagcagccctggaaacatgcccggaagtggccatgacattgctagcgaagaagccaagccatgagcaagcctgagatatgcatgcctttgtacgtagcacactttgcatgctagggtacgtatacgtactcttttgagtatatatatatatatatatatatatatatatatatatatatatatatgtgtgtgtgtgtgtgtgtgtgtgtgtgtgtgtgtgtgtgtgtgtgtgtgtgtgtgtt

SEQ ID NO: 2436 - DNA, 469 bp, Triticum aestivum
  Clone ID: PAT_TA_2436
ggcgccagcggcggccagtgcgggtacgactccgacgccgaggcgttcgcgtgcgtttgcgccgacggatcatcgcgcccggccagatgcgatgggaagaaatccagcaacaaggtcatcctgatagcatcagtgtccgccacagcttgcttgatcctgctggtgtgcctcgtcatggccttgaaatttcatcgacaaatccgcagcatgagttttgtatccaacatcatggacaaaaacatcaaagctgacaatgcaaacgttgagaagctgctcaagttgtacggctccctggctccccggaggtacaggtactcggagcttaagaagatgaccagcgatttcaagcacaagctcggcgaaggcggctacggcgcagtgttcctgggcactctgggtgatcggcgggcggtcgctgtcaagttcctgcaccactccaggcccaacggcgaggatttcctcaacgagg

SEQ ID NO: 2437 - DNA, 446 bp, Triticum aestivum
  Clone ID: PAT_TA_2437
tatgttctctccacagcccccgttgagagtcgcctccagagttcggtcgccgcccctctccttccgtccccccgcgcgcgcggccggccggcgtggggatggatcaggtggttggcttctcctgtatatagtagtggtaggtttagtgtttggtttccccctgtgggtgtctggccatgtgccgtatcggagcgtgccgctgatgccggcgagaggcattggtcggccttcggtgctcttcttcttggccatggtggcgtggtgctactggtggcagggaagatcggcgtcggcgtcttcgttaataatctcgcagttatctggctgttggagctatgaagctttcggtgctgggcttatttctttgctgcgccatggcggcggtgcggaggagttggtcgcagtgctcggcggtcggcgttccggcggtcctggagatgtggtgc

SEQ ID NO: 2438 - DNA, 680 bp, Triticum aestivum
  Clone ID: PAT_TA_2438
cagctccgcccgaccggcgtgcgtccgccgcccgacggacgtaactgcgacggtggacgcgccggcccccgacaacatcgccgctgaggagggcgggcagcaacagatgcaccaggacgagaaggagcacaggccgatgttcatgagtgtcaaggtcaaggcgagggagatcgagaacaccgccgccggccacggccgccagcaccatcacgtgcaccagcacgacaccgggcgcgggccgagcttcagcaccggcgaggacggggtgggggcggcgacgagcgccgccgccggccacggccgcggtcaccagcaccatctcgtccaggacacccccggcttcgcggactccagtcccgagcacgacgacgctccgggggtgcgacttggtgaccttggcgccccggcagcggcgcaggaggtgaagcgcgacgacgctccgggggtgcggcttggtgaccttggcgccccggaagcggagcaggaggtgaagcgcgacgacgctccgggggtgcggcttggtgaccttggcgccccggcagcggcgccgcaggtgatgcgccgcgacgcccccgcggggcggcggcgcggcctccgcgccgcggcagcggcgcccgaggtgaagcgcgacgacgccgcccggaggcggccccgcggcgtcggcggcccggcgccggcgc

SEQ ID NO: 2439 - DNA, 1341 bp, Triticum aestivum
  Clone ID: PAT_TA_2439
cccccccttttttttttttgatcacaacacaaattttgggattgaaatggcgacggatcaccaggagcgctacaaaattttataaacccaatccaaaagcagacggacagatgggcacaaatctctattctgcagcacctacaaagcactggaagtctgaaacagcagcagcaacaacgacaagtcgaacgaattacaagactgactgaagaaaatgacggttttttgtactcgacgaagaaccctagaaaaggaacccagaggtagcagcatccgagaggccgacacgaagaggaagtcaatacccgaaccaaccgcccttgcatagtggtgaccgcatcttgttttcgcaaatgttttcttgcatgaaacgaagaaagtcgcggagtttccccggtcgaattcacgggcaacaatctgtggctatgagcaccacatggcaaggagagtctgaggtgcgttcttgacttcccactaatgaaggctccaaaattttgccgctcctctgatacagaacataggaagattgatgaattgagcgaagctactgcgggggtgaggcgccgccattggagatgacggcggtcttgatgcgctccacggtgcaggcgatgaggctgttgacggtggccaccgaccccagggagagcttgccggtggggacggagtcgaccaggatctggaacgccaccgtcaggagcgacccaccggtgccggttgcccctgccgcggcgtgcattgtccctgcaggaccgtcgggcaggatggcgaagcctgatggcaggagagcgacgtagtctgggtcgccgccgttgagcaccacattcatggccaccacatccaccggcgcgtagatgacgtaggagcccgacgcgtccgtgcagctctcttgcaggatcagcatgttgctttggttcgagttggtgctattgacacggaggagtgagacgcagttgccatggtcgcggccattggcgatgtgagccatttcttggacgatgccgccattggagaggatgtcccactcgctgcgagaggtctcgtcgcggaggaagtcgaagacgcgcttaggcgggacaggtagccagaaggaggtggcagcattgaggacgatgcccggcggcctcccggggtcgtcgacgctcttcctggtcatgaccctgacgtcctcggcgccgctgcccgacagcgtggtccactggtgcgccacagaggccgtcacgccgccgcagaagctcgccaccatcctctcagccagcttcagcatgctcttcctctcctccgagctagtggtcacttcgatgtcgcttgtggggatgttggtggccatggcccttgcta

SEQ ID NO: 2440 - DNA, 681 bp, Triticum aestivum
  Clone ID: PAT_TA_2440
tccaagaggcatgcagagaatgcgtcatcctctaatccaaggccgttcaagacggaaagccctaggaaacatggcattttctctcatcaaaactcgtgtaagaaatccaacaaaggaaatcttaagccacctaataatgctccagtgaagggtgttcaggcagtcaaaagttccatgaccttatcacggtcatattcattaggaagcctgcccacgcccccggcgccagttccttcaccacgaggtcctttatcgaaacaattgtctttcaacaattcgaagagcgaaccaaaggtcaagcagttagcagaaggtgtggcaagcaagctgaagcctgtaaaacattccccaatagatgttagagaaaaggggccaatgagaaagcttatgaagtcagagtcattcaagcgcgagggttcagttagtaaagactccagattcattaatacagaataaatcatctctcttgtctcgagatgaaaaaccaagaatgttgaagctgatgagtgataagagttttttagaaagaaggccttcttttattcttcagaaaccacctttatcaccaaggcctgatagttctgtcaagtcgggagatagaaaagtcgaccaagataatccaaggcctggaccaagcatactaaatactagcaaaaagccaggtaacatcgaaaagaagca

SEQ ID NO: 2441 - DNA, 2035 bp, Triticum aestivum
  Clone ID: PAT_TA_2441
gcttgctctccacgccccgttcccctccccaccacacccgctccccccattccgtcggcgcagcaggcaggcgaacggtgctcactccccctcaccctcctcgttgccatccacccaccccataccaccagtcctccgggcgttcgcagagcagttccaaggggagaggtcttcgatgtgagtgggtccgttgtgcacattgagtctcggattagctgagcgggaagacaatgcagctggacactggaataaccttttcttgattatgctgtagtaaatgacatggatgctgagtatccataactgccggctgagcatcggcgttggtaattttccccgacctgagcaaattatggacgattcccggacctgtggacacgataaatcgacggagaaagcacggggcctgggattcaatgtgttcaaatgcgaaggagcttgggcttaatagtggattgatctaagcaagccggtcctcgatgcatttcgacattgaagattttctgattgggctttgagggttcctgcgaacaagaagtggttcacgggtgccaccatatatcgatgaatcggtagtaattgacgtcagtcctgagaacaaggacttgtctcctgaatttctaatatggctaggagaaaggaatctcacaggtaatggtcggaacatgcgcctaaaagaaggatacatcaaagaaggcagcactgtgagcgtgatgggtgtcgttcaaaagaatgagagcgtgttgatgatagtacctccatcagagcccatctcatctggttgccagtgggggagttgtttctttccagcgaaccttgatggactggtcgtgagatgtgaagatacttcagacatggatgtgataccagtatagcaagctgatgattgctgtggtgtggaatagctgctgttgaagagggaacgttggcctgtcgaatcttttgacctcgggttgggtttgattggtagagtattagaactgagaaaaatgtacaaatgttaggtgtgattaaggctagtaaagatggagtatggctgctggttaatctgtgtttggctgtatagtcctttttccatgtgttttgtcctccttcgctcctgttttttcggttatgagctctcaatacttgtgtaatatgcttcctggctgtatgagtataggggttgggattcaaaaattgcaaaccccaagcatcgccggtttacctggggattacggacagcagagcgacatgcggtcgatttctacatttcagattttcagtctgggcttcgagcattggtgagaacaggaagcggtgcacgggtgacaccatatgtcgatgaatcggtagtaattgacgtcaatcctgagaacaaggacatgtctcctgaatttctaagatggctacgagaaaggaatctctcaagtgatggtcggaaaatgcgcctaaaagaaggatacatcaaggaaggcagcactgtgagcgtgatgggggtcgttcaaaagaatgagagcgtgttgatgatagtacctccatcagagcccatctcatctggttgccagtgggggagttgtttcttcccagcgaaccttgaaggactggtcgtgagatgcgaagatacttcagacatggatgtcataccagtatagcaagctgatgattgccgtggtgtggaatagctgctgttgaagagggaatgttggcctgtcgaatcttttgacctcgggttgggtttgattggtagagtattagaactgagaaaaaatgtacaaatgttaggtgtgattaaggctagtaaagatgggagtatggctgctggttaatctgtgtttggctgtatagtcctttttcaatgtgttttgtcctcctttgctcctgttttttcggttatgagctctcaatacttgtgtaatatgattgcttttgggctgtttgaagacatgttgaatcgggtttatgtgttatttaggataaaattcttgcactgctgttaaagcctaaatatattgttgctgttacattaaaaaaaaaaaaaaaaaactcagactag

SEQ ID NO: 2442 - DNA, 873 bp, Triticum aestivum
  Clone ID: PAT_TA_2442
gtcgacccacgcgtccgaataaaaattcctctgcagcagcagcccatctttaatgcaacactcgccatagttactcccgggcatccacttcaacccaaccactgcgctcttcttgcttccaactcgtcttctcctctgctcggcgccgcttccttccttcctcccctgtttgtttcttgaacccaaacccagcttgtgccccggtcaaaatcggactttgggatcgccatgggcggggattcgaggttctcccactgacgcggctggtccggtcggtcagcgacagcgcacgccatggccgaggaccatggatcgtcgcggcacatgtcgtccatgtccatgtcgcacaaggagctgggcgacgacgacgcgcgggtggtgcatgtgggcgacgcggagcgcaccaacgagcgcctccagttcgccgggaacgccgtgcgcaccgccaagtactcgccgctcaccttcctgccgcggaacctgttcgagcagttccaccgcctcgcctacgtctatttcctcgtcatcgccgtgctcaaccagctcccccagctcgcggtcttcggccgcggcgcctccgtcatgccgctcgccttcgtcctcgccgtcaccgccgtcaaggacgcgtacgaggactggcgtcgccaccgctccgaccgcgccgagaataaccgcatcgccgctgtcctgtctcccggcgtaggcgcccaattcgtccccatcgagtggaagcacgtccgcgtcggcgacgtcgtgcgggtcggtgccaacgagtcgcccccggcggacatggtcctcctcgccaccagcgacaccaccggcgtcgcctacgtgcagacgctcaaccttgacggcgagtccaacctaaagact

SEQ ID NO: 2443 - DNA, 842 bp, Triticum aestivum
  Clone ID: PAT_TA_2443
gcacgagaacaacatcacctggcagaattaagtgagcagccagctagccagcccattggaaggagctagctagcaggagcaatggaggcgaccacggcgacgaaacgcctcatggggctctgctgctgcctctctggtgttcttctgctctccttcctgctccccggcgcactggcggaggagcgattctacgagttcgttgtccaggagacggtggtgaagcggctgtgccggaccaaccggatcatcacggtgaacgggcagttcccggggccgaccatcgaggtgcacaacggcgacacgctggcgatcagggcggtgaacttggcgcagtacaacgtgaccctccactggcacggcctccggcagctgcggaacgggtgggcggacgggccggagttcgtgacgcagtgccccatccgcccggggtccagctacacgtaccgctacaccatccaggagcaggagggcaccctgtggtggcacgcgcacagctcctggctccgcgccaccgtgcacggcgcgctcatcatccttcccaagcgcggcatgccctaccccttccccaagcccgacaaggagttccccgtcgtcctggcggagtggtggaggagggacccgatcgcggtgctcaggcagtccatggtcaccggtgcgccgcccaacgtctctgacaccatcctcatcaacggccagcccggggatttcctcccgtgctccagccaagagacgagcatcattccggtggtcgctggcgagacgaacctgccgcgcatcatcaacgcggccatgaactccgagctcttcgtctccctcgccggccacaagatgacgggtggtcg

SEQ ID NO: 2444 - DNA, 598 bp, Triticum aestivum
  Clone ID: PAT_TA_2444
cggacgcgtgggcgagatacagagatggggcgtcgggtcgccggcggcggacctcaccgtgtgctgccttatgacctcgtcgtgttccgaaatccagcagatagcacgccccatccccgggccgccgttctccacctcggctccaacaccttaccacacccgccgcctacctccgccatccatcgacggctagatccgccatccgtggatgcctagctccgctattcaccgagaccggagaagggaactccagccttcagactccagcagtgatggttcggatgaagatttcaggaacttccttggcgacggtgacaatgcctactcaagaggacgaagcgacacccaggcaccatattttggttcccaataacgaatgtttatagcagcaatgatatgtatgaagattatctccatacatattttcaggccgcacaagtcttaggctctagttatttcaggccgcacttgccaaaaaataaaatagtatgcagcatttttggtagttcagatgggtggttgttgtacagttcatgtgcatacttgcgatgctccaatgtaaaatagtatgcatgttcttgcatggaaaaaaaaaaaa

SEQ ID NO: 2445 - DNA, 1174 bp, Triticum aestivum
  Clone ID: PAT_TA_2445
gcgtacatggcaaaatagcacaaggttcctacagtaaagctgtagttgaccgtgtcctgaaccatctatagctgtcgaaaatgcatcatttcatggacatacatgaaaaatagcacaaggttcctacagaaagctgtagatgagcattttctaaactaactatagcatggtagataacactatcacacaaaatatttacagggaactacattttctcatactgccccccaggaattacaatctactgcagaggtagccaaacccggagatgacacagaatgcagcactgaatgcatccaatcttctcatcacatcaaaaagtgacatgtatatatataccacctaactggaccatacatgcaccagcccctgactgttgccagtgtagatctcgttccttgtcctcctctcgctacaagtgtctgtgtacatcctccaggagcttcgtgggtattctacaccgatccagttggggtagctgtcccgcgagcggccacaccatcggctggaccgttcgctgcaatctgggcctggcccgtgccggtcttaatgtcgctcgtgctgctggctccatgccatggcgctgggtcctcaaatgatgtaacaagctctcctcggaaattccatacagcaactgttctgtttcggaatgtcatatagagagtgctacaatcctgaagacagagcgatggcgcctcaaacgatgtaacaagctctcctcggaagagccagacagcaactgttctatgtctgaatgtcaagaagagattgttctcatacagaaaaatgaatgctgacggggtcataaaacttctcaatactgatctcaattagctcagaacttcgtacatcaagtatctgaaggttctcgtcttcttgcttcacaaggagcttctcattgaattgctcgataaaatcaattttcttgccgcggtgcaacaagtgcttgaataatttgagtggctttccatcttcaatagataatatcctcaaaggaacataacttggcgttcgatcatatattaagagcataattcctggactaatctttatctcctgcacattggtatcaggtattgaatatagaaaggaatagttcttcagatcaaaaaccttgtagataccatccccgtcgacttctgtcgtcttctcgtagccgtacccgtcggcccgg

SEQ ID NO: 2446 - DNA, 885 bp, Triticum aestivum
  Clone ID: PAT_TA_2446
cggcgcgctcagcgactggctccacggcggcggcgccaccctcgtgtggaagcagcgcgtccaggcggccttcgacgttgccgacggcctcaactacctccatcactcctccaacccgccgtgcgtgcacaagaacctcaagagcagcaacgtcctcctcgacgccgacctccgcgccaaggtgtcaagcttcgcgctggcgcggtcggtccccacgggcgtcgatggcggcgacgcgcagctcacccgccacgtcgtgggcacccaggggtacctggccccggagtacctggagcacggcctcatcacccccaagctcgacgtttctgccgcctgcggcacccccctcgagctgctgtccgggaaggaggcaacgttcgacggcggcgccaaaagaggggagacgctgctgtgggagtctgcggaggggctggttgtcgacggcgaggacgcgcgcggcaaggtgcgggccttcatggacccgcggctgagtggcgactgccccctccaccgggccgtcgcggtggcgtcgctggcggggccgtgcccggcgagggagcccggggggcggccgtccatggacgaggtgttcgtcacgctgtcggcggtgtacaactccacgctggattgggatccctcggattacagcaactcccgctcttcgatcgtcgggagatagtaggagtactcggcattttattttggctgcaaagattgtcttctctgttatggagcaaaaactcctttttttttgagttggagagagcaaattcacttgatgtgtaatctgctggcgtagcgactgtaaatgtgctccagtcatgtttaatataccccatttcaaattaggtgccgtgactgagtagtcctggtgcttcaccagtg

SEQ ID NO: 2447 - DNA, 563 bp, Triticum aestivum
  Clone ID: PAT_TA_2447
caagcgccccgtcccctgccacagccacgacatcacggtcgtgcgccacccaccttcggatccctccacccgctcgcgcccttgctccctctccgcctgcggggccgcacccctcgcgctgctcctcgacgacgcggggctcgtccaagtggcgagcgaccggtggcggcggcaccagcgttgtcgtgaaggggccgcgagtggcgggcgacccgcacctcttccatctttccaccaaacgccgccgacctcctctcctctcccaccatcgacctcctctccccagccaaccccaccgacgaattacgcggtcttcccatccccgggggcctcctccctcgaccccgtcgccgggcggcccctaacctctcctcctctccctggcgactggcgagggaggatccagatccactcgatagtggagccccgcctcttctcctctccggtcaacatggaggtccgccgcgtgcaacctcctcgacggcgcccagaacactaggtggcccatctcttactcccatggccatggccaaggcgagcctgcaagatgtgctgcagcagat

SEQ ID NO: 2448 - DNA, 741 bp, Triticum aestivum
  Clone ID: PAT_TA_2448
tggcgcccgcgggaggacggagcaaacgacgccgagccggagcacgcgttctacgcccctctccctctccctctcccgcgcgggcgacgccgggccggagcacgcgttctacgcccctctccctctccctctctctcacgggaggcgagtgcgagggcggaggcgaggcgaggcgcggggggtcggatttggggaggcggatcgagcagcggtgatccgccgccccctccatcccctccaggtttcgtgtcaggcgcgggggctccgggccgattggtctttgatcccgcgcccccgaatcagcgcggatcgcgcgcggatcctaggccggcctcggtcgccgctctcgccccggagttctccctgatccgttggatagatcactatataatcctcgtcctacatccacacgcttgaaaggcttcatatatattcattttagcatccgccacagtcgcctatgtcccgccatcttgggccgtgctgggggacacatctcccaggatcctccgggggttccttgctccctcgctcgggggccgggtttgctggcactgcgcgggctctggaagcattcatctgcctcaggaagtttgccagagctttcttcttctggttttctagagcgtatgaccccaagagtccccacgggttttcacatataaagcgagtgacttctggtgtgcaaattttggtgggatcgcagtttgcttctctaaaagaagggcatgctgtacagct

SEQ ID NO: 2449 - DNA, 415 bp, Triticum aestivum
  Clone ID: PAT_TA_2449
cttttccgtcttcccggtgttccgctcccgcagcaacaccaacaccaacacggttgcttctcccccagcggcggaaggaatcttgagccccctcctcccccggcgccgggcggggcctcgacgggtaaatcgcgacggcgccctagaacccccgagcagccgggcgatggaggaccgcggcggcagctgcgggggcgggggcgcgcggcgggtgggggactacgtgctgctgcgcccgatcgggtcgggggcctactcgcaggtctggctggggaagcacgtcgcgcggtgcaccgaggtggccgtcaaggagatcgccatggaccgcctcagcgcgaagctccgcgacagcctcctctccgaggtcgacatcctccgccggattacgcattccaacattatcgcgcttcacgac

SEQ ID NO: 2450 - DNA, 588 bp, Triticum aestivum
  Clone ID: PAT_TA_2450
ggctcgccttccctgcaacacaagccaccacttgaatctgaaagcacggagaggaggaggaagacgagcaagcaagcaaagggaggtgcaatggagtacgggtacccctgcaacagctgcagcagcaacaaggagaagaggcctccgctcaagagaggccagctcaagctgcagatcgccaggactctcggcagcctcgtggtgccgggcgccaagagcggtttcagcttcagaagatgatggcttgaccggcaaggacaagcaagcatcttcttcggccagtctaggagcatggtgtggttctggtgcttggtgcgtacagggattgcgtagatttagtccctgcttgatttgcggtttgctcattagatctcgcttcctcgatcgacaatttttacgttgtccacgagtgaagaagaaatgtacggagattggagcttcatgttctgattctgagactcgacagtcccgcccttgcccctgtgggttggtctgtcccggaagtctctgaactgaatgaatagactggcctgatgggtgtactgcggacggtacatgccacagtgtcagtttgcctgaaaaaaaaaa

SEQ ID NO: 2451 - DNA, 440 bp, Triticum aestivum
  unsure (1)..(440): unsure at all n locations
  Clone ID: PAT_TA_2451
ttcactcttccgcgctcgcgccggctccgcctcgcgccgttctttagtggcgtcagccatcgccgccgggaaacggggatcactttgttggtgggacttgagacgggcagaatgtcttcatcgcctccggcttcgacggtggcggacgcggcggcggtgggtcatccgtcgcagctggccatcagcaacggggtgctgctggcggcggtgatcttcctcttcatggtcgtcgtcttcgtcttcctcctctacctctacgccaagcgcttcttgggggccaaccccatgctcaacggcgccggcgccacctcctcgcgcttcatcttcgtcggcgactccccgttcccgcgccgcggcctgccggcctccgtgctccggaccctccccgtcgccgtctacggcggcggcgcctcgcccaagacgcccggcggccangggag

SEQ ID NO: 2452 - DNA, 624 bp, Triticum aestivum
  unsure (1)..(624): unsure at all n locations
  Clone ID: PAT_TA_2452
catgcatgaaaagggaatagatatgttgcataaaatttttattaacagttttcatctatgccagatattgctgaaatacttccgatatgattaacttatatttgccaagataaaacttgaaaagttactgctaaatgtcataggtaaggaaaattttgtggcatttaccacctttctaggtcgataaatatttccggtgcctgcttggtgttcccctttccctggttttgcttcttcgtgctgtcgctctgtccatcatggctggcgggcttctgccagatgtccctccttggcagcgccacatcctgtgcgtggcctggtccaccttgtgggttccgtgccttcctngttttggcggctccccctgcatctcctgcttgcgtgtctgcttttcgtcccccgcccttggctcatacctccgctcttgtctctgcttccgaggactggacatggtctgtgggctgtaatcccttatctattagttctaaaggttggcgactttcagaatttcagcaaagatgtgatcgctcggaactatatttattactggagtgggaggaatccataccaagtagtcaattcagcaattcaacgatttggtaacangagaggacatcccganca

SEQ ID NO: 2453 - DNA, 947 bp, Triticum aestivum
  unsure (1)..(947): unsure at all n locations
  Clone ID: PAT_TA_2453
ccacgcggccggcgcagaggagacgccgttgcgatgttggctgtccggtgcgccggcggcggcggcggcgccgccggcgccggcgcctacctgacggctcagaggacaacggctgctcggagcggagccttcaacggccgcagcgcccttcttgctgcgggaactggggccagggagctgagccttagggtttccctctcgcccaactcccacccccaccgcgtcggcgcttcatgcccgtggccagtgcgttgctccccctgtccttctcctgatatggaggtgccgcgcgtcagtaagaagaagaccaggaacgaggaatgggaggcgttgaagacggagttcggacgcatgttccgcccgcagcttcgcaatctaggggaactcttttcgctccgccgtgtctacgacattgaggattatcagctgggcatcctatttggtgcatttcttggatgtgttggctgttaccaactttggaagacggcaccttccatatttgttgatgcagtgctcgcattcgtcttctacaagctcagtgttgtatcttcagagctacatagaagccacaagtccaacagcctgattacgcggctgaaatttggtaccatacttatcatggtttggaaggacatcaagaaaaactatgtcctcctggatgttattaggatgccggttctcctcctctacatctgtgcattcctgttcgatgttgctggcgtgaagaagtatggaaggcaaggcttggtctattttgttaatctgttgaaaaccagaggtgggattcaaagagatatacaggattatgtggttgcctggctatgtctctccctatgacgattctgcaaactagttatgaggctcaagttcctgatgctcaatgcatgagaatgagactgcatcccccntggggtantttctgggatggggcaatgtgtcgggttaaa

SEQ ID NO: 2454 - DNA, 1056 bp, Triticum aestivum
  Clone ID: PAT_TA_2454
acgtcgtcctcgacatgggtgctgttggtagcattgacaccagcgggacgagcctccttggacgagctcacgacggcgctggtcaggagggggattctgatcgtcctcgcggacccaaagagcgagattcagattatggttaagttgacgaaggtgccggaacccattctccgcgagaaacctctacttcacgccgccgtgcatgtggcgcagtgtgaagtcctgctgcatcaccggcgtcagcgcactggctgaccggacggcggctggccggagcttcggcatgttcaagaactaccacatcgacggcaacaaggagatgatcgccatcgggacgatgaacatcctggggtccttcacctcctgctacctcaccacggggcccttctcccggtccgccgtcaactacaacgccgggtgcaagacggccatgtccaacgtgatcatgtcgctggcggtgatggtgacgctcctcttcctgacgccgctcttccactacacgccgctggtggtgctgtcggcgatcatcatgtcggcgatgctggggctcatcgacttccccgccgccgtgcacctctggcacgtcgacaaggtggacttctgcgtctgcgcgggggcctacctcggcgtcgtcttcggcagcgtcgggagcggcctcgccggcgggacgagcatgctggacgagctcaagaagaccctggacaggagggggattcagatcgtgctggcgaacccggggagcgagatcatgaagaagctggacagctccaaggtgctggagctcatcggccacgagtggatcttcccgacggtgggcgaggccgtggcggagtgcgacttcgtgctgcactcccacaagccgggcatggtggtggacggtgcctcgcatgagaacatggtctgattgggcctgacctgacctgagttgagttgttaacaggcaatgcgagccgagatcggtataagcatctccatgctattgtactcctacgttttggaatgaaatccgcattgatctggggggccccgcctttcgccgtgttgagtcttttcaca

SEQ ID NO: 2455 - DNA, 639 bp, Triticum aestivum
  Clone ID: PAT_TA_2455
ttcggcacgaggccagttgcgcggcggctccaacccgactcgatcctctgcagggaggccaagaaaatcaaggtcgagccgagcgagcgatctcgagccctccctcgaccgatgcatccgctcgtgggggcgctgctggtgggggccggggagcggtggtggtggccgtgctggggcccggcggcgcgccacgccgcggcgtgggccggcgcgctggcgctggccgtgtcggtggcgtcgttcgcgccggaggccgcgttcgtgtgggcgctggccggcggcgggtgcgcggccgggtcggtgcgcgtgccgctcgacggcggcggcgaccacgtctgcgtgccggcgaggatggccggccggacctgcgccgacatcatcgtgccgccggcgttcgcggcgctctccgtcggcgcctccgcgtgcttcgtccgggcgatcgccgtcggccgccgccacggctactagtcgtcattggagcaagcccgtgtggccgtgtccttcccctctgctgtgcgacgcacgcctcccgcttctgaacacgtattatgccccggcttcgttttctctcggtcatagatgatgttcatttttttggacacattgatgatactcggtggttaatctgaaatattctca

SEQ ID NO: 2456 - DNA, 1775 bp, Triticum aestivum
  Clone ID: PAT_TA_2456
ccgtccgcagccacccacctgccggagcccggcagccacccgcccaccagccgagcgccgagccgcagcctcacacgcacggtgcgagtacgtggtgagagctccgccctcgtgcctccgtccacccgccctccgctcgtgctgcggggggagggggagagcgacagccatggagccgggcaagatgatgatcaacgacgtgatcgggtacgtcatgctcatccagctgcccactcgcgacgctgggatgtgcatcgtctccctccgttctcgccagctacgcccgcatctggggcaagagcaacgacatcatcgacaagcccgtccactccgtcgccgagaagctggccctgccgctcacctccgtcaacggcaacggcactaacggcaccaacggcgccaatggcggcaggcacgtcaacggcggccaggtcgcgcacgacgtcgagacgccggcggtgaagggtgcgacctgccactagcgagctccaggcgcgcggcacccgtggtgccgtggcgtcatgcgcgcgcgcgcgttacgcacgtgcgtttcattcgatctcggtgtatggtcaactcaactctgctctacgtgtgatgcatgaaaggaagttgcatgtgtcgatcgacggtctagtttctttattttgatttcgcattttgactttgagcgaccacataaatttatgagctccttatgatttagctactaccatatgtaactttgatcattggacctgcttatgacgcgcatgcatgtgtagtcctgcctccctctgctatcctagagatggaaaatcaatcaatattaaccaaccaggcggcgctgacgctgacgaccctgatctgcgcgatgggcaccgggatcaacggctcgatggcgctggtggcggagcgccacgacatgagcgcgtgggtcatcggcctcgacacccgcctcttcaccgtcgtctactcgggcgtggtgtgctccggcgtggccttcttcgtgcagggcatcgtgacggagacgcgcgggccggtgttcgtcacggccttccagcccctctgcatgatcatcaccgccgtcctcggctccgtcatcctcaaggaagagaccactctcggaagtgtgattggcgcggcgatcatcgtgctgggcctctactccctcatctggggcaagagcaacgacatcatcgacaagcccgtccactccgtggccgagaagctggccctgccgctcacctccgtcaacggcaacggcaccaacgggaccaacggcggcaggcacgtcaacggcggccaggtcgcccacgacgtcgagacgccggcggtgaagggcgcgatctgccactagcgacctccaggcggcatctcgcgcatgcgcctacgtacgtactacgtgcgtttcttcggtctcgtgtatggtcaagaaatctgctctacgtgtgatgcagaaaggaagttgcatctgtcgacgatcgccggtctagtttttttatttggtttcacctttgtactacgtggcttccttaaatcttttgtatcttctagatatttgctcgccaattgatgcagaaaggaatttgcatgtgtcaccccacggtctaatttctttatcttgcttcctcattttgactttgagcgaccacataaatttacgagctccttattccgctttagtaacaatctaatgtaactctagtccctgcacccctctcttatcctcgtgcgggtgtcctccggcttcgctctgctatcgaagagatgtggaatcaatcaaaaaaaaaaaa

SEQ ID NO: 2457 - DNA, 414 bp, Triticum aestivum
  Clone ID: PAT_TA_2457
tttttaagcgtccttccttcaacaatggctctcctcaagaacttcgccgctttcctgtgcgtgatcctggcctcgctcgccttcgtcgcgcaggatgcgctcgccgccagaggtgctttgaacaacgtgaagggatacacgggtacctacacaggcaacccaggcggtggttacggcggtggttatgggaacgggaagtatccatgataggccgcatatgatgatacttggagcacggaaatacaaaatacgtacggcagaccatgaataaattatcacccgttactggtatatcgtactctctctgatccataataagtctcgcagttttgtaccaaggtcagttcaaaccttaatacaaaactgcaacacttatcttagattggagggagtaccaaaaacatagtgaatgtt

SEQ ID NO: 2458 - DNA, 1931 bp, Triticum aestivum
  Clone ID: PAT_TA_2458
cgtcggctccaagaactcccccatcacgccaccgattgatccgcccacggcacgaaagcgcgaggcaaaggtcgattcataactaggcgaggcgagaagagtcggagggtgaagagctgccgagaagggtcgccgtagagctcgccggaacccaccgtggctgcgctcgccggcggggaagagggctcgcgggttggccgcttcttctcctcggtgctctcggggatctttgggcaaggcgaggagggggacgcgatggccgcacgcgcgcacaacaacgtcgctgccgctcagcaggcagaacagagctttaggtggtggtggtggtgggagccgcacccaccatgggcaagcagccgacggcggcgcggaccggcaggcccggccgcaagatcacccgccgtcgcccttcgccacgtccgccgccgctgcggcctaccccgcgaggctcaccctgaagaagacccctctgtggaccgtcactctgaagcaccacactggcttcagtgaagcacagctgatggacgccgccaagatcctggtggcctcgcactccaccgcgcctgacagcaagctgaaggtcgtctacaagaagtactcgagcgagaagctcgcaggggtcacgctgcgccctcctgtgacgcacttctccaaatcagcggaccgcgtgattgatatcagcgccgacgctgtcgtgaccaaattggaggccttgtctgacatctccgtcctgtagtacgggaaggagaaggtggtcacctccctcagccacgtgccctcggtgtgctccaagttggtaaccggaatcaccgaagatccagcgatccagaatatcgaccagcttaatggcgtcaaccagctcgacgtcgttgattacatcgaaggatatctacaaattctacaaagtcgccgagaacgagtgccgggccaaggactacatggactcccaggtggagatcaacgccaagatgaggggcatcctcatcgactggatcctggaagtgcaccagaagttcgacctgatgccagagtcgctgtatctcacggtgtatatcatcgacatgtacctctcgctgcagaccgtgctccggcgggagctgcagctggtgggcgtctccgccctgctcatcgcctgcaagtgttaggtggcaagtcccgcagaggtgctggctgtcgtcttgctctccgacagcgctgtctcccgggagcagattctgaagatggagaaggccatcctgaacatgctggagtggaaacctgacggtgcccacgccctacgtgttcctcgtccgtttcgccaaggccgcctcctcctccgatcagaagaacgacaaggagatggagaacaccgtcttcttcttcgcggagctggcgctgctgcagtacggtctggtccagtccaagccctccatggtcgccgccgctgctgtctacgccgccaggctcaccctgaagaaaacccctctgtggaccgacactctgaagcaccacactggcttcactgaagcgcagctgatggaggcggccaagatcctggtggcctcgcactccacggcgcctgacagcaagctgaaggtcgtctacaagaagtactcgagcgagaagctcggaggagtcgccctgcgcccgcctgcgaccgacttctgcaaatgagctgcccgcctgtttgttgctttggatctggacttgggagtgcgatggaaggattgtctgacatttcgccgtgttgattgctattcgtttcttgcttttagaagagtgcaaggagggtttgctaagagtttgttgtttggtcgcaagtcaggcatattatctgacttgttgacaaggatttgtgtgataaaaatacaccttggtcttggtgtatatatatgtcttctgaatgctatctacgacagttattcaattatttgaataatctttggtgtctc

SEQ ID NO: 2459 - DNA, 689 bp, Triticum aestivum
  unsure (1)..(689): unsure at all n locations
  Clone ID: PAT_TA_2459
ctcgtgccgaattcggcacgagccgtcgtcttcgccgacaaagggggtgatcacagagcggcctcgggcgtctacttcatcccggcgctcacgagcagcgtcgtgagtgtcggacaactcgacgagggctggttcgacatcggcatccggcgcggtgttctcaccgtgcacgaccagcagaagaggctgctcatcgaggttacccgctcgccgaaccgcctctacaaattcttctttcaacccgtgcatcctgtgtgccttgccgtgggccatgtttccgacgcgtggcgttggcatgcccggctaggacaccagcacttcgacgggctgcggaagatggcgcgaggcaacctccgttcgtgggctacctcactcgagccccccgacgactgtgtgatgcattcntgccggggaacacggctttgccgtttcccganaagnacctaccggcgcagaaaccctggactggtnaacgggactctgcggccaatcacccggcaacgcaaganggntcctacacctgctccgtccacnctatagaagtnangtggtgctntctcgctcaaggacagcnnanagcatgngaggngaggggaaganngcatcgcaaacnnctgtgnacgnctgnggattanngcagtcaaccnnacagangggaagtnctaagcctannctaaaggttcangggn

SEQ ID NO: 2460 - DNA, 1343 bp, Triticum aestivum
  Clone ID: PAT_TA_2460
ggtctcaaaaaaaaaaaaagcgaaagaggtctactaccatcccagacgaggaggagcagagccaccgcaatcgaatccccttccttccttccgtccccgacgacgatggagcgcgtgagaagggcgtcgcatgccggctcctggtacaccaacaacgccagggaagctggaagaggaacttgatggttggctttcggctgctgctctcaccaagtcacctgatgttagggccgtaattgcaccccatgctggctattcgtactcagggcgctgtgcagcttatgcttttggcaacattgatccaactaacatttctcgggtgtttctgctcggcccatctcatcactactatactccaaaatgtgctctgtcaagagctactgtttatagcaccccgattggggatttaccagtagacctggaagttatcgaggaactcaaagctaccggaaaatttgaatttatggaccttaatgtggatgaggctgaacatagcatggaaatgcatttggccttacctttctaaagtatttcagggacataatgtaaaagttgtacctatccttgttggtgcagtcaactcccaaaatgaagccatgtatgggcagttgctcgctaaatatgtggatgatctaacgaactttatttctgtctcctcagacttttgcctactggggatctctgtgaagttatacatactatgactataagcttggttccatacactattccaacaaggagtttgcccgtttcagcttgaagaacatagagaatggtgaccgcgatgagttcaaacagtatctcgagcagtacgcggtccaccatatgtggacgccataccatcagcgcccttctgcatacgatcaaacactggtcgaccaagataagttgagactttgctcgctacaaacaatcgtcccaattcatgactacgagcaatagcagcggcagataagcatccggtgtggccgaggtggacactcctggacaagtgcgaaaatggtgagcactaggggggatgctggataccctgcagtaactggcttgagcgttgctccctggtggaaagtactgtagcatgcctgttggcttggaaacaccggagcgttctgtcgaacttcgtaataatagcagtctctggtcgaaagccttctgtagcacctcggacggaatcaggattctgggtaacaagagaacaatagatgctctggaggctcctggtgtctgtcttacctgggaacaatatgcttcaggatgtccttgtgtgtatcttcctagtaagctccagcaaaaggaaaatgttcaaaaccatgataaaggttctgcaaatttctgaaaaaaaa

SEQ ID NO: 2461 - DNA, 1200 bp, Triticum aestivum
  Clone ID: PAT_TA_2461
gcacgcaccacctggacgcgtctggaggcgtggcacagcagccgcagagcagccgtcgcccgcagttaccagccatcaccccgcggcgccgtgcacctcgcggcggcggagcacatacgagagcgcgcagtcgatcgggaggcgccgccgatggacccgtccgacgtcgagatggagcccgcggagcatccgtcccagccccagccccagcagcctccgccgccgccgcagcccgcggcggccggagatgggtggagcatgctgtcccgcgcccgcggcctgctccaggagggccagccgtccctcgcgctgcaggcggtactcttggccataagatctcaaggtggtgaacaggctctcatccagactctgaaccgtgcacgtgacctctacaggcagagatcgcagcctgctcccaacattgatgagctcgcttctttgctcgcacagtgtgctatagcaagaggattcaatgacatcaaatccctaattccactagcacctggttctgaccctgtcacgacgttgaagtcggatgaggcatgcatacttgctgagtgtggaaggaagcagctgcttcattttcttgacatggatggcagcagcttcatttgcttgaaatgtggcgggctcttcagcacgtcacgcaaagatgagcacctggcctactggtgcggtgccgcatgatcctggtgataaatccttgctactgtatatgggtgctcaccccagacggtgatcatgatgcgcatgatattttgtagaacctgctctcttttccggttaccgcttctctactgcagggatgccagagatacatctcctgttcacagaagcaaatacatagccaacctagagcattatgaactggaatcgacgcttcattgtgccttgctgtgttcttatggcactttttttgctggtggtttggtaaatcctgatatgatcctctgttatttgctcgaggttgtcaaaatcctcatagtctggtgaggaaaatcttctgtctgtcattagacggcgtatactctatggaaagttagttaactgatgttctgtcccttttaattatgatctgctgattcggacaaccgggagttggtatccatgggcagatctataagaagatggaactctgttgtcactacctgctaccgtgcttttcagtattgtttcagtttcaaaaaaaaaaaaaaaaaa

SEQ ID NO: 2462 - DNA, 577 bp, Triticum aestivum
  Clone ID: PAT_TA_2462
ccacgcgtccgcccacgcgtccgaatgggtgccagcatatgtgaaagatgctttctgggctggtatctctactgttcgccgcagtgaacggctggaggccttttttgatggatatattacaccagagaccacaataaagatattcattgaacaatttgatactgctatgaagcttaggtccgatcgagaagcctatgatgatttccgttcttttcagcaaaggccacaagccctctctggtctgttgtttgaggagcaatttgcaaatgcttatacgataaatattttccagaagttccaggatcagttaaagcagctgatgaatgtgacttgcactgaagtcagtaggaatggatcgatagtgacctacactgtgaccgtcattgggaaggagaggaagtttgactatagagtgatgtataatagtgccgagaaagaagtgtggtgtatctgcagatccttccagtttaaaggtattttgtgtagccatgctcttgcagtcttgaagcaagagcttgtgatgctaattccttccaaatatattcttgatcgatggaggaaggactataaatgccct

SEQ ID NO: 2463 - DNA, 868 bp, Triticum aestivum
  unsure (1)..(868): unsure at all n locations
  Clone ID: PAT_TA_2463
ctgcagattcggcacgaggcaataatcgagcggcggcaacaaatacactatagtaactagctctgacagcgttagggcgctcgcaatggcgagccgtttgggagtcgtgctggctttagcggctgtcgtccttcttgccgcagcgggggccgccgccgggcaatccacgccacggccacccaacgcccagggcccgaagccgaagccgaagccgatgaaggtcaagtgcactgagaaccgcaaggagaacccctactgtttcaaccggaacatggactgccccgccaactgcccccagtcctgctaccccgactgcaactcatgcaaacccgtctgcgtctgcaacaccccgggggcgtgcggcgacccgcggttcataggcggtgacggcaacgccttctacttccacggacgcagggacgccgacttctgcgtcgtctccgaccgtgaccttcacatcaacgcacacttcatcggcaagagcggccacagcggcatgtcccgggacttcacctggatccaggccatcgccgtgctcttcgacggccaccgcctctacctcggcgccaggaagaccggcacctgggacgacgctgtcgagcatctagagatcatcctggacggcgagcccgtgtacctccccgccgacctgggtcgaaggcgccaagtggacctccagccgcgtccccgagctgtctgtgacccgcaccaagggggccaatggcgtgctcgtcgccctccacggaaantcagcgtcagggccaacgccgtgcccatcaacgaagangattccagggtgcaccgttacggngtcaccgccgacgatgctcgcgcactccaactggggttaaantcgaccctcaacgac

SEQ ID NO: 2464 - DNA, 1678 bp, Triticum aestivum
  Clone ID: PAT_TA_2464
actagtggatccccgggctgctcggctccccccgcccctcgaattctccttcacagtccccacttcgccccgcactgatccgacgggggccgtcacggccggcgaccgccgcgtacgtgctttcccccaccttatcctcgggccccgcaccgagtcgcgccgccacagcttgaatcgaggccgccatcgaaccctagccgccgcccctcgattcctctccgacatcgacatcgacatcggcggcggcacggaggcgggatccaggcgacgtcgcgtcgaccggtacccgcgcgtatcacggtgttgagtttggatctctacatcagctgaagttattgtagtagcatgtccacgaaggaaacaaggcttaaggaagttaattctgttgggatgaaagattgggctaatattcagactgatattgttggtctaattataaagaagcttggcattcctgactacatcagattccgtgctgtatgcacgtcatggaaccatatctgcaaggaagtatccaaccatccaagggtggacccatggctgatgctccccacaaagccgcttgatggtgctaagttttttagcttacctgaaaaaaagactcaaaccatccatatcccgagcgttgccacgatctttggatccatgtggactccggttggttcatcccatggttggcttatcttctttagcccgccgcagggaaccatccagctggttaatcccatcagcagcacatcgttccaactcccctcaatcggaaggaggcacatgtccaaggccatgttgcttgacatgagtgagagcaacttcactgttgctgtcatccatcgcgaccaaaaaggataccaagtgacacgcaaaggaagcaaaagctggtcgtttgtcgattcgaaacacattttggtggatgtcttcaagcacagaaggcaactttacaccattgatgtatatggtaccggcccgggcggccccgcgcctccccgttcatggccagatgatgacttcccccaggtggaaccgcatatgcacaacctcgtccactaccagcaccagaagttcaattgtctggtggagaccccgtctggcgatctcataagggtcaagcgccagtcgcagaacaagtttgcgctgtgggtcctcgacagggagacctcttccttcgagcggaccagcgacatcggggaattcgggctgttcgtcagccactacagctcgttctgtttcccggccaaggaccatccgtacctgaaggcgaactgcgtctacttcatcgacggctacaacaacatgtgcgcgttcaacctcgagcacgggaccaaggagctcgtagaagccctcgaagccgctgcccctgcccagagtcagcaagacttttacgggcgccagcctcgagcagagccgttcctatggttaatcccttctcttaagtgattcaacgtgtgcgaagctgaaactggcgtgtacctatatcctagaaaccggtactctgaaccacttacgtataactagtataagtattggacgtattcctggtacttttgtggcaaaaaccatatggctgaagtttgaattgagcagccggtcgttgcgtgtgtttgttttgtatatataatatatgcaacggcttgtgttttggacaaagttgtattactggtcctgggttttgcattcaaaa

SEQ ID NO: 2465 - DNA, 1114 bp, Triticum aestivum
  unsure (1)..(1114): unsure at all n locations
  Clone ID: PAT_TA_2465
gattttattnagcatgtttggccggaaaacaaagtttttctttctatgggaggatattgaagacatacaggcaattcccccatcactatcgacatggagtccatcccttgcaataactcttcacagaggtagaggcatggatgcaaagcatggagcgaagagcgtagagagtggaaagctgaagttttctctgcaatcttttgcatcatttagtgtggccaataggtaatctccgccttccttaaataatgaagtgctttagctccactaacaccaaactacttaaaggtttacctatagcaactgccagcctagaccatcagtgcttgtcgcctgggtgccacgcagcgcccggggcgtgttgtgtgtcgttagcggtcgtgttctttgccctcttttgcatcatttagtgtggccaataggacaataatggcgttatggaaagcaagatcattgagctccgagtctaaagtacagattgctgaggaacaatctcaaaataatacacttcagagtgaggacagtggaatttttgttggtgttgacgattccaagagccttcagatgagtgaagttttctcgtcaaccatttctgctaatatgaattcacttctggaggtgttcgagggtggttcgttggagatgaaagtcatggaaaaagttggatgcctcaaatactcggctacacaatgggaatcagataaacccgacgaatatcaaagacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaaatagaagaccttgctcctaaacaaaaggcgtgcagtgtccaagtcatcttggaattgaatggtcaaagacaccaagcatcagaagagaacgagaagaatgtccttcagttcatctgctcgcctaaaggaattcagcctgcatcaagcactctgcacacagataggtnatcatcgtgacancatgtgatatacgatgacaagatttctgacacactatggcccg

SEQ ID NO: 2466 - DNA, 808 bp, Triticum aestivum
  Clone ID: PAT_TA_2466
gtcaccatttccgccgagtggttccccggccagccccgccccgcccacctcgacggctcctcgccaggggacttcgggttcgaccccctggggtactggtgccggaggcgctggggctgggcaactgggtgaaggcgcaggagtgggcggcgctccccgacgggcaggcgacgtacctgggcaacccggtgccctggggcaacctgccgaccatcctggcgatcgagttcctggccatcgccttcgcggagcagcagcgcaccatggagaaggacccggagaagaagaagtaccccggcggcgccttcgacccgctcggcttctccaaggaccccgcaaagttcgaggagctcaagctcaaggagatcaagaacgggcggctggcgatgctggcgttcgtggggttctgccggcagcagtcggggcggcaccggcccgctggagaacctggccacgcacctcgcggacccgtggcacaacaacatcggcgacatcgtcatccccagaaatatctacggcccttgagcggagccgaccgggctgaggggagatcgaggagccggagcacatggttttcattcatgtttctgcgtcgatcgactggttgatcaacttgccacgctggctctgcgcgcgtacgtccgtgcgtgcaggaactgtacaacaacgtcagctctccggccggcaacctttgtaatgtgtaaagcttaagtagtagccgctgttgtgaatgcacccgtatgatctgtataaactcttgcatgatgatggtctttttcttgaaaaaaaaaaaaaaaaaaggccccta

SEQ ID NO: 2467 - DNA, 631 bp, Triticum aestivum
  unsure (1)..(631): unsure at all n locations
  Clone ID: PAT_TA_2467
gccttggggcaacctcccgaccatcctggcgatcggttcctggccatcgccttcgcgggagagcagcgcaccatggagaaggacccgggaaagaagaagtaccccggcggcgccttcgacccgctcggcttctccaagaccccgcaaagttcgaggagctcaagctcaaggagatcaagaacgggcggctggcgatgctggcgttcgtggggttctgcgtgcagcagtcggcgtaccccggcaccggcccgctggagaacctggccacgcacctcgcggacccgtggcacaacaacatcggcgacatcgtcatccccagaaatatctacggcccttgagcggagccgaccgggctgaggggagatcgaggagccggagcacatggttttcattcatgtttctgcgtcgatcgactggttgatcaacttgccacgctggctctgcgcgcgtacgtccgtgcgtgcaggaactgtacaacaacgtcagctctccggccggcaacctttgtaatgtgtaaagcttaagtagtagccgctgttgtgaatgcacccgtatgatctgtataaactcttggcatgatgatggtctttttcttgaggatcaacgctgctgcatttttaaaaannnaana

SEQ ID NO: 2468 - DNA, 1012 bp, Triticum aestivum
  unsure (1)..(1012): unsure at all n locations
  Clone ID: PAT_TA_2468
cgtccgcccacgcgtccgctcagattcccttgtcctctcagagcgcacgcctgttcttcttcctgtgggtgtgtcaccgcagcagggagcggggagcatcgagagagcaacaatggcgatggcgtcgtcgagcgggctgaggagctgcagcgccgtgggcgtgccgagcctgctggcgccttcgtcccggtccggccgctccgggctgccgttctgcgcctacgccaccacctccggccgcgtcaccatgtccgccgagtggttccccggccagccccgccccgcccacctcgacggctcctcgccaggggacttcgggttcgaccccctgggcctcgccaccgtgccggagaacttcgagcggttcaaggagtccgagatctaccactgccgctgggccatgctctgcgtgcctggggtgctggtgccggaggcgctggggctgggcaactgggtgaaggcgcaggagtgggcggcgctccccgacgggcaggcgacgtacctgggcaacccggtgccgtggggcaacctgccgaccatcctggcgatcgagttcctggccacgcacctcgcggacccgtggcacaacaacatcggcgacatcgtcatccccagaaatatctacggcccttgagcggagccgaccgggctgaggggagatcgaggagccggagcacatggttttcattcatgtttctgcgtcgatcgactggttgatcaacttgccacgctggctctgcgcgcgtacgtccgtgcgtgcaggaactgtacaacaacgtcagctctccggccggcaacctttgtaatgtgtaaagcttaagtagtagccgctgttgtgaatgcacccgtatgatctgtataaactcttcatgatgatggtctttttcttgaggatcaacgctgctgcatttttatttaaccagcgaagctctcttaaaaaaaaaaaaaaaaaaaaaaaaaaaaaaaaaaaaaaaataaaaaataaaaataataaaaaaaaaaantaagggcg

SEQ ID NO: 2469 - DNA, 1288 bp, Triticum aestivum
  Clone ID: PAT_TA_2469
atcggttcttcttcttgttgttgtctcaccgcagcaaggagcagccaggatcgttcgtcctcctgttgttgtctcgcctgttcttcttcttgttgttgtctcaccgcagcaaggagcagccagcatcgagagagcaacaatggcgatggcgtcgtcgagcgggctgaggagctgcagcgccgtgggcgtgccgagcctgctggcgccttcgtcccggtccggccgctccgggctgccgttctgcgcctacgccaccacctccggccgcgccccatgtccgccgagtccggttccccggccacgccccgccccgcccacctcgcaccgcctcctcgccacgggacactttcgggttcgaccccctggggcctcgccaccgtgccggagaacttcggagcggttcaagggagttccgagatctaccactggccgcggggccgtgccctggcgtggctggggttgctgggtgccgggatggcgctggggactgggcaacctgggtgaaggcgcaggaggtggggcggccgctccccgaccgggcggcgacgtacctgggcaacccggtgccctggggcaacctgcctgaccatcctggcgatcgagttcctggccatcgccttcgcggagcagcagcgcaccatggagaaggacccggagaagaagaagtaccccggcggcgccttcgacccgctcggcttctccaaggaccccgccaagttcgaggagctcaagctcaaggagatcaagaacgggcggctggcgatgctggcgttcgtggggttctgcgtgcagcagtcggcgtaccccggcaccggcccgctggagaacctggccacgcacctcgcggacccgtggcacaacaacatcggcgacatcgtcatccccagaaatatctacggcccttgagcggagccgaccgggctgagaggagatcgaggagctggagcgcatggttttcaacttttcattcatgtttctgcatcgatagattggttgattgccttgccacgctggctctgcgcgcgtacgtccgtgcgtgcaggaactgtacaacaacgtcggctctccggccggcaacctttgtaatgtgtaaagcttaactagcggccactgttgtgaatgcatccatatgatctgtataaactctttgcatgatgatggtgtggaggaagttgcctctgacaatctctgttatttgtacgggacagttatcgcgtgatcaagttaacatttcattgtttttttgaggatcgccacgctgctgcatttttatttaaccagcgaagct

SEQ ID NO: 2470 - DNA, 705 bp, Triticum aestivum
  unsure (1)..(705): unsure at all n locations
  Clone ID: PAT_TA_2470
gggcgcgtccccgtcgaacccacctccacggcgccgccccaggggataagggcgacgcctcggcctccccctgccactctcccccactaaccctagacagccccagatccacttcccctcatctcgctcacacgctccttctcctccagcgaggcccgaccgctgctatggtcgccggtgtgcaccaccgcggcgagcgccgcccccactccccttcgacgtgcccacgacccgcgccatcatcgtccacatcgcgtgcgctaccggatcgcagccgaagaggaacaccaccgccgcctgcatcttcttccccaactacggcagccgggtcctcgtcgtcgatccgcgtcatctcgtccaccctaagcccacgtacgagctctccaccgacctcctctcngaccccggtgatggttgtccatgccactgtgatcgactacgtcatcgacggccccctccttctcgcctgagcaaccaaatgtcngagcccaggagccagatgccatcgcctatccttactactacgtgtgaggccgctggacgactangagtagttaggaggtcccaagcaaggangccttgcctttccgatcgtagancctttgtgcaagccttcttaaggnaaactgtttactcatgtcngtatcaagatatgtncttncgcngactcgtttgtatcnancttantattgagcccccnagccn

SEQ ID NO: 2471 - DNA, 1599 bp, Triticum aestivum
  Clone ID: PAT_TA_2471
ccacgcctccgtccccctgcccccgcctgccccccccccccctccacttccatttctcttcccctcgcctcgcctcgtcgcagcggcggctgtacgacattcaccgaatcctccccgaccgacacgtccccatgccacaccacgctggaggagttcatctctcgtagcgggaggagttggactggcgcggagtggagatccattcgggctttggattgatccctttcgttgatcccttttcctgttttgggaagctatggcaagaactccaagacaacttcacttatcaagccggcgacttcggtcatctcctcctcatgcaccttcccactaccagaaagcaacaagggcagccaaggaaaataaattgaacttaacctcggagaaaaaggattggaaacatgccacttgcccaatatgcttggagcgtccacatgatgctgtcctcctgctgtgttcttcacacaccaagggttgtcgaccatacatgtgtggaaccaactatcaccagtctaattgtctcgaacagtttaaaaatgcttatgtgaaggagaagccggcaaatgaagtatcaattgcagtggcagcagctagcaagaagccaaaggatgtggagcttgcttgccctatctgccgtggggaagtgaaaggctggacagtggttgaaccagcccggcgatttctcaatcgcaagaagagaacttgcattcatgaagactgctcgttcatgggatcatataagaaactctgcaagcatgtgaaggccagacatccttcatcaaaacctcgtgaagttgaccctgcacgattggctgaatggaaggagcttgaaagtgcaaaggagaggcaggatgcaatcagcatagtcacaggcttgaatccaggatctatgattattggggactatcttattgaccccaatagtggcagcagcgactctttcatggataactctgattggagtgatgactctgactcttacacgtttcctgatggtggtgatattatgttttctggagctcctgatatccgatcattacgaagagtggttcgcagagcttacaggacaagtggggcaagaccaaggcaaaatgtccagcgtcgcgctctaaccatctccagaagcagtggaaggcgtcgatggccgcaggttggttctgctctgtcagctcggatgccgagggggagacaagcaagatccacgaatgacagctgagaaatgggagcatttcatctgccaggaagcagacatcagcaccttaccatgagagctggtctggcggaaccactattcatgaatcctttagcatgcttctttctggtctggtcatagagtgtggggtttaaaagattttttttcttgttgggccacttctttttctctgatgaatgcgctgctagacctgtgaatgacgtttcttttatttccttttatcaaagtagaatagaagcagcgtatgttaggcaaaagattgctttagccattggtgttattgtcctagaaaagcacaacccaactcttggtcatttctgttcaaagttagtcagaccattttgttatatgtttctgaatttcttttgacatattgctcgacttgt

SEQ ID NO: 2472 - DNA, 307 bp, Triticum aestivum
  Clone ID: PAT_TA_2472
tcagcagcgagtgggtgaggtcccgcattgtcgagggcacgcaggcttctttggcggtcgactgctcgtggtttctggtcccgccctcgtcgcctcaccgccccgtcctcgctggagcggcgtactttgatgtggacgaggtggcggaccggtcggaggacaagagcccctcgccccacatgctgccctcgcccgaccagttcgccgcctggatggaccgccacaacatcacccctgatgaccacgtgctcctctacgatcactccaacggcctcctcactgcgtctgctcgcgtctggcggacctt

SEQ ID NO: 2473 - DNA, 568 bp, Triticum aestivum
  Clone ID: PAT_TA_2473
ctgaaagcaataactgcctcaaaacgcatgaaatcaggcccgagccaagtttgggtgaacgtacctgcaaatacattccagcctcgagcacgtcccctttttcagtataggcactacagtgagcagcaacccttgcgattgaatcctactgaaatttctgaagtcatagctgaagtttgttcagaaacaacttcaaatgcaaatcagtttaatgctccagcccgattgaccacccagagtcggcaaccttcagcggatgtggcatttagtgtcctcattaaacttgttattgacatgtatatgatggactctgaggctgctgctcctctgacactttatatgcttgagggcatgttaagctctcagaaatcacctgccagaacaaaggctttcgatctgattctgaaccttgggattcatgcacacctgctggagcctatgatagttgaagatgcaccacttattgaaaaaggtgatactacaagcaactcttatctgaacaatgagtacggacccaatatggatgaacagagggaagcggaacctgaagaagagcaaaggattagtc

SEQ ID NO: 2474 - DNA, 775 bp, Triticum aestivum
  Clone ID: PAT_TA_2474
ccaccaccacgcgggacagctcaccgagcgagcgcgcgccgcaagaatccaagaacccgtcgtcgccgcgcccgagtactgccacgccaacttctcccgctacttcacgcccgccttctggtccgacccggcgctcggcgcgcgcctcgccgccggccgccgccgcccgccctgctacttcaacaccggcgtcatggtcgtcgacctccgccgctggagggccggcaactaccgccgccgcatcgagcgctggatggagatccagaaggagcggcgcatctacgagctgggctcgctgccgccgttcctgctggtcttcgccggcgaggtggaggccgtcgacctccgctggaaccagcacggcctcggcggcgacaacgtgcgcggcagctgccgcccgctccacgacgggcccgtcagcctcatgcattggtcgggcaagggcaagccgtgggaccgcctggacgccggcaggccctgcccgctcgaccacacctggaagtcctacgacctctacatcgccggggacgggggcagcgccgcctcgccggcctccgggccggcattttccgcctggtagagggagcgcccgtagctgcactgactagacacagtgattcttttgttggttgggcggttcttggcaatcgccggccccccgccctcgccgctcccgggccgcgtgggagggtcgccggcgattgcggcgcgaggaggagggaggagaggagtggtggatagagaaaaagaagagcttgttctttttggtagaaat

SEQ ID NO: 2475 - DNA, 970 bp, Triticum aestivum
  Clone ID: PAT_TA_2475
cgcccgacctcatgccttgtagtgggtccctgcctggggctcgcggcgccgcctgcgcgagccacggctttggatgagctcttgggtttctgcgcgccgtttttgtggcctttgctcgctggggcctcctgaggataccccctttcggcacgcgggccgcgccggaagttttcgatccaaaaaagcctcagcctgttaagaaaaccttgaaggtgaaagtgtacatgggagatggttggcggatggacttcaagcagactcactttgaccaatattctcctccagatttttacgcacgggccgggttcgccggcgcccccgcggcctcggggttttgatccaaaaaagcctcaacctgttaagaagaccttgaaggtaaaagtgtacatgggttgatggttggcggatggacttcaagcagacacactttgaccacgccccgccgccacatgtccaagcaggacgactttgcggggcagacggtgctgccggtgtcggagcttcagcccgggatccgcgcggtggcgctgttcgaccgcaaggggaacaagcttccccaacgtcaagctcctcatgcgctttgagtttgtgttgatttggaatggtttggtttggtttgagagatgatggcgtgtcggcggccattgttggtacctggcgctctgtgcactcttgccccatcttctacctatggcacgcttcgcccgcgaggggctcagtttccccaacgtcaagctcctaatgcgctttgagtttgtctgatttggtttgagagatgatggtgtgtcgccggcatggttggtactctgcattctttgttcatcctgtacatacatggtgccgtctgtgtgaatacggagtgtacctatgtcagtcagttgtgtacatgagaattcatcgaccttgtatttgttgtgagtggtaataaggatttgccatcaaaaaaaaaaaaaaaaaaaaaaaaaaaaaa

SEQ ID NO: 2476 - DNA, 519 bp, Triticum aestivum
  Clone ID: PAT_TA_2476
tgtcgttcgcaccaacaggctcgcagctgctagctcaatggcagggacgcgagcgttcttggtcgcgctcgtcgtggctctcacgtttctcttcatggagggcctggcggcagcggtgccggcgactccggagagtacagcgcagcggcggctggaggcgcgaagcctcctcaggcggctcaataagcctcctgtcgcaagcattcagagctcggatggtgatgtcatagactgtgtgcacatatccaaacagcctgcattcgatcatcctctcctcaagaaccatactattcagatgcggccttcttacaacccaagaggcatgcatcatgactccaacatcacagcccatgcaatcactcaaatatggcatcaaaatggcacgtgccctaagaacaccataccaatccgaaggaccaaggaggaggatgtcctgagggccaattctattaggaggtttggcaagaagatgcctaggagcatcccacacctcaatccaaccaatgacactgacacacc

SEQ ID NO: 2477 - DNA, 821 bp, Triticum aestivum
  unsure (1)..(821): unsure at all n locations
  Clone ID: PAT_TA_2477
cggacgagccgcggcgagcctttgacttctcccacccccaccttcagcacagaaccaaaaaacccgctgatccgaaccgccgagtcccgtcccccctcccgatccggcgacgatggagggcggcgccgacgccttcgggtcctcgaccgcgccgctggcctggcacgacttcctcgagcgcatgcgccagccttccgccgccgaattcgtcaagtccatcaagggctttatcatgacgttctcaaacagagcacctgatccagagggagatagcgcagctgttcaagagttccttgaaaatatggaaggtgctttcagagcccacactccttgggctggcagttctgaagaggaactagagagtgccggtgagggcctcgagaagtatgttatgaccaagctgtataatcgggtatttgcttcagtcccggaagatgtgaagagcgacgaagagctttttgagaagatttctctactccagcagtttatacgtcctgaanacttagatataaaaccagaatatcagaatgaaacatcatggctgcttgcgcaaaaggagctacagaagataaacatgtataaggctccaagggataagcttgcttgcatcctgaactgttgtaaagtcatcaataacttacttatgaatgcttctcatatgtcacatgataacccccctggagctgacgaatttcttccagtcctcatctatgtcaccataaaggctaatcctccgcagttacactcaaatcttttatacatacaaagatacaggtgccaatcacgactggtgtcagaggctcaatatttttttacaaacc

SEQ ID NO: 2478 - DNA, 661 bp, Triticum aestivum
  unsure (1)..(661): unsure at all n locations
  Clone ID: PAT_TA_2478
ctcgcgcgacctcggcaactggtggttgcaggaagactatccaaaaaaaccacaaggatcaccaacaagatgcagcgaaccaaggtgagggggaggtgagggtcggcgcgagcgcggggcgggccaagctggcggagaaggtggaggcggcgacgtcgaggtcgcacgacgagcggaagctggcgcacgagcgcggcagggccaaggtcgccgcggccgaggcgcagctgcacagggagaaggtcgcgcaccgggaggcggcggtggagcaccgcctccacaagcacgccggcgtgggcgccgcctcccccaagccccccgccgacggcggccactgccgcgaggcccaccccgggagcctgccctcgggcgtgtcctctatattctttccatggatgttctcttacatacgcgcgtcgggggtttttgtgctagtgttctatcgagtgccccgtgaattatggacgttgtggatgtttttatgattggttgacaagctaaaatacatttttattttattttcaaaaaaaaaaaaaaaaaattatatnncntcataattcacttcanctcttatccatgttttcactcccatacnanaaaaaaactggttccncaggtcaagggagctatnaaaaaaanntgcgnagctgaaaggaaaaan

SEQ ID NO: 2479 - DNA, 1482 bp, Triticum aestivum
  unsure (1)..(1482): unsure at all n locations
  Clone ID: PAT_TA_2479
annggctcggccctcgcctccaacaggccctcgcactgctggaatacaatagtgcatctacgatcgttgcgctttgcttgaagctagagcagagcgctttgaacaagcacggactttattccagcaagctactcaatgcaatccaaaaagttgtgcaagttggctatcttgggctcaggtagaaatgcgtgccgaaaacaatgccattgcgaggaagctctttgagaaagctgtccaggctagtcccaagaacagattttcgtggcatgtctgggcactctttgaggccaatcaaggtaacactgacaaagcaaggaagttacttaagattggccatgctgtgaaccctagggaccctgtaattctacagtcacttgcactgctggaatacaattgtgcatctccaaatgttgcccgtgtattatttagaaaggcatctcagattgatccaaggcaccaaccatgtttggatagcttggggttggatggagtaggaacgtaggcatggacagaccggccgggcaagtgatgcagcaaggtaggaacagggggatcacagctgaaggttcaagtacttctgacctcgacagcggcacggctgaaggttcaagcactcccaacctcgacagcatcgtggaccgccgtgctgcatacactcgggaggcagagagtgattttgacgtggacggcttcatcaggaggaggctggccctggacccggcggagctagagcgcatgggcctagagggctctgatcccaagggtagttatttcgtcaaatggaggacgctggcggctgaccagggaagcctctccctcttcctcccgtcccgtaagttccttcttccctccaaccgtcccaccggtcgaggcacgctccaccgcactccgcccaccagcgattccgcacgggtagagccctccgcgggtacctcatgctgaagactcaagtacatctgacctcgtctgcggcacggctgaaggttccagcaatcccaacctcgacagcatcgtggaccgtccgtgctgcatacactcgggaggcagagagtgattttgacgtggatggcttcatcaggaggaggctggccctggacccggcggagctagacgctgtgctagagggctctgatcccaagggagttatttctcagaggaggacgcggcggctgaccaggaaacctctccctcttctccccgtgccgtagttcctccttccgttcagcattagcagcagttgttgccgtgtccaccgtgcacagccatcgagtgatcactgacaggtaccgtggcctgagggacagtagtaagtagcacgtgcatttatgtgtatatctgtaataagaagaaccccgatgctgacattagcagtcacttgcccattgtgtatgtagttctgtcagaggctgctcgagaagcagtgtagctgtgtatagaagcccgtctggtctgttgtgnggttacatcatttgttctctgcaa

SEQ ID NO: 2480 - DNA, 258 bp, Triticum aestivum
  Clone ID: PAT_TA_2480
cgtcgcctctccctctcccacacgaaaccagctatcccccgaatccgtgagatccgaggaggggcgcctcgcctcggcactagcatccgcggcgtcgaagatgggatcggaggcggacatgaccgggcccctcctcgccggcggcagcggcgtcgcgccggcggcggaggcggaggtggtgcccccgtggcgggagcagctcacggtgcggggcatagtggtcagcgccctcctcggggtgctcttctgcctcatcac

SEQ ID NO: 2481 - DNA, 804 bp, Triticum aestivum
  unsure (1)..(804): unsure at all n locations
  Clone ID: PAT_TA_2481
gattcggacccggcttcttcccctccaattaatcgcgcgggcttgtgctaagtcgtgacaagtgtcagataggcagctacagagatcacgatggacctcagggcgctcgccttggccgctaccgtgctcctcgccctggccgcgccggcgccggtactcgggcagggcgtggcgacgtcgtgcacggcgtcgctcatcaccagcttcacgccgtgcctcagcttcctcaccaacagcaccaacggcggggggtcgtcgccgacggcggactgctgccggtccctgtcggcggtggtgaccacgagcaccagctgcgcctgcctcatcctgaccggcaacgtgccgctcggcctgccgatcaaccggaccctcgccgtcacgctgcccaaggcctgcaactccatgtccgtcccgctccagtgcaaagatacgtcggctcagctcccagctcctggccccgtcgcagtctctcctgccatgcccccgctgccgccaatgacgccggaggcgccggaaccaccgtctgagaccaccctgacgatgccgccgactagccagacccaggggcagacgaggccgcaggtggtgcccagctctgcctggaggagggacactgcgtctgtgtccgtgatgctgctctccatcattggagccatgctggtctgatcggattccagttaagctgagcacgcagagcagctctgttgctgcaagacgtgctgattgctagtactagtatgagtttttcgtgcttgtttggccacgcttgtcaatataaatacnatataatcaattatgggcaaa

SEQ ID NO: 2482 - DNA, 405 bp, Triticum aestivum
  Clone ID: PAT_TA_2482
acctttgcgtccgggcagtcttggcaaagtatatacgccaacccgctcgatccctgcactccgtatgctacctgtgggccattcacggtctgtactggtaattcacatccttactgtgactgtatggagggattctctcagaagtcaccacagggttgggaccttgatgatcgaacaggagggtgcatcagaaatactccattgcagtgcactagcaagaagaacacgataaattcaacggacaagttccaccccattgctcgtgttacattgacctatgaaccccgaagcatgggcaatgctaccactcagagcgaatgcgcagaaactcgtctcggatcctgctcctgcactgcttacacctataacagtagcgggtgctctatctggcatggggaattgctt

SEQ ID NO: 2483 - DNA, 637 bp, Triticum aestivum
  unsure (1)..(637): unsure at all n locations
  Clone ID: PAT_TA_2483
ccccgcgcccgcccatccgtcccccccccccgccgcccccgtctctccctctctccctcctctctctctccggccaaatcaatccacccgccggcggcgagcaccgagacagaggggtaggagccgacagccgaggcagtccaccaccgcgccatggcgccgcccccgagcacgagcgcccccgacggcggcctggatcccagggacgtgtgcgtcgtcggcgtcgcccgcacgcccatcggcgccctgctcggctccctctcctccctccccgccaccaagctcggctccgtccccatccacggcgctctccggcgagccagcgtcgacccggcgctggtgcaagaggtgttcatgggacaacgtcctcaccgccaacctccggcccgcccccggccccggcctgccccgccccctcccccccgcctcccccaacaaagtctgctcctcggggatgaaggctgtcatgctcgcggcgcagtcggttcagctgggggtcaacgacgtcgtggtcgccggcggcatcgagagcgtggccaatgcccccatatacgctgcaaccgcggggagtgggtcaaantttggccatggcccccccatctnnnggatgctcaaggannnnttgtgggatgtgnnn

SEQ ID NO: 2484 - DNA, 576 bp, Triticum aestivum
  Clone ID: PAT_TA_2484
cgtccgcccacgcgtccgcgtgctcgtcatcaccgccaactccgtcgccgagaccgtcagcctcgcgcccgagatcatccgcggcggcgagtccgtccgctccgtcttcgccgtcctcaacagcaggacgcgcatcgaccccgatgagccggaggccgagcaggtggacggacgcgtgggcgagatcgagctccgccacgtcgacttttcctacccgtcgcgcccggacgtgatggtcttcaaggagttcagcctgaggatccgagctggccagagccaggcgctcgtgggagcgagcgggtcggggaagagcactgtcatcgctctcatcgagcgtttctacgatcccatggccgggaaggtcatgatcgacggcaaggacatccgtcggctcaacttgaagtctctccgtctcaagatcggcctggtgcagcaggagcccgtcctgttcgccaccagcatcctggagaacatcgcctacggcaaggacggcgtgacggaggaggaggtcgtcgaggcggccaaagtggccaacgtgcacggcttcgtcagcgcgctccccgacggctacaggac

SEQ ID NO: 2485 - DNA, 471 bp, Triticum aestivum
  Clone ID: PAT_TA_2485
cggacgcgtgggctgctggacgaggcgacgagcgcgctggacgccgagtcggagagcgtgctgcaggaggcgctggagcggctgatgaaggggcggacgacggtgctggtggcgcaccggctgtcaacgatccgcggcgtggaccgcatcgccgtggtgcaggacgggcgcatcatcgagcacggcgggcactcggagctcgtggcgcggcccgagggcgcctactcccggctgctgcagctgcagaaccaccgcaactgatggaaggacctgatcgatgccatgggtggatggatggatgggggcttgatttttgtgggtggtggtggtctggtctagtgggtgtagatactagggcgaccgtgtgttactggtctcttttctttgtgtttgaactgcaaaccttgtgatctgatcttgatcttgatctgtatcttctccgtgatgaaatgcatgatgcgactctcgttg

SEQ ID NO: 2486 - DNA, 1190 bp, Triticum aestivum
  unsure (1)..(1190): unsure at all n locations
  Clone ID: PAT_TA_2486
cccccccctctcgagcggttctccgccggggccgccgcccaggtccggctcgcccgccgtgaccccggccggcggcccctcgacccccaccgccgactccgtggccgagaccgtcagcctcgcgcccgagatcctccgcggggcggcgagcacccgggccatggtggggaagcgcgtcgggcagccggggctcgacccggtggtgaagaaggcgaagcctgtcacggtggtgcgccggctctctgcgctgcagcacgccgacgtctcctcgccgtcccggcccggcatgggcatcgacaaggagggcaacctgaacctcatcgcgggccgcaaccgcgcctacgtccgcctcgtcggctcgggcaagagccccctcaacgccctcctggggcggctctgcgactcggcccgcggcaagctgatgatgggccgcaaggacatccgggggttccccctcatgtccctgatgcgcaagctcgcccccatgcacccggtgccggaccgcgtcgcctcccccttcctcggggacatcggcttccacgaggatgtcgcagcggccgaggaggtggtcgaggcggccaagacggccaacgtgcacgcgttcgtgagccagctcccggaggggtaccggacggcggtgggcgagcggggcgtgcagctgtcgggcgggcagaagcagcgcatcgccatcgcgcgcgcggtgctcaaggacccggccatcctgctcctggacgaggcgacgagcgcgctggacgccgagtcggagagcgtgctgcaggaggcgctggagcggctgatgaaggggcggacgacggtgctggtggcgcaccggctgtcgacgatccgcggcgtggaccgcatcgccgtggtgcaggacgggcgcatcatcgagcacggcgggcactcggagctcgtggcccggcccgagggggcctactcccggctgctgcagctgcagaaccaccgcaactgatgggggaacatgatcgatgccatttgacagctttgccttggatggatggaggcttgatttttgtgggtggtggtggtctggtctagtgggtgtagatactagggcgaccgtgtgttactggtctcttttctttgtgcttgaactgcaaaccttgtgatccgatcttgatctgtatcttnccccgtgatgaaatgcatgatgcaactctcgttttctc

SEQ ID NO: 2487 - DNA, 683 bp, Triticum aestivum
  unsure (1)..(683): unsure at all n locations
  Clone ID: PAT_TA_2487
attcggacgagcgggcggggcggggcggcgacacggcgcgacggcgacgcgcagggccgcccccccggccgggtggcagaacctctacgccccgaatgagttaatcacccagttctcttaagctcctgagcaaggcaggtgactgatggctcgccttgtcgcgggtggaactgggctgcatccgtggggtcgggcgggtttgacgtccagggtcttggccagacggccacagcacagcagggctgtgagcagtctcagcctggcatcacgcaaagacaaacagctaacattccagttcttgacctcgcatgtgtttcaccgcatgattctgcaatcacaagctgcaagtcagcagagtgaatagtgaaggatcctgctcacacatttgctgtattcacccccacctcgtgtgcccctgttttctgggttaaccaccccctgttcttgtagcactgtcaatcctgtatagatacactccattaccttctggtctacatgtagatttgttgtctcactagaagttcataatccaaagaatttttgttctttctgctggggccggttccaattcncctatantgatcgtatncgcgcccacggncctcggttanaagtctgactgggaaaacctggcgtaccaantatncctncaganatccctttccangtgggtatacaacagc

SEQ ID NO: 2488 - DNA, 564 bp, Triticum aestivum
  Clone ID: PAT_TA_2488
ttcgtttagacaccaagccatcacccagctagagaggagctctcaccgcatagttcagacagcagccacagaccacagtcggtcaggtctcatcccaggcctcagctcttcccgcgcgtccgggaacgcccacgagcactggatgcgagacaggggtacatgattcggttcgacggccacttcgagttcgaggacccgtcgaccgccgagccgccgccgcctccgttcgcggccagggcgatctcgtctgagcaggagcatacccccatggtcgccgcgctgctgcacgtcatctcagggtacaccacgccggtgccggacttcttcttcccagcgagcaaggaggtgtgcacggcgtgcgggatggatgggtgcctcgggtgcgagttcttcggcgcgggggccaggccggcgatcgcaccgaaggcgacggtgggcgggccgcagaggaggcggagaaacaaaaagacccagtaccgcggcatcaggcagcgaccgtggggcaagtgggcggcggagatccgcgacccgcgccgcgccgtgcgggtgtgactcgggaccttc

SEQ ID NO: 2489 - DNA, 546 bp, Triticum aestivum
  Clone ID: PAT_TA_2489
ggtggcccgagtttcagtacagtgaaatgtgcttcagtgataggattatcatcgagctaagtgaagtgggtgtatctattgaacccgtgcccgatcttgcacagagtgaagacgaggatgtcaatgctgaaatctgtagattagaaggccaacttcataaggaggttcttgagaaggaaaagttactagcgaagttggacagaatggttagaactgagaaggagtctcagcagagggaattttcgcggcgcgccatggagagacttgtgctgattgcttacgagaaatacatggctttctgtggctcaaataattcaagcagcaaaagtgttaatagagctagcaaacatgctgccctcagttttgttaaacgcacgatggcacgttgccaaatctacgaagaggcaggaacaagctgctttgatgaagcccctttcaaggatttgtttatttcagcaacttcacacagaagggacccagattctgcttcacaagaaaataatacactaccaaaatcggtccaaaggtctagtgcatcagacgctt

SEQ ID NO: 2490 - DNA, 1082 bp, Triticum aestivum
  unsure (1)..(1082): unsure at all n locations
  Clone ID: PAT_TA_2490
tttggcaatgaaggtaacaggccaatgcctccacaaacgagaggagaccatcatgcttggcgtactgctgttggtactcatggtgctagaccacattctagtgttgaaggccgtggccattttaatcacacttggcaaaatcatcagacgtttggtacgagagaaaacacaagtatgccacacggcgttgggcccagagcttttgtcagaccaatggcacatctgccccctactcttgggtacctcaatggaccatcataccctgggcctatgcctcccatgtattattacatgcctgctccacccatggaggcaatgagaggtccacctcgttttgtccaaaaccaaccagccccccaacctgttttatcgcctgaagcgactgagctaagagctaatatattagctcaagtggagtactatcttagtgatactaatctggagcgagataatttcttgaaatctttaatggatgaacatggctgggttccaatttcaaaagttgcagacttcaacgccccgtgccgaattacaacggatgtccatctgatagtagatgtattggcaagctcaagtcttgtagaagttcaggatgacaagataagaaggcgctctgactggtcaaaatgggtttcttcttctggggcaacatctgttcagagtccatcatctactgccagtatggataatattatgggtgagagcaatactggcggcttctcaaataaggatgattctttctcttcagaccaaaagaagcatcctcaccctcaagataataaatgcaacatagatngtgctgctattaaggcaatagttccaagatgaagagctacctaatgatgcacatagctnttcattgaataaaggnttgtctgccaagactattggtggaaagccctaagagcatttccacattctctgggtaattcacgcacacaaagaagctgctgttaaaactaatgatgtttaaattcgggaagttaacacaaagattaaagtacctgnttctcaaagcgaaagtgggttcccttangatttgccaaatgacccccccagcttcantgggggattaaancana

SEQ ID NO: 2491 - DNA, 764 bp, Triticum aestivum
  unsure (1)..(764): unsure at all n locations
  Clone ID: PAT_TA_2491
gcgagtcttcttcttcctccctgctctgaccgagatccgctccagtggactcgattagggttagggtttgcctctccgatcgtgaggcgggttgctacatctgccttgttcgtcggattccggtagaatcaaccactcgatcgacttaatttcccccgccggtgctgcctctgttttgccgaagatgctgggcggactttacggcgacctcccgccgcccacctcggcggccggcgacgacgacaagccgaccgcctccgtctggtcgagcgccaccaagatggcaccgcccaccctccgcaagccctccgcgaccttcgcccctcccacgtccctcctcaggaaccagcacccccgccccgccgccgctcccaaggccagcgccgtccaccagcagcagcagcagcagccgccgcaccccctccccctcgcctccgccgtcaccaccaccaccgcagcgtccttccaccccgccctcgtcgccgtgcagtccaccgtgctcgaggagtacgaccccgccaggcccaacgactacgaggactaccgcaaggagaagctcaagcgggccaaggacgccgagatgaagaaggagctcgaccggaggcgccgcgaggaccaggagcgggagagggagcgcgagctgagggaggccgaggcacgcctgcgggaggagcagtccagggcctnctccctcaacatatccggcgaggaagcctggaagaagagggccgncatgagcggcgctggcggcggcgctactcctc

SEQ ID NO: 2492 - DNA, 802 bp, Triticum aestivum
  Clone ID: PAT_TA_2492
cacctttgcctcctattttttatctcgtacgacgaggccggcgtgatgtggccatgcttgcttgtgactgcagcaacgacacccaggggagagagtggttggagtaagctgcgccgcaaaggcaggatggccgccgacggcatggaggccagccccggcacccccaggagccccaccgtcttcgactggtgcgttggcttcaaagttcaaaccgaatatcccctcttgttttcgagcgcaccacatcacgaacccaaatgctagatccaaccaccatgactctatctagtacagtagccataaatctgatgcctctgaaccttgtctcttgcagggtggtgatcagttcgctcgaccgctaaccgtgaaaaaagaagaagatccaccaagacggagaagcgcacgagcacaaggagagtagctgcaaacttgaccggaagatggaaccctgtcccagtatatgttactgtatcagttatgtacgtactagtactacttccgctgtaaacatccactccacgtgagatggtgcgagttttcgtagcaaaggatgtgctagatggatccgagtggtagctcaaggaaaactttggtagtaggcaaccggcgacgtgcaacgacctgaggcgaatgagaccgatgtgaagtgtgtgtgtgtgtgtaaatcctaccagtagatgcactagatcagaggggatgttgagctctagctgctctgtacaaggcccgcgggcagcatgtgctaatgcatgcagtgtaaaatatgtctgcaataatgcatggctaagtgagcctccactcc

SEQ ID NO: 2493 - DNA, 751 bp, Triticum aestivum
  unsure (1)..(751): unsure at all n locations
  Clone ID: PAT_TA_2493
gaaagaaggaggattcactgcgcctgcgccacacacacccctcgacaccgaaggtttggttggatcgtcgtgctccatggggcttcttgaccagctgtgggacgacacggtggccgggccgcggccggaccacggcctcggcaggctccgcaagtacgcgtccttctccccgtcctccgccgcctccgcgacgaccgctgccgtgccgtcggccgacgtggcggcgccggcggtgacgcggagcatcaccatcctccgcccgccggctctgtccgtgacgtcgccgcgcagcgagtccggctccggctccgcgccctcgtccccggccagcgtccccgactcccccttcggcacagcaacgacacccaggggagagagtggttggagtaagctgcggcgcaaaggcaggatggccgccgacggcatggaggccagccccggcacccccaggaaccccaccgtgtacgactgggtggtgattagttcgctcgaccgctaactgtagaacaagaagaagcagatccaccaagacggagaggtgcacgagcacaaggagagtagctggaaaccatgaccggaagatggaaccatgtcccagtatatgttactgtattagttatgtactactactactacttncgttgtaacatccactccacgtgagatggggcgagttttcgtagcaaaggatgggctagatggatcccgcatccgagtgggagctcaaggaaaacttggtagtaggcaaccg

SEQ ID NO: 2494 - DNA, 817 bp, Triticum aestivum
  Clone ID: PAT_TA_2494
cgcaggtttggttggatcgtcgtgctccggaggatccactgcgcctgcgcctgcgcctgcgacacacccttcgacaccaaaggtaataatcagttccatccccttgcccctccctctcggccaagaacacgcgaggcaagaacagattaaccggaggaagaagaggagatgatcatgattgtatgaacgtggctcctgatctaccacgtacgtgcaacgcgcaggtttgatcggatcgtcgtgcgctccatggggcttcttgatcagctgtgggacgacacggtggccgggccgcggccggaccacggcctcggcaggctccgcaagtacgcgtccttctccccgtcctcctcggcctccggcgacgaccgctgccgtgccgtcggccgacgtggcggcgccggcggtgacgcggagcatcaccatcctccgcccgccggctctgtccgtgacgtcgccgcgcagcgagtccggctccggctccgcgccctcgtccccggccagcgtccccgactcccccttcggcacaggtaccttatcacacctttgcctcctatttttatctcgtacgacgaggccggcgtgatgtggctgacatgcttggcttgtgactgcagcaacgacacccaggggagagagtggttggagtaagctgcggcgcaaaggcaggatggccgccgacggcatggagtccagccccggcacccccaggagccccaccgtgtacgactggtgcgttggcttcaaaccgaatatcccctcttgttttggagtgcaccacatcatgaacccaaatgctagatccaaccaacatgac

SEQ ID NO: 2495 - DNA, 718 bp, Triticum aestivum
  unsure (1)..(718): unsure at all n locations
  Clone ID: PAT_TA_2495
ggnaacgaggaggatccactgcgcctgcgcctgcgcctgcgccacacacacccttcgcaccaaagtaataatcagttccatccccttgcccctccctctcggccaagaacacgcgaggcaagaacagattaaccggaggaagaagaggagatgatcatgattgtatgaacgtggctccctaccacgtacgtgcaacgcgcaggtttgatcggatcgtcgtgcgctccatggggcttcttgaccagctgtgggacgacacggtggccgggccgcggccggaccacggcctcggcaggctccgcaagtacgcctccttctccccgtcctcctcggcggccggcacgaccgctgccgtgccgtcggccgacgtggcggcgccggcggtgacgcggagcatcaccatcctccgcccgccggctctgtccgtgacgtcgccgcgcggcgagtccggctccggctccgcgccctcgtccccggccagcgtccccgactcccccttcagcacagcaacgacacccaggggagagagtggttggagtaagctgcgccgcaaaggcaggatggccgccgacggcatggaggccagcccgggcacccccaggagccccaccgtcttcgactgggtggtgatcagttcgctcgaccgctaaccgtgaaaacagaagcggatccaccaagacggagaagcgcacgagcacaaggagagtagctgcaaact

SEQ ID NO: 2496 - DNA, 953 bp, Triticum aestivum
  Clone ID: PAT_TA_2496
gcgcctcgcctgcggcacacacacccctcgacacccaaggtttggttggatcgtcgtgctccatggggcttcttgaccagctgtgggacgacacagtggccgggccgcggccggaccacggcctcggcaggctccgcaagtacgcctccttctccccgtcctccgcggcggccggtacgaccgccgctgccgtgtcgtcggccgacgtggcggcgccggcggtgacgcggagcatcaccatcctccgcccgccggccctgtccgtgacgtcgccgcgcagcgagtccggctccggctccgcgccctcgtccccggccagcgtccccgactcccccttcggcacagcaacgacgcccaggggagagagtggctggagcaagctgcgccgcaaaggcaggatggccgccgacggcatagaggctagcgccggcacccccaggagccccaccgtctacgactgggtggtgatcagttcgctggaccgctaaccgtgaaaacagaagcggatccaccaagacggagaagcgcacgagcacaaggagagtagctgcaaactatgaccggaagatcatggaaccctgccccagtgcacgtggatagaggaagcactacattatggaatggagggagtatgtactactactagtactacttccgttgtaaacatccactccacgtgagatggtgctagttttcgtagccaaggatgtgccaccgtgtagatggatctaagtcgtagctcaaggaaaacttggtagtaggcaaccggcgacgtgcaacgacctgaggcgaatgagaccggtgtgaagtgtgtgtgtaaatcctaccagtaggtgtagatgagaggggatcccctgctgcttgctctgtacaaggcccgcgggcagcatgtgctaatgcatgcagtgtaaaatatgtctgcaataatgcatggcgaagtgagcctccacttc

SEQ ID NO: 2497 - DNA, 1282 bp, Triticum aestivum
  Clone ID: PAT_TA_2497
tgacgtctgcgcgagcgaggggggattcacttgcggcctgcgccacacacacccctcgacaccgaaggtttggttggatcgtcgtgctccatggggcttcttgaccagctgtgggacgacacggtggccgggccggggccggaccacggcgaggatccactgcgcctgcgcctgcgcctgcgccacacacacccttcgacaccaaaggtttgatcggatcgtcgtgcgctccatggggcttcttgaccagctgtgggacgacacggtggccgggccgcggccggaccacggcctcggcaggctccgcaagtacgcctccttctccccgtcctcctcggcggccggccacgaccgctgccgtgccgtcggccgacgtggcggcgccggcggtgacgcggagcatcaccatcctccgcccgccggctctgtccgtgacgtcgccgcgcggcgagtccggctccggctccgcgccctcgtccccggccagcgtccccgactcccccttcagcacagcaacgacacccaggggagagagtggttggagtaagctgcgccgcaaaggcaggatggccgccgacggcatggaggccagccccggcacccccaggagccccaccgtcttcgactgggtggttgatcagttcgctcgaccgctaaccgtgaaaaaacactccacgtgagatggtgcgagttttcgtcgaaacggatgtgctagatggatccgacatccgagtggtagctcaaggctgacctggtagtatgcaaccggcgacgtgcaacgacctgaggcgaacgagacgatgtgaagtgtgtgtgtgtcattgtaaatctgaccagtagatttactagatcagaggagatgttgagctctggctgctctgtgctagctccgaagggaaaactttggtagtaggcaaccggcgacgtgcaacgacctgaggcgaatgagaccgatgtgaagtgtgtgtgtgtgtgtaaatcctaccagtagatgcactagatcagaggggatgttgagctctagctgctctgtacaaggcccgcgggcagcatgtgctaatgcatgcagtgtaaaatatgtctgcaataatgcatggctaagtgagcctccactccaaggatgagtgtgtgtgtaaatcctaccagtagatgcactagatcagaggggatgttgagctctagctgctctgtacaaggcccgcgggcagcatgtgctaatgcatgcagtgtaaaatatgtctgcaataatgcatggctaagtgagcctccactccaaaaaaaa

SEQ ID NO: 2498 - DNA, 807 bp, Triticum aestivum
  Clone ID: PAT_TA_2498
gattgttgcctgatcccttgacatttagctttagacttgctaaggatgccaagcctgctaatgattccaaccattctactgttgagaatgttggtccgtctgccggtgagaatgttctgaggtgtaaagatcctatatcagctcataaaatgacccatatggaagttcaaattccggaacaacacgaaggaaattattcaagatgaacctcaagcatttcatgcaaagatgttgcaagggagaaaattgcttccgaaagaaaacagtgcaaccgtcctctgggctggtgttcttaaacgacatacagttgggaggttccaccattgcaggagggtgatacatcctttctctgtctacttccctagtacctggagactactcgcctgcaatcttcttctgttataattgacgctacggatgttcttcgtgctcgggcaaaggcagagtccccggatgaacctattctatgccgcggatccccattccatatccatgtagttggtacagagtagcaaacactgtttggtgtagtttagaggcagcgatttcaccatgacatgtgcagctgtgaagatcatgtacaagagcattattcccctgtacacttgtgatttatttgagccacttggaggcttcctttgtaatacacttgtgtttgtgtacagtgtaaaagcatccgccaaggttaatatggtgcacttgcgcacctccccccctgccctgtagcctgtaggcgctttgattcaacgaatttttattttgtttgggaggattatattctcaaaaaaaaaaaaaaaaaaaaaaaaa

SEQ ID NO: 2499 - DNA, 1081 bp, Triticum aestivum
  Clone ID: PAT_TA_2499
ggcacgagggccaagggcacgagcgtgcgcctcttcgtgccgggcctggccacggcgccccgcggcggcaggctgccgctgatcgtctacttcccgggggcggctacgtgctcttccgcgcggcctccgagccgttccacaacaacgccgcggtcctggccgcctccgtgcccgccgccgtcgcctccgtcgactaccgcctcgcgcccgagcaccgcctccccgccgccttcgacgacgccgccgacgccgtccgctgggtgcggtcgtacgccgccggctcgccgggcaggcccatcttcataatgggctgccacaacggggccagcatcgcgttccgcgcggcgctggcggcggtggacgagggcgtgcagctgcgggggctgatactcaaccaggcgcaccacggcggcgtggagaggacggcggcccacgcgtccgcccacgcgtcccgcgtcctgccgctgccggcgaacgacctgctctgggagctcgcgctaccgctgggcaccgaccgggaccacgagtactgcaacccggaggccatgctggccggcgtcggagcggagcggctgcggaggctgccgccgtgcctggtgctgggccgtaagaaggacccgccgagggaccggcagagggtgctggtgcatgcgctgcggaaggccggggtggccgtggaggcgcagatggacggcgccgggtaccacgcgatggagctgttcaagactaactgcgccgaggagttcaacgcgcaggtgacggacttcgtccgccggcacgccggcgacgcgacggcgtcgacgtatacgctgcgaggagcaggctgtgatcggtggatccaaaagcggaggttgttacaacggcgctgtctcatctagtacaatttttaaacgactaatatatcaatcatatcttcttcaccatgctatgattgatcgacttggactgacgggctgaggctcggagtctactcctacgccggcaagtacaatcagtagagtgtcgagctactggattgcagtattatccccactttttgaatggatttttgtcacgtttgttttaaaaaaaaaaaaaaaaa

SEQ ID NO: 2500 - DNA, 311 bp, Triticum aestivum
  Clone ID: PAT_TA_2500
tgtgctccgaaccaacctgttggaatggttggtttgactgacagcatgcctgctgaagttggtacttctgagccgcagcagatgaatagttctgacaatgccatgcaagagccgcagtctgaaaatgttgctgacaagtcagcagatgatggctacaactggcgcaaatatgggcagaagcatgtcaagggaagtgaaaaccctagaagttattacaagtgcacacatcctaattgtgaagtaaaaaagctattggagcgtgcggttgatggtctgatcaccgaagttgtctataaggggcgccataatca

SEQ ID NO: 2501 - DNA, 1753 bp, Triticum aestivum
  Clone ID: PAT_TA_2501
gccacgtgggtgaccgggactttgtgccgcttgcggggcgagcgcccgagagagcgagagagctttttcctcccccccgacatgacaccgcatctgcccgtgtcgccccaccccgcccaccacctgctcgacgcgctgcccccgtcgccgcaccaccgccgcctccgcaggcgccggcgattctgcccgccgcgccccagggcctcctcctccccctcctccctccgctgccgcgctgccgccgccgccgcgccgcagccggcggctgcggccgcagcgaggacgcgggccctcgacgtggcgggcctgcgctccgccgaccccggggacgggggccgttttgtgtatatcgtgatggcttcaaccctgaaatatacccagctgggtggcctcgcgctcgcagccgccgcggacggggccgagacaacgctcagcttcccccgtgccttgccaaatatttttcaaagtactacggaccccctgtttttgccaaacaaactgaatccggttgagctgtccggtacgacgttgaaatctgcatcaaacagagaaaaagaaaaaaaggagatattgacattttacatgtacatggttttttttttctttctttcttccctttttgtatttttgttgtttcgtttgctacaactcacaactcttgggcaacgaatggcccccttgtgttggatgtatgctgaaaaaataatgtaaagatgcttgtaagcagcctcgctgcaaagatagtgacttgcagaagccattataggaaatcattcataaagatcttggcactttactttgacaagttgaatgacaagaacaatgatgctattgaagaagtaaaaaaaaagagcaaacagatacttacattttcacactttgtaccaaggcaagagttatgtccagagaagcgaatgctttactatccaaaccttccgaaggtcatcggctctgattatttggaaagaaggctgacagctatacacgacaacgctaaagatggagcagcctgtcatgtattcgggcatacacatttctgttgggattctgtggttgacggtatcaggtgttccaacacaggtatgtccaagcgcctctggcataccctcgagaaagaaagcgaaggataaatggaggccagggatggttgccgttttgtgtatatcgtgatggattcaaccctgaaatatacccggctatatggtctgactattacaacaagaacagaagggagcctgagaacactcagcttgcgccgtgggttgccaaatatttttcaaagtactacggaccccctgtttttgccaaacaaactgaatccggttgagctgtccggttcgacattgaaatccgcatcaaacagagaaaaagaaaaaggagatattgacattttacatgtacatggtttttttctttcttccctttttgtaattttgttgtttcgtttgctgcaactcacaactcttgggcaacgaatggccccccttgtgttggatgtatgctgaaaaaataatgtaaagatgcttgtaagcagcctcgctgcaaagatagtgacatgcagaagccattagatatctctcttcatctcccgcgtggctgatgggtctccgtctcactgctcttttttgttgtgtcgcagtggagtccgagctgccatggtgtggcctgagcggtgacgatgatgttgtaacagacggatagattgtgtggacttgatcgtactatctccaaaaaaaaaaaaaaaaaaactcga

SEQ ID NO: 2502 - DNA, 416 bp, Triticum aestivum
  Clone ID: PAT_TA_2502
gtggaagctgcggttaatgtggcagagatatctctgtacgacagagtggtgtgtgggcgctgtggtgacttggatcctgagatcaaggacaaggtttgtccatcaagatatccatggactgctgaggagaggacacaagcaactgaggatttgggtttgccttcgcgtgctgcggttcacttccggtcctaattgaaatatgatttgcatgatattcttatgttatttactttgcaaatcatctgtcctatatcttttagtttgaaggaattactgaacttcataattctgtagctaccaagcctgtactctttctttcccttcaattcaagcttgtaactattgcccaatgcttgatgcgttggagtatattttgatgtgtccccttcaaaaaaaaaaaaaaaaatttttttttt

SEQ ID NO: 2503 - DNA, 625 bp, Triticum aestivum
  unsure (1)..(625): unsure at all n locations
  Clone ID: PAT_TA_2503
ttgttgtcggatccttcatctaattacatttatgacctggctgctattttgattcataagggtagtgctgctaatagtggtcactatgtggcacatataaaggatgaaagcaatggtcactggtgggagtttgatgatgagtgtgtatccagccttggttttcacccttttggtgaaaaaccaggcaagtcatctgataaagcggatcggaaatctgaaggtacttctaccgaaggctctgtggcaaatggtaataacagtagccatcatgaggctgcaccgacttctaatatgggagaagatgttctcttccactgatgcttacatgctaatgtacaaacgttcgagcaaggatgaaaatggtattaaaagcaataatattgtggaagccagtaatagttcacttccacgccatctgatggatgagattgatgctttgaatgcatcatgtgtaaacgaatgtggccgagtacctaagtnaaaaaagataaccttttggcttccatacaaagaaaggccgccaaagaagtnaaatctgnttattacaggaagcacctgctaccccnagacgantgattcaaaatttttgggntttcaatnanaccggggntcnccaatggggngg

SEQ ID NO: 2504 - DNA, 884 bp, Triticum aestivum
  unsure (1)..(884): unsure at all n locations
  Clone ID: PAT_TA_2504
tcccacgcgtccgccacgcgtccgtgaacaaaagaggagagctggttgattttctcctgatatcacccttcaagttcctggttgattttctggtgatgtcacccttcattgtgccctctgatgacattccagttctagacttcttcagcatttggttcctggggatgctattgctgaaattctggactaatttggctcattggacaagggacgcgcctttcctggctcatttcattgatggaagatgggactggaagcttactcgggcaaaggatgatggctttgcagggttgagggcaaagtgggtcttgcaagatatattgatgcctatcaccatgaagctagtgattgttctgggtgttccttatgtgcttgcgaagggccttttcccaaggtttggctactctgctgcggtgaactcggcggtgtaccatttcgcatggctgggcagcctcgccttgtgtgggctctgctaccttgccaaggtattctggggtgccctggtgaaactccacgattctatcagggatgagcgctatattatagggcagaggctgcaagactacactgacaacagctgaaggcccttctccttgcaagttgcaactcagttttctatagtagttaggtttaaacagaacaacagtcggcgccaggaagcgaagaggccgtgttactgatggagatgatacagtgagatgtcgcagaggtagcttgcttgtaaatatggatgtaggtttaagttgccaacagctgttaagtcacgattcttgtgcccggtttggtaaggatccggaatggttnagaanttgatcgttaaccgtggggttgtaataacctgtgggtcccaaggaatccncanacgtttttctgcgatngtcaat

SEQ ID NO: 2505 - DNA, 411 bp, Triticum aestivum
  Clone ID: PAT_TA_2505
cggacgcgtgggcggacgcgtggaagaacgcgtgggctcggctgcagatcgccggccggcgactcccaccatttttctaatcgctacgtcggagcgcacgcccgcacgccaggcccccagatcccgaattgattattgcggtgatgggcccccacattctcgtctccacggcgaggaggatggtgtaggcgcccccctaggaggaggataagagcggcggcaggcgcaggggggaggcggagcgcgaggagggatggatgggcaaaagcacaatcggaggaaacagggtgggacgtcgaccaaggcgggctccggcggcgaccaggccagtccgccgggcgccaaggcgggcgccggcggagaccaggcctgtcaactagggggcaccaaggcgggcgccggcggggactt

SEQ ID NO: 2506 - DNA, 2026 bp, Triticum aestivum
  Clone ID: PAT_TA_2506
acccacctccgcatcgcgcgagcagcttcacgcggattggtagggagggaggggtcgcgattccccacctggtaacacctccccagctccacttccgctcctcggccgcagccaccgcctccgcagccatggccgccgccgccgccgcctcgccgagcccaagaccaagtacgatcgccagctcaggatatggggtgatcaaggacaggctgcactggagaaggctagcatatgcttgcttaactgtggccctacaggaactgaagcgctgaagaaccttgtgcttggaggaatagggagtgttactgttgttgatggctccaaagtcgaacaatcggacctgggaaacaattttttgttggatgaagggtgcttgggtcaatcaagagcaaaatctatatgttcattcctacaagagctcaatgatgctgtgaaagccaagtatgttgaggagtcaccagcaacaatgatagatacaaatccttcattcttttcccagttcactattgtccttgctacccagcttccggagagttctttattgaaattagacagtatctgcaggagcgcaaatattgtgttggttgctgcgcgttcatatggtctaactgggcttgtcagggtcagcatcaaggagcactgtgttatagaatcaaaaccggaccactctttggatgacttacggttgcacaatccctggccggaactcaaacaatttgcaaagtcaatcgatatatgcgacaaagatcctgttgtgcacaagcatactccatacattgttatcctcgtgaggcttgctgaaaaatgggctgatgcacacgatgggcaattaccttcgaccaggcaagagaaaagggaatttaaggacctaattcgagcccatatgcttaacgtagatgaagacaattataaagaagcagtagaatcttcatataaagtctcggtaactccaggaatcagtgatgaaatccgtcagataattgatgatagctcctctgaagtcaatttttcttcttcagatttctgggttttagttgcttctttgaaggaatttattgcaaatgagggcaatggtgagctacctctcgagggaacaataccggatatgacatcacttactgagtattatgtaagcttacaaaagatttaccaagctaaggctgaatctgattgtcttgccatagagcatcgggtgaagagtattttgaagcgaattggtagagaccctgattctatttcaagggcatgtatcaaaacgttctgcaaaaacactagaaaactcaaagtctgtagataccgcagtatggaggaggagttcagttctccagtcctatctgaagttaaaaagtacttcgccgacgaagacagttgcttcgcaatgaacttctatgttctgctacgggctgttgaccggcttgctgccaactacagtagattacctggaatattcgacaggctgaaggaggctgctgtctcggtgctaagtgacatgggtttgaagggatcatccttgtccgaagacctgattgctgaagtgtgccggtttgcgggtgcagagattcaccctgtcgctgccttcataggcggagtggcctcccaggaagttatcaagctggtgaccaagcagtttgtgccgctgaatggaacattcatattcaacggaatcgacctcaagtctcaagttctggccttatgacatggcttggttatcttgtagagtgctttggaacggtcatccaattgggtagtaaacctagctagattctgcgtcacggcctcggtgcatgcaatgaaaatcattctgtccatttatgtaccttggtactgaggtagtgtaattcgcacagcggctgcagatcagctctatacgaattcatggggccccttcccccctcttttgccgttgatacttgttggcagtggaatgtgggatgcttagttcctacgggcaactataaatcatcttggctaagaaaactttgcttaatgaccaagctcaaattcgatcaaaaaaaaaaaaaaaaaa

SEQ ID NO: 2507 - DNA, 821 bp, Triticum aestivum
  unsure (1)..(821): unsure at all n locations
  Clone ID: PAT_TA_2507
tcgggccgggaagcagccgcggaagtttctcacggcgacaagcacctgtgtgcgtgcgtgcgtgcgtgatggctggggaggaagccaagaaggcggtgccggctgctgcggcgccggaggcagtcgcggagaaggatgtgccggtggtcatcccgcctcctcccgggggttgagccaccggccgaaagcatggacgccaaggccctcgtccacggccacggcaaagctgccgaaaaacctctccctgagaagaacatccgcaggggctcacgtgggagagccgtcgctctcgcaaaggtggagacggagaagatgagctcttggatcaaggcatgggcggagaacgagtggggcacagaaaggcaatcgcccacagggaaagcttcagcgatgagtgcaatggtagtggcccggcatggtgaagaagttctcaagcccgaggaggtggcaggaaggtaccgtgcaaccgggctggctccctaagaaacttctcggatgtttcaggggcataagaagcacctcaatcttacgcgttggaggtgatctgttctgtgtagttgtttttcttctttacattctgaaaatgtgtcctgttttctgtgagttaagtttgtgactcttcatgttatctttttttgctgggagctactcttcatgttgcatacatgtaactgcaaagacagatttttggtggtacatatatagcatgcattgttcgcgttgtctgagaaaaaacaattacttgcagtaatattcccctcccgtttttcatacagggagctattcttcatgttgcatagcangnatgcaaagacagattt

SEQ ID NO: 2508 - DNA, 683 bp, Triticum aestivum
  unsure (1)..(683): unsure at all n locations
  Clone ID: PAT_TA_2508
gaaaaaaggttcagtttagttattaaaagttctttagatgcagatcactttctacatgtttctgcaattctctcctattatatggtttggtgtttgtcccggtgtgccgtgtttggtatcccatttcatcatctttaagtcgaatggacactattttgtttattaatcacttttgaactaatactctntcaacacttattttatacataaaaaaacttaactgacatttaagaaagttgacattgcatctctggttcgttcaatgaaattttcccacgcgtccgcccacgcgtcgtgctcttctatttaactgtctatggttgattgtgatagtgaagtcgatattttgatttctaatagaatatacatcttagttttcctctatctatgtagagggctcaagaaagagacaagaacttgtgcttcaagcagcgaagatagccagcctaaatgaatcgaaacaagaacaagaatcgggaaattacagatcaggaagtgcagctggtacggtcactccctttttgccaaaactgcttggcaatcatcttcttgccaatttataattgaattcctactatgattcgcttcctaaaagaaatagcaatcatcttgaaacaagtaatttatctagctacaaatgcttattctatactggttatgttgcctccaattgcggacaatgg

SEQ ID NO: 2509 - DNA, 601 bp, Triticum aestivum
  unsure (1)..(601): unsure at all n locations
  Clone ID: PAT_TA_2509
cccacacatcttgcaagttcaagggggtgagctcagctgaatgcgcggcgacgtattgtacctttgcaagccgagtatcttgctctaatttgttgacagggtaagagagggctcaagaaagagacaagaacttgtgcttcaagcagcgaatatagccagcctagatgattcaaaacaagaacaagtgtcgggaagttacagatgaggaagtgcagctggtatggcctctccgtttttgccccaaatcaaccacggaaaaaactgctggacaatcaactcttgccaatttatagttgactcctgctatgatctcttcctaaaagaaatgcaatcatcttggaaacaagtactatgtgcatgtccagggacagaattgctaaaagaaactccgacattatanccttagatgatgactcgcatcnntgtgaaagggaaacctcacggaccttggagatgatgggaaataatggcccaactttaacaacgcaaggtcattcaacttgggccctccacattgcgtcaacaggagccaacggaatggccaaagaccncatgaattcncagacantcancacacacggtttnnggngacaggtcatng

SEQ ID NO: 2510 - DNA, 474 bp, Triticum aestivum
  unsure (1)..(474): unsure at all n locations
  Clone ID: PAT_TA_2510
tttgcaccatcccgactttaaccttctagtcgccgctccgccatcgccatgtcgtcctcctccgtcgccgtcgccgcgccggtggagcacatggtgctcatcaagctccgcccggaggccgtcacctcgggggccgccgccgcgatggtctccgcgctgcaggccctgcccacgctcgtcccgggggtgtcctacctccacgcgggccccgtgctccgcctccgctcgccggccgccgacgcgctgggccccacccacctcctccactcccgctacgccaccaaggccgacctcgccgcctacgccgcccacccggctcacgtggccgccgtgcaggcgcacatcgtccccaacgcgctcgacaccaccgccgtcgactgggtcaacgccgccgagtccccgtcacccgcgggccctgcgccgccgtncggctaacctcgcgaagtcaaggaaggggcggactccggcaagtcn

SEQ ID NO: 2511 - DNA, 903 bp, Triticum aestivum
  unsure (1)..(903): unsure at all n locations
  Clone ID: PAT_TA_2511
tttgaaaatgctctgactgtgcgcattgttacattgcataacacaaccaccaaggaaaatgaaaccctgatggccattgggactgcttatgttcaatgggaggacgtagctgccagaaggacggttgcttctgttctctttcactaaaagtgaaaattctcaaaatctggtaactgaagtctactcaaaagagagtaaaggcgccgtatcagctgttgcgtcacttcaaggtcatctgctgatagctgctggtccaaagatcacattgagcaaatggactggttctgaattgaccgctgttgcattctatgatgctcctttgcatgttgtgagcttgaacattgtcaaaaattttgttttgtttggcgatatccataaaagcgtatattttcttagctggaaggagcaaggttctcaattgactctgcttgcaaaagattttggatctctagattgctttgcaactgagttcttaattgatggaagcacactgaaccttgcagtttctgactctgataaaaatttgcagatcttctactatgctcccaaaatggtgggagagctggaaaggggcagaagctcctttccagagcaanagttccatgttggagcccatctgaccaagtttatgaagctgcaaatgcttcccgctccaagaatggnatctgagaagacgaatcnttttgccttccttttggnactttggatggtggaattgntgnantgcgccnatgatgagtnacatccgccggntcagacttanagaggaagctgtaatgcgtccccactgtgtggcctgaaccaagntatcaagganntaaacaacggaanganacgcctggcagtanacattgattnagtcctgaacaangatcanngtgaaanaactnnatccnacaatgg

SEQ ID NO: 2512 - DNA, 1181 bp, Triticum aestivum
  Clone ID: PAT_TA_2512
ttcggcacgagggtttaatgtacatatgggatctcaataacaggacctgcatcttgcaagattctttggcttctttggttacctctccagatgaggcctcaacaaaagattctggtacagtaaaggttatatctgctaagttctcaagatgtggttcgcccttggttgtccttgccacccggcatgctttcctctacgacatgagcatgaagtgctggctaaggattgcggatgattgttttccagcatcaaatttttctagctcgtttagttctactcaaggtggagagctaggaaagttgcagattgatataggaaagttcatggctagaaagcccgtttggagcagggttacagacgatggagtgcagacgcgggcccatcttgagacccagctagcagcttcgttggctttgaagtcttcacaggaatatcgccaatgcctcctatcctacattaggtttttggcaagagaggcagatgaatctcgcctacgtgaagtctgcgagagctttcttggccctcccatgggcatggttggtgatgtgtctaccgatgcgaataatccgtcatgggatcctgatgttcttggaatgaagaaacataaacttctcagggaagacatacttccttcgatggcgacaaaccgcaaagtccagcggctgctcaacgagttcatggacctgctgtcggagtacgaaagcgtcgccgaggaaaacgtcgacaaaatggacgtgacacctccagcagcagaagccaaggtcgataaaatggacgtgacacctccagcagcagatgccaaggtcgataaaatggacgtgacaccgacagaagccaaggacaccgcggcatagcgaacaaacccttccggtccggtttgctggcgatttattgaccccttggtaagcatagagaaaagtgcatacaccatagcatctattttgagaactttcccgtggttgttttattctgcttgtagttcctagtgtcccccgcctgttcgtcaaggtgtgacctcggcggaacgactttaacctgttcgctgtatcgcgagtgtaacaacagtagaaagaaagcgaggtcgcctgatgattctgtaacagttttatccgtaggtcttgaggaattttttgggtccataggcgcaatgccgtttcttttttgcgagcaggatgcacggt

SEQ ID NO: 2513 - DNA, 591 bp, Triticum aestivum
  unsure (1)..(591): unsure at all n locations
  Clone ID: PAT_TA_2513
cacgagcttcatccactctgaaattgtggaattagcttgcatggtttatgggtctatgcctaaacatttagatggtgatgaattcgcctcgtcccggcccaggtgttcgctgtgccttgaagatggtgatctaaactcaagccttgtattggatgaagcagaatatttcaagaatgcaaaatgctttggttatgatatttctgctcaacagttgcctccaaactatttattctgggccaatgtgtggatgcttgtaggcgatgtctatgcggaatatcaccgattgggcagccatcaagcaccggtgctccaggagcaaaagcctgaaggtgaacttaggatgtcaaatgaagttgcaatggaagtcaaacgtcttaagagaaaaattgggaaaagataagcagaattgtggaacatgctcactgataaaactgtagctgccaaagtgatagggcaaatagtnggcagtagtgcaagcagttagtagtcctgagggcctcctacaattgcaatgggaagaaaagaaaaattaaaaagcgccggccgggnaaaggaaaaattccgttcannaanctactgaaaatttaaagg

SEQ ID NO: 2514 - DNA, 934 bp, Triticum aestivum
  unsure (1)..(934): unsure at all n locations
  Clone ID: PAT_TA_2514
cctcaagccggacgtggctgcgccgggggtgaacatcctcgcgtcgtggatcccaacgacgtcacttccggccggccagaagcagccgtcgcagttcaacctcgtctccgggacgtccatggcctgcccccacgtcgccggggccgcggccaccgtcaaggcctggaacccgacgtggagcccggcggccatccggtcagccatcatgacagcagcaactcagctgaacaacgacaaggctccgatgacgacggacgcggggacggcggcgacgccgttcgactacggcgcggggcaggtgaacccgaccggcgcgctggaccccgggctggtgtacgacctcgcggcggacgactacctgagcttcctctgcaactacggctacggcgcgtcccagatcaagctcatcacctcccctccggccgccttcagctgcgccggcaacgcgagcaaggatctcatctccgacctcaactacccgtcgatcgccgtcacggggctcggcgccggcgccagcaggacagtgacccgtgaggtcaccaacgtcggagcgcaggaagacgccacctataccgtcgccgtcagcgcgccggccgggctggatgtgaaggtcgtgcccagcaagctccagttcaccggcagcgtgaagaagctggctttccaggtcaccttctctggcaagaacacagcggccaaggccgccctcacaggctccataacatggtcagatggaaaacatacatccatagccattccgcggtcagcagctggatgaaatgttgaatctatgtatgttacaagatgaacttgtattctctcgtctaggtatacttacatgttagtacaccaattgctggattttgggcatgcatttcatgatcaatccaattataaggntaaangcacttgggatccggacaacaaaaaaaaaaaa

SEQ ID NO: 2515 - DNA, 688 bp, Triticum aestivum
  Clone ID: PAT_TA_2515
gcacgaggctgctgtacatctctctctcttatctctcccagaaaattccctctccgtccagccagcccctctttttttccccctctcgccgagaaaaaagaatagtttctacccgggcctgggccgccggagcgagcttctggccgcgccccaccgcctggggtctcccggcgccggctggatctgaggacgagccgcggttcgctcgcttcttccttcaaggtttcttgcaaatttgggtgatcttgaaagctcgtgaagaaggggttgttggccaagtaaaagatcctggagctggcttagggtgttgtccataaaaaaaatcatgggtgctctctgcgattactgtggggagcataggtccatggtttactgccgatccgatgcggcttctttgtgcttgtcatgcgatcgcaatgtgcattcagctaatgctctttctcggcgccatacgagaacacttctgtgtgaccggtgtgcttcacagcctgccatggtccgctgcctagaagagaacacctcactttgccaaaattgtgactggaatgggcatagtgctggatcctctgctgctggacacaaaagacagaacataaactgctattcggggtgcccatcatctgcagagctttcgagaatgtggtcattcattttggatattcctaatgtggctcctgagctgaattgt

SEQ ID NO: 2516 - DNA, 908 bp, Triticum aestivum
  unsure (1)..(908): unsure at all n locations
  Clone ID: PAT_TA_2516
atcgttgacgcgtgggcgccgcgatcgacgcgctgagcagcgccgcgagggaggagatgctcgatttggtggccgcctccacgcgattggcgcggcgggtgtgcggggtttacggcgcctggatgggccccgaggcggcaacgctgtggctggtctctgaacggcacacgccgggagtcccccccttgttgaatgagaggagcgacgagctggaaactgtggctcggattggagctcttggaatggaggtgtgtgaagcgctcatgggattgcacggcgaggggctggtgctgggttctccggctggactgcttcagccttgatcattttgggcgctgcctgctcgacttgaatgaggttttggccttgtgccgtggagtccgggcaggggtttgcttgtccaaggatggtgctttggttgctcccgaaatggtggcaattctgagggacgccacaaggatgaggagtcatgatttcgatggcttgatagggcgtaattcagatgtttggctgatgggctgtatattggtggcgcttgttactggagatgagcggcttgcggcggggtggaatactgttggatcatatgatgattggcagaaggaagtgcttacgaggcttgacgctgcattggttggtacgcagttagaaccattggctgcaactacaagcgttatgcttaagctatgaaccanaaagccgcccaagagattgctgatgtttggaaatgtatcaaaggctcacaagataaacctgggtgctgatgctttggctccctggctgaatgaatnttgtaagccnaaaaaaaattttaagggtgcttggctcccccgggggaattntncccaatgtgctcccgcccaaanctggcttaatcaaaatnataatanatgnanacccctcccnaa

SEQ ID NO: 2517 - DNA, 1227 bp, Triticum aestivum
  unsure (1)..(1227): unsure at all n locations
  Clone ID: PAT_TA_2517
agcagccgctgccaacagttcccagagctattcgagcggcaaccagcgtcctgttctactacatggccacgctcaccgacaggatccagacaagactctgcaagatggtcagtcaagtgatgacaagtcttcacaccatcagaagggtgggcatgaacataattttgcgcgtccaatgcatcttccaaattttgcgttgatgccatctgctggtcaatcagagtgagaagaaatcgaatgatcaccaccagcagccaccaaccagtcgaggccagggggttcggattgatcttgcttcatctcagccttttgtgatgccctttggttccattggcgctcctggttctgctccaaatggtcttgacttctcgtcattggcacagaaccatgcgcttttccagagccatcaagaagcaggccggcatggttaccctcagctcaattttgcttcagcccagtctgttcaagctgcacagcataaaccccagcatcaaaatgctgcagaagctaaatctgtggctggggattcatcttcaatgccaagtgctggagataatgagagaaagaaatctgcatctgcaaagtacccgagtgattcacagcagcattctctttctttctctaagccagaaaacaagtcttttatgcaccctttccttggtagcagtgctaatgagccctcagtccgcactttgagccttattggtgcggaatcttcgaatgcctttgggttaggcagcagcaaatcttcaagtgcttctactgcagcagctacgtgcagctgcagccccatctgcaccaaccatgtcccagcagcagcaacagcagaaattcagctgcagctgcaccaacaccatcagcaccagatgcagcaacaattccagcagcagcaacagcagcagcagcagcaactccagcagcagcaacagcagcagctccagcagcagcagcaactccagcagcagcaacagcagcagcagcagcaacaacagcagcagcaccagcaacatatgttacagcttcagaaacagcagcagcagcagcaattgtttcaaaatcatctgaactctcgccccaggtctgctgctccgagtaatgcaagtggatactctgaccgtttgagtgcgacgaactttcagaatttaatgtatccatcaagcgcttctcaaggcggagttnctggncaatcacctnaattgaaggcatcgtcgtcgatgagagtgtcag

SEQ ID NO: 2518 - DNA, 700 bp, Triticum aestivum
  Clone ID: PAT_TA_2518
gcggagccccgcccgccggctccccgcccaccccccccgctcctcctcgcggccaccccccgtgcccgagccaccgctccttctcggttcctccgccgtaggcagaaacgtgctgccctgcgcgccgtgccgcacggccgccgcatcgcactccactccagtcggtggcgaggggaagcccatggaagtggtcgcgtcggcgccggggaaggtgctcgtggcgggagggtacctggtgctggagcgccccaaccccggcctagtcctccgcaccaccgcccgcttctacgccatcgtccgcccgatccacgacgagctcagccccgactcctgcggcatgggcgtgggcggatgtgaaggctgacctcccctcagctctcccgaggaggccgcctacaagctatccatcaagaattcgacgctccacttgacgtgcgcaagggagtctactaaccctttcggggagcaaaggatcaatttctcagtagccgctgccagattgtctattaatgatactgagaagaaaggtgcactacacaaactggtgtcccattgaagcacgtggtctgcctctaactccagaggtactgcttccattgcctccatcttgctcaattacgtttagctcagtgctcgcttgtggtactggaccaattgccaggcccggagtggcaactacgggaatggctggttaaatgca

SEQ ID NO: 2519 - DNA, 393 bp, Triticum aestivum
  Clone ID: PAT_TA_2519
tcggtacaatgctggctcaaccgatttgggctgacaaattgcgtgggttcatgaattatagaggtaccgcaaaaattaggttgcaagtcaatgctacgcctttccaggctggtaggcttatcctagcatatattcctcaatatgttcatgagccaaggagtcatactatccatttaacttccttaacaacaattactcaattgccccatgtggaaatgtccttgcaagacactgaggcggagctggtcataccatatatagctccaaccactcattatagtgccttgtctggtttctatgattggggtacagtcttttgttatgtttattccccattagcaactgggacggctagcaatactgttcgctatactgcttggatgagctttgatg

SEQ ID NO: 2520 - DNA, 945 bp, Triticum aestivum
  Clone ID: PAT_TA_2520
tcggtgtcggacgaggggcgcgtggatggcttcagcggcggcgaccgttctcagggcatgcgagagctagcgcaggcgatacggcgccttggtgaggcctacgagcgcgtggagacagcgaagctggagcaggccgccgagatggagcgccagcgtctggacttcgcacgggagcttgagtcgcaacgcgtgcagttcttcctcaatacgcagaaggagctctcacagggcaagagccacatctctcccgctgcggctgcctcccactcccaggtaggtgccgccactgttggtggctcatctaggaggatggcgtccgtaccagattccacatcgagaagaatggcaccgtttcctgatgcccggacgagcagcaatcaccatgaccggtaccgtgccagcgacggtagcagacaccatcaccgccctgccctccgcccgcattatcagtaccatgagaacaatatggcagactctgcagctgccagcgacggtgagcagagcgatgaggaggaggaggaagaggacgatgacaatgaagaagagagccagtaatgagagactgaataacaggtccaggcattggtgattcaaacagtttctattggtatgtgttagggttacattgcaacaacttagcttatattgaatgcaagcaggaactatatgtctaggcagtaatttattggcaatcgtttatcaaagtgagatctctaggagtataattagtaactagttatgataagctcccgccctgtaccatgtgctagccacataatttcatgtctctttatctagttacaagaacaccatctggctctgatgtcgtttgtgccaagaatgtggcgtgtttgccaaaccctgtggccccttcaaggttgtttttttgccaaactgtgccagcagcaacagcaacctgaatgattatatgtgttaaaagtaccc

SEQ ID NO: 2521 - DNA, 642 bp, Triticum aestivum
  unsure (1)..(642): unsure at all n locations
  Clone ID: PAT_TA_2521
cctatcgtgtccgcccgcccgcgcggccgccccaccaaaggcagcgcagcgctagcgtcttggccgggtccatttcttcgacagaccaaccaacgctctcgcaggacacgcacggccgcaccgcatgtcgtggtctgacacggacgcggcgctcttcgcggccgtcctgggccacgacgccgcgcgccacctggccaccacgccgccgcacctcgacggcccggcctcgtcgtcgcccgagctgcaggcgcgcctgtacgacctcgtcgagcggggaggagcctggacctacggcatctactggcaggagtcccgcgccggcgccggcggccgccccgtgctcggctggggcgacgggcactgccgcgacggcccggccgagcaagcccgggccacggacaggagcctggcgcgcaagcgcgcgctgctgcggctgcacgcgctgtatggcggcggggacgacgatggcgccgactacgcgctccggctagaccgggtcactggcgtcgagatgtacttcctggcgtccatgtacttctcgttccacgnnnacgccggcgggccgggccgcgcgctaacctccggccaccacgcctgggccaccgtcgatccccacctgcccggctctgnnnnngctcccgg

SEQ ID NO: 2522 - DNA, 651 bp, Triticum aestivum
  unsure (1)..(651): unsure at all n locations
  Clone ID: PAT_TA_2522
gaaaaatcgtgattcgaactgaggcgcgcgcggcgccacgggctcgtcattcgaactgacgggccgaccagccagccaccccactgcactagctttcctaggagctagtagtcccatggccatggccagatgcctcttgctgctagccatcgtgtcccttgccgccgcggaaggcggcggaaacaactccaccgactctgccgggcaggtccgcctgagctgcggcgcgtccgccccggccaccgactccgacggccgtgcgtgggaaggtgactccgcgtccatgttcttgccgtcgacgaacgccggcgtcgcggcccgtgcgtcgtatcaagacccgccgctgccttcttccgtgccttacgtgacggcgcgcgtgttcgcgtcgagccacacctacaccttcctcgtccgccccggccgcgtgttcctccgcctctacttctacccggccgactacggcaaccgcagcgcctccggcgccctcttcggcgtcacggccggcnggcgtcacgctgctgcgcgacttcaacgcgtcccaggccgcgctcgcgctcgacgccgcctacctcgtccgcgagttctccctcaacgtcagctcgggcgggaagctcgacgtcacgttcgccccgtcccccggcgcctcctcca

SEQ ID NO: 2523 - DNA, 514 bp, Triticum aestivum
  Clone ID: PAT_TA_2523
ctttcattcaatcgagccaaccaagccacgccgctcaatcccgcaggagcccgaggcctccacgctggagccacgagcgccaccgccaccatttggagcgccgccgttgccggagatgagtgccccgctgccccatgcttcttctccctctcctctcattcgtttctcttggctctctagctctctgcctctcaagtctccctattatctccccgtgtaggagccgtggaagccatggactgaattcggcctcgaggtcccgacgccgccatctcctgcatctgctgccgcgctaagtcccgcttcctcgcatgcgcctcaagtccgtccccgcgtcgtcacgggcctcccttgcttcgccttggtctgccatggcccctcgcccgcacgccaagttcttgccgcggacgcctcgatctgccatgccgacgccttccatggagttccctgcagcctcccgtcagcgtcatcttgagccgaacctcgccgtccgccgccatggacgtcccgacgt

SEQ ID NO: 2524 - DNA, 703 bp, Triticum aestivum
  Clone ID: PAT_TA_2524
gcacgagggctgcgtaagcagcagcaggtggaggagctggagagcatgatccggctgaagtgtgctgaggccgagatgttccagctgaaggccaacgaggcccggcaggaggcagagcagctccagagcattgcgttggccaagtcggagaaggcggagcaggactatgcgagcatgtacctcaggcgccgcctggaggaggccgaggcagagaagcagtccatctttgagaagatcaagctgcgggagaacccgaggccgctggcaacggtgcctccccaggcgagcagtagtgctgccaccgcggcccccacccctggcgactcatcacagatgatgatgctgtccaagatccaggacctgctgaagaacgtccgcagcatgccgtctggcaagtcggacgtgcggcagtcgaaatagccggtgatgcgtgtttcatgggtgatactttctgccatgtaaattgaaatatgtctcatgatgtttctttattagttgctgcatagttatactgaattgcattgtcgtttatttgccgttgttgtaatgtaaacttagtttcataatgacaatgggggctaaaacagaccaaatacgccatttctctctatactagagtgataggcgagctttgttgtgcccgttgattggtgtgatgattttatcaagcatatgcagtaaccgttgtgatgatctttaaaaa

SEQ ID NO: 2525 - DNA, 473 bp, Triticum aestivum
  unsure (1)..(473): unsure at all n locations
  Clone ID: PAT_TA_2525
ctgcatggcctttctgacctcaaaatagaatatctcacgcggccccgggcgggctctcttgaccctagagtcactccaacaacaagaggaacatgggagaaggctgctagggagcatccgaacaggccaaaggttttgctgctcaaatctgttgatgcagcacaaagtgagcttgcagactacactatagcgtcagagccagctgaatgtgccattcaagaatctagtattccagcactacttaaccaggggctggtggcatcatcctctgtaatgagtaaacagagcacttctgttttgagcaatatgggcccctcagaggtttcttctgctttaacatgatttggcgacctcgacgatgggtagcttttccgataaagtgcgcttttattatcttaaatgtagcatcaagcggatataaatcattatgagtgacacacggcctctgcataactaagttgcacacagccann

SEQ ID NO: 2526 - DNA, 1958 bp, Triticum aestivum
  Clone ID: PAT_TA_2526
ccacgcgtccgcaactcgtggaagcctccgccggagctgccgcccgcgatgtccaaggccgccgcagccgccgcagcggcggcgtccctcccgccaccgccgcccgaggtggcccacctggtggagcagctccagcgccatcacctcgccccggacgcctccctcctctccagctccgcccactccgacctcctccaggcgcgcgaggaggtcgcggcggagcgcgcccgctacctcgaggccctggcggtgtacgcggaggcgatggccatggtggaggagtaccagcacgcgaccgccgcgggcagcgccggtgccgccaagaagctcaactgctccccggaggtgtacgagtccttggagcaccatttggcggtcgccgaggcggtccaaaggttgaggctcccactgctctcgcaggacggggaggtgcatgaggaggagatagaaaagctgagcaccttgtcaagggtttcatttgacagtaccgtaacaagtgccacgccaagctcaacctcaatctcgactaactacaataactatggcagcaccggtagtgcgttgactgctgccgctgccgctggtggtggtggttcggagctggttgagcccggggcaggtggtgttcctgatcgctttcttgggataacatcagattatctctaccaggtgcagcaacagcagccagccatgactgtggacatggtcgagtatcagagatctgtggcaagagagattgaggctcggttagaagctaagtgtgacgctttagctgatctttttgcaatggatgaaagggattcgtcatccatcaatcagatttcaagtgccaggcttccagaaagggtgaaattaattatcgaaggaatagaaaaggaagagtcccttctactggaggatcttgcttcgatggacaggaaatttgctgagcactataatgtcctggagcaaattcttgctgtacttatacagtttgttaaagacaagaagttagaacaccagcaccaatatgatgatgtgaagaagacctggcttattaaaagatgccgtactatgaatgctaaactaagctacctggagcaccatctcttgcgtgacacctacacgaaggaaacagtacctgcattgcatagaatcaggaaatatcttgtggaggcaacgaaagaagcatccaattcctataatgaagcggtctcacggctccgcgagtaccaaggcgtagacccgcactttgacgtgatcgcgaggcagtaccatgagatcgtgaagaaactggagggcatgcagtggacgatccaccaggtggagatggatctgaagccggcctcatcatgatcacccaggtgcgtgtccccccccccccccggcggggggaagagacgtccgtccgtctcatgttttgtgggacgttctctgtgctgcccgcagccgcggcgcgcttcgttcgtcgtgtgtgcttggcgtggtttttgttcgtgttacccctgccgtttcctcttttcgtcttttgcattcccccttcagatagtgaggacaagtgacgcgcgaatgaaccgcaccggtcttttgtcgtgcggccgtcgtatcgagctctcgccgtaggaggttttccgtgtactgtatttgtcatggcaccatgccttcgctgcttctttcgttgtcaccgctagctggatcaagcaaaacgcgaaaagaatggagaagaaacacgagagcacgcgttgcgttttttttcgttggttggaggttgcaaccacgccggccgggtgatatggacgatcaccgtccgaccgtctgtctgtctgtctcctatttaagctcgcacatggccgggacgccgccgccctgcaccggcccctcttctcccgcgaccagcgatgatggagttgcgtctgacaaatggacatatccaaatagagccagaatactatgctccttttagagttgcgtctgacaaa

SEQ ID NO: 2527 - DNA, 613 bp, Triticum aestivum
  unsure (1)..(613): unsure at all n locations
  Clone ID: PAT_TA_2527
tctctaggtcgccggtcatccacaacaaggacgatgtcgccggacgtcatctccatggccttcgtgcccatcacctccctgctcaccggcgtccccggccgcggcttcctcaaccacgccgtcaatctctacctcagatacaagccgcccatagaggagctggagcagttcctggagttccaggtgccgcggcagtgggcgccggagttcggcgagctgccgctggctctcggcccgcagaggaagaagaagaaggacagcctgccgtcgctccagttcacgctcatggggcccaagctccgggtcaacacggccaaggtggactccggggggcggccggtgacgggcatccggctgnttcctggagggcaagaagtaacagccggctgggcgtgcacctgcagcacctgtcggcgacgccgcgcgcggtccccatcgtcgtcggcgaggcggtcaccactgccgccggggacgccgtgaacgagcgcgcctacttcgagcccgtgaggtcgtcgctgctgaccacgcgtgcacggcgccggtgcagcacgccggcgcgcgcatcgacnactgcgccgccgttgtgaccgcggctgctggaagtgcccaagcg

SEQ ID NO: 2528 - DNA, 369 bp, Triticum aestivum
  Clone ID: PAT_TA_2528
ttgtctggccagcttctctcgtctctggttccctgtaacctacaccatttctttctttttcaagcgtgaggcatcacagctccttacttgctgcccttcataagcagctgatcggccacttatcagcaacaaagatgaagattggaaagactacagagatcctgaagaaagcggcggcgatgtgcaagagcaagaccaccaggctcctcatcctcgcctcgctccagcgtcgcaggatggccgctgccgccgtggtctctcacaagatccacacgcgcattgtggctgaccgaaatagagtggactgccacaagcctctcgcgctgcgaaccatcgagaagagaccggtgatcgtccatgggggtgact

SEQ ID NO: 2529 - DNA, 777 bp, Triticum aestivum
  Clone ID: PAT_TA_2529
ttttttttttttttttttagccaaaagtgctcaaacaaaaatccatataacagaacaaaaaagatagctgttgatagggcggaataggaaatgtgtgtgggggtgtgggtggggggtaaccaaaatagttaatacagtctgtcatacaaagcaaaaactaaagagtagggagcgatcgctaccacatttgcactgatgacaactagaataaaacaaaatatcacatatccgagccagcaagttgacatgctttgtgcctcccttcggaaaagcacacccacgaaaactaaagcattgcagtgatcaagcttcagtcttttgctcttctgctgcttggtgatactggtagtcaccttcctcgtatgcctcgccttcttcagggccttcaggttctgtgttgggttgtgcctgatagtgttcatgctcatgtcgctttgagctttcagtttcatgcccatgcccgccttgaacttgatagcaatacgactcataacttttgtgttgttcatactggttagagccataatgcttcccatattcagccatgctcctgtcatgctttggctcaccattgtattcagcatccctatccttcaagtgagcgcggtcacgctcgtaacttgcacgctcatgatctctctcgcgatccctgcctctctcacggcgacgatcatgagagaggccacgatccttctccctatcatgatccctaccacgggccctattcctatctctgtcccgacgatcacggtcacggtcacgcccatggtctttttt

SEQ ID NO: 2530 - DNA, 402 bp, Triticum aestivum
  Clone ID: PAT_TA_2530
tgggtaccgggccccccctccgagacttgccctcgcgtcccatatactagcattgattgccgagaagatcttgcccatcgccatttgccactaataccatcgctccatcgccaactccgctagcctgctagggagactcaatgccgtccctgccgaaagctgcggcgtccatggatcacgcggtggagggcgccatgagcgccaccctgctgagcctcctcggcgtcacggccaagtcggagaagggcgcggcggcggcggacgacaaggtggagtggctccggtcgcagctcatcggcaaggacgtcgagttcgacacgccgttcgggcgccgcgcgctgacctacgccgaccagacggcgtccggccggagcctgagctacatcgaggactacctcgtga

SEQ ID NO: 2531 - DNA, 963 bp, Triticum aestivum
  Clone ID: PAT_TA_2531
gcattgacaatggcttccgccgctaccgctagcagcagcaagaagctgcgcgtgctcctcatccccttcttcgcctccagccacatcggacccttcaccgagctcgccgtcagccttgcgacggccagaccacgggccgttgccgccgccgccgccgtcgcgcccgcgcccgcgcccgcggcccgcgcgcggcccctgctccaccggaatgcggccggcggcgcccctccgctggtggcggcgtccccccccccccccgccgtcggccgcccccccggcggcgtcgacctccgcgcggcggcagcgcaggccgacgcatggcgcatcgacgtggctgcgctcagcgacccgctgatgccccccctgcaggcccccctcatcagggcgcagtcaccggaccccctcgtcaccgacgtccacttcatgtggaacgccggcgtctgcgacgggctcggcgtgccatgcgtcacgttcaacgtcattggcgccttctcaacgctcgcgatgcgccatctattgggccgcgtttcaagcagggagccagaggtggtgactaccatccctcggtttccagaccccgagatacgagtgcccacggtggagctgccggagtacttgaggagccaacggaagggtgaccaatccaccttcgaccggctctatgcggtgcaaggtgactgcttcgggctggccccccgcgccccgccagacctggaggagcattactgcgggatgtacgtgggcaatggctacgcgaagcgtgcgtacatgctaggccccgtgtcactacgaccgccgtcgtcaccgggaagccgacgactcacggtacaccgactggcttgactccaaagccaagccggtcggtgggtgtacgtgtgcttcggcagcctcgcccacgtctccgacgctcagctggacgagctccctctccggcttgaggcctcagggatggcgttcctgtgg

SEQ ID NO: 2532 - DNA, 1218 bp, Triticum aestivum
  unsure (1)..(1218): unsure at all n locations
  Clone ID: PAT_TA_2532
actgaagcacaatgtttgncgcgttaaaggcattattcaggtttccagaacgattggtgacgcctacctaaaaagttcggagtttaaccgcgagcctcttctggcccggttccgcattccaggacccttccataaaccaattctttgtccagaaccatccatagaagaacacagactgtgcgcagaagatcagttcgttatatttgcctctgatggactatgggagcacttgagcaatcaggaagctgtggatatagttcactgttcacctcggaatggcattgcgagacgactaataaaagcagctctgcgggaggcggcaaagaagagagaaatgagatactcagacttgaagaagatcgaccgcggggtcaggaggcacttccacgatgatattactgttgtggtattattcatggaccccgcgcttatcagcaggaggctctacggtgggccgttgctttcgctaaggggcggtggcagcacgccaacgtttgcacagaaatgctgaccatccatcactgatgctttctggaaatatcctcctatatatcgttcatatcttgggctgctggtgctctccacacgacatgcagacactgcgtcgagcggtgcgtggaggagccgtattgttttgacttctaatatgtacagatagagagagaaagaggcgttgttggattgccgcgtcatcggtgtgatgacatgagcaccctctgttggctcgctcgctcggagaaacctaagctggcagctgcaatgcataatttgcaggtatcagctggcgtttctcttttcgcggggtggatggacctcaacttgagcagtactttaagaaacatgggattgagacattgctggatgctgttgttacatctcatggcctctccttcattttgcagcttcttcggctttctgtcccacattgtataactgtttaagctttattaagctggatgcagctctgtgaagtgtggatgttggggcagagttggattagcattagccatggactttgtgaagagtgtatgtccattttgccaagacatgaaggactaaaaatatatattctacttttaacttgttgaatcatcagtatttatttccagtctgtcgaaatagaaatccacatacatggttatacacattagaaaggatcatcatgtcacccaagtacagtgtttgtttgaacttgcattgtgtgcattgcagtccaaa

SEQ ID NO: 2533 - DNA, 1493 bp, Triticum aestivum
  Clone ID: PAT_TA_2533
gttagtcaagagcaacatcaagtggccgtcaaggtgggatgcatacctgaagatggacggtgctaaggtgcactggttctcaatcatgaactccatgatggttgtcttcttcttggccggtattgtgtttgtcatattcttgaggactgtccgaagggatctgacgcgttatgaggagatggacaaagaagcccaagtctctgatgaatgaggatgctttcaggatggaagcttgttgttggtgatgtcttcagggagccctgctgctcaaagctgctgtgtgttatggtcgctgatggtatccagatcaccggcatggcagtcgttacaatcgtgtttgctgctctgggttttctctcacctgcttccaggggaatgctcttgaccggaatgatcatcctctacctcttccttggaattattgctggatatgttggtgtccgtctctggaggaccatcaaacaatccacagaaggctggaaatctgtcgcttggctgacctcctgcttcttccctggcattgttttcatcatcttgaccgtgctgaactccatcctgtggggtaagaagagcactggagctttacccatttcactcttcttctccctcttggccctgtggttctgcatctccgtgccactcactcttattggaggcttgctaggcacacgggctgcaagcatagaattccctgtccgtaccaaccaaatcccaagagagatccctgagcgcaagttcccttcatggctccttgtgctcggtgcaggaacgttgcctttcggcacccttttcattgagctcttcttcatcctttctagcatctggctggggaggttctactatgtattcggcttcctgttcatcgtcctcttcctgttggtcatagtctgtggtgaggtttctttggtcctgacctacatgcacctctgcgtggaggactggaagtggtggtggaaagccttctttgcctctggctccgtcgcgttcttcgtcttcctatactccatcaactacctggtgttcgacctcaggagcctgagcgggccagtctccgcaacgctctacctgggctactccttgatcatggcatttgccatcatgctgtcaactggcgccatcggcttcttgctctcgttctacttcgtccactacctcttctcgtccgttaagattgactagaagccccctgcagtagtgtcacccgattctggtgatagttatcccttagaaaacacaaacacaaataattgtcaaactgaaaaatggaaacatatggtgatttacatggcttagcacagttactccagcttatgtttacttcttagacatgtttgtaatgcttcggctatgttctcttgcctttttttgtaatagtattatgttttgcttgctctgggcgtttgtgagcagcaaatttctgttatcggggacttgttgaaatatgaaatgggccaattggtttccagccacttgtgatctgttttgacgttttt

SEQ ID NO: 2534 - DNA, 1050 bp, Triticum aestivum
  Clone ID: PAT_TA_2534
gtcgactagtactacccctggcctccggctggatgcactgcatccagccctccctttccccgccttcgttctttttcttcctgctctcatctgcctgtctgcatctcccagtccatgaaccagcgatcgtagaagtcccggtcggcgctggagcactgccgatgtgcataccaagcttgatgcccaggaaaagatgctagctgacgtgccatcggcttcaccaggatttgtagattgccagatctgatctgattctgcgagaactctgagctaccaaagctgcttcgactcgaagctctaccactgccctatcttgcactttaagaagactcgatcgtcacggaaagagcagacggaggtatcaaattccatgctagctcctcatgttcttgagcgcaagaaatgagtcttccgagtcggaggacatccaagaactgatcaacagtggcctcaagtgcaacgcatccacgccagccgacgacatggagagcggcagaggcggggcacgagccgccggaagcacgtcgtcttcatcgcccccgcccatggttctgccgtccgaacagaaagcacggtacagcacggaggaggatcccagtcgttgcagctgcagcgatagcttcttcggcaagtacttttcattcctcctgctcatgttcgtcaccgcgtcgctggtgatcctcccgctcgtcctgccaccgctgcctccgccgccgtcgatgctgatgctggtgccagtggcaatgctgctgatgctcctggtgctggcgttcatgccgacgtcaggtggccggggtgcgacgggcccgactgcctacctgtagataactagtacgtccttttcttgtttgttctgttggattttgtgatagggtagtcatggaatcaagttttatgcccatcaattgaaagtaccctgctgcttttctcggcatactaaatgaggatttaaaaaaaaaaaagtccagctaaatgaggcctttggtcagaacagcgccgtgactaatttgcgccttctttattaactatgcttgctatattaacacgaaa

SEQ ID NO: 2535 - DNA, 1588 bp, Triticum aestivum
  Clone ID: PAT_TA_2535
tccccgcgtcccgcccccgctggcggtcactggcaagtcgcgattcctccatgcgtttgaagaaacacgcaatacagtggtactttcactggctgttcctgctgcgtgcgcggccaggccagaggctcctgaaactggttgtcggagagatgaggtctctgggttgattggcattaccggtgggtcttgtagatcaccaacggggaatgctcctgacgctggtgctccaaggaggggattgtcgggacctgcagagttctctttgctgccagtagttgatgcaactggattaagtaccacacgggcagtaggacctgtatcaagtgatgatcaggagccagaacaagaaaatctattagacagtgacaagcacattgccgacactgagaaactgttggagaaacctacaccacttgagagtagggattcaggtgcatcacagtcagtttcagctcagatagttgatgaagataaagtcggcatggtcgcagatgagcgttagacttcagcgatgagctcaagatttcgttttcgtccgtttagggctgggatttaccctttcccaatgtttccagtgtgagggatgcggtgtgtttgtatgcttagttcagatggagtacaaactcccagggactagtagtttagcaccagcctgcccccccgcagctcccgagatcctctccaaagaagagaagagtacataaggttcagcaagcagagcatcccaaaattggatctgggcaaggtgatcaaatatctgctccagcaccaaaattaatggaagctccacctacttctgcaattgatcagactaatgatgccccttcactaaacttgaactcttcatcatcttcttccgctggcagtcagaggcaagacgtgatacctcctgcttttgaagaaacacgcaatacaatggaagtttcagaagctgttgctgctgcttgcacggccaggtcagaggctcctgaaactggttgtcagagagatgaattctttgggttagatggcattaccagtgggtcttgtagatcaccaacggggaatgctcctgacgctggtgctccaaggaggggattgtcgggacctgcagagttctctttgctgacagtagttgatgcaactggattaagtaccacacgggcagtaggacctgtatcaagtgatgatcaggagccagggcacgaacatcggtgagacagtggcaaccgcattggcgacacggtgaggctgttggagagccctacaccacctgacgagagtagggattcaggtgcatcacagtcagtttcagctcagatagttgatgaatataaagtcgacatggtcgcagatgagcgttagacttcagagctcaagatttcgttttcggcccctctgcgctcggctgctcccctccccttcgtctcctgcgtgcggcggcgctgtggttcctgcccgggcgcccgcggagtaaaaactccagggactagtagtttagcactagtctgtccggagcaactcacgagatcctctctatatacgtgaaatgtatatttgctaacctggtgtagactgcggacaagtatattcatttatttatgcgtgt

SEQ ID NO: 2536 - DNA, 962 bp, Triticum aestivum
  Clone ID: PAT_TA_2536
ccgacctcaagctggcgcctgcgccgctcttcctccgcatcgcgccacggtcttctgcggttgtcgtgatccaccccaggcgcctgctactggcgacctccgcgcctcgccgcccaccctgccgctgctggccgctccccgggttgctatcccccacccctgcacctaggccagggaggctttcggtcttaatctggagcctgtcgccccgccggcgttgggggaggagcctgagggctcggatctggcggggtgcgggcaggtgcatccggccctgctgccatccagtagcaggaggctggttgaacccctcgacgcagcccgcgcatcaggcgggcgtacgacggcgtccggatgggctccgtcgagcgagcttccagaggaaggcggcgacgtccgattctggctctggctcgggtggtggcgccactcgccgatccagctcttcgactgctcgtcgcaagaaggcgaaggtggtggcggggctccttgagctgtcgctggcggtgaccccgtcgccgttgaccaggggaaagctcaagctgatcgctgagcaatgcgacctcaatgcatctggcatcttcgatcaggttcaggcccgtgctgcatcttctgaagcgccggcctcctctgctacttccagctcctctgcttcttcagtgcgtgtcctcgactgcccatatgcgtagcctttttgttgatgccgtgttttatcctagggtctgcatggttaggtgtctatctatcttcaatatgttgttgttaggcggcggtgctagtcagccaacttatgttccgcagctaagctgctttgttgctttggggtctgtcagctttagtgtcttcgagtttgtaccgtgttgttggagtctgtattgtgcttgtcacaaggcctcacaagcactttcgatgcctattttactatgctttctgatgatcatgcatgggtgcccctgtttctt

SEQ ID NO: 2537 - DNA, 465 bp, Triticum aestivum
  unsure (1)..(465): unsure at all n locations
  Clone ID: PAT_TA_2537
ttgtcccctccgccgccgcaccacgggccctcctcctccgccgccgcgtactactacaaccaccaccacccgccgcccccgcacgcgtaccacggcccgtggcaccccgcgccccagccgccgccgtcgcagatgcccgcgctcaccggccccccgcccgagttcgtcggccaccagcaggcgctcaaggtgaagaacgacatcaacctgcgcaaggacaccatccgcctcgtgcccgacgccgccgaccctgaccgccgcctcgtctccttcaccttcgacgcggtcaccgacggcagtttagttatacattactttgccaaggaaggaaaagactgcaatttttcttcagtgtacccagacttgcagacaccaacaaagatacctttccagaaaggattggtcaaaattatgtcaagcctctggatctggtantgatctgggatctttcccggatgactttaa

SEQ ID NO: 2538 - DNA, 1413 bp, Triticum aestivum
  Clone ID: PAT_TA_2538
ggggacaacagtttggtagatatggcttgcgcaacacttgatgaagaagacaaacaaaagtctgtgataggatcatcttctgaagctgctctgaaccttcttccacctgctaataatcagacagctgtatctgtggattcgacgacagctaagtatacgccagacaaacatatgttcagcaaggacagcatatatgaagatttctctatggatgatattgatctgagttacgaaaattatgaagaactatttggtaactctcatattcagactgaggaactctttgatgatgctggcattgacagttactttgaagttaaggaagcgactgctgtgaattctgatgagcagcccaagccaaagcagccggctgctagcaatgcgttatctgctgactctgggatgtcaaatccagcagtaaaagaagatgattccagtctttgtattcctgtgaggcaagctatttcctattctggctttactggtgagagcattcctgaagaataccaggattgtggtgtatcaccaatgctccttatgggcgagcctccatggcttcctcctggtcctgatggctcatttgctggaattagagacagtgctatcacacggtacaaggagaagaagaaaagaagaaagtttgaccacaagatcaggtatgaatctcgcaaggctagggcggatgtgagaaagagagtcaagggacggtttgttaaggccggtgaagcgtatgactatgatccgctcgacacaaggagctactgaatgcagaaaagcattgtgcttagattagcttaaaccagtgcctattgcagctgggaaaaatcgataaatcagacgctgaagcaatcatggcatacccacctctggaaagaaaagaatagaaagcaaccaacgaggcaaaaagatttgaaagttgtgcaagttttcaacgccgtttctcctgttccttctgtacagcggatggaactcgcgtcttctattgcttccagagcagttttggtgaatgaagacaacgcaactagatggacttcctgcgtttttctccctttctattgactatgtggcatccacctaccctgactgcggtgttttcggcggtatgcttccagattgtgttctcttaggcgaaagatggctgtagttgtgaagtatcctgctgcgttatatttttatgtgaattctgctgcaatccggagttttgtgtgcaattatgcatgtgtaaataccaggtcggaaataagccggtgcttgtaaagtttgttgtttcaagctggtggtggtgatggagcccatgtaaacttgccaccaattttgtgtgctcaccctgcccaaataaggaaaccttcagacctagtcaatgctactatttgtacttgagcatatatatatgcttggatatgtcattttgtc

SEQ ID NO: 2539 - DNA, 802 bp, Triticum aestivum
  unsure (1)..(802): unsure at all n locations
  Clone ID: PAT_TA_2539
tttcacgcgtccgcccacgcgtccgcttaaatcagctgatggaagaaggcatcaaagaagccgagtcgagcaagaaagcagcagcagccgagagcacagcgaccaaagtgggcgtcatggccgactcgacgttcgggagcatcggcgacgtgctcaaactgctgccgacgtcgacggtgatcgtgtacgaggtgctcaacccgatcgtgaccaacgccggcgcgtgcagcgtggccaacagggtggtcaccgcggcgctcctcgtgctctgcgccttctcctgcgccttctcggccttcaccgacagcttcgtcggcgccgacggcaaggtcaggtacggcctccgtgacgcccaggggcctcctgccattccggcggcggcgacgacgacgacaccggggcgagggacttctccaagtacaggctgcgtccggcggattccgcgcacgccttcttctccggtggtcgtgttcccggcggtggcgctgctgggcggacgccaacacggtggcgtcttcctacccggcgctcaanggagcagcaagaacaagtggcatggcgctcccntcgtggtcngngcctcgcnagcggctctcctcgtttccctccaagcgcatcnatngggtacctcccggcgaacctgctgcnactcgctggctccataactatccggccgtatctnaagtatcctctcccgcgtgncnagtttggttgctgcntaagtttgntttaggttttaaaanttgntttctagngtggtcagtcctcatgtgcctgctttgtctcagncgaaggcaattaa

SEQ ID NO: 2540 - DNA, 640 bp, Triticum aestivum
  Clone ID: PAT_TA_2540
gctcacccctccgcccacgcgcaacgttagtgccgctccccctccctgcgaaaccctaaccctagccaccaccagcgcgctccctccctcgatcctcatgtccgattccgaagcatccccgacgcccgcggctgcggtcgcggcggcggaggcggcggcgggcgagaactccccgtctccggcgaggagtgaggagctgctgccggtggcggagaagatctcggaactaaatgaatcacagtcagagctcccgggaagacttcgaggccttaaggaggatttgcagagctggagaagcaatttagacacccaagtgcagaaatacaaaactgaaatctccgatatcaaaactgcacttaatagtgaaatagaccagctgaaatcagatttccaagaactgaggaccacccttaagaagcaacaggaagatgtgactattagcttgaagaatttggggctagaagatgctaccgaaactgatgggaacaaaggaactggagaggaaaatacaagtgagggtgcattagcaaacatgggggacctgaaactagaagattctaccgaaactgatgggaacaaaggaagtgtggaggaaaatacaagtgagggtgcattagcaaacatgggggacctgaaattg

SEQ ID NO: 2541 - DNA, 1241 bp, Triticum aestivum
  unsure (1)..(1241): unsure at all n locations
  Clone ID: PAT_TA_2541
agacgccgcggcctgtctcctccctcccgccctccctcccagggcgcccccgcggccgctgcaaccctccctcccccccgcccttcccccccaccttacccccgctctcctccccgcccccccctattcctcccccccctaccctgcgtctgaatccggctccaaccctgcagcagacgtggtttggagggtcggtggtggcagcactcccctcccgcgggcggctcggctccctcccctccgcgcgcgaatcgcctcctcggtttcctgaagaatcgtgttgggtcctgctcgtgagggctgcaaggggaggagaagaaaggtgggctgaggtcgatcaagtccgggccaagcaagcgatgatggagaggaggtcgctcatggaggcgctggtgaccgcggcgcagggaggctccacggacacgtcggtgctctccatgctcaagtacgccgtgctgcccatcgccaaggtcttcaccgtctgcttcatgggcttcctcatggccaccaagtacgtcaacatcctccagcccaacggccgcaagcttctcaacgggcttgtgttctcgcttctacttccctgccttatattttcccaactgggcagcgcaattacgctcgagaagttgctgcagtggtcctcgcgtccggtaaatattgttgtaggcgccgtgtctggctccttgattggctttgtggtggcgtctatcatccgacctccttatccgtacttcaagtttactgttacccacgcgtccgcagggaacattggaaatatacctctggttctcattgcagcactatgtcgggacccatccaatccttttggtgactctgaaaaatgcagccaggatggaaacgcgtatatctcattcggtcaatgggttggtgcgattattgtttacacatatgtgttcaagatgctttctccaccacctggagagacctttgatggtgaagaggagaagcttccggttctggcatctgaagaaaacgcgatgcctgaacttggtaaatatccaacaggcactcacactagtactgtacccgaggatgagcctttgttagctctcgaggggaatcaaaaaggctctacttctctaggatcaaagatattaagctgtgctagatgtgtggtgaaattcctaaaagacaagcaacttcttcagccaccaattattgcctctgtctttgcaattggaatcgnnnttgtncnattcttnnnnntttgatattnannn

SEQ ID NO: 2542 - DNA, 537 bp, Triticum aestivum
  unsure (1)..(537): unsure at all n locations
  Clone ID: PAT_TA_2542
ccgaggtgcatttccaatctttcatcatccatctctcccaagagtcagcatggcttcaccttcagctctgaaggttctcgccttcgtctgcatcgtggcggtggtcggcctcaacctgagccagccggcgtcggcggcgagctgtgccgactgctggtacgacggatggtgtgatcgtttgtgcggtcttattgaatacgggtgccatgcgtgcgaacgcatacaaatgagagggtgctcgcccaggtgctaccagggttgccttgcaacctgcaggagcgtagatgcatcgtccggatcgatgtctgcctagagcgtgcgtgcgtcttccagtcgttcaccatcttttaattctatataatcttgccttttactgtattagtttgcatttcacgccacacatcctgtgttcatgcaatcgatgcgcatccatccatatgttcatcgttgttaccccacagaatggttaataaagctccatcgatctggatcagtgtaaaaaaaaggttgtccacaattcaaaanaaaaaaaaaaaa

SEQ ID NO: 2543 - DNA, 952 bp, Triticum aestivum
  Clone ID: PAT_TA_2543
ggtgttccggggctgtacggggagcagcgtaccgcgtacgtacgcgcatcccaccggctacacgggccaccgccgcgggtacagggtgtcagcgcgggcgggcgggcccttttctgtcgctctttctggtgcgggccttcaatgcgtcgtcctggtggctgctgatatccatccgccctcccggactcctcggccgatcagattcggttctgttactcgagctcgccccggaaagaggggaggagataagagggaggaggttggggcctgagccgccggcaggcaggcattctgatccggattcggctcctgcaacctctcagccgcctcgaggaaggaaggatacttgagaagccaggctgctgcgggttttttttttcttcaacaagtttcagggatctgtttgacactgaacagacccttgacctctttgtgcaacactcatcttctgtacaacttgcggcaagaatttggcagcaaatgggtcgaggaatcacagtgattcctggcctaaggtctctcggacgcgtttcttgtgacttctgttcgaaatttcacttcaacatgtggttcatgctaatccaagcttccaaagttggaatctgatcacttgtgacagcgtttctccgtctcctcagttccagcaatatggacacggagaactcctggattaggaggaccaagttttcacacaccgtctacacgagggttggttcccatggggtgcatgtggctcctcttgggagggatgtggagcagagacttcagaggtttgtgagcatgggtaagtctgtgacgatgcccattgatcgaggcaatgatgaaacagtggccgcgctgaagcatactgctagtctgccatcactccgatcctcactccagcctaatgagaaaaaggccagcaagcagaagatgagtttggagattcctttgagccctccggcaaagtctg

SEQ ID NO: 2544 - DNA, 1281 bp, Triticum aestivum
  unsure (1)..(1281): unsure at all n locations
  Clone ID: PAT_TA_2544
atgtgtttcccgcacccaacaacttgaccccctcttcctccctctccctctctgtgcgtgttgacaagttgtccgcagcgagcacgctggatagttcggtcgctcctctcttcttcttcgaatcaaggtcgagctgcatgctgcctgcctgagcaacatcaaagaatatcagtggtggcgcgccatcatgatgaacaatctaaagcttggcgttgaggttgtcagtgctcatgacctcctccctaaggagcagggcacagccaatgcctttgtagaggttgaatttgatggccagaagtttcgcacggccatcaaagacagcgacatcaaccctgtctggaacgagcagttcttcttcaacatatcagatccatctcgcctccaagagaaagagctcgaggcgtatgtgtaccatgcaaaccgcgccagcaacaacaagacttgcctcggcaaggttcgcttctccggcacatcctttgtcagccaagctgatgctgcgcccctgcattaccccctggagaagcgcaccatcttatcacgtgcacgtggtgagcttggcctcagagttttccttacaaatgatccgtctagccagggccatctgctgcacgtcaggatttttatttcgcaagcacgcccaccactgcccaagagcaggctgtcgccaatgctatcccaaatcctttccaagacaccaggataaatcaagtcagacaattccaacacttgccacgggaacagcggcagcagcgtccaccacccctggccgggcagcaatactacgcacaaggtcagggttcatatggagagcagcaacagagaagctactcggctgctgcagggatgaaaactgaagcccctcagcctcaggtagcaaggatgtattccgcaggtcnacagcagcctgtagactttcagctcaaggagacaagcccaacgcttggtggtgggcgtattattnacggccgggtgatgcctggtgagaaggccggggcatatgaccttgtggagaagatgcaaatcctctttgtgcgtgtcgtcaaggcccgtgaactgcccnacatggacctnactgggagtcttgacccttatgttgaggtgcaccttggcaactataaaatgaaaacaaagttctttgagaagaaccagaggcctgagtgggatgaggtgtttgccttccctaaagaagtagtgcagtcatcgacacttgaagttgttgtcaagganaaggacatcttcgggatgactatgtcggtcgggtgatgcttgacctgaatgagg

SEQ ID NO: 2545 - DNA, 1788 bp, Triticum aestivum
  unsure (1)..(1788): unsure at all n locations
  Clone ID: PAT_TA_2545
cccgcgccctgtcggcccggggccgcgccctccccccgcacacgggcatcagcagcccggaggacggcctcctctcctcctgcacgtgggacccacgcatccggagccccttcttctacaactccggcttcagcgtggcgctctcgaaggcgccggcgttcatcgccgagatgcagaagctccgcgacctcaagccgcgcgccttctgcggcctcgacgccaagctcggcgtgctcctccgctacgtcagggcctcttccgcttacctcgggaaatctgaggactccgatcgactgcgacgtcacctactaccggtgctacactgcaggcgagccccgcgctaactccgacgtggtcgccgcggccgaaatgacgaccttgcgctagcaccgggacgccgccccttgcagtcagcaccgccagttcctctgcggcggcgcctgggccgaggaccataagtgccatcgcttcctcaaggtgaaggccaggtacgaccccgacgggatcttctcccagcgagtggagcgaccaggtgctcggcatcaaagggagccccaacatcgtcgagaaaggctgcgccattgaagggctctgcgtctgctccaaggactcgcactgcgcgccagagaagggctacttctgccggccgggaacgatgttctcggaggcgagggtctgctcgacccgggccgctttcggcgacgaaagcgacgaccttctagacgaacagtgatttgaggcgcatgcatgcatgcatgcgccgggtcaagcggctgcgcatctaagtttagattgcgatgctgactttaatgttgcttgtatgtggcgtgttcgcttcttccagagattgtaccgtctgtacttgtagtaagttactagtttgatccgagctacttgatgtagtaatattatggtttgcctattgttcagaagaaaataaatcgcgggaaaagtcccacccggccctgaccacggtcgtcattgccaaagtaccccaaagccgctgagttcctcaaggtgaaggccaggtacgaccctgatgggatcttttccagcgagtggagtgaccaagtgctcggcgccaaaggcagctccaatatggctgagaaaagttgcggcatcgaagggatctgcatctgctctgatgactcgcactgcgctccagagaagggatacttctgccacccggggaaggtgttcacggatgccagggtttgctcaacccgacgcacattcggcgacgaccttctgaaggaacagtgattggtaatgcatgtatgcatgtgtcggctcaagcagcaccgcgatcaaagcgatatgctgactttaatattgtttgtatcgtggtgtgttagcattttccagagatttcatccatctcggtggaagatttaaataacgacgctatagcaccgctataacgtttgaaggggcaccacgccgcagctacgcttgctttgctatgctatgctttgttatggctggatgccaagtatatgtgatatatgtatgcatgtcaactatcaaaaagtgtgtgtgtgtgtgtgtgatattgattgtatgtttgttgaaaatatatcctagagacaataataaagtcgttattattctaaaaaaaaaaaaaacgtaccattcnccccaaagtgancctattacnccgctcaacggccgtccttttnaantccttactgggaaacctgcgtaccacttatncctngcacaaaccccttcccactgggtatacaaaaagcccacgntgcctccaaattgnaccgatgnaatgggacc

SEQ ID NO: 2546 - DNA, 1160 bp, Triticum aestivum
  unsure (1)..(1160): unsure at all n locations
  Clone ID: PAT_TA_2546
tgtttacaacagaatggttgcaatgaagcgaaagaacctccttccttcagtggagggaatggacgctgttgactattatgttggcagctcctccaacagtcacttctctgattttgtgcagccaaatcctagtgcacttaccgagcctttgcatccgcgaatgcctttaaacattggtcgaggccgccccacgcgcccgcgcttagttaatcaagaaggatctcagaggaatgtcagagcacgccatgatagtgctaatgtttcgttggaacctaggccagcttcaacttacacaccaagtagcaatcatcagctgccattccattcagccacaagtgctttcgcaagtacggcagcaggaaggaaccaagcacctttttctgtgccaacaagaacattaccttcaggtggcactgggatcactggtaggatctaccatcatcctatgcctagccgcagcagcagctcaagtgttgctgctgccccaactgtccatggttcttcaaacagtgcgatgtttgccaatgctggctttcctgctcctagagctgttcatggctcaggtgctgctgctgccccaactgtccatggatcttcagacagtgcggtatttgctaatggtggctttactgctcctagagctgttcatggtggcgccgttcctagctacggccatccatcctccacagtttcctctggctcaaagagcattttcccatgatgcagtcattccgagctatcctagctggctacctctacatccatgaggatcatcgtgccagctcctcccagcactgcgcctgctcctcggcgggctcgggggtccctggcgcgcgccgccactgggtgggaaggaaaaattntnaatagggaccatccaatttattgccgnaananaaggggttatnatgnacaattggtttcnancaaanaatcaanacaanaactgtgaccccanaangactttnnacggacatgntganatgattnccaaggacntttgcctgggggaaccaaagnacgggnaaaccgcttgcgacnaaaaatnaagttgtaaaaatggcggtnaattggtnnggaaaacacaaatatgggcngtcaacgccgaggtaaaaataancctgaatnatgaggaanttcaagaggcnaaangtaggaan

SEQ ID NO: 2547 - DNA, 1576 bp, Triticum aestivum
  Clone ID: PAT_TA_2547
ccacgcgtccgcgcccgcagaggaacaggaagaagaagcagtccctacacaagaagaacaagaggcagcaacatacgcagacaagcaaacggtacagaacgagacagcacagccacaggtgataatagagcaggagggtgaaaaagccgacgatgatgatgatgtagcggtcaagactgatgttcctgcacatacttcaagcgctgacacacaaaatgagcaacacactcacgctattaacccactccaccagggacaaatgcttcctgcaactcatgatgataattcagaaaataagcacccattccaccatcgacccacgcgtccggagcaggaagaggaggaccctgaagaggtcattttcgacgactctgtctctgttggtgaagggcaggccgcatctgagatcaaacaaggagaggacgacgacgggcaggctgcagctgagagcaaacaggaagagcaccgtgctagggccgcggaggctgcagctgaggtcaaacagcaagaggacgagcgcaaggttatgtcagacatggccaacaacaggcagcgcaaaaaggagctagagatctttgtgggagggctggaccgtgaagccgtcgaggaggatattaggaaggtgtttgcgcacgtcggtgatgttgtggaggtccgtctccacaaggatctctccaccaacaagaacaagggctttgcgttcgtcaggtttgcaaacaaacaccaggtggctcgcgcgcttgctgaggtgaagaatcctatgatacatggcaaacgttgtgccgtcgccgctagcgaggacaacgacacactcttcttgggcaatatttgcaatacgtggacaaaggaagctattaagaagaggctgcttgactatggagttgaaggagttcaaagcttaactcttgttcctgatactcaaaacgaaggccagagccgtggttttgcatttctcgagttttcttgccacgcggatgcgatgcttgcattcaagaggctgcagcaaccagatgctctgtttggtcatcctgagagaactgcaaaagttgcttttgcagagccaataaaagaagcagatgcagaagttatggctcaggtcaaatcagtttttattgatgggcttccaccatactgggatgaagagcgtgttaaaaaccgattcaaagcttatggtttgatagaacgagttgtgcttgctcgcaatatgtctagtgctaaaagaaacgattttggatttgtcaacttctcaacccatgaggaggctcttgcttgtattgaagccaccaacaacaccgagctgggtgatgatggaaaagcaaagctaaaagtaagggttagactttcaaaccctttacctaaaagtcaggctgtgaaaggtgaaatgagtggcgggtttcgaattggacatcctggatctggttttaacaggcctggtagaggttttaatagggacagagctgcccctcgccgggaaggtttccatggtgataggggtttcaataatcacactcctggtcgtggtgcgagatttaattctgcatacagtaacaacagttttgaagcttcgccctctgat

SEQ ID NO: 2548 - DNA, 943 bp, Triticum aestivum
  Clone ID: PAT_TA_2548
gaaaggatagctatgaccgccatggaattggaagcaagggacgcaccggtcgagccgctggaccgcctagccgccccctcctcctcttccgcctcctcctcctacgcctcctcgctctgcgccatgtgccagggccgggtgggccagggcgacgcggccgtgggctcccccgcagcgggctccccctccccctgctccgcctctctcaagtacgcgcacagggggtgtgtgcagaggtggtgcgacctagaaggggttcgccctcagcgtttcgtgccagcctgctctcgccccccccagcaagctccgccccctgagatgctgcctgccgtctgcggggatggggatctggcggaggggctggacgggcaccagggcatgcactatgcgccgtccgacgggccgatggacggcccggacaccgtcggctgctcggcccgccgcccgccggcggctccgggcgccagcctttggcgagtgcggtatccctcatactgcgggtgtggcatctcctcgccgtgctgaccatcaagcccgcgcagcactgtgccttcagcctcctcacgatgttcattctccgggccgcggggatcttgctgccgctctacgccgtcatgagggtgatccgcatgattcagcacgggcggcgccagtaccggttgcatcagctgcttgaggagcaaagaagaaggaatgcatccaggcgtagccaggagcagcagcagcttgtaattagcattcaatgaatactgcacatactgtattgccgggggcaatgttcaatcaattccatcagttgtaaaccattcatataaataaatatttatatagtaaagttgaaaattacagttgctgcagtctagcacagttcactatgccatggaggcctcaaatgtgaataaaggctcaaataatagtgtgtttttttgtgaaaaaaaaaaaa

SEQ ID NO: 2549 - DNA, 249 bp, Triticum aestivum
  Clone ID: PAT_TA_2549
gcgattggtgcggtcacaggtttcagcttagtgggatatatggtacaaggatgctaggacttccgtcgttgctgttgctggccgtttgggccaaggagttggttacatggttgacgtagagttttattgtccgggtgtaatgttgtctctggggaaaaatggagggagtgtctatttagcatttgactgttttacaattggaaaacattcaaatttcctaactaataagcagctgccacttgtatgtcc

SEQ ID NO: 2550 - DNA, 1109 bp, Triticum aestivum
  Clone ID: PAT_TA_2550
cccacgcgtccggttattttttcttgtgcagcagtttctggtctggtccaaggcgagagagtgttcttgcttgagttggtgttgatccaatgggcgagatgaaccaccagcccggggcgccgccgccggtgggcgtgccaccgcccatggggatgcagcccatgatgaacgcaccggtcggcgcgggcgccatgcaccagccctacgagcagttcaaccaactcaactactgcgtccactccaatccttcttgggttcaggtagcagggcttgcattcctccactacctagtgatgttgggctctactgtcatgcttgtgtcaattattgttcctgcaatgggtggtggtcctggtgagaaggcttgtgttattcaagcgttcctgtttgtcagtgctgtcaatagccagacagtttaacacaaacgactttgaaagtaatcacgagagatttgttcacacaatgagagcaactcaaggggctctaattgttgcttcaatcctcaacatgattcttggatacagcagagcatggggggcatttgccaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccactttacttcagacatatccatgaccgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatctgcaccatggatcaaaatttcataccccttccattggggtccaccaatcttcactgcaggtcattcatttggaatgatgggtgctgtgcttgtttcatcttttgagtcaaccggggcacactttgcaactgcacgtctagccggtgcaacaccacccccagctcatgttcttactcgaagtattggtttacaagggcattgggatattcctggcaggactgtgtggtgctccagccg

SEQ ID NO: 2551 - DNA, 2426 bp, Triticum aestivum
  Clone ID: PAT_TA_2551
agccggttcatctgtatcagtcgaaaacatcgggctacttggattaacaaaagttggaagtaggagagtgatccagatatcaactggcttcatgatattcttctccatatttgggaagtttggggcgttcttcgcgtcaatcccgttgccaatcttcgcggcaatttactgcatcttgtttggtatcgcagctgctgtgggaatctctgccaaccagtttgcaaacaaacactccatgaggaacatctacatcattggactatcatgtgtccttggcatctcgatccctcaatatttcgcggactacaccgcttttgctggccgtggacctgcccgaacaaatgcaggatggttcaatgacatcatcaacacagtttttgccatgcgcgatttattggtgtcgccttcgtctttttcagtttctggtctgggcccaggctaacaaattgctttaaggacatccgcaatataacagtttctgtgtagatcatatatatattagcatcagattacagatgcatagactgacgacacaccatgacatggtactatagcaccttattccacttgtctcatcccaagaaaacttcacaaacagctctgctttctagggatcaggcaaggcaattacatacacgataaatagaaaccggtacctggcccgctaagttccgcggttagaagcacatgctaggggtaggtgcaggagcgcctgcgttaggagagccaggcatctttgagcgcgagtaggatcccacgccttgccctcggcgtcgctgcagctgccgctcttgtctggatacatgacactcactgccgtggcggggccggcggctcccgccttgcccttttcatccagaatcttcgggcggaggcggtcggccctgagacccgatggtctgttcaagggtggaggctgctacggtgaacaccagcgcggccctagagcatgttgacctacttcctcaacatcgggattactggaatggacgcctgtccggcagcgaacccactggtggggagattctcatggatcgcctcgcagcactaccgggagaatggacttttgctagccactccggagccttaatgagtgcgtccgctttcgccgccagggtctgggggacggcgagatcttcacgagggttgtggggtgcaagggctgctcgtggagcaacaatggcaggcgggcacttcagcttcataccagctggtggctgtagagccttggcgacaaggggcagaacgccactcattgcccggtaagaccgagcgagtgggcactgtccattttctagccattcatcactcattgcctcgtgggacggtgggttgcctcctttttgtttcatggaattctgatctggcttgttaggcttcttgtgtgactggtctagattgttgggcttcttgttctgctttttgcccttgccattaaagaagttaaacccgaatggtccaaatgctgatagacttatggtagcggctctagcagccaatggattaaagggaagagcaggttcgggcttgacatcagtgctctcactgcggttctcatcaggcacatatgatcttcctgaaaggggaactatcccatcctgtccatggaaaagcttgaatgccgactcaaagcctggtccatcctcaaagatgggacccttgcctcctcgggcagctacaggcaaagcagaagaaaatgaaaaggttgtagctccattgatgttcctcaggaatgggcatttctcaacaccgggatgaccagaaaagttctccgatgatgctgagtcacagaacaggctgctgaagagcatttccatcctcgccgagtcgccggagagctgctcgcctgcgtgcttgtctccgtccgtgcggtgggggcgagagagggagagtattcgcgtgccggccaaacggtggcgctgatcgtcgcgtcgcttctggacaacacgctggagccccgtgccaacgagaacgaccgggggctctcatggttcacgccatttctgcgccgccgtaaagggtactcggaccctaggaacgaggagttctacagctacccgatccgggtccatgacttggttccgcaccggtttctctgattctagaaggggtgctgctaattatcctgtgctgctgtgcaatgtaaatcccctttgttcttgttagccttttaccccctgtggcccgtagcgattggtgcggtcacaggtttcagcttagtgggatatatggtacaaggatgctaggacttccgtcgttgctgttgctggccgtttgggccaaggagttggttacatggttgacgtagagttttattgtccgggtgtaatgttgtctctggggaaaaatggagggagtgtctatttagcacctcactgttcggctactggggcacattcgtctcccctaactaataagcagctgcc

SEQ ID NO: 2552 - DNA, 785 bp, Triticum aestivum
  Clone ID: PAT_TA_2552
cttgttcattcagctaatttttttcaggagaggactcaagtgccttgaggcacttgaaccccatgtaaaagcaatagctgagaaacagcacattgactatcagttcaccggccttgaggacaatgaatgtgacaacgatggctccagctcttaccaagagacttgtagtgatgacagagaactgagtttcgactatgaaataaatgatagagaccaagattttattgcttcgagaggttcaatggatttgggtatcggcgcccggaggacttccccaacgccaataaaagagatcaagcaggaagaggtgaagctactgaaggcagaagcagcagctccacaagtgaagcctgagatcatcacacattcagctccaatgtttgctgacaattttgtcgatcaaacagagaggcttcggcaaatccggccatcttcagcccggcactcatacaaactcccaacaccagcggatgatgactatcccagatcagcagctgttcacaggtctcatcattccgcgcattttttcggaagtaaagatggcgctgcagccaacttgtggcattcatctccaccggcgaaagattacaaggcgagcaccatgcatagtggtcccattaaactgccatcaaactctgattttagtaagaagttaaagagagagtcctggtctggtccgattccaagcaaagcaggatcaagcaagcctgatcccaagtcatccatgggccgtcctcatgcgatgatatccaagtcgtgtgttcatgctaggcagccgtcaccag

SEQ ID NO: 2553 - DNA, 648 bp, Triticum aestivum
  unsure (1)..(648): unsure at all n locations
  Clone ID: PAT_TA_2553
ctctttcatgcccgtcccctggtcctcaggaggaaaggagagggaacgcgcagcgcagcacaagaggtttccactgactagtacggccgcggttctaactagctgttgcgtggcgtcgccttcttaagccaaggccaagcaagggaccgccggggcgcgagcgcgcggatggcggccaggcactcgtacccgcccacgcgggccacgcggagcgcgccggcgcctcggccgccattgtcccgcctcggggagtcggagacggcggcggcccaccccggcgccgacccggaggcgcgccgcaaggccaagaagcagaaccagctgtggcccaagacggtgctgcgcaagtggctcaacatccggtcgccggactccgacttcagcgccgacgagggcgacaccgccgacgaggccgccagcgactccgagtacgaagagatgtgcggatgggaacgccagcgatatgatcaggaccggagaatgcgtggattgggtgcccagactactgatagccaaatggagggtgttccatacggtcttcatagaaggcgcaagtcagagactcttcgtgctcagtatatcgatgtcaaggaactgagggtctgcataggaacttggaatgttgcaggcaaacttcnanctcaagat

SEQ ID NO: 2554 - DNA, 734 bp, Triticum aestivum
  unsure (1)..(734): unsure at all n locations
  Clone ID: PAT_TA_2554
tggctttgggtccattgcatcgcgctgtacaccatatcgggtgtagcttgctttcttctatatatggaatacaagcgtgtggctacactgaggttgcttcatcttgtgcgaacaacgagcaaacatagccactttactgttcttgtccgtgggataccaaagtcaactcatgaatcattcaacagtgctgttgagagtttctttacaacgtaccatgcaccgagctacctatctcatcaagttgtttataaagttggtaaacttcagaagatagtgacgggtgcaaagaaggtttatcggaagttcaagcattttaagggtaccacagtcgatcagacatgcagatccgtgacatatcgatgttgtctttgtggggtgtcatcaaattcgttccagttgttgcccactgaagagcaaagagaggggaaaaccttgtgtgaaaaattcaaacttgaacttacctgccgaggaatgtgctgctgcttttgtatttttcaaaaccccgtatgcagcgcctaattgtacccaaaanttccccagacatccaatcctaatgaaaatgggtcactagttcctggccccagaacctaaaagacatgttactgggccaatctttggttaccgtacaagcagctttggattcgccgcatagctacacttcttggttctattgtttttatgttcattattcttgtacctgtgacatttatacaaggtctaactcagctggaaca

SEQ ID NO: 2555 - DNA, 758 bp, Triticum aestivum
  unsure (1)..(758): unsure at all n locations
  Clone ID: PAT_TA_2555
gccttgaccccgttgccnttggccanccaaggganccgggccgtnagggttggcccttgccaagggttgaaagccaaccaccccaaattgaaagnattgnggggaggangcctaanctggggttgganccgccggaaaggcccttgttgcccccgggccgccngctttggttgaatccaaattgttttgggagaccccttcctttgccangatatttgttcccacccggttctggctccagggagtggcccgcgccccggccgggtgggtcgaccgcagggccgccggggattcacggcccggagccagccgttcgcccgccgtctttttccaaccccttgggaaagcggaggggattcccggtttttattaatggaccgcttgcncagaccttggtttctgaagaaaacccaccgaagtacaggagtttcacgatgtctgaattttttggggctttctttaaacgagaccttgctagcaaagctctacttgacaacttcaaattgtaagatggtccaaacatcaccacacaatgtttaaacctgcccacatgccagtatgtaaccatctcagcgcaaacgtcgtcctgtgagagtgaaatgcaattattctacctcatgtggtttctccatagtgcctcccaacataaagctagtattttttccaccgtgtaatcatcatattcttgttgtctcagtgggctgtcttatggagctgagtgtggcctcaaggctgttagtcttcacacatcgttgaac

SEQ ID NO: 2556 - DNA, 900 bp, Triticum aestivum
  Clone ID: PAT_TA_2556
ttcacgcgtccggtccttgtttatgcttgggcagaagacgtcgaactgatgggtccgacaactatcggttccctacagtctgacgagtatgctgttgatcagggagtgatctctggtccagcaacagctatcgccattgtggcctcaatggtttcaaatgtccctgtggtgggggacttcgcacgagctactgaaatgggagcccgagcgataggaggtatagccaaactttttggttattccaatccaccaatgattgacgacgtccaacctatgcagaataaggcattccatgcatttgcaaatgttgagacgcgcgttcccatagacaaactttgtctggatcccaaaaatgaagtttccatttcgcctgctattgcgggcgttgatgaggaagaccctttggtgatttcagatctctgttgtcgagagagctatatcaaagctttcaattggacaggagcacaggctgtcgataccctcctttggagtgcagtggtaaatccacattacgcttttctatctgggggttttcgaactatgccacccgtcacgtatttgacacccaacttccgtttttggaggggatcaatcgtatacaaattccgattcatcaaaacggcctttcataaaggtcgtgttttgatttcgcacgatcccaacggtgatattacgggtacatcagataccgagaccacaactttttcgcgagtagtgcatttggagcaggaaactgaactagaatttgcagtcccctacatggcaacatcgcctatgttggagattgttgattttgcctcttttccccttaccaattccacctcagcagcacctgcttacgtgtacaattcacgttggtataatggtactattaccatgcgcattcagaccaatctcaca

SEQ ID NO: 2557 - DNA, 772 bp, Triticum aestivum
  Clone ID: PAT_TA_2557
ctgtcgcgtgggatctcacattcgcgatcacgtagccaaactgaaacaaccaagagaggaaatcttttcgaaacccaaaccctaggggctcgcggcgcgcgccatgaagatcccgtttgtgaccaagtggtcgcaccgatccagcgagcccgcggggccgtcgaattcggctgcagcgcagcagcagcagcaggcgccatcgtctccatcggcgccgtctcctcctcctcccgtggcgtcgacagaggcggcaggggatgagttcattctgcaggaggaagagtaccagatgcagctggcgttggcgctatcagcgtcggcgtcgggcgccgagggcgctggggatcccgacggggagcagatcagaaaggcgaagctgatgagcctcgggaagggccacccggtcaccaacagcgatcgtggcgggggagacaccccggagtcgctctcccgccgttacagggactataactttcttgattacaatgagaaagtaattgatggattctacgacgtatttggcctctctgcgggatcatctgggcagggcaaaataccttcactggcagagcttcagatgagcattggggatcttggatatgaagtaattgtggttgactataaatttgataatgctctgcaggagatgaaggaagtagcagaatgctgcctgttgggctgtcctgacattacagtattggtgcgacgaatagctgaagttgttgcagatcacatgggtggtccagtgatcgatgcaaatgaaatgatcact

SEQ ID NO: 2558 - DNA, 1218 bp, Triticum aestivum
  Clone ID: PAT_TA_2558
ttcggcacgagggccgcgctgagctacgggctcaccgtcgcggggaaagggcaggagcaggtgctgcaggagctggacagggtcctgaaggagtacacaaccttctccgtcaagcaggtcgacgacgaggcgggcgaggtaatggacacgagggcggtgtcggcgcgcccgccggaggaggctgccggggacaagaaggaggaaattgaggagcagtccgcggccttctggacgacaatcgcgccaaacgtagacgactacagctcgtcggtggcgaggcttatcgccaagggctcggggcagctggtaaggggcatcatctggtgcggggacatcacagcctccggcctgaaatgcggggaggcggtgttgaagaagggtgcgggggcgaacggcaagcatacgcaggtgaagccgagctccctcaagaggatgaagagggccagaagggtcactaaaatgtcgaacaaggtagcaaattcaattctctcaggtgttctcaaagtctcaggatttgttaccagcactgtggtcaactccaaacctgcacagaagttcttcaagttaatgcctggcgaagttattcttgcttcgctggacggatttggtaaagtttgggacgctgttgaggtgtctggaaagaacgtgatgaaaacatcgtcagttgtcactacttcagttgtaacgcacaggtacggtgatcaggcaggtgagatcacacaggactacctccacgccaccggaaacgctcttggggtcgcgtgggcggtcttcaagattcggaaagcgctcgacccaaaggggcacatcaagaagtcgtccctggcgagctcggcggcgcacgctgtggctaagcaatcgataagcctgcaaaagaagaagtgagccgtcgtcgtcgtacgcaggtcgatggcggctccactgtatattgtaatgttcttgccgagtttcttgtgtgggctaaggtggttccactatgctgtgtaatggtgatgtacgttcctttgagctggatagctaggagttttatttgttggatgttagtgccactgccgcttctgggttgtgtagttctgtatactgtgatgtgtatgtgaacatgcaagatggacctatttcgtgagttcttttgtgggatcgtgacgagagagtcaggccaccgggtttctgttgttccgccgtggcgcgggaaggtatagggaagacataaaaaaaaaa

SEQ ID NO: 2559 - DNA, 1465 bp, Triticum aestivum
  Clone ID: PAT_TA_2559
ctcggcacctggtctgggctcctttcgctgttgcttttcccttggggttttgctttgccgttccgcagctgctttccaccgtggctcttgtccatgggtcctgtacttccgctcgcgtgctctacccgcattgttctggctccccgttccttctgcccttggctggtgcgccgggttggggctccgccccgcccctgtcctgcatggcctctcggaagcttgctctgcgtgcttttttgcgggtggcccgccccacgaatgtcatacaaactctgtctgaagctatttgtgcatgcactatatgggatgtctgctccttttaacatatcatgtgttggtctcaagtatgcttcagcagcttctgcttctgcagtactaaatctcctcccagtgttaactttctttttggctcttctgttgggcctgctgttgttacgataacagcgctgccacccgagcctgggcgcgtttcgctcgcccggcgccctgccgtgcgtcacccggggcgggtggtttcacttcccgcgtggtgcgggctatggggggtgctcccgccgtcgcgtgcgactgtggggggtgccctttcctctgtgtgtctgggccctttgctggtggagtgcccccccgggctgctgaacgcgtcccgtctggtggtctgtgcggcgggtctttctgttcttgcggctctcctggggccggggctcaaatctatagtccatcaccctattttccgtcacccaagtcgagttgatactcatccatcaaggagctggatattgggaattctcctgcagtctcttgcgactgtaatgtttgccctttggacagtgtttcagggccctttgctggaggagtatccgtccatgctgcttaacacgagccttcagattgtctttgcgactgtccaatcattttttatggctctagtgatggagagagacttttcaagatggaagttgggattggatgtaggtcttgtggcgatcatctattgtggcgtacttgttactacattggcaaactacctgcaaatctgggtgattggtaggtgcggcccagtattcctggccatgacagtacccctaactttggttatcacaatcattctatcacttctcataggagaagctgttacccttggaagtgtaataagtggcgcgctcatggttgctggcctgtacaatgttctctgggggaagagaatagagcaagtagctctctgcaagcaaggaggtagcggagaaaatggatcatgcttagatttggaggaacaagaaagcggtgtgccagttccagcaacgcgggattcaatcaagccagtgccaggttcgaaagagagaactgatacatcaaactgaactgtgaccagcaagcgttgttattatgggtgtatgaaagcttttgcttcaggtcagcccaccagaaaccattcagagatctgtaatattttttctgcgagtcagct

SEQ ID NO: 2560 - DNA, 625 bp, Triticum aestivum
  Clone ID: PAT_TA_2560
ctgagccgagcaacccacctgaccaatacgaggaaaagaagcccaacccacctgctcctacgatcccgtcccctatccttcgaacagcatgacgccgcaaccaccgcctccctccctggctcgcgccgccgccgggccccggccacaaatcgcactgcctccctaccccgaccttcaaccgcgccgccgctgcgtcctccctcccgtgccgccaccgccaccacccttcccacctggccaccaaccggcgccccgccgcacccccgaccccaaccggagacaccgcctcacctccttcccggattccgcggcatcgtcccccacacgctgccgctgacgacgggagcaaccaccggtgcgggttgctccaccacctactggccttcaccgctcccctccaccagcatcggccccaccccagccatcgagcgtcggcgtcccccatctccctccaccttcctctgcgcgtgatggacgcatggcacgggaccgtgagctcaccggattccttccccctacagccagcgccaccacctacatccggcgccatagtcgtccaggtcgttcaccttcgccgcctcaggccatgcaactccgcccgtgtgagtgcgcgccgcacctccgc

SEQ ID NO: 2561 - DNA, 477 bp, Triticum aestivum
  unsure (1)..(477): unsure at all n locations
  Clone ID: PAT_TA_2561
nagaaggcccnattgtggccaggggtgactgttcagtgcatcggtgtgccggtgtggggtggtgaacttcctggagaagttgaggcttccaaggagaaatcagcgagtctcgaggctttattagcaggaagcaacccaaaaaggggttgagttgtcaggggagttggctcaagctaatgaagagaaggagaagtttgaagaattgtcaaacaaggccaccacagcgcatttggaacccgagaagcaggtccagactttacaggctgaatctagaatctgcccggggtaaaatggaagaggtggagaatgatcttcaggccctgggtgttagagaaagctcagtacttgacaagcttaaatctgcagaggagcagcttgagcacagtggaagggcactagaacatgccacttccaagaaaattgatctggaatctctgtaccagtctttacttgaagatacagagaagaagctccagc

SEQ ID NO: 2562 - DNA, 1208 bp, Triticum aestivum
  unsure (1)..(1208): unsure at all n locations
  Clone ID: PAT_TA_2562
cctcgtgccgaattcggctcgccgggccgtatttcggaaatttcagcggcgggcaagctacaaactcacaactgccgttttcttgtactggatgaagttgaccagctcttatcatgtaattaccgcgaggatatgcataggatactggagcatgttggaaggaaacctagcacttcatcttctagtcacatccttggcccacttgctaggcggtctgaacgtcagacaatcttggttccagcaacagtgccgttttcagctatacgcgcagccaggagtcggggccatgatccagttcttgttagggctaagagtgtacgtcccgcttgactcgatcactgttccaaggcccatgctgtcccagggtgaccctaactctgattccccaacaatgtcagtgaatcaagctgcagttgacagcttaccaccatccttggagcattactactgtacaaccaaggctcatcacaaagttgacaccttaaggagatgcatccatgccctggaagcagagacggtgattgcatttatgaacaacaccaagccactgaaggatgttgtgtttaagttggaggcccgtgggatgaaagctatcgagctacatggagatcttgggaagcttgcaaggtcaacagtcctgaaaaagttcaaggcaggtgaattcagggttctggtcacaaacgagctgtccgccagaggactggacataccagaatgcgaccttgtgatcaacctggatcttcccacagactctacgcactacgcccacagagctggccggactggacgtcttgggcggaaagggaccgtggtctcaatatgtgaagaaagtgaggcatttatcatgaggaaaatgcgcaagcagttaggtgtggccatcaagccatgtgaattcaccgaaggccagattaccgttcataaggaggaagacgtggaatagaactctgcattgctcaaccatcgttttagtttgtcttaagtgctactgttttttcgttggcatttagtccgactgtattttcttaaaatgttgccacttaatacttttgctcagcggagactagatacattggaaaatacatggtccttttttgctggtagcattcagctggactgcagggcattgaaatctgagaattaccagtcttttctggtgncgtttagatgttaaanaaaaaaaaaaaanaactcgaggggggggcgtacca

SEQ ID NO: 2563 - DNA, 567 bp, Triticum aestivum
  unsure (1)..(567): unsure at all n locations
  Clone ID: PAT_TA_2563
gcacgaggattgtgaggtccgggatggtgtccgccgtccagcaggagccgcggatgggcgcctccatcctccgcctcttcttccacgactgcttcgtcaacggctgcgacggttcggtgctgctcgacgactcgtcgacgctgaccggggagaagaacgccgggccgaacgccaactcgctgcgcggcttcgaggtgatcgacgccttcaagtcccgggtcgacgcggcctgccccggcaccgtgtcctgcgccgacatcctcgccgtcgccgcgcgcgtcggcgcttacctgctgggcgggccgtcgtggggggtgccgctgggccggcgggacgcgcgcacgacgactcaggcagcggcgaacagcaacctgccgtcgccgtcgtcgagcgcggccacgctgatctcggcgttcgcgtccaaggggctggactcccgcgacatggtggcgctctccggcgcgcacacgatcggcgcggcgcggtgcgccagcttccggtcgcgcgtgtacaacgacagcaacctcgccccgctggacgccttcagcnnngtgcgcttcgncacgg

SEQ ID NO: 2564 - DNA, 1030 bp, Triticum aestivum
  Clone ID: PAT_TA_2564
cgctcctcgacggcgtcgggcacctccccgcgcgacccctggggattctggcagaacttgagtacagccctgtggggttcatcaccagctgttaaagagtgattcagtgatagagaacagaacaggtggtagtggtcgccgccggcctcgtgtaccgtggtgggcttgatcgcttcaagaaagctcaggccttggagccgttctcagtgcagcagtctggttctggcacaaagagcgtgcccacggcggtgaaagtgcagccagctccattggtgccgccgcaaagctcacatcttggtcccagccagagtcagcatgcttcgcagagtgccggctcaagcatggccgggcaagaagctgctggagcccccagacccgctgggacgcagtttggtggtgggcagtcgacgtggcaaccgccggactgggcaattgagccgcgccctggggtttactatcttgaggtgatgaaggatgggaatgccattgataggattaatctggacaagaagaggcatatatttgggaggcaggtgcctgcttgtgagattgtcttggaccatcagtccgtctcacgccaacatgctgctgtcgttccacacaaaaatggaagcatctatgttatcgatttaggatctgttcatggtacatttgttgcaaacgagagattaaccaaggacagccctgttgaacttgaagttggacagtcacttcgctttgctgcatcaaccagagcatatgttctacgaaagaacaccgctgctttttttcccgctcaaagcctcccgtcagatgtgagtttgccgtctcctccagactctgacgatgaagacgccgttgttgcatacaatacaatacttaatcgctatggtgttagcaagtcagacgtgccattgaagagaaaaggctcttctggggatgcttctgcttctgctgtaaatgatgacagccaggcagtcggtagaccgtcgaagagaagcagaaggcggagagtgtcatttagagatcaggttggtggagagcttattca

SEQ ID NO: 2565 - DNA, 1856 bp, Triticum aestivum
  unsure (1)..(1856): unsure at all n locations
  Clone ID: PAT_TA_2565
gtccgcaccaggccttgctctcctccgcccccgtgctccctccgccggctgccgccgccgccccttcgcccgccttgcgccgcggcgcccgtgctctccggccgccccttaacctacccgccctcacccccctgtctcccctccccgtcccccccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggaaaaaatggctctaagatcgggagaatcgggattgaagccaatgaagaattgcggtccatattcaagagagatgtccatctgatgctccaagttagagttgctaagaagaggagttcttgaatagatcagcagatcatgattgtagcggctgtatagatagctgctggtatgaggtctgctctgcggtgccggttcagagatattcgattatgtgagcctgtgcttgtgttggtcgtgttcaatgatactgtgagggcttctccacttgaatcaaggacctgtatgccttagcattcaaatatgagtagcgatttccagttacaagtttgctcgacaatattgagcaggatgtaagcacatataaggaccagttgcaaagaggcggggttattgtgattctgtttcaaataagttgtaccttgtgtaaaagacaagctggtatggctggtctcttctggcatctcagtttgcctgagtcccgggcgataaagttaatcaaacgattgggtgccgaggtaaacccaaaccagaaacgtatattatgcatgaataaggttgacctagtggatgacaaaaaagacttgctgaaggttgcaaaggaatttgaagatcttcctggatttgagcggtacttcatggtttctggactaaaaggcaaaggagtgaaggaccttgtacaatacttgatggaccaggcagtgagaagaccttgggacgaggaaccggcgacaatgactgaagaagtaatgaaaaccatatcattggaggttgtgcgagagaagatgctggatcatattcaccaagaaatcccatatgtaattgagcatcggctgatggattggaaggagctaaaagacggttctcttagggtggaacaacactttattgcaccaaagcaaagccaacggcagatccttgttggaaaaaatggctctaagatcgggagaatcgggattgaagccaatgaagaattgcggtccatattcaagagagatgtccatctgatgctccaagttagagttgctaagaagaggagttcttgaatagatcagcagatcatgattgtagcggctgtatagatagctgctggtacgaggtctgctctgcggtgccggttcagagatattcgattatgtgagcctgtgcttgtgttggtcgtgttcaatggtactgtgacggcttctccacttgaatcaaggacctgtatgccttagcattcaaatatgagtagcgatttccagttacaagtttgctcgacaatattgagtaggatgtaagcacatataaggaccagttgcaaagaggcgggcctggacatctgagtatgttgtgatacatagatatacgtacctgcactaggttattgtgattctgtttcaaataagttgtaccttgtgtaaaagacacagcttgtaaggcttgtcttttctttgttaaaatatatataatccctcctcggtcaactgagacttcgttatgtnctcagttgatgctacct

SEQ ID NO: 2566 - DNA, 1819 bp, Triticum aestivum
  unsure (1)..(1819): unsure at all n locations
  Clone ID: PAT_TA_2566
gcatgaagcgccgcggggggcagaagtttagttgagagatcgccggcggccatggcgactgaacagctcaacgtgttgaaagcactcgacgttgccaagacgcaactgtaccatttcaaggcggtcgtgatcgccggcatgggcttcttcacggacgcctacgacctcttctgcatcgccctcgtcaccaagctgctggggcgcatctactacaccgaccctgccctcaacgagcccggccacctcccggcgaacgtgtcggcccccgggaacggcgtggccctatgcggcacacttgccggccagctcttcttcggctggctaggggacaagctcggtcgcaagagcgtctacggcttcacgctcatcctcatggtcctctgctccatcgcgtccgggctctcgtttggacacgaggccaagggcgtactggggacgctgtgtttcttccgtttctggctgggcttcggtgtcggcgcgcgactatcctctgagcgccaccatcatgtcggagtatgctaacaagaagacccgcggcacctgtatcgccgcagtctttgccactgccgcggttgggcatcctttttgggactattgtcacgatcttcgtctcgtccgcattccgatatgcattccctgcaccgccattctacattgacgccgcggcatccattggcccggaggccgactacgtgtggcgcatcatcgtcatgttcgccaccatcccggccgccctgacctactactggcgcatgaagatgcccgaaactgcgcggtacacagcactcatcgccggcaacacgaagcaagccacatcagacatgtccaaggtgctcaacaaggagatctcagaggagaatgtgcagggtgagcgtgccactggtgatacttggggcctcttctcgcgacagttcatgaagcgccacggggtgcacttgctagcgaccacaagcacttggttcctgctcgatgtggccttctacagccagaacctgttccaaaaggacatcttcaccaagatcgggtggatcccgccggccaagactatgaatgcattggaggagttgtaccgcatcgcccgcgcccaagcgctcatcgcgctctgcggcaccgtgcccggctactggttcaccgtcgccttcatcgacatcattgggaggttttggatccagctcatgggattcaccatgatgaccattttcatgctcgcaatcgccataccttacgactacttggtgaagccagggcaccacaccggcttcgtcgtgctctacgggctcactttcttcttcgccaacttcggccccaacagcacaaccttcattgtgccagccgagatcttccctgcgaggctccggtccacatgccacggtatctctgccgctaccggtaaggcgggcgcgatcatcggcgcgttcgggttcctgtatgcgtcgcaggaccagaagaagcccgagaccggctactcacgggggatcggcatgcgcaacgcactctttgtgctcgcaggcacaaacttcctgggcctgctcttttccttgttagtgccagagtctaagggcaagtcgctcgaggagctctccaaggagaacgtcggcgacgacgacaccattgctccgactggtgtctagagacatgcaggtgtacttgcacactcgtgcattgttggtgtgcttgatttgcttttttgtgttctatttttgttttctttgccgcgaccactttctaaatttctagtgttgtaatggtgacaatgtaatgcgtacactgtaacagngattcaaattccaattcnaaaaaaaataaaaatatcatttga

SEQ ID NO: 2567 - DNA, 902 bp, Triticum aestivum
  Clone ID: PAT_TA_2567
tcttgcagatttcattacccaacgtagctgcggctagcccacggaggcggggcttccgcgcggggggaggatgagcgcgcgagcaccaccgccgccgaccatgccggagtccgactgggcggtcaggcggatccgcaaggagctgaagctgctctggctcgaccccccggcgttctgccggcccggcccggcgcccgtgacggacctgttccactgggaggtggtcatcgacgggcccgacggcagcccctacgccggcggcacgttccccgtcgacgtcgcgatccccaagaagtaccccatgaagcccatcaagctcaccttcaaaaccaaggtgtaccatcccaacatcgggccggaggggaggatggccctggacatcttcggggagtggtggagcccagcgatcacgattagcacggccctcctgtccgtcgtctccgtcctctacgaccccctgcttgacctccccgtccgccgcgacgccgccctgcagtacagggaccagcggggtctcttcgagcagaaggccaggcgctggacccgcagatacgcctcggcgccggtcgcctccttctgcgcggcagcggcagggaaggaggtgctggaggaggcggcgactagtggggcggtggcatgtcgtcgttcttgtggagcggggaaatggcgtttcttcggggctcgtctccttgccatctagtcctccccccccgccgcgcactgcgctgcacttcagtctccactacaactgcgctactgttttgctctggtggttgcgactgactgggcggtcgtatggggtcggcttcgcttgcctattggccttggtgtggcccttgtgccaccgctcggaggcgaggtgtagggctcgttccatgctcctacgcaacttctgcaaacag

SEQ ID NO: 2568 - DNA, 430 bp, Triticum aestivum
  Clone ID: PAT_TA_2568
gtggacagctagagccagccaccaccgtcttcctggcgagaggggaggaaggggcaggtttagcctggcaggtgcttctcgggttccatggcttccagcgagggggcggcatccttgctctgcatcaagctcgtggtctgcctctgcttcctcggattatcccaaggcaggggcacggccaagccgccattcacgttgaggaatctcccacccctcgagaaggcgagcagcttccccgcgatgcgccacgacagctacgactacattgtcgtcggcgggggcaccgccggctgccccctggcggcgacattgtcgctcaagtacaaggtgctcgtgctggagaggggcgggtccccttacggcaaccgcaacatcttctacatggagaacttccacattggcctcagcaacacggcgccggactcttcgt

SEQ ID NO: 2569 - DNA, 2212 bp, Triticum aestivum
  Clone ID: PAT_TA_2569
gcccgggccgggctccctctgcactccttggcccagccaccaccgtcttcctggcgagaggggaggaaggggcaggtttagcctggcaggtgcttctcgggttccatggcttccagcgagggggcggcatccttgctctgcatcaagctcgtggtctgcctctgcttgcccggaagctgccaccaccgtcgaccggcaccaatccacggtttagcctggcaggtgcttctcaggttccatggcttccagcagcaagggagcggcggcgtcctcgctctgcatcaagctcgtggcctgcctctgcttcctcggatcatcccaaggcaggggcacggccaagccgccattcacgctgaggaacctccctcccctcgagaaggcgagcagcttccccgcgatgcgccacgacagctacgactacattgtcgtcggcgggggcaccgccggctgccccctggcggcgacattgtcgctcaagtacaaggtgctcgtgctggagaggggcgggtccccttacggcaaccgcaacgtctcctacatggagaacttccacattggcctgagcaacacggcgccggactcttcgtcgcaggccttcgtctccaccgacggcgtcatcaacgcccgggcaagggtgctcggcggcggcacctgcatcaatgctggcttctacagccgagccagctcaagcttcgtgcaggatgttggctgggaagaagacctggtgaatgagtcctacccttgggtagaggataaggttgtccagtggcctaagatcgcgccttggcaggctgcactgcgggatgggcttgttgaagcaggtgtatcccctttcaatgggtacacctatgaccatgtttctgggaccaaggttggcggcaccatcttcgacgcaaatggccaccgccacacagcagccgacttgctcgcagctggagaccgtaacaacctgagggtcctgcttcatgctagtgtgcacaagatagtgttcgactcgcaacaaggacgactgagaccaagggctatcggggtacaatttgctgatgaggacgggagactccaccaggcactcctcaacaacaacagagatagcgaaattatcatctcttctggtgcaattggcagcccccagctgctactcctcagtgggattgggccaaagaatgatcttaagaatcataacattcctgttgttctccacaacaagtatgtggggaaagggatggctgacaaccccatgaactccatcttcatacctacgaaaagccccccgcggcagtcactgattgagactgtcgggataactgaagccggtgtgttcatcgaggccagcagtggttttggccagtcagaagatagcatccactgccaccacggaatcatgtctgctgagattggacagctgtccacagttcctccgaagcaaagaagcctggaactagccagggagtatgcacataacaaacttagtctacccaaagaggtgttccagggtggctttatccttgagaagatcgatggtccactgtctacaggccatcttgtccttgcagacactgatgtcaagaacaacccggcagttactttcaactatttcagccatccacaagatctcagccgttgtgtctatggcatcaagaccattgagaaaatattgaagacaaacagtttcgctcatctgactcctgatgatgatgctggatatgaaatagaaagggtgctcaacatgagcgtgcgggctaacgtgaatctgatacccaagcataccaataccacagaatccctggagcaattttgcaaggacacggtaatcaccatctggcactaccatggtgggtgtcatgtagggaaggtggtcgaccagcagcaccgagtgcttggagtctcagggctccgggttgttgatggctcaacgttctctaggtcaccagggaccaaccctcaagccacggtcatgatgatgggcaggtactttggagtgaagatcttaaggcagcggctaggacgagcagctggagtgtagtagattcctgaacacctgccttttatgatgtgtgtgtgacctagaaaagaaatcactaatttttgctgggatccagtgtgaatcaccaatgtaagacattctaggagtttcatctgtacccagtaactatttgtcgcgtacgatattgcccattaaattgtttatcaaaaaatctttcttcctaaaaag

SEQ ID NO: 2570 - DNA, 594 bp, Triticum aestivum
  unsure (1)..(594): unsure at all n locations
  Clone ID: PAT_TA_2570
ttttctcggcgggagggcgagagggagaggggctgacgttaccccccgcacagatcatcaatcaaaccggagcgagctcgcgtcaattccaccgccagggcgcgcattaatcagattggagtcgcggcccgagccgctccgcccgcgaccacccctcggatcgacccggcggccggaggaggcgcgcgcgcgcgggctgcggagcggggcccgggggcgactcccccaccgcatcggcgatgccgcacgagcggggcgtgcgcggcgcccgccgcccccgcccccgaggaggacgcgctgtttatcgatttactacatgaagctcccctgtctggccatcgagagcctaggagcatagtcagtggcaccttgtactgtatattgttggtagggtatgctgctgtttctgtgtctgctccatggatatttcttcgtttaacaaggcatgattcctccaatgctatgcaactccaatgttatccttcngcttcntaaaagcaattttcaacaatattgggntcaacaagtcangaaagnanattgaaggctattacaatttaaccaaaaatgaagcaattgctcgacttcaatttn

SEQ ID NO: 2571 - DNA, 417 bp, Triticum aestivum
  Clone ID: PAT_TA_2571
cgtacccgtacgcgatgcttcctttgcccgccctcctcccctcgtaacctccacccttccattcccgtttccgagctgctcgcctcccctcccctcccctccccgctcagccgagcctccccaattcccggcaccgccgccttctctgacccggtcgtatttatacaggcccattcaaaatccacgccgcaaaatattatccacaaatccatccggggttagggtgctgccagctgaggctgctgctctgcttcactgctcttccctggtgacttccggcctcggctctcgcgtggtaggtatgggcacgggagagggcaggggccggcggcggcggaagctcgagggggacgacagcgaccaggagtatgtgttggaggaagaggaggaggaagaggaggtctttcagatttagta

SEQ ID NO: 2572 - DNA, 829 bp, Triticum aestivum
  Clone ID: PAT_TA_2572
gttgaccgtcgtgcagttgcaggcagctccacgcccctcccctcccctctccccttccggccgccgtcgcgatggccgagacggtggacttcgcgagcggcgacggggaggcctggcgtgcggcgctgggcgcgtacgaccgccggctcgcggcgctggacaagcccgacctcctggacgccgactccttctaccgccacgacctccccctcctgctgcacggccgcgacccggacccctacctcgccaagcccgagctggtgcagctcatgcagtggaagctctcgcgcggcaagtggaggccgaggctgatggatttcgtcaaaagcttggatgacaaagttgtagagtcagcgtcacgcaaggcatttgcagcgctgcccgacctcagcaaggccatcaccgagctcactgtgctcaagggtgttggccctgccactgcatccgcggtgctcgctgcctatgcacccgatgttgcgcccttcatgtcagacgaagcaatggtcgcagccttgggcaatgtaaaggaatacactctgaagcagtaccttgcgtttgcggagaagttgcaggctaaagcagaggagttgagcgtaggaggagaaagcttgacaccttcggatgttgagagagctttgtggagctcggcaatcgcctccaagccaccgaaggcaccagcaggtgggaagagaaaacgatgacgtgtgtgccgccgcacggttgcgctagagctagaatggtctgctggtgataggccttagatcgatctttgtagaatgtatgtcatgtacttgatgcctttggatcagcaaacatatttgtgaatggg

SEQ ID NO: 2573 - DNA, 828 bp, Triticum aestivum
  unsure (1)..(828): unsure at all n locations
  Clone ID: PAT_TA_2573
cgccggcagnaagcaaaagtattggcagctcactcgaggtttctgatagcaggctcagcactgaccatttccagcagaaggaagcctgccgaaggcgtgcttctcctctgatcagtgtggagtactcaaatggatgggacaccatgtcaggtggaggctgcggatcatccggtgaggttggcgatagcttcaggttcaaccttgaggaggtcgagtgtgcgactcagtacttttctgaggttaacttgctaggcaagagcggctttgctgcgacgttcaaggggatactgagggatgggtctgttgtcgcggttaagagcctcaataagacaagttgcaagcaagaggagtctgatttcctgagaggcctgaagacgctcaccatgctgcgacatgagaaccttgttggcctgaggggcttctgctgctccagggggaggggggagtgctttcttgtgtatgacttcatggttaatgggtgcttgtcgcattatctcgatgttaacgaaggggctgaagctagtgtgcttgattggccttcaagagtttccatcatcagaggcattgcaaaaggtattgagtacctacacagcaagaagagcaacaagccatcactggtgcaccagaacatttcggctgagaaaattcttcttgaccaccatttcgccccacggctgtccgtcccaggactgcacaagctccttgccgacgatgttgtcttctcagccctgaaggccagcgcagctatggggtatcttgcccctgagtacgccaacacgggacgcttcaccgagaagagcgacgtctttgcctttgggattgttgttc

SEQ ID NO: 2574 - DNA, 882 bp, Triticum aestivum
  Clone ID: PAT_TA_2574
tgccacgaaggcacccacgggcacgtagtagcatctacggtagtagcacacattacttggctcaagagatggccaagggagcggtgatgcttcttgttctcttcacggcgctgcccgccgcgggtggggcccatcggccgggtaatagggccccagcccccgggggtcgcccggcggcggacccacgctgcaccgccacacctccatttctacttccatgacacgctcgacgcgtgcggccgcgtcggcgatgcgggtggcagggccggcgactgtgccattgcaagcccttttcggcgccgtgtacgttatggacgacccgctgacggagaggccggagctcgggtcagcggccgtgggacgggcccagggcgtctacataggggcggaccagacagcaatgggcttcctgcaggtcatgaacctcgtgctcacctccggcccctacaacggcagctcgctcaccgtgctcggccgcaacaacccgcttgccgacgtccgtgagatgcccatcaccggcggcaccggcgccttccgattcgcccgcgggtacgcgcaggcccggacccacacgatggacctcaagaccggcgacgccaatgtcgagtacaacgtttatgtcatgcattagcatgcaaaaatttaagggcttaccgattgtaatgcttcacatagtgttttcatttcatttcattattattgcttacatcaggttgacgtgctttgagatttggacttttccttttcctaaatattagtgtgcctttgtctcgggttaatcgtgctagcaaggggcaagaaataagtggacctaggtgaaatgtggtgtgtgttttcttaaatcaatggaaacttatttatcgcaaaaaaaaaaaaaaaaaa

SEQ ID NO: 2575 - DNA, 501 bp, Triticum aestivum
  unsure (1)..(501): unsure at all n locations
  Clone ID: PAT_TA_2575
accatcacatcgcacccacaccgacccggcacgcccttttccccgtccgtcgccagcaagctgcttgctttgcttcggttagctcgctgcgcggcgccgctctcggccctcccgcggccaggctgctcggatggcggggcggccggggtacgtcacgctgccgataatctcggtgctcgccgcgatcgggtacgtctactacaccgcggtgttcctcgcgatccccgcgtggctggggctcgccacggcggcgggggtcgccaacgtcgcggcctacaccacgctcgcgctcgcctgcgtcgccgcctaacggcctcgtcgtcaacgcgcgaacccggggccgcgtgcccgccccgcctttcgttgcccgaacggtccaaggaacgcccaagancccccctccaattaagattnaaaagcncaangggtgggnggatttttaagaaaaactggccannaaaagttgttctcaaatnaaaaaacctccttcnccgcggcaaa

SEQ ID NO: 2576 - DNA, 871 bp, Triticum aestivum
  Clone ID: PAT_TA_2576
cggacgcgtggggccgtctccattttctttccgtcctccctcctctcccccggccgctcgctgctcccataccgtctcctccgctgccggggcagacggactggagatctgcactcgattcgcctacctcgtcgatcgaacaggaagacagcaacgggtttggagaacctcaagaagagccgaaagatgtcgctaggctatgcggagaagctgtcttaccgagaggatgtgggcactgtgggcatgcctgagaagttcgactcccccaaactcctccaagggaagatagaagagcttgcagttatggtgcaaaagagtaagcatctagtggtgtttaccggagcaggaatatcaacttcatcaggcatacctgatttccgaggcccaaagggtgtgtggactctgcagcgtgcaggaaaaggtgttcctgatgcttcactcccatttcaccgagctgctccaaccttgactcatatggcattggttgaattggaaagagcaggtctcctaaagtttgtcataagccagaatgttgacagcctacatttgcgttctggcttcccaagggagaagctggctgaattgcatgggaattctttcaaggaggtctgcccatgctgtaaaacggagtaccttcgtgattttgaaatagagacaataggactgaaggatactccaaggcgttgtacagacaagaactgtggagctagattaaaagatacagttcttgattgggaggatgcgttaccccctgaggagatgaattctgccgaggagcagtgtcgagcagctgatcttgtcctatgtctaggaactagcttgcagattactcctgcatgtaatatgcctctgttgtcaataaagaatgggg

SEQ ID NO: 2577 - DNA, 442 bp, Triticum aestivum
  unsure (1)..(442): unsure at all n locations
  Clone ID: PAT_TA_2577
tctcattataaacctcctcgcgcgcatcattgtcgtgtctgctcgtgatgtattctgaaaatggaccaccactgtatttggattaacaattgtgttgggcatgagaattacaaaattttcctcgtctttgtgctgtacgctgcaaccgcaagcttctattctttggctctgatgattggaggcgcagtgcatagtgtgcctacagatgaacaatcaggaattgattctccaagaaaatcgttagttatttgtggcgtctttgtgggtgtaatgactttgggcgttgtctatcctcttggtctggcatgtttacctcatcttgcataataagactactatcgagtaccatgaaggantagggcaatgtggttggnaaaaanggtggaatctttacaanccccaanttntccgggntcaaanaaaatntnttcgggccaggccc

SEQ ID NO: 2578 - DNA, 597 bp, Triticum aestivum
  unsure (1)..(597): unsure at all n locations
  Clone ID: PAT_TA_2578
gaacaaagcagaagaaaaaggtgagtcatttccgttcctcctcccgcccccagttccgggtctctgtttctccagtctccccaccgtcctccctcatcccaaatcgaaccgcctccccgtcgcatcgatcccaatctgaccacccccaaaaccctaaccctcactcgcctcctagcacggcggcgagtcacggcggcggaggcgtgagatggctgcgcgggcgtaagcatttcggaggcgatcgccggaggtgggggcttcctgtgacccgccagcggtctcgctggtgccggcccgtgcccgtgggtatggcgacgtcgtcgtcggctggcgggggccgtgccgccgggggcgcgcctggactcaagacttacttcaagacccccgagggccggcataagctgcagtacgagaagacccactccccctccgtgctgcactacaaccacagttctggtggcaagactgtctccgaaattacagtggcatatttgaaggagaagcccgtgggccagggctctacaccgaatcaacgccggactgtacacttcggtttcgtgttgcttgcgtcgggggggggaccgggnttggtttaac

SEQ ID NO: 2579 - DNA, 346 bp, Triticum aestivum
  Clone ID: PAT_TA_2579
tgtgcgagcgtctccggaggcccccccccgccgccgcccccaccggccccccccctcccgcccacgcccggctgctaaaggcagcgggcgaggtcagcgcgccccgacgagcctccctcgcgcgggggagcggcgtcaagggggcgtcgcggtggggatctccggtgaggcggcgcgcggcgaggtgcgtatggcaaggcggagcacggccgagggctcgaagtggaggtgctgggcacggtgttcttcgcggcgtcgggcggaggttggaggggctgcgcacccaggccctagaggcagcagatctcggccaggagaggccgcactggcgatggccgggatttgc

SEQ ID NO: 2580 - DNA, 421 bp, Triticum aestivum
  Clone ID: PAT_TA_2580
gtcacatatttcgtgagtctctgctcgtgaccgcactaacaacacactaacggtttggatatttgatccgagggggcctctggcccgatagcactaaccatcacgtgggcatagtatgggcgttctgcgtcgtatgcatcagccgaagcttaatagacgtcatgcgactgagcggcgcgcgccgggttggactggtaagctcctgcctttttgaaggaggtagctaggtctgctcaccggccgcctacgcaacgtgcaggtgttcccggggcgatggcccatgacccctgggggcataggtttagtccggcgtgcttgacctctctattaagtctaggtcgggttgcggcgtattgtttggacgaggccgggcatgacccaggaaagtgtgtccgaccggagttaatcgagcgtggtgggt

SEQ ID NO: 2581 - DNA, 454 bp, Triticum aestivum
  Clone ID: PAT_TA_2581
atcgaagaccaggccccggcaccgcacatcactttccccttagttgctcgacactactgggttactatcgagtgccgagggtgagacctcttcagcacttctaatgttaacgttgtagtgtagctattcggtcgtggtcatcgagggtgatttcctccttaaccacttcccaagtctcagaaaggtaacgatgctatctttgtcgtcatcgaccaattctcgaaggttgctcactttctgccagtcaaggagactatcactgctagtcaattagcaaacttgtatatctccagaattgtgtcactccacggcattccgaaggagatcagttcagaccgtggaagtattttcactccgaagttctgggatagtttccaagaggcaatgggaactcatattacctggagcactgcttatcatccccaatcccaagcccaagttgagcgagtcaatc

SEQ ID NO: 2582 - DNA, 1298 bp, Triticum aestivum
  Clone ID: PAT_TA_2582
ccacgcgtccggtgcccaccgagctctccggcgcctgagacctcgtccatcttctccgtcgtcctccaccacttcgtctacgtccacgaatcgagctggaacgcgccgagtcgagcggaacggcatcttcctccgtccccgcccgcgcgcccccgtcctccgaaccgccgccccgtccgtcctctccacccccgctgccctcccctgctgccccgcgaccccgagaccgctgctgatgcccctgtgatcgactacgtcgactgaccccccttcttcccattcggcggagcttccaggcaagccccccctttgatcatcccgatatcgcccattccattctctcatgcttgcattagattttgctactgttattgtttgctcctattctgatgcatagcctgcttttgtatctgcttgctgttaccttacctgcttatcctaaactgcttagtataggttggttagtgatccatcagtgacccccaccttgtccttgttgcccctgcttcatcatcgaagacccgatcaacgggatcgaagaccaggccccggcaccgcacatcacttccccttagttgctcgacactactgggttactatcgagtgccgagggtgagacctctacagcacttctgatgttaaccctgtagtgtagctattcggtcgtggtcatcgagggtgattccgccttaaccacttccgatacgactctgtcgtgcaacccctcaagtgtgaacctcgggggtgattcctcttacgttcaccttgatgattacatcgagtggaattcaccggaggtgattccttgggttttccccttgatgtttagacacacagttactatgattactatgactttacactaaaccatgttactaaagacggcttgaccctgaggggtacccgcgggagcttaattgcgagtgatgtggagatgtgttgacctggagagtaaccgagagttgaacacgaggcgtggccgggcattcttagcccttgtcgcaagtcctcgagatggggcgacagggtcacatatttcgtgagtctctgctcgttaccgcgtgttcctaatccactacagtctggatatttgatccgaggggcctctggcctgatagcactaaccatcacgtgggcatagtatgggcgttttgcgtcgtatgcatcagccaaagcttaatcgacctcagcgactgagcggcgcgcgcagggttggactgcgtaagctcctgccttgtttaagaaggtaattaggtctgctcaccggccgcgtatgtaacgtgtacgagttcccgggg

SEQ ID NO: 2583 - DNA, 648 bp, Triticum aestivum
  unsure (1)..(648): unsure at all n locations
  Clone ID: PAT_TA_2583
ccagatgctctgagaacaggggcaatcgaatatgagaagttcttggaaactggagaccctgaatttgcatggaaaccaccgcaggatgaatggaagagcattgccttaggttatacttctggaacgacatctagcccaaagggtgtggttttgcatcacagngggtangcttacctaatgtcactcagtggtgctcttgntatggaaaatgaacgatggcgcggtttacctgtggactttgccgatgttccactgcaatggctggtgctatacatggacgcttgctgctatctgtggaacaagcatatgtcttcgtcaggtcacagcgaaggctatcttctcagcgatagccaaccaaggagtgactcacttctgtggggcgccagttgtgctcaacaccctcatcaacgcccctccagctgacaccattctcccgctgcctcgcgttgtggatgtcatgactgctggcgctgctccaccgccctcagtccttgcggcaatgtcgaagctcggcttccatgtctctcatacgtatggcctctcggagacatatgggccatccacggtgtgtgcatggaagccagagtgggacatcctgccagatgacgagcgtgcccgcctccaagctcgccagggcattcgctatgt

SEQ ID NO: 2584 - DNA, 1121 bp, Triticum aestivum
  Clone ID: PAT_TA_2584
ccgtcccccgcgccattcgccccaccaccgccggagcgccgttggcaccacacctcgtcataccatgcctgcacggggcctcatatagcggagaagctgaactcgcaagacccccaccccctgcgggagctgcgatggccgtaccgccgcaacttcccccgccgcgccgcctcctcctcttgcccgcaccgctgggaccgtccagataccgctgctgcctgcccagccgggcggaaactccctttccgccgtgctgccacgggtccgccaaagggggccgggcctgccgcctggggtgtctttctagtcgtcgagcccgtgcgcgatcggctctgccccggtcttgcccgcgaagcctggcacccggctcggaggcgggtcgcccatcgacttcagcacgtgggaccagcatcctggagcccctcgtcgcgcatcacggccaggaccatcgagatttacacttcggtgtaatgtaagcattgcaatcgcctttgatatgttctggaacccaaggctgtctattgagatgttcttcaagaatgagggaaaattctccaaccgcgcgacatcgtcaatatcgagcactgctgtgactggtgagatatcaaagatggcggccccggtggttggcaattcagtctccgagttccagtcgggcttcagcgacatgaggtcggacatggcagcgagggtttctttcaagtatgggtgcacgagaggggtggccggcgcgccgttcttcttcgtgaacggtttccttcagcccggaggcgggtcgcccatcgacttcagcacgtggaccagcatcctggagcccctcgtcgcgcatcacggtcagaccatcgagatgttcacttcggtgtaatgtaagcactgcaagccgccttttatatgttggaaccaaaggatggctgccagcggctggctattgtacagacagcagccctgtgtgtgtaaagcggtcgacagtagtatcctctttgttcttctatggaaccccgcgcccagatgagaacattatatacatactctttttactggttagtgatttcggaactcatctgatcgtttggcttttataatcaagtgtttcaccaccatcgttatgaccagcgatttgg

SEQ ID NO: 2585 - DNA, 396 bp, Triticum aestivum
  Clone ID: PAT_TA_2585
cggcacgaggcaccgatctacctccagccatcactcagctcaaggcacaatcaggcactcagcggccgcaagggcacacatacgacataccttcagcgtctcggcgtcaatggagaagagccggcagtacatgatccgcttcgaggacccgagctccgcggccgcggagccacaggtgccgttcgccggcaaggttttctcgccggagcaggagcagagcgtcatgggcgccgcgctgctgcacgtcgtctccgggtacaccacgccggcgccggagttcttcttcccggcgagcaagcaggcgtgctcggcgtgcgggatggacggatgcctcgggtgcgggttcttcggcgcggaggccgggcgcgcggtcacggcatcggacgcgccgagagc

SEQ ID NO: 2586 - DNA, 561 bp, Triticum aestivum
  Clone ID: PAT_TA_2586
ctctcagtctcccctccggtggcctatcttacgatcccacccgccgctccttcgcagaaccttccgctccccgcctctacaaaaccaccaaaacccccacttgccctctcccacctcccgcgccgccatgggctcctcctcctacctcccccacgacatggatttctccccctacctccccgccgacatgggctcccccaccgccgacgacccctccctcaacctctacctctccgacctcatccccggctcgccctccgaatacctcgacctccccccgaccccgcaccacgagcaggagcaccagaaaccctcccccgacggccacggcggcgggggcggcggcggcggcgactccccctcctccacgccggaggacctcgtgctgcccttcatctcccgcatactcatggaggaggacatcgacgacaagttcttctacgacttccccgacaaccccgcgctcatcgaggcgcagcagcccttcctcgagatcctctccgatcccttcttcaactccacctccgacgacagcaacaaccgcgccgtctccccgtgctc

SEQ ID NO: 2587 - DNA, 1145 bp, Triticum aestivum
  unsure (1)..(1145): unsure at all n locations
  Clone ID: PAT_TA_2587
ggnctgcaggnaattcggnacgaggcttcctccggctgccaccatcatccctacagccgcagctgatgatccatcagctgacgcgtgccgccgtcgccacgagatcacagtcatcggggataacgtgccggctcccataactgagtttgactctggtgtcatcccgcttgatatactcaaggagatgcgacgcgcccgcctccctggtcctacgcccgcccccgccctcgcccgccctcttgccttgctcaatcaagacgctgtagctattgccaagacaggatctggaaaaactctcgggtatttgcttcctgggtttatgcatataaagcgtatgcaggccaccgcaaggtctggcccaacagtgttagttttggcacctaccagagagctcgcaacacagattttggacgaagctgtgaaatttggcagatcatcaagaattgcttctacgtgcctttatggcggtgctcctaaagggccccagttaagagatttagaaagaggggttgatgttgttgttgcaacacctggaaggttgaacgacattctagaaatgcggaaaataagcctaaaccaggtctcgtaccttgttctagacgaggctgaccgcatgctagatatggggtttgaaccacaaatacgaaaaatagtaagagacataccttctggtcggcaaactcttatgtacactgctacttggcccaaggaagtccgaagaattgcagatgagcttcttgttcaccctgtccaggtgaccattggaagtgtggatgagcttgttgctaataaagctattactcagcatgtggaggtggtcactccctcagaaaagcttcggcgtctggagcaaatattgcgatcccatgattcaggttccaagatactaatattctgtaccaccaagagaatgtgcgaccaactatcaaggacactcaataggcaatttggagcggctgccattcatggtgacaagtctcagaatgaaagagagaaggtcctgagtcaatttagatctggacgatctcctattttggtagctacagatgttgcggcacgaggtttagacatcaaagatatcagggttgtgatcaactatgacttccccactggtgttgaggactatgttcacaggattggcagga

SEQ ID NO: 2588 - DNA, 554 bp, Triticum aestivum
  Clone ID: PAT_TA_2588
cccacgcgtccggaagaaagggaaaatctccagcaacgacagaatgcgattgaccaactggttgctgaaaaggacagcctcactaaaaagaatgaagagctggcagcagagcttgaatctctgaaggaacagctccaagcaagggaatcgagcgatcaacagcagggaagtggttttcagcagagccactctggaatggcacacccaagatcaatgccgaaaaggaaacggcaatctggagatgaagatgttgatgagcatgagcttatggaagatctttccgttatagataatcctgatcaaggtttaaacactgagcttgaggctactagaaaggaaatttctgatatccactctaagctgattgaggttcggttgttctctgttgatatcagatacagcaaacatcccatcacactatgtgaaatcttatatataaagaaagttgatacaagaagtttgtattccaggggttcactgatcttagtactactggagtcatgtttggaatcaatgttaagctcatgcagtcatacctgcaatgcatgactctt

SEQ ID NO: 2589 - DNA, 1382 bp, Triticum aestivum
  unsure (1)..(1382): unsure at all n locations
  Clone ID: PAT_TA_2589
cccggccacgtcgtccgcccacgcgtgggctgatcagctcgggagccattggtgtagctgtgtagccaacaaattggtgctggttccccatttcctcagactatatggctgagacaggagatgcaggtcgcttgccaacatcccttgatgtgctggcttcagatgttcactccaggctggagttccacaggtatgccttcatggactgtgttggcataaaaaatgcgcttcactgtgtcatcgaagaaagggaaaatctccagcaacgacagaatgcgattgaccaactggttgctgaaaaggacagcctcactaaaaagaatgaagagctggcagcagaacttgaatctctgaaggaacagctccaagcaagggaatcgagcgatcaagcagcagggaagtggttttcagcaagacccactctggaattgtgacacccaagtatcaatgccgtaaaaggaaacggcattctggagatgaagatgttgatgagcatgagcttatggatgatctttccgtaatagaaaatcctgatcaagttttaaacactgagctcgaagctagtatagagtaaattcctgatttcgactttaaacttattggacgtttcactgatctgagtactactggaggaaggaatatcgccctaaaaaacatagggcaattggatgacaggccattcctggcggcatgccgtaagaagctgcctgccgaagaagcaagagaaaaagctaaagaagtacaccgtgtttggcaggggcatatacagaacccagagtggaatcccttcaagactgtcacagttgaaggtatcccgaaggagattattgatgtcgatgatgacaagctgcaagggctatgtgctgcatggggtgaaggggtgcacaaggctgtggtgagttgtttggtagaaattcaagaaagtggcaggctgggagatagaaacattgtacccgaggtctggaattacaagtgcaagagaaaggccactcacagtgagagcatcgagtacttgttcggtcaagtgaagcgtctgagtgacgcgaaatccagaacccgcagcgcaaggtgaccttgtagaggtgtggtggtgcaacaggatgatgacccacagtggctaggtagaacctgtctgaaggtgaagaactgaagactggaattgtcaatgaatcatatcgcagaacaatgttaggatttatgtgttatgtatctgtttggtaccatttataacctctggtagagtgccggtattaagcttttgcgtgcaactcttttaccagcagatcagctatgtttcagtaatctggtagactcgggtatctagcttagtgtgaactctgaacttcgatatttaacgtgcaagacatttctanaaggctcaa

SEQ ID NO: 2590 - DNA, 410 bp, Triticum aestivum
  Clone ID: PAT_TA_2590
cggacgcgtgggccgtctcctccctcgcatcggccttctcccacctctccctcccctccacctccgctccccacccgccccctctcctccgcctccccaccacccgccgcgccgctcgcctcgtcctcttcgcctccggggccgacgccgccgagccggtcctcgaggcggaggcgcctgccgccgacgacggccccgaggaggtgctcgcggttgaggccgaggaggacgcgctctccgggctggcgctgcgcaagttcgtgaagcagcggctgcccgggggattcgccgcgcagcggatcaccggcacgggccgccggaagatggcgtccgcccgcgtcgtgctccaggagggcaccgggaaggtcttcatcaacttccgcgacgccaaggagtatttgcaagcgaat

SEQ ID NO: 2591 - DNA, 1064 bp, Triticum aestivum
  unsure (1)..(1064): unsure at all n locations
  Clone ID: PAT_TA_2591
ccgccacgcgcccccgcccacccagcgggcacaccatctcgctccccgcctcggccctcgcctcctcctccgccgcgtcctccttcccccccctccccccccccccccccccccctcgcctactcccacgcctcccccacctccgcgccactcgccgcggcgccccctgcgtcacccccggcgctggggaacaagtccgcgagccggtgggagaggccgcggcaggtggcccctcagggccggagcccgggcgggcggccgcgggcgtgggcgcgggggctgcggaggacgcggccgcgccgcaggagctgcccgggggatccgccgcgctggggatccaccgccacaggccgccggaagatggggtccgcccgcgtgcgcccgtccggcgagggcaccgggaaggtcttcatcaacttccgcgacgccaaggagtatttgcaagcgaatccgatgtgggtggagtattgcaaggatccccctggtgactctagggtttgagaacaactacgacgtctttgtgaaagttcagggaggcggcctctcaggccaggcccaggcgatctgcctcggtgtggcgcgtgccctgctgaagatcagccctgccaacagagtccctctgaggtcagaaggcttgctgacgagagacactcgcgtcgtcgaaaggaagaaggcgggtctcaggaaggcgcgcaagcgtccccagttctccaagcgttaagcaggatacttcattgttgttagagtcatttctgcgccatctttccccacttgaaaaaaggccctctcgtgtctttgttctgtgctggacgccacagatttgtaacattcgttttctgaaagcatttttcttgaggttacaaaaaaaaaaaaaaaaaaaactcaccctaaaaccctcgggggggcccgctccacgcccccatttgatccgactgccncctcaccggcccttccaactcatcccctgccctgcccccctcccaacncggcacaccccctgcccaccgggcctcccaaaagcccacgttcctccaanattccacctatggcatggancccntngg

SEQ ID NO: 2592 - DNA, 749 bp, Triticum aestivum
  Clone ID: PAT_TA_2592
gcacgaggccaccttcccagtgacaccaagagggaggggagagatcgcaaattttctgcttgtccagtaacaacaatggcagctcctccgacgcccacgctggtgctgctgccggagtggggcgccgggcacctcatgtccatgctcgagtcctgcaagcgcctcctcctccgcggcggccgcgccttctccatcacgctgctcgtcatgcgcccgcccaccgcgcaggccacctcccaggtcgaggagcacgtccgccgcgaggccgcctccggcctcgacatccgcttccaccgcctccccgccgtcgaccccccggccgacgccgccggggtcgaggacttcatcgcgcgctacatccagctccacgcgccccacgtccgggacgccgtcgccgggatgccctgccctgtcgccgcgctcgtgctcgacctcttcgccgcgcccatggtcgacgtcgcccgcgggctgggcgtgccctcctacgtcttcatgtcctccaccggcgccatgctcgcgctcacgctccacctgcccgtgctccaccgcgtggttaccgtggggttcgacgagctggacggggagctgcacgtgcccgggctgccgccggtaccgccggtccccgggccgtgccccgtggtggacaagaagagccccaactacacgtggttcctgcgcctcggcggcagcttcatggacgccacggggatcatcgccaacaccgcggacgggctcgagccggggcccct

SEQ ID NO: 2593 - DNA, 981 bp, Triticum aestivum
  Clone ID: PAT_TA_2593
attcggcacgaggggaggtcggaatgtattctgcgctgactcttgggttgctgccacaggcaccgatagagcttcaacacatccgattggaatgatggcagcagtgatgaatgcagtattgctccaagcgtcactagaaaaaataggtgtggagacacgagtccagactgcactgatgatgcaagaggttgcagaaccatacataaggcggcgagctatacgccatctggaaaaaggaagagttgttatctttggtggaactggtgctggtacaggaaatccactttttacaacagatacagctgctgcactgagagcttctgaaatcaatgcagacgttgtccttaaaggtgtcattggagatgatgaatatggttgtcctcctaggagcaacggcagtgcaccatttgagcacatctcatttagggagttggcagcaagaggaaccagcaaaatggacatgacagcaattacatgttgtgaggagaacaatattcctgttgtcatctttaacatgttagagcctggtaacatgtccagagctatttgtggcgaccaagtaggtacgttagttgaccagtcaggaaggataacttaaatcacaagggcgattagctgtgttgtagcattgggacatttgtattctctcacggcagcgtgcatcttcgttgattgcatggatctttgtggatgggagagagggtaatgttcctcggagagaaggctcacaccttgatttgcatcgggtgctcgttgtttgtagcggctctgccatgagaagttgtttgtttgtagtatctgtctgtaatgtgatggttagactagttgaagagcctttgtataaagtcgtatttatgcctgcgtatggcgttaggtcaggtcatcagaatgttgtattgtgctctagtagtaacttgtaacgctgttgttgagctgtagtgttgtactgtattggagaaaggcatttttcttcaaaaaaaa

SEQ ID NO: 2594 - DNA, 850 bp, Triticum aestivum
  Clone ID: PAT_TA_2594
gccttgcgggcgcactcgctacccacgcacgacgctaaaccgtctcagagaaactagtactagctagcactgagcaatggcttccaatgcgagcttgttggccgtgatcatggcgtgcacactcctcggcggccacacgtgccacggcgcacgccacttggccgacaccaccccggcggctgccccacccgctgcggctgctgtccctggcctcccggccctgcctaccatgccgaccctgccaccgatgccggctgtgccaacggttccggccgtgacagtgccagctatgccgacggtgcccacggtgaccgtgccacaggtgacactgccacctcctatgcctgctgttccttccgtgcccaaggtgaccatgcctccgatgcccgccatcgtcgtgcccaaggtgaccatggcgccgatgcccgccgtcgttgtgcctaaggtgacggtgccaccgatgcccgccattccttccatgcccaaggtgacactgccgccgatgccttctatcccaaccgtcaacgtgcctatgccgttcctggcgccacctccatcagcataggtctgccatgtgcatggtgttgcgttcgtgatctcgctcaacgccccctcgttccattccatgcccacgccacccccctcgtgccgcgcctatgtgatgtggtggccccctggttgtttggctctcgtttctcccccttcccgccattttgtgtgtggcgttccccaaggcttgtccctgttcccctgtgtgttttagcttggtttttacccctccttgggtcattggggcggggttaaatctcagtgataaaaaacttcagtattcaaaaaaaaaaaaaaaaaa

SEQ ID NO: 2595 - DNA, 1343 bp, Triticum aestivum
  unsure (1)..(1343): unsure at all n locations
  Clone ID: PAT_TA_2595
ggccggccccgtctcacacgcgccagtccgtctcccccatcccctctcggcgattctcctagggttagcgccgccgccggccgctggccgcctccgccgtcgtcccgtctccttctcctccgccccgcgtacctgacccgccgctcgagctgtgccacgcgactgttctccgccgccaagctagtcggacggaccaccggccgcgcccgcctccctcgtcggccgcagttgcgagccgccctcgcccgccagtcgccgccaagctgcgccctccccatctccgagcctgctccgcacgctctgcgctgatttcagttnggttcgatnccctcaaaattcgtgaaatgcttaccaatggggggagcgttgccgggtgcccgggggacgtgtctgcacatcatgcgtttgggccacatgtggctgatgcgagtatcaaacatcggcttctgactaggaccacaactaccaggggtgacccacccctaaagaagctccaaaagaagttcatgtccttcgccaccgaggtagagaaggatgcagacaatacaagtgattgtgagaggctgtacaaggcctttctgcaggaaataaacacttttgagctgcctcttctaaaaagcaaggctgtagttgatgcaaatctcagggaaaaggagagcttcaacgagctgcaggttgagatccagcgacaaatcttgcaagctcagactgatattgaggatcttaaaaagcaacttgagcaaagcaagattgagaggcagcacaaagaggagtgtgaagcaatcagaaaactgatttcctcgcagcctccacggtcagaaaccgagaaacttatcgctaatcttgagaaggagatagctaatttggaggccgagagtgcagcatgtacaaggacgttagagcttaggaagaagcagtttgctcttcttcttcatgtggtggaggaattgcaaatctcgatcgaagatgagcaaaggaacatagcagatgagctgagagccgccactgaagagccaaagttgagcatagaggaaggcagcggcggtgcttcggatgcgatggctgtagactgattaacgatcctagcactagcgagttgcttaccctgcacgctcaagcatgcttcggtagtgtctgggcgcggtgtttctttgtaagagatccctttttatgttgttgctgtggtatcttgaaccgtaagatgtacttgacgtcgaaccattccgtgcttgtatgatagagatgcagaatcattgtgctgtaatatgtactccagatttagaattgcagcgtgattatttatcgaaaacggcggagtcaaaaaaaaaaaaaaaaaataaaaa

SEQ ID NO: 2596 - DNA, 1123 bp, Triticum aestivum
  Clone ID: PAT_TA_2596
gccgggcctcttctccccccgtccgctgccccggcctccttcccccccgctgctgccccccccccactctgccccccccgcccctgcggctcggctgcctccggacggccacgccgctgccattgggccctacaccccttcggttggacggcctaccccgtgacccaattcccctcccccccctgcccgggccgtctccaggcccctccccgccgcttgccgctgctccaggcccggggtcccctcgcccatgccgtcccggcggctgcgctcctggtggtggccccgggggggcgctgctgggcctgcagtacttggagccgtcggctggggcctttctctacgggggcggtcctaccgacgccgtccgcggcgatctcccgacgcagctctgcgttcttgccgccggcggggtctcttagagtcaatcaaaagtcttagtgccacttcttgctgctactacattcatgaggaccattgtgtgactacattgcctgtcgtcaagcctttcaagtatctggctctcctgatgtttacacaagggagatgctactaaggaagcagaacatggagaagttttcctgatgtttacacacagggagatgctactaaggaaccagaacacggagaagttttcctgatgtttacacaagggagatgatactaaagaagtagaacacgaagaagtttcaatgaattagagagttatagatgccagctggtcctctacatacctgataaaaataagaaaaatatatgtcaatgtaatctgcatccattgcagctaatagctctcagttttgcccatggcaatgggctgctgggtatcaaccgaatgacgaatagtggcccgagggatggtaacatggttgcctctttcggaatagccatttagatattattatgtttaagagaggatgacaattttttcttcaaatttgagccttccacgagctcaaatttgactccttggttcttatctctatgtagttatggatcagtgagataatggattaccgtggcttttgtgtagttatggaattatctgtgtataagaataaggatgcacatgtaattatagcttcttgcccaccttttatatttgtatcgtttttctgataaa

SEQ ID NO: 2597 - DNA, 840 bp, Triticum aestivum
  Clone ID: PAT_TA_2597
ttcggcacggccctgttccagtcccgggcgccccgcccatccgccgccctcccccccgtgcccccccgccgcggctccggcgtcggcggcccgcccccccccgcccgcggcctcccccccatcgccggctctgccgcgacggccaccgcgcgcccgccgccgcccggtcccgcggccgcgccgtcctcgtccgggccgccctccccgccggcgccggccgcgccggcgcccggcgtgagctacttcatcggcaactcctcgtcgccgtccgacgcgtgctgcgtccagatgcgggccctgttccagtcgcaggcgccctgcctctgcgccgccgtgtccgccgtgccgtcccagctcgggtccgtggtcggcggcctgctccccaccgcctgcgacctgccccccaacgcctgctccgctgtgacagggacctccggctctgctccggccggtggcgcagcggcgccgtcgtcgtcagggacacctactgatgctgctgccgccgcgccggtgaccggtccggctgatgcgaacccggctggtacgccttccggtggtggggtgaagtcggttccggggacggttgattcggcggctgccgttgagtgcaaggggacctccgctgccgtcgtcgtcctggccatggctgcctcgttcctaagtagctgcttctgttttctgatctcattgtgtgattccggccggggtttgctgtgagcttgtcacacgattagatactcaagtttatcattgatctgatccaagtgcgcatcagcgttgtgacttctttttaattggttatcatccccaatgcacatcagagttgtcaaaaaaaaaaaa

SEQ ID NO: 2598 - DNA, 412 bp, Triticum aestivum
  Clone ID: PAT_TA_2598
ttgcctccagacgtggcgttaactagctatcttgcagctctgtctatagaagagagcggtatttcagaaggattagctgcaattaaagcagaccgagcagcagagagcatatctcacagaagtgcccaacttcatgggggcacagaagatgaactctcactgaaagactctctggcggccgtgagaaatgcacctcaagcagcggctcggattcagaatgccttccgtgccttttctttcaggaggagacaacacatggacgctcgacttaaggatgaatatgggatgacacacgacgatatagatgaacttgcagctgcatcaaggttatactaccaacatcatgtttcgaaacggcagttttgtgataaagcagctgtttcaattcagaagaaatacagaggttggaaag

SEQ ID NO: 2599 - DNA, 1261 bp, Triticum aestivum
  unsure (1)..(1261): unsure at all n locations
  Clone ID: PAT_TA_2599
cgccctaagacccggtgaccgagacgagccccccaacaccttttgccgagacgagattctcttccgcagccgcccccgtcgacgtcgccgtcgccgtcttttgccaccgcgatgcctcggtattattgcgattactgcgacacttatctgacccatgactcgccatctgtccgtaagcaacacaatgctggatataaacacaaggcaaatgttcgtaactactatcagcaattcgaggagcagcaaactcaaagtttgattgatcaaaggataaaggaacacctgggacaagctgcagcgttccaagttggcgctcctttcaaccaacatcttcttcaatatccaggaaatatgccccgtccccgtcttccgattctgcccacacccatgatgcaacatggttatcctcaacatcaacaacctggtgggccatttgcaaggcctcctattttaccagttcctgggactccaggttatcctggtgctccaaccatgcctgcaacacgggggccctcctgggttcaatgcctatgcaggtggcacctcccccggtgcatccgtacactacaacgtataaccatcaggggccccacctgtgtatcaaccaaatcacgcatcaactgcaggctcaacttctggcgctccacccctggccccagcggcccctccacaggctgcattctcctatgcacaatcgaatgaaggcaaccactgatctgttccttggtggttatcgaatgagattcgaagaacagccgtaacttggaagttgatgcttcctgcctgtctgtctcctgaatttcggaggcagtctgtctcttgaaatttggagaattgttaagaaaggcttcctgcagttgtattttttgtattttaggtggtgtaacctttacttcttaatacaccgacttcgtattagtttcttgcccttgaaacttgataatggatataacccatggatggcgtacttgatgtagtacatatttgtcattaaaacaaatttatttgttgacacgacaacaaaaaaaantcccaaagggggggcccggtaccattcncctanaggancctattaccgcctcaacggcgtccttttaaactctgacgggaaacctggggtaccaattaacccttgaanaaccccttcncaactggtatacaanagccacgtgcctccanatnccaccnaagnaatgaccccntcgggataccggggttgngtacccactacgtaatttaagcctagccgcccttcttttcn

SEQ ID NO: 2600 - DNA, 353 bp, Triticum aestivum
  Clone ID: PAT_TA_2600
ttgttttttttgagatcatgatgtctgtctacttttcggttttgccctgttcgtctggtgtttgcctatgaaatcatgaagtgcaagtcgcagcaattaacataacgggagatacatggacagatcacgccccgtcaaaaataaaatgaaatacatggacagatcacgctagcatatcagccagttgatccacagatcaacagcgtgccgatcatctccatacaagcagctctactagtactaggcaaagctgatgttgtaggccttggcgccgtcggacctgaagatgccgaaatggcgctcgaacttggcgccgggcttgccgtactggtcgtagaggtcgaacaggaaca

SEQ ID NO: 2601 - DNA, 653 bp, Triticum aestivum
  unsure (1)..(653): unsure at all n locations
  Clone ID: PAT_TA_2601
tttttggtcgtccccttctccgccctgcgcaccgactaccgcccctacgagtcgcgccgccgcttcgccgcctcctacgacctcttcctcgccgaccgcgccctgctccccatgctgccccgcctcctcggcaaatccttctactccaccaagaaggcccccatcgccgtcgacttcacccgggctggctggccggagcaggtccgcaaggtcctcagctccactttcctgtacctgcggaccgggacctgctcggggatcaaggtgggcaggctggacatggaggaggaggagatcgttgacaatgtgatggcggcagtggaggccgccgtggagaaggtgcccaagaagtgggaaaacgtgagggctctgcatttgaaggctgtggattcggttgcactgccaatttaccaggttgtgccggagttaggcatgaagattgaggttcgggttgcgcgattggaagcaggagttggtgccggaggaggtgatcnatgctgcanaagttgggactggcagcaagtgcaaggacaagaagatgaaggcgctgaaagatgccaatggtggagctgaagctttgaagtacaagaggaaaaggaacaagaaggatcagactgaaaatgttgtgatggaagaagcccaaggggcgactg

SEQ ID NO: 2602 - DNA, 365 bp, Triticum aestivum
  Clone ID: PAT_TA_2602
ttgttgacgcgtgggtcccccgcaagcagccgcaagccgtcgaggccgacggcgacgggagccccccaatccccaaatcctgcggcgcggggcctcaaattcggcgccgcgcagcagcctcggtccggcttatggatccagatgttctcgtgggcccgtagcaagcagtcctcgcccgcctcctcctccggccgccgcggcggggacgccgccgccgccatggactccggaagcagccgccgcagcggcggggggagcgggcacggcagcggcagcgggagcgggagccgcggacgcagcccgcggctggagcggcgcaacgcggcgaagcacatcgactacgaggcgggcgcggcggcgacgac

SEQ ID NO: 2603 - DNA, 1153 bp, Triticum aestivum
  unsure (1)..(1153): unsure at all n locations
  Clone ID: PAT_TA_2603
gagaantttnancctntgattacgccagctcgaaattaaccctactaaagggaacaaaagctggagctcccccgcggccgccgccgctctgggcctgggggggcccccccgcggctcgcatcccgcccggccaatcccttccgctccctcctccaaattaacaacagagacaggggcagagatctctgtctcgactctcgatctcgagagaggaggagcagcaatggcgtcgccgcaggtcctccccttcctctgcgccgtcctcctcctcgcggggaccgcagccgcgcgccggcacgcgccgccgcaggcgggcgcggcggggcagagcacgtacacggcgcccagctgccgggagcacacggcgtcgctgctggacttcgggggcgtgggcgacggcaacacctccaacacggcggcgttccgcaaggcggtggagcacctgtcgcagtactctggcgagggcggcggcggcggcatgctctacgtgcccgccggccggtggctcaccgcgccattcaacctcaccagccacttcacgctcttcctccacgccgacgccgtcatcctcggcacgcaggacgtgacccagtggccggtcatcgacccgctgccctcctacggccgcggccgggaccacgccggcggccggtacgcgagcctcgtgtccgggagcaacctcaccgacgtggtgatcaccggcaacaacggcaccatcgacggccagggcgccacgtggtggtccaagtacaagtccggcaagctcaagtacacgcgcgggtacctcatcgagctgatgcacaccgacggcgtcttcatctccaacgtgacccttgtgaactcgccggcgtggaacatccatccggtctacagccgcaacatcgtcgtgtccggcgtcaccatcctcgcgcccaccaagtcgcccaacacggacggcatcaacccggactcgtgctctcaggtgcgcatcgaggactgctacgtcgtctccggcgacgactgcgtggccatcaagagcgggtgggacgagtacggcatcgccgtcggcatgcccagcgagcacatcgtcgtgcgccgcctcacctgcgtgtcgccgacgagcgcggtgatcgcgctcggcagcgagatgtcgggcggcatccgggacgtgcgc

SEQ ID NO: 2604 - DNA, 456 bp, Triticum aestivum
  Clone ID: PAT_TA_2604
cgcctctccagcaaatatcagtttccgtatatatcgtgtcgccagggccaacacggcggcctagcttaccttgtagttcatccagagaacacacaatggccgtagcgatgccagctgcgcgctcgcttctcctgcttctcctcctggttgcgccgctggcgccgggctcgtcggaggcggcagtccggccgaaccccaagatcgtcaactgggtcgcagacaatgcccgcgcctccacgcccgacagcttcggcgccctcgtcttcgacctctccgtcggcacgccgcggcagaccctctccttcgtcatggacatcaccgagcagctcgtctgggcgcagtgcggccaacatgggttcacgcagtcgcaggcgcccaccttcaggcccggcagctccttcgccccgattggctgcaaggacacggcatgccagagcctggcccccgacgacaact

SEQ ID NO: 2605 - DNA, 668 bp, Triticum aestivum
  Clone ID: PAT_TA_2605
gcacgaggacggcctctgcgcacgccagcagcgcgtgcaccaggagaacttctctgccgcggaggcgctggtgaagcagatacccttgctggccgcgtcccagggcggcgccatgcgcaaggtcgccgcctacttcggcgaggccctcgcccgccgcgtcttccgcttccgcccgcagccggacaagctccctcctcgacgccgccttcgccgacctcctccacgcgcacttctacgagtcctgcccctacctcaagttcgcccacttcaccgccaaccaggccatcctggaggcgttcgccggctgccgccgcgtgcacgtcgtcgacttcggcatcaagcaggggatgcagtggcccgcccttctccaggccctggcgctccgtcccggcggccctccctcgttccgcctcaccggcgtcggccccccgcagccggacgagaccgacgccttgcagcaggtgggctggaagctcgcccagttcgcgcacaccatccgcgtcgacttccagtaccgcggcctcgtcgccgccacgctcgcggacctggagccgttcatgctgcagccggagggcgaggaggacccgaacgaggagcccgaggtaatcgccgtcaactcggtcttagagatgcaccggctgctcgcgcagaccggcgccctggagaag

SEQ ID NO: 2606 - DNA, 834 bp, Triticum aestivum
  unsure (1)..(834): unsure at all n locations
  Clone ID: PAT_TA_2606
gcacgaggcttccatctcctgaactccacatcgtcccgcgcccaccccggcgaagtgcatcatctatcgtttgttttccctcaatctctaagccgatagaaaggtgagagttgaggggtaggtcggccgaccggagggctgtggaccatgtctggcgtgtgggtgttcaagaacggtgtggtgcgcctggtggagaacccggggagcgagcggacgtctacggtgcgacggaaggcgctgctgcacacgccgagcgggcaggtggtgtcgtcctacgcgacgctggaggcgaagctgacggcgctggggtgggagcgctactacgaggacccggcgctgtatcagttccacaagcgcggctgcctcgccctcatctcgctccccagggacttcaaccacttctcctccgtccacatgtacgacgtcgtcatcaagaacagggagtccttccgcgtcgtcgacgcctagacggccctcttccgtccatgcagtctctcgatctcgtctcatctgttcagctatagctcttcttccatcgtttgacttgatttcgcatgcagggtttgttgttgttagtgatccgggtgttatatatgattggttgtgcctgatttggttgggaggtctagtgtggtagtggagtgagcgagggtactgtttctgcacacatatgtgcgtgtggtgccgagtatatgcataggttttcgttgtgggtgtgtatatgtaatgcgtgctgggggtgtgtaagatctctgttttgatgtaaattagtgtccgtgtgatgactatatatatccacttacgttcatttgcacgtntccccgcaatgcacan

SEQ ID NO: 2607 - DNA, 346 bp, Triticum aestivum
  Clone ID: PAT_TA_2607
gagttgaaacacaccacagatggaacgcaatggagaaagatcgacagagagttcaaagattttgcagctgacgcaaggaacataagatttgctctaagtacagatggcatgaatccttttggcgagcagagctccagccatagcacctggcccgtgactctatgcatctacaaccttcctccttggttgcccatgaaaaggaacaacattatgatgcaattgctcatccaaggtccgaagcaacccggcaccaacatcaatgtgtacctaaggccataatttgataaacttttacaccggtggggcaaacttgtggtcgttttttggaatgaccacaataagaagg

SEQ ID NO: 2608 - DNA, 1578 bp, Triticum aestivum
  Clone ID: PAT_TA_2608
ctgaccttccgtctgcttcctgttccgtacgacatggctgctcgtcggcgtcttcatccgccactcggtgcggagctctcccgctctcaccctcgctgggtgatgctagatcgcttcgtccactacaaggcgtacgcgggtgaggctgttgcggaggaggtaatggacggcacgcaatcggcgatctcctctacctgcaccaacataagcatcgccgtctctctcagggttgctgaaccgcccgctgtgtcccgtctctacctccactggcccgagcgattcatgacggcgtcgttgagccaggtgagtcagccgttcatcatcgcggctcacggccgctccatacttttccaggcgcaggcccccttcgttggagatagctgtccggcattctactattaccccatggactatttcctctacacagcctctgactcagagaagtctccttgtctcatgcgactcccgccttgcttcgatggtggggacaagaacccggacgtggatttgtacttccacccgtaccgtctccagcagctgcgatctatgtggcgtgatgacattggcctcctttgccgtggcaagggggagttcgtggtggcgcagctcacatttggcggccagctctgcgtgctacaccataaacctggggaggagcagggcgacatgaattggagcgtcgaaaatatgcccttacctgacggcgatgacatcccaaacctgctgcgtggttcgtggcaaacggacgccgtcgtcccctatggtgattgttacctgtgctgggcggattgctacctgggcttgttttttgtcggtgtcattgacaagcggacgaagcccccgtgctacgtccccttacctgatggtctggattccaatcgtctgtgcgttgacccagggtatcctgacccggcccgtcgtgtctgtgtctctgagtccagcatgattaacctcatatgtgttggtgatcatgctggctgcagtgtgtgtgccagttcttgttctgctttcactatcacagtatggactttgaccaacttaagggaaaagaaatggatgaaatgtttcaccatggaagacagcaagttctcggctgctcttgattttgacaagcgtcttccgcatgtgctaccagagttccctaccatcagcttggttaagcctgatgttgtttacttccggttgaatggtggtaataaacttttctggctgattgagattgacatgaagaaggaagtgctggggtcaaccagtctctacatctttgaagaagaagaagaagagaaatgctccattgacatggcccactggagatcatttcctggttactcctttgttcccagcccgttcacccgatacttggaccagcatgccatcagaagtctggaactcagcgagaagttacagaatataagacttgagcaagctaaagaaaagatatttgttgaagagtgaagagcttatgctaggaattgttcggcagatagaagaaaccaggaatactttttagtattggtctgtcttgtcttaattttttattctgggtgcattggaaaagcttacctttccgggtgtact

SEQ ID NO: 2609 - DNA, 402 bp, Triticum aestivum
  Clone ID: PAT_TA_2609
tctagttctagatagtaactgtaatctgatgtgtatatattataagaatcataagcttagatgtatgtaaatcttttaccattttttggaactatttcgtatttccatcaaatgtagatgcatttttcaacatttccgtacaaatagtagactatattcatcctgtcatatagtgtgtaacattcatgttagcatagataagtaaatttgttaatttgaagagattttgcagcaaactcattatccatgtacttgtgcttatgtaaaatgctggcaacatcatacggcaagtgtgtattttagacttttagttcataacttcagaaaaaatctttgtagattatgttcttgaccccaacatccttattgctacttcatcatttaccattacttgcagtccat

SEQ ID NO: 2610 - DNA, 824 bp, Triticum aestivum
  Clone ID: PAT_TA_2610
ggttggccgggcgagtccagggggttccgagcgtagatcgcccgacgctgagctgcatgtgcacacacgcggaggtggtatagggacgagcagggagtggcgcttgtgaggagcccccgcctgatccgacgccgtgagagttgacggtcctgggcagacagaatgccggcgattgtcactcgatagggtttagccgtccgcgtgcacttctgtgtgagtagagcggatttggatgtaaaaatagatttaaccatgtgttggtgagatactgcgctagaaccacatgtcaatatatttttcggtttcgacgaggagctttgcaaccaagttggaaataagtttatatgattcattaggcgatggacggtccgcttgtcaagcggagccatttgcgcatcaatagaagatttccacttttactacagcgaagtttatacgtgctattggagaaggtcacacaccacgctagtttgtcatcgaaaccagccaccgttccgaggactctgacggcagattgcttggcggacagcctcatcgcaatcttcgctccatcttttttctgccaaccacaaaccctactaggcggttcgtgaccatcttgatgtcgagttctcggtatccgcggcttcgtgtgattctacatttcctgcttatttttttctgcttcgtggcctcggtgccctgcctggttgctctggactgtgtgctcttcctaaaaacgatgcccggtcggcttgtaaagcggaactatttgcgcatctgtagatgattttcctccattgtgcgcatcttccgcctgtcatcccataatatagtgcgcacac

SEQ ID NO: 2611 - DNA, 1170 bp, Triticum aestivum
  Clone ID: PAT_TA_2611
cccggcacgaaaccatcgtccagccacgcaggcgagcgatggcgagcctgagcgtgcctccggtgctcacgcccccgcgcgatgacgccgtcgctctccacaaggccttcaaagggttcggctgcgacagcacgacggtgaccaacatacttgctcaccgcgactcggcgcagcgcgcgctcatcctgcacgagtacaaagccatgtaccatcaggatctttaccatcgcctagcaaccgagctgagtggaaaccacaagaatgctatgctgctttgggtcctcgcccctgctggccgtgacgcgaccatactgacccaagctctcagcgggcggcatcaccggccggagagcccccgccggcgtcacccgccccacggcaccctcgccgccgcagggcccccggcacccctgccgtgccacgcccccgcgccaccaggccccccacctcgccgcacccgcctgtccagcccccacgcagatcatcccctccacgccggggctcccgcgcaacgaaggcccggaagttgatcctgcggcggtcacagacgacccgagggacctcttcaccgaccccagggcgggcaccgatgagcgggccttcatccgcatcttcagcgaacgcacctgggcgcacctggtgtccgtggccaacgcttaccagcacatgtacgcccggtccctggagaaggccgtgaagagtgagacgacagggaacttccagttcgggctgctgaccatcctcaggtgcgccgacactccggcaaagtactttgccaaggtcctgcacaaggcgatgaaaggcctgggcaccagcaacgcggcgctcatcacgggtggcggtgacgaggaccgaggttgacatgaagtacatcaaggcagagtaccacaacaagtacaaggggtcgctggctgaagctatccactccgagacgtcggggaactaccgaaccttcctcctctcactcgtcggctgggaccgctaattcgctcctgtcgatcccacgcatgcatggtggcgccaccaagactgccatgtgtgatccatcaataggcattggggcacaataatctgaaaaggagcaaaataagattgtattattcctgtggaatcaacacaattgttctatgttcacttttccaaatatggagtcatcagtaccttcactat

SEQ ID NO: 2612 - DNA, 537 bp, Triticum aestivum
  Clone ID: PAT_TA_2612
gatgtcttgacccgatacctctggaggccccaatattagataatactcataaatgcaaaactggcaaaaatcatagagcaaagcgcgaatatgtagtagctacccacacattgtacctctcagcagcattcagttttactccatttaatacacagtgttcaagctatgtgcatatagttgtgggcttgtggcatgcccccatctgtgatatgtgaatctgagggcaaaacactcgaactgaatcgacaatgcctgaaatgtatacttcttgacctctcagtgtcccattctgccattgtattgtcatgagtcttgactccagagttgaggtaaattgtgagcaacctaaggccagaaggcggaaggagaactgtgttatgctatgcatataattgagtggacatttagaagctgttgaatgcagaaaaaagatgcaatactgggccgcccctcatggagaaattatgaggtactacagactgtatcccatgccccaatatgttgttgacttgataatacacgtgcgagcttaatgcc

SEQ ID NO: 2613 - DNA, 1333 bp, Triticum aestivum
  Clone ID: PAT_TA_2613
gggctgcacgcggccgtcggcaacgccgtcgccgacgacaagcaaatcgtgttcgccaccggctccatgcagctgatcaacgcgctggtgtacgccctgtcaccggacagcaactccggctccacggccagcgtggtcgccaccacgccctacgccccactttacggcacacagaacgcggtgctcgtcggccgacagccgggagtacacatgggccgggaacacctccctgtgggccaaagcgtcgcggaaccccaccaccaaggaggacggcatcgagttcgtgccgtcgccgaacaaccccgacgccgtgctccaccagcccgtcgtcggcggctcgtcggcgatcctcgaccacgcctacttctggccgcacttcacgcacatccccgcgccctccgacgaggacgtcatgctcttcaccacctccaagctctccggccatgccagcagtcgattcgggtgggcgctgataagggacgagaaggtggccaagagggtcaataactacattttgcagaacaccatgggcgcgtcccgcgacacccagctccggatgctcagcatcttcaaggccatactggccaacctgcacggcaaggaggacatcttcgcctttgggcacgacgtgatgacggccaaatggcgcaagctcggcgccgtcgtgtcgcgctcccgcaggatctcgctgcagaacatccctccccagtactgcacctacttcgacaagatcagggagccatccccagcttatgcgtgggtcaagtgtgagagggaggaagacagtgactgctccgacgtgctgctcaaggccaagataatcacacggtccggcgtctggaacgacgccagcagccggtacacgaggataagcctcatcaagtcccaggacgacttcgacctgctcctcgagaggatcacagaatttgtcgatgccgagctcaccgctgctggttccaactccatgtgatgtcccatgttaatatacagaaacgggtcaagaaaatgtcagtatacagaaggtatgtatttggttaggacgggtaccaaaagtacgacgtccagagatcagctacgcgttgattgtgtcccacgcaaggtgatgatcacacgagcacacattgtggatggactatgaacgaacactgaacattaccggaatgatcagctatgttgattgttctcagtgtgtattactagtacttattagacaagagaaatgtttccatgctgtaatgagtggaggattaaggagcgcatgcaaagctcagaagccggtacattaatgctagtttgtccagtcatcaaaaaaaaactcgagactagttctctc

SEQ ID NO: 2614 - DNA, 1099 bp, Triticum aestivum
  unsure (1)..(1099): unsure at all n locations
  Clone ID: PAT_TA_2614
ctgttcagacgatcgacctctttcagtggataaagctgttgagtccaataaaagatataaccttactggaaatgtattaaggcagtacaacacacgacaaaattcatcgatgaatagagttttgcctgagccaggtatctaatcatggtctgcatgcactagctaacatctataaaaactcatgggacgctgttcatattttatcccagttgtctcaccatggtggctagtttctctgatgctgtttaggtgcgccggagccagcaggtcgcgccccaaatgtccatgaaggcgatgcagatgatgggatcttgaaattattttcaagaaaagttcttgctgtaattctcaaagtactctctcttttgcgcttgttcactcgccatgagcaacagttggaaaatgttcatccacatactgcagccgtacccagtaatcaaccaaatcttcagatagttaaggaagaccgagtaaatccttgtctggagcgtcttgaaagacttgaatcgatgtgtaatcaactcagcagaaagcctcctgagatcccacaggataaggatcgtgctatacaggattcttttgataggataaaatccattgaatttgacctgggagaagacaaagaaggtattgcatgcaacagtgatcaaacaaatgcagatggctgaaacattggagtccgtgacagagtctggtcatcatagaagaaggaaattttgtacttaataaactcacagcaatgtacatgtgaacaagaaaaaaaaacagagatggcgactctgatgactgctttccgacagaaactaaacagcattgctttgtatatggctgctcagtctcgcttctctttttggtcaatcaaaaagatgggtgatgttaataagaaggatagatagttggtgaccggaggaaaactgaggggatggtcaagaagagcgccctgnaagataactgaatatagcgaagataactgaatatagcgcggcttatatatagcaaaagaaagttgaaagatgaatcccgacgcacagctcatgttctttgtatgttttctgttttctctgcctctatgcgcctcctgatctgctgtatgcctgta

SEQ ID NO: 2615 - DNA, 322 bp, Triticum aestivum
  Clone ID: PAT_TA_2615
tgattgtattaagcattcgaccaagccatcgagcgacctcctcgatctgcatttggcatcggtggtcaacttgcattgctcgatcgcgccgacgtctagctcaagcaaccttaagttagcaagctagctaggctcagaaatcttctagggctatagtacacacactttgcactacgtactcacgtgtggtgtgatcacgtcgtcgtcgtcgtcgtcgacatggtcggaagcagccccatgcaggctgtgctggtggcgccgggggtgaagggcaagcaggtgctcccctacaagcgggacgcgctcaaggagaagcacgcca

SEQ ID NO: 2616 - DNA, 1035 bp, Triticum aestivum
  unsure (1)..(1035): unsure at all n locations
  Clone ID: PAT_TA_2616
ccccggctcaggcacacggacaggccgccccgctgggccggcggcagctcgaccgacgactgcacccgcgcggcaaacagcatcgcgacatccatggcgttctccgccgctcgcacgatgcccagcaggcagctcacccccgcggtctcgccggcctagtcaaaggcctcgtgatcatgcatcacaccggtgagcgcaatgccttggtacacggaggaggtacgttcagataccagccgccgaagctcgcgctgccgagggcctgcgacggcgacctcgaccaccacgggtgcatcgccaagttcaacagactccgccaagtggttcttcccgttgctgagcgaggcctgcgactacatgcggtcgctgctgaaaaaatcgtccatcatcttcgtggacatgttcgcgatcaagtatgatctcgtggccaaccatccccaatcatgggattgagaagccattgatgacatgctgcggccacggaggccccccttacaactacgaccccaagaggagctgcatgggcgacagcaaggacctgtgcaagcttggcgacaagttcatcagctgggacggggtccatttcaccgacgccgcaaacagcatcgttgcctccatggcgatcagcggcgaatactccgttcctaggatgaacctcaccagcttggtcaagcctgcaaaggccaaggctgcgtaatgatgcatccatccagtgaacccaatgctttgagatataggaatgatgaaggtgaaggtactaacaaaactaacccccaatgagagttcatcggaagtccttaatcacagactcgcagtcaccgtaaaaaatgggactttattttttcttcttttcttttcctttctgtataattgaagtgtgcgtatattctaggggttaagttaatgcatatgcaggttgtctgtggactgtggctctgtgccatatatgaacttgtctacaaaattttccctcaaaaaaaaaaacattgtctacaaaattctgaagtttgatcaataaanacttaaatagagant

SEQ ID NO: 2617 - DNA, 819 bp, Triticum aestivum
  Clone ID: PAT_TA_2617
tgcccacgcgtccgcgttccatcatttttaactgttttttttcactggttttttagtcccctccccaccccacaggcagcaaaaaaacacccgacggcacgacgctcccatcgatccccttccaatcgatccctttgtcgccgccctcgcactcgcgtcaagcgccctcgatccctgcgctacctcccttcgccgccgctgccacagatcccttccccgcttcaggagccgccgatgatcccttccaggagccacgggtatcttctctctcgggacgctgctccgacacgatccggtaaggagacaggcctccgtgtgcggcaacgaaggcggcgagtggcgggcgacggccgacccttcactccgcctcccgccctcgcggcctcgccgcccctggtccgccttcacccacatgcgccctccacggctccacggccgacgcctcccgcgctcctcccccggccggttcgctcggccttcgccgctgctggggcctgcggggccgtcagacttcgtccctgctctggtctgcggcgatccgcccgtccctcatgcgtcggcgggtctccatccgtcggccggccactcggtcgtcttcctcttctggctccctgcgtgtcgtacccccccccccgtgtccctttcgcacggcggggcagagggagttgattgaggaccgcatcgttggcgacccagtgcaagcacgtggcagcgactacgatgcacattaggctactgttcttctaccggtgcgcagcggccgtgtgccgccgccgagctcttcattggcgtcctcctggtacaccatcatgcagcacc

SEQ ID NO: 2618 - DNA, 797 bp, Triticum aestivum
  Clone ID: PAT_TA_2618
tttgtcattggtgctgaaaaatgttcacctctattaagactgagtgaggaacggatgatatcgaggattggagttccatttgaaccttgcaatggcaacaacaagtatgtccaggtaaaaagggaggcgggctcgttgccttcaacaattaccagtgagtgggactctgaaggacatctgtgtagctcagtttgcaatcatgtggagatagctatgcaagctctctgtgctctttatcgccaaaggaagttagcaatgggggatgcaagagaggaatccagggcacgtaccttggcggaatttcttttggatggtgatctgcagggaccaatgagaagaactgttgcggaactagagaatcatgatgcgacaaatccactttttcttatccaagtaacaatcagttgctctgggcagttgtatgatattttcaggaagaaagaagatccatacttctgttgacgacaacgaagcagtaagtacgtggataagatgcagactccataacttgtcatggaagaggggcatattttgttgtgatgcaggtggtaccgaaaccaaacagtatggattagagtgatcctaattaggagtagttcctcgttgaaccatggtttgaacccgttgatgaagaagcatcgacatggcggctctcatgtcgaactttgttttctgctaggatttgaattgctgatgccggggtgcatctcttttgtacagtatgatgtagtcatgtgactcccttgcaggggtgttctataatcctctagctgcgaatcattaccatcataagatgc

SEQ ID NO: 2619 - DNA, 826 bp, Triticum aestivum
  Clone ID: PAT_TA_2619
gtcaatgacgtgctagtcggagcgacttctgctgctctatcaagatatttttttcgcaaatctggtgccaataacaccaaaatatgtctgcggtctatcctccttgttgatacaagaccaaccactagcctacaaatatgtttattgattggaaatgttgcaactaggctagatgctccttccatcatttggcgagatatccatttgcatatgtccgatgataggaataagagctatcttcacgtgtaaatgggcgaatcgtttatcaaaatgtttggtctgaaggctggtgcttttatctttggtcgtatgtttgccaatacaactcttgcgggtattctcaggttgctgaacaaatagagttgtatgggcaccctgttgtcttcatgcgcctagtgtttatggagctccgcaaggtctgcttgtgcaatgtcagagttacaatagcactattatggtaagtttgtccgtcgatgaggaaataattccagattatattgaacttatggatgactttgttgagtctttcgggcgcattaaggatggggcttcaagactttcaacatccatcaagcaagaatagtcaatatgcagatatatcagtgtgctccctaaaattgtataaagacagcaatatgctcctatatattcgctgtgtgtatcacgagtcatactagtaattaagaagcagaacatggatggaagtcaaatgtattaagttcactattattgttggataatgatgtgttgcattatatgaagcacaatagttataccattattgtgtataatgcacactattaataaaaaaaaaaaaaaaaaaaaa

SEQ ID NO: 2620 - DNA, 566 bp, Triticum aestivum
  Clone ID: PAT_TA_2620
tgttctgaaggttcagggcggtatacctggtcagatggtactagttttcggcgcgagtggaggacggggatgaggcatgggcaaggaaagacgctgtggccttccggggccagctatgagggcgagtatgccggtgggtacatatatggtgaaggcacgtacactggacaggataacatcgtctacaagggacggtggaagctgaaccgtaagcatggtctcggatgccagacgtatcctaatggggacatgttccaaggttcttggattcagggagaaatacaaggtcacgggaagtacacatgggaaaatgggaacacgtacaccggcaatatgaaaaatggcaagatgtccggaaagggaacatttacttggaaaaacggtgattcgtacgaaggcaactggttagatggcatgatgcacgggtatggtatctatacatggagtgattgtgggtactatgtcggaacctggaccaggggattgaaggatgggaaaggtacattatatcctagtggttgcagagcgcctgctggtgatgagctgtatataaaaaacctaaggaa

SEQ ID NO: 2621 - DNA, 730 bp, Triticum aestivum
  Clone ID: PAT_TA_2621
aggaattcggcacgaggctcccctcccccctgcctgctttgaccctgctggctggctgcctggcttcatctgcccgccacgcctttccccgccgccgctcgccgcttggattcgtaggatccagcgaagcccgtccccgcgccgttcgccggggcattaggtgacccggccgtgccgtgtaggacacgcggaggaagatgaccgtggaggggagggtcagcggcgggggggacggcggcggcaaggacaagttcccggtcggcatgcgcgtgctcgccgtcgacgacgaccccacctgcctcaaggtcctcgagaacctcctgcgccgctgcgtttctgatgttacaaccactgggcaggcagccaccgccctcaggatgctcagggagaacaaggaccagtttgacctcgtgatcagcgatgtccacatgccggacatggatggtttcaagctcctcgagcttgtcggtctggagatggacctcccagtcattactaaggctaacctgcttaatcctctgctgctctttgtaaacgatgctctaaaaggtatcactgccggggaatgattgtcgagtgaatctactcgtttcatgtcatgtcatttggtgctccagaactttggagatgaattatgtctgctaacctacaaacatcgcaaatagttcctcgatgtgctactgctagttttgttagggaagatggaaaatctttgttcatttgtgtggtt

SEQ ID NO: 2622 - DNA, 829 bp, Triticum aestivum
  Clone ID: PAT_TA_2622
tttgttctaagggaatgaaagaattgtcataaccgagtttgtgtcaaatggcactcttagggaacatttggatggacaacatgggctaatattgggcttcagtcagcggcttgaaatagccatagatgttgcccatggattgacttatctgcatctatatgcagagaagcccattatacaccgggatgtgaagtcatcaaacattctactaactgaaggcttcagggcaaaagtagccgacttcggatttgcaagaattggttcaacagatccaggccagtcagagattcaaactgatgtgaaaggaacagctggctatgtggatccagagtatctgcggacaaactatctgacagtcaagagtgatgtgttctcttacggcatcttgctcctggaaatcctatcaggtcgtcgtcctattgaggtgaacagaggaggaagagaaaagattaccgtgcgatgggcctttgagagatataacaaaggcaatgtccaggagatactggatccaatgttgaccgaatcagtaaacgaggatatactgaataagattttcgatgtgatgttccaatgcgtcgctcctacccgcgctgacaggccacatatgaaagaggttgtggagaagctctggaagatacggagggactacgctaaaacccaaaacagagcagaagggtctctttaaaccatcttgcactgggttattgactgctgtttttttcgcttgagagaacatgggtgaactcggttcttgttaaggctgaacattgccgtgcttttttgtcgaacacgaacagctgaaatctgtacctcggccgcgaccacgcgt

SEQ ID NO: 2623 - DNA, 753 bp, Triticum aestivum
  unsure (1)..(753): unsure at all n locations
  Clone ID: PAT_TA_2623
attcggcacgagggccagctgctcgctcgccgacgtcaacggcctcgaggaccgcccgctcgccatccccaaggccgacctcatcccccgccctcccgccgaccacaagctcgaggaccagatcctcctcgcgcagatcaccaagttcagctgcggcgggtacgccgtcggcatttgcttcagccacctggtgttcctcgccccgcgcccggcgcagttcctcacggccgtcggcgagatggcgcgggggctcccggagccgtcggtcaagccgatctggtcccgcgacgccatccccaacccgcccaagccgccgctcggcccgccgccgtccttcacggccttcaacttcgtcaagtccaccgtcgagatctcgctggacagcatcaagcgcgtcaaggaccaggtcgccgccgagacggcccagcgatgctccaccttcgacgtggtgaccgccatcatcttcaagtgccgggccgcggccatcgggtccgcgcccgacgccgaggtgcgcctgggcttcgccgccggcacgcgccacctgctcggcggctccctgccgtcgccggacggctactacggcaactgcgtgtaccccggcggcctcgccagggccagcaaggaggtgaccgaggcgtcnctggtggagatcgtgacggcgatccgggaggccaaggacgcgctgtcggcgcggttcctggactggctgggcggcggcgccaaggacagccactacaacgtgtcgctggacta

SEQ ID NO: 2624 - DNA, 1738 bp, Triticum aestivum
  Clone ID: PAT_TA_2624
ggaggcctcaaaaagaatcctcgtctctcccctacatataaaaaaaaaagcttctccgccgcttgccgtagtcagcgaggtcgtcccaaggccagtccttctcgatcctcgggactcctgatgaagctcgcgccgtccccggtgtcacccggcttggccgccgacggaaagcctttccctaggtcggggaaggagctgaagcgaaagcaagaacatgatagcacaacagcaagtagtgagagtagcaagctaaaacatttcataacaggaagtccagggcacgatgatttgaatgatagttttgatgagcaatttggcttgaagacttctgggtctggaaaggagctgaagcgaaagcaagaacatgatagcacaacagcaagtagtgagagtagcaagctaaaacatttcataataggaagtccaaggcatgatgatttgaatgatagttttgatgagcaatttggctacttgaagacttctgggtctcataatgagcaaggaggtggttgtgcaagtggcatattggtgagaagcacaaacaatgatgtgaatctcttgaaagattcttgctttgacccacaagtatctgttgaaaggatacatgaaaatctgcgctcacttggttatcccttgccaacaaaatattgccgaggcatgcgtttgattaatcattgtgctgagaaatttgagtatgtggatggtacttggcgaaatgtccagaaggagctcagtaaagaagttgctttaaatttgtcctgcagtgttgtctcacttgcttcattcaatgggactacaagggtatttgcatgcacaggcatacttatagaatgcacgcgtgttctgacatcagcaagcttagtcagatctgatgatgaaaataagatcgatgataacttgaggattaaagtataccttcccaacaaacaatatgtcgaaggaaatctgaagcattataatttacactataatgtcgctgtagtagacatcatgccctgccctggtgtccatacagcaaatctctaccatgaagtacaatttgagccctcttgtaaggtggtggctctagggcgcacttttgtaggtggcgcattaacggccgcatgtggaatgttgactgacgagccgagcaaatttgattgcacagagcttttgacctccacatgtaaaattaaaaaggttgggattggaggcccccttgttgattttgatgggcactttattggcatgaacttttatgacgagggaaaactccattcatacctaggaataccattcttgaatgcctgaggcattttaagacagacaggagcattgatgccagtagtacaataaactgcaaattaaacagatggccagtgccgaaaccacaatgggtttatccggcgggcgatttgtttttcctgaacgaccaggcggaattgaaagcataccctccactgttgctttaacttgccttggctctcctggcctatcggcccatagtgtgataaccaccatgcgacccttatgttacgctggacctgttactgccttgcctagcaagcgtttaaactattgatacacaaggacttgttttgctgctaactagctggcggaagcgcggaaagtatgaatgagcctgttggctaaattgtgccttaatttattgttttttgtgtttactttatttgttttactaagtagcgtgggaagattacaaactatcgaaaagagtataaattgctgggttgattaa

SEQ ID NO: 2625 - DNA, 809 bp, Triticum aestivum
  Clone ID: PAT_TA_2625
aatcccttcgcggtcgcctgggttggttagccgaggcaggctgcgcggcgccccccctccagctcctccgtcgctgctgaagactcgggctgactgctcctagtgcttggggagcaggatgcaagtctttacacaggtgatgggtccgttgacatcaaaggccgtcccgcaacaaggcgcgacacaggcaattggcgagcatgcgtcttcatcctagggcctggctgttgtgagcctctcgccttctctgccagcgcttcaacccccgtcacgtttcgcaactgtttgccccgtcgcggccttcctgcagctgcgcgcattgttcccacgtcgctaggggcttgccctcgggcctggaggtattaaaccatgtgtgtcatcctttggggctgatcaatttgatgacagtgatccaacagagagagtaaagcagggttccttcttcaactggttctatttctgcataaatatcggtgcactcgtatcaggcactgttattgtttggatacaagataactcgggttggggaataggatttgccattcctactgtatttatggcattggctattgcaagcttcttttcagcttcagatatgtatagatttcagaaacctggtgggagtccactcacaagagtgtgtcaggtcgttgtctcagcattccgtaagtggcatgttgaattgccacatgacactgctcttttatatgaagttgatggtcaaaattcagcaatagagggaagcagaaagctggagcacacaagtgaacttgaattccttgacaaggctgccatcatctcatctactg

SEQ ID NO: 2626 - DNA, 600 bp, Triticum aestivum
  Clone ID: PAT_TA_2626
ggacgagcagcagcagcagctcgggttgcctagctgcttctctgctttgcttgcctccgtgggagtgaggtctcgagagggaaccccatggcgtccgccgccgcgcttctcctccagctcttttttctgctgctcctctcgctctccgctgctcagcctggtttcatcagcttggattgtgggggagccgatgattacacagatggctttggcatccagtggacttctgatgccaagctggtcttcggtgggcaggccacaaacctgccggtccaaaaccagctccagaagcagtattcaactctgaggtattttccagcagacaacagcaagtattgctacacgatgaatgtgaggaccaggacacgctacctcgtcagagctagcttcctctacagaaacttcgacaacagcaacgtctaccccaagtttgatctctccctcggagccactccctggtccacggtcataatcgatgatgccgacacgccggttgtagaggaggccattatcttggctgccgctcccacactcagtgtctgcctctccaatgccagcacaggacagccgtttatatctacactcgagcttcgccagttt

SEQ ID NO: 2627 - DNA, 807 bp, Triticum aestivum
  Clone ID: PAT_TA_2627
ccgaatccctaaagcccgaccagtcgaccaccagccagctcctccgtcctctccccccacccccgccgcccccccccccccccccccgccccccccgccccccccggcgccccccccctcccccccgcgggcgggcacgccctcccccggcggccgatccggcccccgccggcggccgcagcgggaagcgccggggggggccgcccgacgcgccgggcgagacgcgccgccccggcgtgcgcggactggcccccacgacctgcgcggccggagccccacagcccgcgtgtccgagaggcgaggcacgtacacccagacaggaaccctaatgacccccaggccgcacggaagttccaccaactaggggaggacataccaagtgctttagtggcccccgctcagcgccaagcattactgatgcagcatgggaaatctggcatctcaacggatgggataattgatccagcagcaattttcgcgatgctattcggtagtgagctttttgaggattatattggtcaattggcaatggcgtcaatggcttcacttgataattttgacgaagatgaacagatcgacacaaaaaagttgcaagacaaaatgcaggctgttcaaaaagaaagagaggagaacccggcactggttcttaaaaaccgtctgcacctttatgttcaaggaaataaagaggaattcgttcggcttgctgaggccgaggtgtccagacttagtgatgcagcatatggacttgttatgctgaacactattggctatgtatattcaagacaagctgcaaaagaacttggaaag

SEQ ID NO: 2628 - DNA, 653 bp, Triticum aestivum
  unsure (1)..(653): unsure at all n locations
  Clone ID: PAT_TA_2628
gtttattttggattgaaaatttacttgtccgaccagcttcttggtacttgtaaggaagcacgcctcttggtcaatgtggctgaggaaactgacctgaaacatcctatttccttcacgtataaatggctccctcctgcggatgataaggatgaagatcgccgtcagcccaagggccttaactttctccatgatgccaacctgccggtgatctacaagcaggccttcaacatctactggactagggtcagtttgagccttcacgagctcgacatcggagccagcactctacatgcttatcgacgcggtggccatcgaggtcaaacttgtccggaaatatttgtcggagtaatggatgtatctatacgcattttagttttagacacatccatttttatgcatttcttcgacatgtactgtgatttgtgaagacgtgcgttgcacgtacacgctaactagtcaatgtaagtagcatggcgacaattttccctcccaaaaatatttggaatgaaatcgaactatggccggaactctgaatatcctgggatggatgccaaacctgagaaacctaagaacatttgccgtcatggcacataattgtccaatgagatatgaagctctgtgtacttggtcacctatattgagaangatccact

SEQ ID NO: 2629 - DNA, 1014 bp, Triticum aestivum
  Clone ID: PAT_TA_2629
ctagattctacctgcatagcttgtacgtgcgcgcagctccggcaagtcaggcgatcgatggatagagatcccatggaggcgccgacgtctacgacggctgcgctggttatgccaaagacagcgccggcgagcgacaagaagctgccgtcgcggttcaggcgggtctgcgtgttctgtgggagcagcgcagggaggaaggcggcgtaccaggcggcagcggtgcagctcgggcagcagctggtggagcgcggcatcgacctcgtgtacggcggcggcagcgtggggctcatgggcctggtgtcccgcgccgtgcacggcggcggcgggcgcgtcacgggcgtcgtgccccggtcagtgctcccgcgcgagctcatcggcgagacgcccggcggcgaggaggtgaaggccgtgtccggcatgcaccagcgcaaggccgagatggcccgccgcgccgacgccttcgtggcgctccccggcggctacggcacgctggaggagctgctggaggtcatcacctgggcgcagctcggcatccacgagaagcccgtgggcctgctgaacgtggaggggtactacgactcgctgctggacttcatcgacagggcggtggacgaggggttcgtgtcgccggcggcaaggcgcatcatcgtcgccgcgcccacgcccggcgagctgctggcggcgctggaggactacgcgccggcgcacccgaacggcgggaggcgtgaagctcagctgggagtcctccgtgggacaccatggcctgctccgccgcccaagccggacatctcccgctagcccgggccggcggccggttcaactcaccaacaaaccaccaaacccaaagattaagtttgacaaacacacacacacacatatcagactcctagactatatatccattaacatccaaaccaaaacatagatattcatcatccgttatatatatactttgtaatactttaagatatccttgggtggattaacaactaattcccgtataaaaaaaaaaaa

SEQ ID NO: 2630 - DNA, 740 bp, Triticum aestivum
  Clone ID: PAT_TA_2630
cccacgcgtccgcccacgcgtccgtaagtatggaagtgaaccaaagtctactacctaaggttcagttcaatcttgagttgtcagaaaaggagcgcagtgacagggcaaatgttgttcttcctttcgaacatcaaggaaagggcgagccaatccgtatatacgatggacggcgatctctcccggaggctcatcaagatcccaatttaactacggcagctctcctggatgaaacagaagctcttaaatctgcaaacccgaagggtgaaattcattaccttcgtgactctgatgatgagcgacctgactcggatgaagaccccgatgatgatttggatatttagccacaatatgagctctgtttatcttagtgggcagctatcaaatcaaaggaacataaggtgctcgcggaaattcttggaggcgattcactttgccttggcggctgagcgagtgcaaagttatggttgaacaatttaagcccctgtagtatgtatggttgaacaatttaagcacatgtattgtgtatagcttcgagagcattggagggcaacctttgtgtaggggtttgaaatttcttgaatgctcaagactagatgtgttgatggtagcatatcgagtgaaaggtcatccccccaatgcgattttctagtgtgtgtgtttttttgtgacgtggatgaatgctgtgtcacaatcgctcatataggtccagaacaagaggatgtgagatgtaacactgtttt

SEQ ID NO: 2631 - DNA, 1255 bp, Triticum aestivum
  Clone ID: PAT_TA_2631
ccgcccgacgcggccgggtatacctacacttgtagcctcggttatcttgccagtgccagctgagctagctatatagctccgtcgcttgcttccgagttccgacagctcgctccgatgacggtggcggcggcgggcgcgggcaggcgttacgcgctgttgctgggcggtgaacgactcggactacgccaggaaggcgcacggcgggtaccggaacgtgttcttccgcgccctccgctccggcgaacccgacgaggcgtgggactgctaccgcgtaatcgacggcgagttccccgcagccgaggatctgggcctgtacgacggcttcgtggtgagcggcagcccgcacgacgcccacggcgacggcgccccgtgctgggtccgccgcctcggcccccgccgccccgccggccgcgccccggggccgccccccctcggccccgccgccggcctccgcgcccgccgccgcgccccgcgcggcccggccgccggctcccccagcggctgggaccgctttgcaaatgcacggaccggctgttgttagttcggagctggaatgggcttcttgcccgtggaaccaccccggagcgcctccatcatcgaggttcaccaagatgaggtgtgggaggtaccgcccggtggtaaggtgctggcctactccgacaagacgcgcgtggagatgttcgccgtcggcgacaacgccctcggcatccagggccacccggagtacaccaacgacatcctactcaacctcaccaaccgcctcgtcaacaacagcaccatcgacgggtgcgtgggcgaggacgcgcggaggacggcggagagcggcgagccggaccgcgagttctggacggggctctgcaaggccttcctgaggggctcagggtgcaccggcggcggcggcgcccccaggccgccgccgcagggaccggcgccggagcttagctgcagccaccacgtcgctcacttccctgccaccgcctcccccattggcttgtagcgctttgcaaatgcacggaccggctgttgttgagttcggcgcatgcatgtgctcgctagctgcagtagtataatggtacggctgcatgcatgcacgtacgatcggtgaagcgtttgtgtcagcaactatacgagtggctgattttttttcgcatgtgctgcgttgcacacagcatgtcttgtagttgtatggtttggataacggacataaggtctgacgaatgccctcgtgccgcgttcggcaccaaggggggggccc

SEQ ID NO: 2632 - DNA, 523 bp, Triticum aestivum
  Clone ID: PAT_TA_2632
tcttcacgcgtccggtcatgccagctttattcagagcacttgatgattatgctgtagataacagaggagatgtgggttcttgggtacgtgaggcagcaatggatgcgctagaaagatgcacgttcatcctctgcaagagagatgctgttgcagtgagagcagcgccagctgctgaggatgagtctcagccaagcgacatggatgcaaatgcaattagtaccacatgccaactatgtgattctgctattgcacagggtctggtcgctggcattgcaaagcaggcagttgagaaaatagataagataagagaaatagcagtcaggactctgcagaggattctgtacaaccaagaacagtttgtcccgtctataccttacaggaagctgttggaagaaattattcccaacaattctgatttggagtgggcagttcctacagtatcatatccacgattggtgaagattcttcaggctagctgttacagcaggcctgtgctttcagggcttgtgatttctaccggtgg

SEQ ID NO: 2633 - DNA, 858 bp, Triticum aestivum
  Clone ID: PAT_TA_2633
gatgcccacaaaaaaaactctcctgtctgttccccctatatttggcacccttcctacttccgacaccattattttggtagtcaagtcacatcacattactcatgtgattaaactaaacgacgcgctagacacgttacactagtgtttgacttggtacagaaatgaaataattgaaaagatactgttcatagctcatgtctgacgaccttgcaagcttgcaatatcatctgcttcttcgcttttcttttctcccgagtgatcgaatttcaccacagggctgcagcttgcctctcagcaaaggtgaaaaactgacaacgaagcttgtatggatctcttgcttgaattcctcccattactggacaccactccatcgagcccagtcgataaactgcataccaccatagatgttattggcaaagcggacaccaacggtgaaagccattgcaacaggaggggcaccctttgcaactggtgatgcctcaactactcgctccagaccattgatgatctgatagcgtgtattagacgatacagcaaggaatacgccccaaagagcagcacttttaataagtggtggaacaggaatatcttcatctgtttttttgacactcctcttggcattcattatcatattgcaaattccctgaccgataataccacagacaaatccaactgagccatacaaaacacccttataaaagtatgtcccgattctttgttggactgtaaatctgcagcctggcctttcagcttcaaaaacactgcttggcaaagctccagccatccggttgaacctccctaacagccccgttgacgaagaagcctttcccaatctaacatatggcggacgcgtgggtc

SEQ ID NO: 2634 - DNA, 646 bp, Triticum aestivum
  Clone ID: PAT_TA_2634
ggccctacccctctgacggtgctagggtgcctgcgcagcctgcgcctccccgtcaactcgaccgccgcaagttggcgctcctgcactacctctttgaaggtgatcatgtgcctgctcatcctgagcctcaccgtaaactcgaccaccgcagactgcggctgctgcataagcttagccgcaaaaggatgttgttctacttgtatttttgcgggtggctctgactttgcctgcaagaacacttgttgtttcccctgtattcttgaagattctgtggttgctaagatggatgaaatgggagtggcttcgaagatggaaggactgtactaaaacgatatgcttgcattgctaccaacatggatgccattcatcggcatatgttggattgcttcgatctacggccgtgttcggctgtgggtgccctcgcataatttgttgactatatggggcgacctcttagtcaatccatgtatgtcatgcatgtgtgcacgtgtgtgtgcgcgcgcacgcgcactcacacgcctatgtaatttctcttgttgcttgtaataaggccatagacaatgtccacagtgatatgtgtcatgtacgttctcatatgtcaatatattgtctgagaccctaccaaaaaaaaaaaaaaaaaaaaaaa

SEQ ID NO: 2635 - DNA, 621 bp, Triticum aestivum
  Clone ID: PAT_TA_2635
tgcgcggccgagtacctggagatgacggaggagcactccgaggacaacctggccgcacgcgccgaggcctacctctcgcagtctgtgctcctccaccaaggcgctcaagtcctgcgaggagctgctgccgcacccgaggagctcggcattgtcgcccgctgcatggacgccatcgccgcgcgctcgtcggcgacgtcgcgctcctggttccgccccctggccgtgcgcggtccgcgccgggtcccgcgggtgatgctcgcctgggccccacgaggacctgaggaccgaggctttggagggctgcctcgtgtcctacgccaaggccaccctccccgggctgtcgaggtccatgaggtggcgccgcgcgtccgcgccggtctcgtcggaggtggagcagagagacctcctggaggcggtggtcgccagcctccccgcggacaagggctcggggagcgtggtgaccgcgaagttcctggtcgcgctgctgcggacggcgcacatcctgcgcgcttccgacgcggcgcgcgccgcgatcgagcggaaggccgcgacgcagctggaacaggcaacggtggaggacgtgctcatcccccgcgtccccggcgccgcggagacgctcta

SEQ ID NO: 2636 - DNA, 389 bp, Triticum aestivum
  Clone ID: PAT_TA_2636
cttcgcgctcggcatccgccgatcggttcctcctgccttggccatccgctgacaagatcatcggcaggcgcctccccccagggatcgatcgaagatgccgaagatagcgctgggccaccgccgcgaggcgtccgaccccggctgcctccgggccgtgctcggcgagctcgtcctcaccttcctcttcgtcttcgtcggcgtcggctccgccatcgtcggaggacaagcagtcgcagccggaggcgacacgtcggcggcgttgatcgcggtggcgctgggccatgcgctggtggtggcggtgttcgcgaccgcagggttccacatctccggcgcccacatgaacccggccgtcacgctcagcctcgccgtcggcggccacatcaccctca

SEQ ID NO: 2637 - DNA, 1597 bp, Triticum aestivum
  Clone ID: PAT_TA_2637
ccacgcgtccgggaaacacaacgacgcagtcacgcaccggctctttcctccacccctcgtagggctagctagggtttctccgcccaaatcgtgtaataataacccacttgaagattcgcgcgaacgctgcggcgatggccaccaccgtccagccccactccccggacccaacagccatcaccaccacccctgcccctccccctcctccttctccacctcgccaggagaacccgaccgccgcgggggaaggcgtagagatcgcggcgctcgatgagcagcctgccgccgtcgccgtcgccgacaaggggaagacggcccccggcggcgggaagctggtggcggaggccatgcgcaagtgcgcggcgccccggtcgtcgcgctaccacggcgtgacgaggctcaagtggagcggcaagtacgaggcacacctctgggacaacaccagccaggttgaggggcgcaagcgcaagggcaagcatgtgtacttgggaagctatgttactgaagagaatgctgcaagggcacatgaccttgcagccctgaaatattggggcataactcaacccaccaaactaaacttcaatatttctgattatgcaaaagaaattgagatcatgaagagcatgaatcaagatgaatttgtggcctacataaggaggcagagtagttgtttctcaagaggaacatcgtcatacaggggtgtaacaagacgaaaggatggtaaatggcaagcacgtattggtaggattggtgagagtagagacactaaagacatctatcttgggacctttgaaactgaagtggaggcagctgaagcgtatgacctagcagcaattcagctccgtggtgttcatgctgtgaccaactttgatatcagcaactactccgaagaaggtttgaagaaactagaaggctcatctgaggtagtgaacctggaggaccaatcagaagtcactaagttagctgtgaccaacttggatattagcaaacactgcgaagatggtttgaagaaactagatggcgcatcccagatagtgaacctggagggccaatcagaagtcaccaagttatctgtgactaactttgatattagcaactgctgtgaagatggtttgaagaaactagatggcgcatcccaggtagcgaacctggaggaccaatcagaagtcaccaagttagctgggccttactttgttgtttgccaccgcggtgatgatggtttgctgcctcttgatcgctcctccgagggtccgtccctccacctccatcctgtcgtcactgaggttgcgggtctcttgtcttcggcatcccttcctgtaaattttttttcccttcctttttcccttttctctgatcgtcagtctctcctcccttctcctttcttggttgatgatgagagtgtcttttcttcgtccacctttcctgatacttttctttccccaaggtttttcccttcgctggttgccaactctattatttaccagctccagagtaggatcgtgtgatgctgtactctgtattctcatgtacactgattacaaaccattgatagtacttgtagacattacaacacaaaggaagttcattcttctatttt

SEQ ID NO: 2638 - DNA, 978 bp, Triticum aestivum
  unsure (1)..(978): unsure at all n locations
  Clone ID: PAT_TA_2638
ccagtgagcagggcaggtggtcgagagccccatccacctccataaaaccctcctttgctgctcagggctcagggctcacagccgcgtctgcgaggactcgaggaggaaggcaccgcgtctgcgagaggattcctgaagagagcaagtgcaagagctatgggcaactcctgtgtcactggctccagcagcacctcaaaccacgggcagagtctgaaatccaacggggaaaaagctagtgacaattcgtgtgttactggttcatgcctgtcaaaccagggccagagccaggaatccaatgggtcggagacaaccttcaaatggaggattgatggtttctcctcgcttcttgataagggatggaccagctccagtgtgtttaacatcagggggtttgactggtacatggtgctgaacctaagggacagaaagagtggtgacaaaaatgaatatgtttctcttgagcttgtgctgtttctagcacctgagatactccatacggtcgtggaggcaagtttcaagttcctgatatatgaccagtcatatggaaagcaccttgaacagcatcaagtgagccaaaattttcaggctccaagcagagtctctgggacctcattcatgatccccctcgcaacgcttaaggagcaatcctctggattccttgtcgaagacagctgtgtttttggtatccagttcatcaaagttgtccctgttaaaggcagctcaaaacataggcagaatctgaaagccaacgtggcaagagccattggcaactcatgtgttactggttcaagccagtcaagccagggacattgccaggaatccaacgggtcagagacaacctttaaatggaggatcgatggnttctnctcgcttcttgataagggtgaaggatggaccaacttccagtgtgtttnacatcangggggnttaactggtacctggatgctgaacccaaggacagaaagagnggcgacaaaa

SEQ ID NO: 2639 - DNA, 609 bp, Triticum aestivum
  Clone ID: PAT_TA_2639
ttttttttttttttcccccgccaatatttttatgtctactgttacaaaagttgcaatgcattagtctcccggtgatgtgcgatccactaagcactttatatttggaaaaaaaaggaggaagaaaaaggtacgtggcgcctgcttgctctcatagtaaaacgagcaataagccaagcgaatcaacgagcggactttatgtgcgaaaatgaccgtacgcagctagctaacataatatcgaatctgacgtaactggcgagtactatctaggtagcggctataatatcgcaggccagcgcccagtgataccactattatggcacacgcatatataccagatagaggacgatgccccgcaacggccgggggtccatgtatccactgccgtactccggattaactaggtttagtaactggtatagcactggagcacgtaccaaccagctcaccggtcatcatgtcttaagccaatgcaatatactactcactagggatcgtggtagctccacaggctctcccccgcccccggcgggaacggccactcgtcgaaggcggtggggctcagccttgaggaggataacaaaaatagacaaacggcaagattgagtgtgt

SEQ ID NO: 2640 - DNA, 1351 bp, Triticum aestivum
  unsure (1)..(1351): unsure at all n locations
  Clone ID: PAT_TA_2640
cgagcaataaaaggcatgatgaacaacacgctgtggttcgatgtgcttcttctggtgctcttcagacagtcagcgatgcaaagcaaagtaatggtcaaatccatggaaagagtgtaatgcatacagttagaggtggtgtgttcctctttggtcaagcgatatcttgcttggtaaatactccaaaacatagaattagctccactgcggcaattaactatgagttgggacgatctagaacaacattaacctataatggtgaaaaattgactgttgcttcccgtggtgttctggatggtgcaccttctggagaacctagtgatgcatacagagatgacaagtttccagaagctggccttgggatgaatccggaagtagttgcaggttacctcattcaaataatggtactgagctctcatctgctccggatcacacgtgtacaataagtttatctgaagggcagtcgccagatgtgtacctccctggcctcattattcatatcgttcccataaagaatggtacttctccattgccgaagacacttgtgactcgtcacaagaacaagagttataaagcatttatagcgaatcggcgggattttatggaccttgttgtgacccctcgcatgttccttgatcatctcccgtggaggtgtcactatgccatgcaaagggttatagaaacacggaaacggaaccagcccattctcaattcatgcagtggagaggattctgtctaactgaatttgttaggctggtacaaatgtatcattatgcagcttggcctcttccttctgtacaaatgtatcattatccaacttgacccctcacatgttccttgatcattctcccgtgggaggtgtcactatgccatgccaagggttatagaaacacgggaacggaaccagcccattcactattcatccanccggagaggattctgtctaactgaaatctgttaggctattcgcaaaaaaaagaaggaaatctgtgacgctggtacaaatgtatcattattcagcttgcccgcttctgtacatatacaagttagggagctatgatcatgtactcttcacatgcataagctaggaagctgtagaaggagcaagggcccaaacgagccttgggtccatcctgatgaacgctacttgacctcagcattgttgtattcaactttcctgatagctagggcgcgcccctcttagacataccatcaggtcaacggagaccagcatcattatttatgacaagcttgtagtattaaattaaagcctctggtgtcaacttttgcttcgagcactgttgtaactttgacaccagcacatgtatgtttcgcctgtaaaatcnaactgcca

SEQ ID NO: 2641 - DNA, 377 bp, Triticum aestivum
  Clone ID: PAT_TA_2641
ttgaatcaaaaatttatgcagcatctggagaccaatccggatcatgagtgtctcaagggcctgtttgattggcggcgccccggccgccgtacttgcccagattccctcaagccatgcatcttctacctgtcaattttccctcggcaccacggcatttcggcaaaggcgactagtaaggaggtggattgcagaaggttactgttgagacagtgatgaagaatctgccgttgacagaggggagaacttcttctccaagctcctcgagctgagcataattcagcagataccacagttagtcaccactgcatacaatgacaccagcatggtctcgtgccaggtcaatggcttcatccgcgagtacctgcccgggcggccgc

SEQ ID NO: 2642 - DNA, 1425 bp, Triticum aestivum
  Clone ID: PAT_TA_2642
ttcggcacgagggtcccgccccggacgcgtgggcggacgcgtgcgctatcatcctcttcctcgacctcgagcttccccctgtcccctccattccccccgcacaggattccccagatcgacgccccggttcctcccgaaccgcaccggaatcccccgccggattggccccgcccatggtgtaatcaggggtcccgaccgcgctggcgatggaggcgcagtggctcgccgagtacccgcaccaggccgccgacaaccggccgcgcaagcgcccccgcctcgcatgggatgccgcgccgcagctcttcccgccccccaaggcaatcccgatgctatattgtgggcaggaactaatcaacggcaatttcactactgctttcctgccgccaccaccaatttattatgctggaccaccgcggaatctttcgcccccttggaggccggatgacaaggatggacactatgttttcacactcggcgagaaccttacaccaagatataggatactcagcaagatgggcgaagggacctttggacaagttctggaatgctgggacttggaaaaccaagaatcagtagctatcaagattgtgcgttccctgcagaaataccgggaggctgctatgattgaaattgacgtgcttcagagacttgggaagcatgattttactggccgtcgttgtgcagcaaatacggaattggtttgactatcgtaatcatatatgtatagtatttgagaagcttggaccaagcttatacgacttcctgcggaagaatgccggccgttcatttcctattgatcttgttcgggagtttgccagacaaatattagagtctgttacatttatgcatgacctgcggcttattcacacagatcttaagccagagaacattctccttgtttcacctgatacaatcagggttcatgattataagattcctatacgcccacccaaggatgggtctgttttcaagaaccttccaaaatcgagtgctatcaagcttattgattttgcaagtacaacattcgatcatcaagatcacaattatgtcgtgtcaacaagacattaccgtgccccagaagctatccttggacttgagtggaattatccatgcgatctttgcagagtgggatgcattttgattgatctctgctcgagggaggctttatttcaaacacatgaaaatttggagcatcttgctatgatgaagaacgttctatgcccccttcccaaacacatgattgccagagctgatagacgagctgagaaatacttcaggcgtggactaatgcttgactgcccagagggggcagcctcactagagagcatgaaggcaggatggaaattgcctcatctgcagaatctggacatgcaacatgtgctatcattctgactgggatctaatagatcttcttccaagggcttc

SEQ ID NO: 2643 - DNA, 599 bp, Triticum aestivum
  Clone ID: PAT_TA_2643
ttttacgcgtccggagattccatcaacccgatcccgtcgtggaattttcaacaaggctattcttgaacgctgtctgaaggtatataaggaaaaactggagggcttacgtctacctgtaccagtagagaaactgcagcaaattcatgaggtggcgaatggcgaagccaaattgctgtttgataaacagcactttggtaagcatcatgctgtacagtcaatcctcaagcttgaagatgagattacaaaggtgtacaaaaacttccttctagctaatgagtatcaatcgtccaagctttgcgaagcacgtttttcggaatgtgaagatcaaatggatcaccttcaagtcttgaaacttccttccatggcaaagttcaatgcaggctttttttactgcaatcggacttttgtaatggaatgtgtggggcctgcgaaggaaagatatgatcataggatgtcaaagatgctcctcaaatctcgtgctcttttcatcaaggagtacaataacaagctcttcaatttggttggtgaccttcgctctggtcatggtcgtgcttgggcgctttgtgatcaagttctttctacttgaaattgctgcatgg

SEQ ID NO: 2644 - DNA, 415 bp, Triticum aestivum
  Clone ID: PAT_TA_2644
ttatttgtctgtgcttccccaggtgttacacaatatcgtacgcaatgtttgtaccccattacgaaaatgccctgtactcctggatttcggccacactacttccgcccccgccccctaaccttggccggctgtccccgtcggccagccggctcccggcctccgggtccccccccctcccgcgcctgctgctgctgctgcagctcgctcttctgcgccgccgccttcttctgctggaccttctcgccgtacatgtaggaggcgaagccccagaggcagagcaccagcgcgatgccctttggcccgtcgaacttctcgtggaggaacatgacggcgaggacctcggagagcggcaggaggaccgcgatcatgatgccggcgaggagcgaggaggcgcaagtgatgagccccatgatgc

SEQ ID NO: 2645 - DNA, 386 bp, Triticum aestivum
  Clone ID: PAT_TA_2645
ttgtcgcgtgggcggacgcgtgggcttgggcacaaagatccaggacgatatatatgctctatgcatgcaaatctacctagcgagcttgaaacgaagattttggagacaaagagagggataaatttaaaccctatatgatcaaggcacaaagatccagaagtagaaatgtgccaaagctggggcgtcccatggtccctagcgagctaggatgcccacgaaatgaatctgagggtgcgaatagctcagctcgggcagatataatgttgtaatgtccagactagagcagcagcacaagatgatgtgtaattgtaatacggaattacttgtcacaaaaatggatgtatctacaactaaaatacatctagatacattcatttcttgacgag

SEQ ID NO: 2646 - DNA, 1153 bp, Triticum aestivum
  Clone ID: PAT_TA_2646
gagggcgccggctacacggccctgttcatccgagccccgttcagcggagcccactacaccggaggttgtatgcaaggctgattcgagggattcggatgctaaggatgagattggcacgcggaccacaagtgatacgtctgttaggaaatctggcagagctcctggggaaaccggcaaattcgcagagctcgctggaggaggctcggcggagagtgacactgagattgacctggcagaccactccgatgaaaagatggaggctgcagcagttacggaagaaatcccaggggaagtcattaaggaagaaatcccacgtgaagacattgaacctgaagatcctccagcagagactccttctggcaagaagttcacgttcgcagagctcgctggaggagccgcggctgaaagtgacactgagattgagtttgctcaggacggggctccggcgacggagggtcctgctgctaaggaacagctcccaggtccagcgaaaaaagaggcactagcgagtgaggacgctagcccagaacagacgaagcaaaaagctatggtagtagaagatgaactcgatgtgctttcggatgtttcctctctggttaaagatgcagatcatgataagagaccgccgcgaggaactcctaagggaaaacagtcagcagcgaagaaggaagcaagcggatcccggaaaaagaaaaaggcgaaggtagacgaggagctctctgatgaatcctatcaggatgacgacatgggcgaggaggaggatgatgacagcgacgacgactgggccgggtaaggggagcgacagggagtgcccagatctgacatgccgtgaaaagggtggatcggggatgagtgaccctccctccctcactggcgtgcgtagtagagctagcagcgtgcatagagcgagtgtgtgtgtgtgtgctctttttagctgatcaatgtgaaataatgcttgtttgttgatgtacaagttttctagagcatctcactccatgtgtagtagcgcaggaatccgatcccgacccacgcgggttgtaataggagtagaaattgcgagatataattcgctagacgtgtttgtttgttgtaataacaggagcagagatcgttgtgaggttgtgctgataacctccaggccgagcccccagcg

SEQ ID NO: 2647 - DNA, 682 bp, Triticum aestivum
  unsure (1)..(682): unsure at all n locations
  Clone ID: PAT_TA_2647
cgggcacgagnnggnagggcatgggcagctcatcagggctcgtcgtctggaggggaaggccggttaaccccaagaagcatggaggagtgagagcttccatcttcattcacgctctggtgctgctgagcaacgctgccaacatcgccaacatcatgaacctggtgacctaccttcgcggcaccatgcacatgggggtggcggaggcctcaacgacggccagcaacttcttcgcggcgctgcagatgttctccatcccggcggccttcctcgccgactcttacatcaagcgcttctacaccgtcctcatcttcggcccgatcgagattctgggctacatcctactagcagtgcaagcgcacgtcccgtctctgcacccgccgccctgcagtcccactggcgcgcagacctgcgagacggtccgtggctccaacctgagcttgctcctcctgggcctctacctgatccccatcggcgacggcgcggcgcgcgcgtgcctgccggcgctgggaggagaccagttcgacacggccgaccccgtggagcagcggcaggagacgagcttcttcaactggtacaccttcgccgtgtcctccggcggcttcgtcggcctggtgctcgtcgtgtgggtggagaacaggagaggatgggacatcggcttcaccctgtgcgctctctgcgtgct

SEQ ID NO: 2648 - DNA, 1102 bp, Triticum aestivum
  Clone ID: PAT_TA_2648
gatgccaggaaggagagtggctctgacattgttattgtggcaaggacagattctcgtcaagctttgtctcttgatgaagcgttatggagagcacgagcttttgctgatgctggagcagatgttctatttattgatgcccttgcctcaagggaagagatgatggcgttttgtgcagtttcacctggagttccaaaaatggccaacatgttagaaggtggtggtaaaactcctatactgagccctcttgaacttgaagaaattggttacaaaatcatagcctacccattatctctaattggggtatcaatgcgtgcaatggaggatgctcttgttgctataaaaggtggccgcatacctcctccaagtagcttgccatcatttgaggagatcaaggatacgctagggtttaaccgctattatgaagaggaaaagcgatacgttgcgtcaccagctcaatcatcctttgggagtggtaattatgattatacaagtgaagcaagcagttcaggagacaccaagtccaggactgagaaatcacaagaacctattattgacatactgccacagctctatgatcctggttccgctggaggcagaggtccttcaagtgggatgtggtcccgcacacttcgattaaagattacaggaagagatggggtccagaaaattgatgccaggatacctgctggattcttagaagggatgacaaaagttataccaggcctggctggaactaatatcatggaaaggcttcggaacgcgcctatggattcagacaacccccagaacgggcagatactgcttgattttgaggacggcatgggagataggatccaggtgttcatcgcgtgagcgtgttgttcgtttttgtcgtcccagcatccgatactcagacaagcatcttgtttcagtttagtagtagaagcaaatggttgctactctacttggtagttggtagtaggcccttgctgcctacatccagttatgtaaactctgcatcatactgcatgcgtccagaactagtcttcctgtaaccttccttgtctcatggattcagaagttaaattcaaataaaacaagttatggaaaaggtattcctctt

SEQ ID NO: 2649 - DNA, 488 bp, Triticum aestivum
  Clone ID: PAT_TA_2649
tctcactcccaagctcccctcgatttcctctgttggtctcatgccgccaccttgcttatcttccctgcacgcactccccgcagttcaggtcgttggtgcggccatgggtctggtctaggtaccgcgcgcctcctcgatcccccaggcccgccaatagtgaggaggcatagcagggcttgaggagcagttgcgtgagggagtagttgatcagttgagctagtcgaactcgatggtggcgttgccgtcagcgtggatcgtctcccctgcggtggctgggaggtaagcgagtgaagcagcatggagtttgaggttcccccgtgcgcgatgttggagctccagcatgcaaggcacttttcagcctatgatgaatgcaggtttgtatccacaccggctagttgcaaggtcgctaaggatgtggataagccaatacagtatagttcaaagtacaaagcaaattaagaacagattttaggtaatgtagtcagcat

SEQ ID NO: 2650 - DNA, 485 bp, Triticum aestivum
  Clone ID: PAT_TA_2650
gagagcagcaacagcagctgggcgagcgagcgatggagcgagagccggagcagtagcagcagcgcgagtgagtgagcgagagctgaagcagcagcagcagatctggctggtacgaccgccgccgccgaaggggcctcacactaggggagagccgccgtggagatgtcgcccgcggcgctggcttcaaggtagccgctccatgggggtgcaggatggagcaccgtcggcgccgggaggtcaagttaaggagaaggtgcgatgcgatgagtgtacaacctctttggtggcgccgagtaggcctcggcttcgtccgaggagtcggtgaggatgttgcggttccggtggagcaggttaaggcggcgctgtggggatggagcagccgcgatagacgaggcgatcgtcggagcagctccttggacgtggaggacggggctgctgaaccggtgggatggcgagatggacgacggatcctcatccggggaggt

SEQ ID NO: 2651 - DNA, 1010 bp, Triticum aestivum
  unsure (1)..(1010): unsure at all n locations
  Clone ID: PAT_TA_2651
gctgcgaccnattctgccggagacgccccggcctgtggtgcacaccttctgcaagatcctgacgccgtccgacaccagcacccacggcggcttctccgtgctccgccgccacgccaacgagtgtctcccgccgctggacatggcgatgccgacaccgactcaggagatcatctccaaggacctccatggatctgagtggaggtttaaacacatctacagaggtcaaccccgcaggcaccttctgacgaccggatggagcacattcgtcacatcaaagaagctgatggctggcgatgcctttgtctacctaaggagtgagacaggagagcagcgtgtcggagtgaggcgccttgtgcagaagcaaagcacgatgccggcgtccgttatatcaagccagagcatgcatctcggggtgcttgcaagtgcatctcatgctctcaagaccaactccatcttcgtggtctactacaggcccaggttaagccagagccagtacattgtcagcgtgaacaagtaccttcaagctagtaagactggatttactgtgggcatgaggttcaggatgaacttcgaagcagaagatgtccctgtgaagaagttttttgggactatagttggtgatggtgatctttctccacagtggtcagggcctgtatggaagtcactcaaggtccaatgggatgactcggtcgcaatttgcaacggccctgagagggtttctccttgggaaattgactcatctgatgcctcctcacctgccatcagtgcactgctgcaatcatcggcgaagaacaagcgtccaagggagacaaatgaaaactttgatcttccatcacaggagccgactcaggagttttggctgtctggaatgacacagcagcatgagaggacatatgttggttctagtgaccccaaccgtatctctgggtatcatcaaattctttggccaagcagtgatacccgcagggtatggtgccatgagcagcagttcggtttgtcaaactccattg

SEQ ID NO: 2652 - DNA, 503 bp, Triticum aestivum
  unsure (1)..(503): unsure at all n locations
  Clone ID: PAT_TA_2652
ttcttctccctccaccaccgccgcgacggcgaccccccagccgcacgccgaagcgaccccctccgccccgaccgcgtctctccagccctagggtttccgcctcctctccgcccatagccatctccacgcggcacgccgcagccccgcggattcctccccccttttcgagctcaaaattgcggcttttccgctcgattctcgggcacgaatcggccattgatttcctccggttatccaaggttttcccctgatttttcgcggcgcgagcgggggcttcccgaggcgattggtgctctgggagcggtctcttgtccgccgcgggtccgggctgcggctgaaggcctcgccgatttttccatgagcgtgggccgcgcnagctgccggggcccggtcctccggggcgcgcgcncgggtgctcntgttaatgcatccggtgacctgcggtgcaattcgccgacccganangtcgtccctccgcgggggcgggtcgatccgtcggcggg

SEQ ID NO: 2653 - DNA, 1657 bp, Triticum aestivum
  unsure (1)..(1657): unsure at all n locations
  Clone ID: PAT_TA_2653
gcgcggacgcgtgggccgagtcgcagttgcaattcctatacgacctcgatccccctcctcccccaacaagtcgaatccgcccgcgttgaggaaggatgtgctcccaagcccccaaatccctagacctagacctcgacctcgacccctccccagtccccagatccctagacctcgaccccgaatcccaaccctgccccggcgtgacgacgacggccgagctccccgacgaagcggagaacccctgcttgtcgcggtttcgccaccggcgactcctcgccttcctctcgcgccagcgctacgatgtcgccttcaacgggctgatgctacaggcgagtgagcccttctgcttggagcgtctgcaggggctcgtgaggaagggcctgtgggaggatgccatcgactaccttgatggcttcctgcctgccggccccaggagcctccacgcccacgccttccgcaacttcctcttgatgcaccactacttggccagcatcgccgccgggngatgagtccgccatggacaagctccgggcccaccattggatgcaacacgtcgttgatgcctggaaaacgaaagcgaaccacacatttcctcgtgtcatggcccaagccctgctctcgtcggagcagctccgggcgtccatggactgggatggagtgaggagggaggctgcgtacatcctctccangttagcttctatgaccccagagctcaacaggccgctggcatgccgacttgctacaccaagccgcaccaagtgcttcccattgacggggcctctggattgtgcaggcggcggcgcgtgaaggaacagcgtccccatctacaaccagctgctgttgccagggccatccttttcagggggagtcagcgttacacaagatctctagccaactcaagtttcgaattcattgagaatgcaaaggaatggtttgcgactatcatggatgaaagcttacgagctggttcaggtaaagcgacttccctgctccaacaaattatgaaggaaggtgccccgggtgctccagtttcactgataagtcctgctaaaagttctggtacctcgtcattgacaaatgcaggtgctcctgtttcttcagtgtgcccgactctgaacatgacaagagacgctgaaaactatggtatctcatcagtgacaagtccaggcccagaaaagagtcaagaaggtgcctgcggtggtttcaatcccagaaagaatccacgggcagaattggcaactattgatgaatatttggattcaaaaaggcaacgtactactgggacttttggggaagcaagtatggtgccggtgaatgaagtttgggctgaagctcactagctggctggtgaagtcaaccacctagattcataaccgagatatggtgacaatggtggtggtggtggtgtacctgctaactcgcacttcatttatgctttgaacttggatgttaattatacaactttgtttccaagtgcctactatgagctagtacttcataagtaattctgctagtgttggttaatcaggctgcttactgccagcattttctatcactgaaatgaaaattaatcagattattggatcatatcattcagtaacagtattgccaaaagatacacgtaagtgtgacctcaaaaaaaaaaaaaaaaaaactc

SEQ ID NO: 2654 - DNA, 361 bp, Triticum aestivum
  unsure (1)..(361): unsure at all n locations
  Clone ID: PAT_TA_2654
ccgcctgcgctccggtccggatccctggggcccccccgccgcctccctcgcccccgcggccgcgtcgctttcgatctctctcacctgccattgctttccatcgtccagcgcgccaccaccccttccacgctccagcgtgccgctggcccacaccacgcgttgccgcagccggcccacgcccctccgccgcgcgccgccaccgccggccgcctgcccgttcccccgttcctccggctgtgcgaggcacggtggcggtgggaggaaaactggncggatctgggcgcggccttgagagatctcgcggctggtgcggcagcttgctacgatggcagcgacttgtgaggcagccatacaacgtacc

SEQ ID NO: 2655 - DNA, 594 bp, Triticum aestivum
  unsure (1)..(594): unsure at all n locations
  Clone ID: PAT_TA_2655
tttctcgcggacgcgtgggcggacgcgtgggtcggacgcgtgggtccctccgttccaacctccaaccgacgccaacgacttcaactccaatccattccgttcaacgtttccggccgccgcaacgtgcgactgactgaccgactggaagctccgcctcgcacgcctcttgtctttgtctaccggctcgcacagaagaatatggttctccccatgtcgcgggcgacgaggctggtgccggagctgccgctgctgcggcggggcaggcgcgcgcaggtggcggacgacggggagctggccgtgccggcgcacttccggtgcccgatctcgctggagctgatgaaggaccccgtcacggcgcccacgggcatcacctacgaccgggagagcgtggaggggtggctggcgcggnnngcgaggcacgtgccccgtcaccggcggccccgtgcgcctcgccgacctcgtccccaaccacgccacgcgaaggatgatccaggactggtgcgtcgccaaccaggccgagcgggtgcccacgcccannntgcccgtcgccnnnnccgacnnnnnngnnntgctcgccgccgtgtccaccgccgc

SEQ ID NO: 2656 - DNA, 828 bp, Triticum aestivum
  Clone ID: PAT_TA_2656
ttgatatctttggcaattatgcaaatgccatcaagtggtccagtgcctggcccaacaacaaacttgaacataggaatggactactgggcaaatacagcaagctcctctcctgcattgcatggtaaagtgaccccaactgcaattccaggggctgtggccccaacagagccgtggatgcaggatgaacgtgaactgaaaaggcagaaaagaaagcagtcaaacagggattctgctcgcagatctaggctgcgcaagcaggctgaatgtgaggagttggctcagcgcgctgaagtattgaaacaggaaaatgcttcacttaaagatgaagtgagccggatcagaaaggagtacgatgaacttctgtcaaagaatagctcactgaaggataacgttggagacaaacaacacaaaactgatgaggcaggacttgacaataagctgcaacattctggtgatgacagccagaaggacactaattgagctatcatgcaatgctatcagatcatagccctaactagattgttgctggcgcagttgtagtatgcgtattgactccatacttattgcatttaattattaccaggtcgtggtaaatcttaatgccagcctcgtgtgctggttcctgtttcacacatgtcttggcttatcttttagaagtcaagatgtgactgaaaatgtaggttgtgaaccagttcactgtatctgttagaaattgttggtactttcaactttacagatctgtattgccgactgatattgttttgtatacctggcaaaagactggtttcttttaattcagtctggttgaacaaaaaaaaaaaaaaaaaa

SEQ ID NO: 2657 - DNA, 960 bp, Triticum aestivum
  Clone ID: PAT_TA_2657
gtggctcccgcgcgagcccagttcatcccgacacggcgcacgcacaggtgaacggactgggcgctggcgctaaccctaccggacatctggatcggagcagagcgccgccccgagcgtcggcgcgccacccccgcgccgcaggcacggccccaagccaccgagcagcgtccccgcgcccgcacgctaccacgcgctcgcctcgtccttgattgctcggcacttcggcaggcacgaccaggactgcgctcggagcacgctgaccgccgtccatcgtaacggcctgggtcgcaacagacagcacgcaggggctaacgccaatccactgggcctagcctgttacatttcaaaggtcaaattctgtcatgaataccacacagaaagttgatccaacggaatcagctgctaagattgctcaacaagcctcgcagttcaaacgatggggacgtagacatccatttgttcgatatggtcttccactcatttcgttgacagtgtttggtgcggttggtctagctcatcttatacagggaagcaaagaagtaacgaaggaaaaggaggatatggaatgggaggtcgtagagaaaacaaaagctctgagccgaacaggaccggtggaaggggcctataagcctaagttgctcccgctggtcgagctcctcttggcctggcagccaaaggtggaccgaagcagctgcggcttctggagtgggaggtcgtagagaaaacaaaagctctgagccgaacaggaccggtggaaggggcctataagcctaagaagctctcgctagaggatgaactgaaggctttgcagcaaaaggtggacataaacagctacgactacaagagaattcccaaacaaaatgaaaacaagtgaagtaaagcaccgtttatcatgctaaggagtggggggattttcttaaaaagctctcaagtagttttcttcgtattgtttctcagtac

SEQ ID NO: 2658 - DNA, 2085 bp, Triticum aestivum
  unsure (1)..(2085): unsure at all n locations
  Clone ID: PAT_TA_2658
cgtccgcccacgcgtccgctcctcctcgtccccgtagaaaaggacacgcgtagccgtgaggcagaggcagcagccgcggcactcgagcaagccagccacgctagtagtactattactctgctccagtcatccatcgtctcccttcccggcggtgcccccagcgagcgagcgagcggacggtcgccgccgcgatgcagcgccggctcccggcactcctccgccgcgcggcgggcgcggggcccgcgcgccggtggctctccgccgcctcctccctcctcttcgacgacacccaggagcagttcaaggagagcgtgcaccggttcgcgcaggagcacatcgcgccgcacgccgccgccatcgacgcctccaactacttccccaaggaggtgaatctgtggaagctcatgggggacttcaacctgcacggcctcacatctttttgtactctgctccagccatccatcgtctccctttccggcgagcggctccctgcgcactgccgcagcgcattcgcgagcagaaagccaaagagaacgggaaggaggacaaaagatattcaggtttttgaacacgacggcgaccagaattagagctcaggtgtacccgtcggcgaagcaaggaaaagactcttcgtaggagcgggttgtgtgcgttggtggggcaccctgacccctctcgaggcacccgtgccgtccaggtggaacggcggccctaagggtccagtactcgccagaggagtacggaggggctcgggctcggggttacatgtaccactgcatcgccatggcaggagatcagcagggctgtccgggtcagtcggcctttcctacggcgcacactcaaatctgtgcatcaaccagctggtccgtcatggcagccctgcccaaaaaggaaaagtatttgccgaaagctaatcaagtggggagcatattggggcattggcgatgagtgaaccaaactctggctctggatgttgtcagtatgaagtgcaaagctgagaaagtagatggcggctatgtcattaatgggaacaagatgtggtgcacaaatggtccgtctgctcagacattggttgtttacgcgaaaacagatataactgctggatcgaaaggaataactgcattcataattgagaaggggatgcccgggttcagtactgcccctgaaggtggacaaacttggcatgcgaggaagtgacacatgtgagcttgtctttgagaactgctttgtgcctcaagagaatgttcttggtgaaaagggaaaggtgtttatgtcatgatgtctggtcttgatctggaaagacttgtattagctgggggtcctattgggctcatgcaggcatgccttgatgttgttcttccttatgttcgacagagggagcaattcggccgtccgattggtgaatttcagttcttacaggggaaaatggcagacatgtacacctccttgcaatcatcaagatcatttgtatactcagttgctagggactgtgataatggcaaagttgaccgtaaggattgtgcaggagtgatcctctttgctgctgaaagggcaacacaagttgcacttgaggcaatccagtgtcttggtggcaatggatacataaatgagtacccaactggccgtctcctgagagatgcaaaactgttcgagattggagctggtactagtgagatcagaagaatgataattggtcgtgagctgttcaaagaggactgagattattcttctggaagccagctagtcagtgcatattctaacttgaggaggtgagcaggatttagaccattagtgaactgtccctgatgttcaatgtttgatgatgttctatccaatccttctcatacttctgtatatgtccaacattcttgcaaataaagttcaatcttttacttgttatctggttctagtcaatatctataagtttgttgcaatgatatactgcaacttgacacataatcacatttggctcattcacatacaactttggatcaatataacaaatgccaaaacgagccgcacttanagcagaatcattaacttcagttcaanacattagacaattgaaactcagcaggagcaaat

SEQ ID NO: 2659 - DNA, 437 bp, Triticum aestivum
  Clone ID: PAT_TA_2659
gatgccacatggcaacccttttgggtgttacgacaaccagcagtttcaacttcttattattggaggaacagatatgttccccctggtgacaaatggacatgttcaggactccctgatacttcctgaagtcgagaggcccacggaaccaaacgccgagaactttgttgcccccgcgagccagatttggatcagtgcagcgtctcgcgaaccttcacagagtggatcatctaatgccctgacggctcaatcagccggttttgaagtatgtgatgagctacgtcctatggggcaatcattgtctatgtgtgagagcactaggaaaaatgttgcaaatggaacagctgactgcagatcaaacggcaaagattacagagagaaggtactaaaagataatttgaaggatgaaagaaagagagtggccctgacacgaatgggat

SEQ ID NO: 2660 - DNA, 439 bp, Triticum aestivum
  Clone ID: PAT_TA_2660
ttgctgcgtgctgtgaggagccgttggccggtgggaacggtccctgggcctgacggctcctgggaggtggatgtctgcccggagctgcagagcctcaccggagatgtcatctcgcagaccgcgttcggcagcagttacctggaagggagaaggatttttcaactgcagactgagcaaattgggcgattcatggcagcggttagcaagatcatgattcctggttacatgtcctttcctaccaaaaataaccgaaggatgcatcaaattaacaacgagattgagtccatcttgcggggcataattgcaaaaaggatgcaagctatgcaggaaggggaaagcacaaaagatgacttactcggcttattactcgagtcaaacatgtcagacacggatgaaaacggccaatccaccctaggaatgtcagcacatgaagtcatgg

SEQ ID NO: 2661 - DNA, 826 bp, Triticum aestivum
  Clone ID: PAT_TA_2661
atcggataaaaaatgaaaactctcttctgtctaagacgatgagactttttagcactaactatcgtctactcatcacaggcactccactccagaacaatctccatgagctttggtctctactcaatttcttgctgcctgagatatttagttctgcagagacctttgatgagtggttccaaattactggtgaaactgatcaacaggaggttgttcagcagcttcataaggttcttcgcccatttcttctccggaggcttaaatctgatgtcgaaaagggtttacctccaaagaaagaaattatccttaaaggtgggatgtctcagatgcaaaagcagtactatcgaggtctgcttcagaaagatttggaggttattaatgctggtggcgagcgtaaaagattgcttaacatagccatgcagttacgaaagtgctgcaaccatccatatttattccaaggggcagaaccgggcccaccttacacaactggtgaccatctcattgagactgcagggaaaatggtgctcttagataaattgctgcccaaattaaaggaccgcgactccagagtgcttattttctcacagatgaccaggcttttggatatcttggaagattatcttatatacagagggtatcagttttgccgaatagatggaagtacaggtggacaagatcgtgatgcatccattgatgcatttaacaaaccaggaagtgagaagtttgttttcttgctttcaaccagggctggtggacttggtatcaaccttgccactgctgatgttgtgattctttatgatagtgattggaatccacaagctgatcttca

SEQ ID NO: 2662 - DNA, 421 bp, Triticum aestivum
  Clone ID: PAT_TA_2662
cccccgtttaatcaaaactggtgtatagattgttggtttgtctctatgtgcacagggttatgattgggtaatcgaaatgttattcacattgtcaattgactaatatgtgctacttggtacccttgctacagagaaaccagcgacaatggtgatccctccaccagacagggcagctagaatcgtcggttttctcaagcccaaccttttgaggatggatttctcgaacaagtttgtgaccgcccaggtgatccacaccccaacaacaaccgtcccgtgttctgtgagctcacgggagaagctgctgagatcgcacatgtagtcgaccggcgacgtctctgccgtcgcaaagattggaaagttgttgggcgagcgcctgctgctcaagtagatacctgccgtgtccatccacatgaagagagag

SEQ ID NO: 2663 - DNA, 661 bp, Triticum aestivum
  unsure (1)..(661): unsure at all n locations
  Clone ID: PAT_TA_2663
cctctcgtgccattcttgttcctccgcctccctctcttccgctaaccagatatcaattatcaccggcgtgaggcacgagcctgattgaacatgtccgcctcacgcgccctcctctcgagcccgcacggcggtgcgagccggaccttcacgagagcgccggcccgcctcgccgcgccctcgatcccgttcgcgcgctgcggcgctctccgcgcccggaccgcgatcctgtcgtcgccggcggccactgtgccggtgacctcttcggagccgaagcgccggatctcgcgctccgtgtcggactcggcgccgctgggcgaagcctgcggtcctggtggcgggagaagctgggcgaggccgggctggacgtgctgcgtcagttcgccgacgtggagtgcgcgtacggcatgtcccccgccgagctcctggccaaggtggcgcagttcgacgcgctccccctgcggagcggcacgaaggtgacgagggaagtgctgggaggcgggccgcgggcggctgcgggtggcggcgggccgggtcgggataaaantcacngaagcgngacgaggnggtgctngcntgaacgcccacgcaacactcgcgcggcggaganggangcctgtcctgangccgaagttccagnncnccctaggcgaatgaangcaat

SEQ ID NO: 2664 - DNA, 665 bp, Triticum aestivum
  Clone ID: PAT_TA_2664
caccctcaccctcaccctcaccaaatcctcctcctcctcctctggctagcaaagctcaccaccaccaccaacaagcaacaacatcactcatccatccatccatccgtccgacaccagatcgagccaagaaagatccaagaaatttcccaattgaggaccaagggagaagaatttgttgtcgatccactcagcaagcttacctagctagctgcttcttcatctcatctcttggtcagcttcgattggttgggggaagcaatccccatggagttgttcccccggcagccggacctggcgctgcagatcagcgccaccagctcctcctcctcgcccccggccgcgccgccgggcagctggggccggccaccggacgccaccaccggcgccaccagcatggatcaattcagccaccacctagggtttctgcgggccagtcagccagtgccaccgacatcgccagcaaagatgccacgccgccgtcggcgtggacgccgccgccttccgccgccaccgcagcgagctactccaaccacatcagcaaccactaccaccaccggatgaacgccttgctcaagcctataagaggggttcccatctaccaccaccacccctccttccagcagctccagcaccagcacatggccatggcctaccggagcagcggc

SEQ ID NO: 2665 - DNA, 1284 bp, Triticum aestivum
  Clone ID: PAT_TA_2665
gcgacgacgaggagggcttcttcctcccctccggccaggcctccgcgccgcccccttccgcggccggcgacaccctggaggcactcaagagtttggtgcagagcgccagcgtcgcggagcggaaccttctcgccgacgcttccaggatcgccgagcggtgcggcaggacctgcaagggcaaggcggagtgccgcaacgccgtcgccgacggcctcagggccctcggcgatgaccccgccgtcttcgagtcgcgctcggagaagaccccgtcgtaccccgctggggagcacgagtacaccgccggggagcacggggacggggcgaggctgatcgtggaggtgcacttcaggtccgaggacgagcacgcccggtcgaccttcgcgtaccgcgcgtcgaccaaggcgcacccgccgctgttcgtgggcacgtccgaccggctcgggaagatcgtgtccgtggtggcggaggcggcgcggcagagcatgaagaagaaggggctgcacttcccgccatggcgtaagccggagtacatgcgcgccaagtggctgtccccgcacgtccgcaccggcgacaaggcggccgcaaccccgtcccccgccgcctctgccacggcgacggcggtgtcggcggcgagcttctcgggcgagttcgagctgctgttcggcatgaacaggagcggggtctcccccacccccggcgagaagatcacggtgggtggtgtcgccgtggcgccccacggaggaaggcggcgagcaagaagcagcagcccagggcgaaggtcgtcacggggctcgccgccgtcctctgagcgtggcgaggcgaggcggacaaaataaccgccagtagatggacggatccccaatttttccacccaccgccttttccgtttctttctcctcggcgcgcttcgatccgttggcggatccagtttttggtgtttccgtgttcgtttttccggggtttttttgtttcggaaaaaagagaaaaaaacactcccatcccctagcagcaccatccatcctccattaatttcgagttttgacccccctgccatgtaatttttgttctcgccatgaggaggccgtggagctttggtgacgcttcaccccctcccgccgactagtactagtagcagcagctgtaagagaagaagagggggatcgtccggcgaggcttctcgccggctgttctctgcttgcctgtaggaattgatcaatctaagacttaccttgccagtgaagagttgttatataatcttatggatggtgcttgttaaaaaaaaaa

SEQ ID NO: 2666 - DNA, 182 bp, Triticum aestivum
  Clone ID: PAT_TA_2666
agctgatctagctcacagctcacgagtactacgtacatgtatacgtgttgatcggggcgaagttagcgtatacaagtggcgagcggtacctagaggcaggggagagggaagctagagcagtggtcgcggccatgggtgcccaggagatcaagtacttctcgcaggcgaagcttggccggcgg

SEQ ID NO: 2667 - DNA, 670 bp, Triticum aestivum
  Clone ID: PAT_TA_2667
ggtcgacccacgcgcccgtccggctccccgcgtcgtccctcgcgcgccaaagaagcgagatggcacgcctatcttccattcccatctccctcctgctgctagctagcctcgcctccgccgccgcctcggcagcagccgtgggtcaagaggaaggaggcatcaagatccgcgtgcggtatccaaccaaggagcagtcgcggtggctgaaccgctgggcggagaagcatcaggctcaaggatccggcgaaggcttcaggatccggccggccaccgacgaggagtcggcgtttctgaaccgcatgtcagcccgcggtgcggagaaaaccggcggccgagccggctacgacggccgcatcgagtttggcgacgaccatccgaagaatcgttgtggatgccttccactctcgagctcacacgtccaaggcgaacgatgagctttaggagcattggtgcctaaccggcgaggccatggatggcctcgtgtccttgtcgatgaacggaattgacaagggaggatggcagcaaggagtggctgtcgtgtatcactagcctgttttagtagcttgttttttctttttttctaatctgtttttgtagcttgttatggcgtcgcggccagtagggttcgtcctcggagatgttatcgaattcatcatctactagttgcagt

SEQ ID NO: 2668 - DNA, 1647 bp, Triticum aestivum
  unsure (1)..(1647): unsure at all n locations
  Clone ID: PAT_TA_2668
gaattcactagtgattagcgtggtcgcggccgaggtgagaactagagataaagaagagaaggtataaataaaaaagaaacgaaataaaaagagaaaaaaataagttatgaaatgcagtaattcttctttattcttctaattgattgcaattaaactcggctcaatcttttttttctaaaaaagattgagccgaataaaaatagatcatgatatgatcatgagacttgacaaatcgagattcgtctattctatatatctagaatatatatattaaggtataatacaataaagaaatacaaataaaataataaagtatggtattaccatttgagaatggaatcaaatacgcagtatttacagaaaaaagtcttcgtttattgggaaagaatcaatatacttttaatgtcgaatcgggattcactaagacagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccgtagacaggcaagtgaaatccaatccacgaaataatttgatccatggacggcacccttgtggtaaaggtcgtaattccagaggaatcattaccgcaaggcatagagggggaggtcataagcgcctataccgtaaaatagattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctcctacgggatagacctcaacagaaaactgttgagtaacggcagcaagtgattgagtcaattagttcctcatagaaattattggctctagagatatggtaatatggggaagacaaaattgttgaaccacgcacagaaccggaagcgccccttgtttcaaagacaggaggacgggttatccacatttaatttgatggccaaaggcaaattgaaagctaagcagtggtaattaagacccccgggggaaaataggcatctcccctacgttacccataacaggtggaattatcgacgtaattccataaagtcattcgatctgaatgctgcatgatgaacataacccagatgacggaacccagggccctggggtgtagatgttcattacgtgcgcgattcggcccttccggattcctcccctggactcccacgctcctggtacctcggcctatggctcatccaagaccctcctggctagagttcgtcatatacatctagaaagccgtatgcttggaagaagctgtacagttnggaaggg

SEQ ID NO: 2669 - DNA, 690 bp, Triticum aestivum
  unsure (1)..(690): unsure at all n locations
  Clone ID: PAT_TA_2669
cggccgctcgagccggccggccggcactcggccaagctctcctctcttactccatccctcgccgccgccacagatcacacctcctcgtacgtcgctcgtcgctgccaccaaccgaagcgatggccgcctccaccgtcgcatccaaggccctggccctcgtcgccatcctgtcggtcgccgccttctccgtcgtctccgcccaggaggccccggcgcccagccccgtgtccgccgccggcgtcgcgatgccgtccctcgccgctgcgctcgtcgcctccggtgccgccttcctcttcgccgccgttcgccactgaagagactgcctccgtcttccccgtcgacctacctagtacaaccacatatagatccatttatttatcactagtgatttgttcgttcgtgtcattttgcccagatctgctactgtgtgtcactcggtgatggtgattagtatctccttattagtagagattgtacccgtgtgcttgtagatactatttatccggtttgatctagtattcgtatgatcgctccatttagttttgattagatgaagcttgctgctctcccctgttttttcgtgcttatttccagtctcgcggtgtaacccttttcgatgaaatagtcagttgtgattccgaaaacgtacaatcccccaaangagnctttaacccctncggcctctttaag

SEQ ID NO: 2670 - DNA, 455 bp, Triticum aestivum
  Clone ID: PAT_TA_2670
ggtgacccccccgcgtccgcctacaccggcgaggcgtcggcctgcgcccctcgccgcgcccggcacacctccctcctccactccccccgcacccgaccccttcgcccccgagcttgtttctccagctaccgcaccggagcggcatggcgctcacgcgaccatcgacgggctatgaaggaggaggagacatggcatggaggtggtggccacttggtagccttcgtctgcggcgccataccactgtcggggtgccgcgcaagaggtcaggtccgtcgccaccgcgagccaggggacgctcgttggtgatcctacgtgcaggaagccaacggggggcacggcgtcaacaagccgacaggaggcggggtcttcccactgggatggaggagcaggcgatggccaggaggccgccggtgggggagcaacgaggcccgagctctaggctccgcacacattgc

SEQ ID NO: 2671 - DNA, 363 bp, Triticum aestivum
  Clone ID: PAT_TA_2671
tctccgacccgaccatgtccctcaagatcaagcgcggtctgcgcgagagaatcgtggagtccgtctccgaggccatggcccagctcgagatcgaggactcctccgccgcggacctcaagaagaaggagctcgccctcaagagactcatcaccaaggccatgtcctcccgataaatgtatcgcttccttcccttttttgctggctctggcgtctttctttgagattcctttgtttttcggaaaagcaagaaaatatcttccgggggaaaaaaaaggggccttctgtttctccagcccagatctcggtaccatgatctggcacatgacttgatgcccttttttgatacacacttacgatagacac

SEQ ID NO: 2672 - DNA, 766 bp, Triticum aestivum
  Clone ID: PAT_TA_2672
ggatgtttgtgttccattgtctattcttgcagaatgcatatctgtatctaagcaactacttgatgcgtcaccattgacttgtttggttatcgcccatgccggtgacggaaatttccacacaattatcctatttgatccaagccaggaggaagagcgaagggaagcagagagactaaaccatttcatggttcatactgctctgtccatggaaggtacatgcacaggagagcatggtgttggcacagggaaaatgaagtacctggagaaggagctggggatggagtcactgaggacgatgaaaaggataaaggccgcgctggatcccaacaacatcatgaatccaggaaagctcatcccaccccacgtctgcatctgaccaacgaagtgcctgattccatggcagtgggttcggttgttcaagtttgtcgtggtgccgccactgaatgcgtccatgaaacctttggatctgttacagccttacccgaggactccaacacatactacatgagttacaatacaacttacagtacccggcccggccatactgaataaaaggaccaggacgttgttatctcttggtgttatttgtaccaatagtagtatacatgcatgacaccgtttactgggcctgcttcacgtattaacatacctccaaaacacgagggagtggtttacatcctggtttcacaaaatagcgttcttgctctatactcttgttgtaacagtcatatattcgctccgttcataaatatgagatgctttggat

SEQ ID NO: 2673 - DNA, 801 bp, Triticum aestivum
  Clone ID: PAT_TA_2673
cacggcgaacacataaccattagaaaaaggactgcaaggccgagtagaaatgatcgccctgaacagcttgctgatccagagacaacgactgatacagacaggaacatggctgctctgtttaatgttctgaggaagaagaaaaaaacaagactcgaaaaccttgttttgaacagaatgtcctttgcccaaacggtggagaacatatttgccttgtcattcctagttaaagacggcagagtggaaatgaatgtgaatgacgacgggcatcatatcctctctccaagaaatgcacctgctgctggtgcaattgcctcaggagaagtgaaatacaaccattttgtcttcagatacgattttaaagactggcagctcatgaaagggatagtcgcggagggggaagaactgatggtgcacagtccgccttctctcagcacgtctggaggaaatacccaggcggagatgcctactcgcagcatgcctggaggaaataaccagggggaggtgccggcacacggcacgcctggaggcaacgaggatcccgcgacgcctgtgcatggcacatccggaggaaacagcgagcctgagatgcctgcgcacacaacttcaatcaggaagcactgcaggaaccggggcctggtcacacaagcgcggcaagacgagacgacagccatggaggataagcggcagacggatgcgcaagatgaggtgatgcgcacggtggtcaagcgggaggacatggagatggccaaggacaggcaggaggtggtccagacgtacaagcgcaagcggtctgatcgccat

SEQ ID NO: 2674 - DNA, 1169 bp, Triticum aestivum
  unsure (1)..(1169): unsure at all n locations
  Clone ID: PAT_TA_2674
cggacgcgtgggcgccgtccctccacttcgaaatcctcctcccacctctcgctcccctcgtccaccccggctcactccacctcccgcgcgccgccgccgccatgggttccgtcgccggggacgccgtgcgcctcgcctacccgcccgtccgccgcgacgagtccgtcgtcgacagctaccacggcgcccagatccccgacccctaccgctggctggaggacccggactcggaggagaccaaggagttcgtggcggcccaggcggagctggccgagtcggtgctcgccggctgcgccgacagggagggcctgcgccgcgaggtcacgcgcctcttcgaccacccgcgccacgccgagcccttccgccgcggcgacaagtacttccacttccacaactccggcctccaggcccagagcgtcctctacgtgcaggatgatttggaagcagaggcggaggtcctcttggatccaaacactctaagcaaggatggaactgttgctctttcaacgtattctattagcgaggatggcaagtacatcgcttacgggctaagtgagagtggcagtgactggatcactattcgcgttatgcgcattgcagacaggcagcttatgtctgacaaattgtcctgggtgaagttctcatctataagttggacacatgacggaaaagggtttttctatggccgatatcctgcgcctggagtggaattggatgctggaaccgagacaaatatcaatcttaatcatcagatatattaccatatcttggggtctgatcagtcagaggatatactatgctggaaagatcctgaaaaccccaaacattcccttggtgcatcggtcactgaagatggaaagtacatcatactgggtacctatgatggttgtgatcctgtcaacaagctatattattgtgaaatttcttcacttccccatggattagagggtttcaagagagacaaaggagatgcttccatttgtcaagcttatagacaactttgatgctcaatatcaatgttgtggcaaacgatggtgatgaatttacattcctgaccaataaaaatgctccaaagaataagctggtaagggtaaatattaaaaaccccaggggggcctggggctgttcttcctcctgaagcttgctcggtcctgctgcccggtcatggn

SEQ ID NO: 2675 - DNA, 570 bp, Triticum aestivum
  Clone ID: PAT_TA_2675
ctgtgaatttcggcagtgcggccttggtgggtggtccggctcagggatacctggtgtatgatcttagggaggctggccctgctcaaagtgagctgccaaaactgacatcgcaagaactactgacaggccgtgatatacctgttgaagacaagtttgaggtgctagtatggagatctcggatcccgccttactgcgactacgctgttacttacgaaaaacagaagaatcatgtggcagtgagaaaacgtcagcgcaaaagttaatctggcaaacagaagtgcacaaaggagttagatccccttccttatagtttagtaaattattattccctgttttttgagaacctattattcgttttcctatatactgatatactatgtgtgtatgcactttttagatggggtatgtgaagtgcagtgagttactgttgctagcctgagttgtgtgtacgtaatagaagccctcgtgtaaggaaactgcttaaaacttgtgactactgtgtctgtgtgtgaccatttcaatgtaactccccagtgtgtgttggtggctagttggctttagccacaccaa

SEQ ID NO: 2676 - DNA, 1040 bp, Triticum aestivum
  Clone ID: PAT_TA_2676
gttgttgtcgtctcctcaaataagtcgtatcagcgcatttaggctctggtcaacaagtggacggacaggttgtccattcttgttgttcttgcgtgtcaagattcttggctgcagacttgcagttctgcagatacaccatgattgcagcaggtgttggaagaaatcattcgatggtcataactgacaaaggaagtgctttgtatacggacaagctggggacgagttcactaaggagtgggactaaggtgtcaccactcccctgccttgttactaaagcaactaatgttgtttgtggtgctgacttcactatctaactgtcatcggttgagggatcttcccgtactgtatggccttcctgaaactatgaaacttaaagattagcacgctcttttttctttcagataaagcaaaaggctttgatcatcttctcatgataaaatatttagataattatctgctttggttgttattagtggggttttccttcgtcatttctttgaagatgtatttagttcttctgtgctattcagtacatcaggacttcctcggtacggctaacttggtcatggaagcgataatcagatcactccttaatgctaagaggggagggatgattttagggatatttttgtcaatggaggacattgacaaaaacattgaatacaaggagcttgcagccatgatggaatgaatctttgcgtggcagcctgcttgccgcccagatagtgagcccctgagctcctgaagaaaggacagttgaaggagatgaaagaagcgaacacaaaggatcctacgccaaaggatgaagaggccggggaagtgatggaagggggtgcgtggaggaggacaggtgcatggcggaagctggcgtgatggctgcgaaggtcaaaggagagaaggcttgcactggactcattttggagtctcttgacaggcacatcgcacatcaaccttgggtgatttaagtgagggtggttctatcttttccgccctctaatttctgtcaatgactaaagatagatattagggaaaattttaaa

SEQ ID NO: 2677 - DNA, 258 bp, Triticum aestivum
  Clone ID: PAT_TA_2677
cggacgcgtgggctgttctcgtgggccctcctcctcccgcacagagcacacacatggggagcggccatgccacggcgacgagggaaggccatgatggggcgacgtcggagaggtggcaggcggcggcgaagacgaggagcaggaatatcgccgtctcacatctccaccgggaccaacatcgcggtgttgaggcggtggagtggaggcctggggagagttgcctagaagaggaggaggttgccggaggaagaggggaag

SEQ ID NO: 2678 - DNA, 379 bp, Triticum aestivum
  Clone ID: PAT_TA_2678
tcgttccgaaccgccaaagcgtcactctcgacatccctcggttccttcacccttccctcttcggcttctcaccgagtaattttggcagccggctcgatccctccaaggccgcagagactcgatactttgttgaacgatcggtggctggtgttgcgtttgcgagtggtgtacgattcttcgttgtgccatgaggaatcacaagaagttgctgcagttcctgcggccggacccggcggtggcggcggccaacgacgacgggtgctccccgctgccttcgcccacgaccagcgggagcgcgagcacgtcggccacggcgtccccgtcgccgtacgtcgcgtcgtcgtgggtcaacctcccggggctcggcgccggggcggcg

SEQ ID NO: 2679 - DNA, 2370 bp, Triticum aestivum
  Clone ID: PAT_TA_2679
gcgcacctgaacgcggatacagcgtaatcacgctgccgccctccgacggcccagtaagggtgggatttcgtccgtgcccgcccctacgcctgcactgtgctcctcttccacggaggagatcgaggcccacctctccaccgcgaccattagcaagaagcagctgaagaaggacacgcggaaagccgagaaggccgggaaggcgtcgcagcgccggcggcagcggcagccgcaggcggaggaggccgtccccgtcgcggccaactacggtaatgtccctctagaggatatggaggccaagctcatccccgcctgggcctgggccgcgagcggcgagcgtgacgttcctgccgcgaccccctccgcccttatccgtctctccgcccacacgctgcgccccgtcagccagaagatggctttcgtcgtgcttggcctgaggatgagcaccgttcagtgcgtgccggtcgtaagcgctggcgccggcagcggcacgcagatgctgttcttcgccacctccctcagtaaggagatcatcgtcgacgtcgagggcgtcgtcaccctccccaaggagcccctcaaggccaccacgcagcaggtcgagatccaggttaggaaggtctactgcatcaatagggcgatccccacacttccgatcaaccttgaggacgcagcccggagtgaggcagaattcgagaaggctgaacaaaatggggagaagctggtacgtgttctccaggacacacgcttgaactatcgagctatcgatctgcggacacctgcgaatcaagcaatcttccgcatccaatgccatgttgagaacaaatttagagaatttttgttctcggagaattttatcgggatccacagtccaaagttgattggtggatcaagtgaaggtggtgcatctgtattcaagctggagtacaatggccagcctgcttgtttagcacaatctccccaattatacaagcagatgagcatctgtggtggctttggccgcgtctttgaggttggtcccgtctttagagcagaaaagtcaaacactcacaggcatctgtgtgagtttattgggttggatgctgagatggagatcaaggagcactactttgaggtttgtgatatcatagatggcttatttgtagcaatattcaaacacttgaatgaaaattgtcagaaggaacttgagacaataaataggcagtatccatttgaacctctgaagtacctagagaaaaccttgaagctgacgtacgaggaagggattaaaatgctgaaggaagccggaactgaaatcgagcctatgggtgaccttaacactgaagctgagaagaaacttggtcggcttgttaaggagaagtatggcacagaatttttcatcctctatcgatatcctttggctgtgcgccctttctacaccatgccttgctacgatgatccagcttacagcaactcttttgatgttttcattcgaggtgaggaaattatttctggagcgcaaagaatacatacgcctgaacttctgaggaaacgtgcaatcgagtgtggaattgacgcgagtactatcgcatcgtacattgaatcattcagctatggtgcacctcctcatggcggtttcggggtcggcttggagagagtggttatgctgttctgcgccctcaacaacatcaggaagacatctcttttccctcgtgacccacagaggctcgcgccataagtttctttcctgggtcgacagcttgcacccatggttgtcatcatcttcaccaatctgctagtcaagtactggaacaacctaacgatgatgggtgcagcgctgttcattacgtttgagtttatggcgtggccaatgtgtagcaccgtcagtgtgttggagcttctgttaatactcacaaagctacttatgttgataaccaatctcgaacaaaatgaaaattaatctgcttttccaagtgggtctgctagctgtgtttttgcgcttgctgatactgccgtcattttcgttatttgtctctgtcaaactgatgcaggcggatgtgtccgcatccatccgaagccaaaaatgcaataatcattactcttttaaactgcaaaaaaaaaaagcttgtgtgtcaggccctaaaaaaaatctgtcgtagttcagtaagctactagtaatgattcagttatccaccggctgggatcaatttgaggcgatagactcatttcgcccgttgagcgttaccagtagtaaataaagagttcctgtttttcccgttcgggttaaaaccctcccctataactaaccgggttgtggctggatggaatatgctttccaaatgaattctctctatccccgtcatggctaaaaaacaggaaccctagcgttttttttcc

SEQ ID NO: 2680 - DNA, 748 bp, Triticum aestivum
  unsure (1)..(748): unsure at all n locations
  Clone ID: PAT_TA_2680
tccacgcgtccgtctccctctctttcccctgcctccttctccagcaaaggccgccgccacggccaggccggcgtggggcgcgccaccggctccacttcgccgccgcacctccgcactccatccatccattcgctgcaccgcgacccatccaccataactaccacgagtcccttgctgcacctcatgccaccaatctgaatctcttcttccttcttgctgctgttcatcccaatctcgctgctgttcatctttgctactgcccgcagctctcttcgtctctctcaaacttgttgatgcagatgccctcaacctcctgctgctcctctcttcttacgcccctgctgttgccccttctacccctacctcgctgctgctctgcttctttttcatccccacgctgctgctactccttctctctacgcccctgctgctgcttctttcccaatcttgccattgcccttctgcatctccaacttgccgctgctcctctgaacctcttctcctcctagtgctgcttctatcgtgccgcttccctgcagcggttcctttccttcaacccggctgctctctctgtgtangtgtgtgcntgtcgctgtgtgttannatggtgtgttgttngnnctcacaagtnatgaanagtgtgtgaanaagagatatgttgaatccangganatntagccgttcntaanantttgttgatcagtganaaatggnacggangctggagancntccaattcaaggtattg

SEQ ID NO: 2681 - DNA, 907 bp, Triticum aestivum
  Clone ID: PAT_TA_2681
cacggatgatgctgaaaagcaaataagggggcgccttaaggccgacctcgggctgacaccgatgagggaggacaatggcggtgccctgttgccgaggaccggggaaggcttggcgctgaggccaaagtcgggaagtcggccagacatgaataacagccagcaggatctcgtcgcggcagggttcgtgccttcgtatggcgacggcctgctcgccgtcaggaagtcgtccagcacccctgagttccaggactcagacaacaacaacatcgcttcggtgtggctgaggcgcaggtggaacctgaaaccagacgccttcgctgtgcctctcccaatcctgctcctggacagccttccgaagccgctcttcgacagcctcccgaagcccattgctgcatggaggaacaaggcagcccgggattaacatccaaggctcacagctcatcgatacaacgccttttaatttattgatcggtgtacaccggtgattgtagtccaggtgcaagaaggggtgaggagttggcttacattgtctggttcgggagtacgtttacatggtccggtgtggacggtgggcattgtcgcaaccgagaggtgcgcttcttcttcttcttcttcttccatgagctacagagatgatgcttaaaagacagagttggatacagtgatacaatagctctacatatacatagtgtactgaacctgctgcgccgcggcgatggcagcagcaggagcagtttgtttcctttttatgagttgtttgaggatatattctttgtcttttgtacgcgacgcagaactgcagatagacaacatacatataggaggatcaaagggaaaccagaggcagtatgttgtacgtacactaatgaaggagaatggactttgttagtgcccgtgtgttactctt

SEQ ID NO: 2682 - DNA, 498 bp, Triticum aestivum
  Clone ID: PAT_TA_2682
gcttctaatacaagatgatgtgggtgggctcgaggtattcaaggatgggatgtggatacctgtgcatcctgtgcctgatgcaatccttgtaattctgtctgaccagacagagatcataaccaacggaagatacaagagcgccgtgcatcgagctgtggtcaatgccgaccgtgcccgcttgtcagtggcgacgttctacgatccacctaaatctcagaaaatatgtactgccccccagctcgtgagcaaggaccatccgcagaagtatcgggatgtggtttacggcgactatgtctcatcctggtacagcaaaggcccagagggcaagcgcaatatcgacgccctcctgatggagcaatagacagggccattgaaatgtaccacaaaaatttgttacacacacagcgcgaacctgacaaacttgatcaataaagaggtggaaaacaaggttgtacataatgtgatttgtttgtgtgaaattttactctagcctccgtg

SEQ ID NO: 2683 - DNA, 599 bp, Triticum aestivum
  Clone ID: PAT_TA_2683
cgcacgaggccgagtctagcagaacccacaccaacaggcttgcagctagctagctcaatggcggcgacgcgagcgtgcttggtcgcgctcgtcgtggctcttacgtttctctccttggcgggccggccgtcggctgcgccggcctccgccgggagcttagcccagcgccggcgcgctgggggttccctccttggccgccgcctcaagccccctgtcgcgggctggcaggtttatccaaatctatatagcgatagcaatacgagactcttcatctactggactcgtgatgcatatcaatcaacaggatgttacaacctactgtgctcaggcttcatccaaacaagcaatcagatcacaattggcggcagtatctccccaatgtccacctatggtggcacacaatatgacatcgatattttagtttggaaggaccgagcggggggcaattggtggctgcaagtgggaggcgattatgtggggtattggccatcatccatcttctcctacttggcagatagtgcctctaccatcatgtggggcggcgaggtattttcacctgatgccggccaaacatccacacatatgggcagtggacactt

SEQ ID NO: 2684 - DNA, 915 bp, Triticum aestivum
  Clone ID: PAT_TA_2684
ttcacgcgtccgtgcaattgatcaattggaggttcagttcaaccaatctgacggtggctttgtcgtggttagtgcacaggaagattcttctacgttgaattcagatgttcatggccaagtcgtccattctacttctcttacattgttcagcaataaatggatgcggttgacgcatgaagttaaatcaggacaaagtggaaagttggaatgtttatcggtgaaggcaataataaataagcaccttgtggtttgctgccaggctgaaagtcctgcttcaatggaagacttcccgctgtggaaatttgaggatcaagtggagacattgcctacaaaggatgctgcactcgccttttccgggcagaaactgattcaagtcgaagagccagacactcaagttgaccttgtcttagattctactggcccttgcgctggttggagagttgtttgttgtcccagtaaccatattatcaaaagggcacgcagttcattctggtgagctgaaaattaatctcgtcgatgccaaaggcggtggtcttctgatgagtccaggggaagcagacgaatctgaaagccatcacgttgaacttcttggtgtttcaaccgcaagtggggatgaagtgtcgaaggaagaagttgataacattaaaaagattcaatattcatttggggtcgtatcagttcccatgctagttgcgggtgattcctggtcctgcaaattggaaattaaatggcatggagcaaagtcactcatgctctatgtttcacttggctattctctagactcgagtgaagatgcatcactacacagacttaacgtgcacagaagcttgcaagttgaaggaaagatccccatgatagttggtcaccagtttttgagaccatttaggcgagaacccttgttgctatctaggatca

SEQ ID NO: 2685 - DNA, 685 bp, Triticum aestivum
  Clone ID: PAT_TA_2685
ctctcccccgatccccaaccattctccggcgaacccgccccatccgccgtgcttgggtagatagatggagggcctggcggaggcggggagcggcggccatctcgcgcctctccttgacgtccacggcggcgggggcggcggcggcttggacgcggccctcctccgccgcctctacgccggccacttcctcgcccgatggggcgcgcgcatgtgggagttctcggtggggctgtacatgatccgcgtctggccgggctcgctgctcttcgccgccgtctacggcgtcgtcgaggccgcctccgtcgccgccttcggccccatggtcggcaccctcgtcgagagcctcacctaccttcaggttttgggcctgtggctgctggttcaaagctcatccttcatcgttgccggggtctccgtaaccgcgctgctggtctacgatgacctgaaagtgacgagcttccctgtcttcttagctctagtcgtggtgactaacgtgtcgggcgcgctcgcggcgctctcaactcttgccggcaccatactgatcgagcgagaatgggtggtggtgatttgcggcgggcatccgccggcggtactgacgaagaccaactcgatgatccggaggatcgacctgagctgcaagctgctggcgccggtcctctccgggttcatcatcagcttcgtctcc

SEQ ID NO: 2686 - DNA, 770 bp, Triticum aestivum
  unsure (1)..(770): unsure at all n locations
  Clone ID: PAT_TA_2686
gttgttcacatgaaaggagttaccatcggatacgtggcctgcaacaaggaattgattggggtattcagcctctcggattcttgccgaactgggtcagccgaggccatcaaggagttgagatcactgggcatcaagtcagtgatgcttactggcgatagtactgccgctgccacacatgcacagaaccagctggggaacatactagctgaggttcatgctgaacttctgccagaagacaaagtgagaattgttgatgaactgaaggcaagagatggccctacactgatgattggcgacggcatgaatgatgccccggcactggctaaggctgatgttggagtctccatgggcgtgtccggttcagccgtcgcaatggagacgagtcacattactctgatgtcaaacgacatccgcaggatcccaaaggcaatcaagctggccaggaggacacaccggaccatcgtcgtgaacattgtcttctcggtgactacgaagcttgcaattgttgcacttgcgtttgcagggcatccgcttatttgggcagcagtccttgctgatgttggcacatgcttgttggtgatcatgtacagcatgctgctactgagggagaaaggcagtggaaaggtggcgaanaaatcctgtgcttcttctcactcaaggaagcatgggcatggtacttcccaccactgctccgatggtcaccaccatgagcatgtatctgcaggtaagcattcttcttgccatgatcatcaccatgagcatgatcacca

SEQ ID NO: 2687 - DNA, 922 bp, Triticum aestivum
  Clone ID: PAT_TA_2687
gaattcggcacgaggccaattcccggcatgagatctagaactagcctttctcattcctcggttcggattttcttgaacttctgaaggtgggaagagcatgaggccgtgggcgtgggtggcggccgtcacatggatggctgcctgctccgccgcggcggcccacggcgagcagccgctgtcgatgatcgccgtcgagaggaccaccctcgccgtcgacgacgcggcgcacgtcaaggcgtcccctgcggttcttggactggagggccagtacagtggatgggtggagctggacttcttccatcccgacccctccggcgatgactggatcggagtcttctcccctgccaatttcagtgccgcgatttgtgagcctgagaataagaggcaatatcccccagtgctatgcacagcacctatcaagtaccaatttgcaaagttcaagaatgacgggtatagtaagtctggaaagggctatctgaagcttcagctgatcaaccagagagaagatttctcatttgcacttttttctgggggtctcttgaagccgaagctgattgctgtctcaaacaaggtgacgtttctgaacccaaaggcgcctgtctacccacgtttggcgcaagggaaatcttggaacgaaatgacagtcacttggacaagtggatatgacatcaaagaagcagttccttttgttgaatggggtgaaaaggggggacgccggttcctttctccagccgggacattgacatttgacagaaacagcatgtgtggtgcaccagcacgaactgttggttggcgccatcctggttacattcatactagttacttgaaggatttgtggccagactcgatgtacacctacaggcttggccatagattaccaaatggtacccgcgtctggagtaagtcatatagctttaaggca

SEQ ID NO: 2688 - DNA, 648 bp, Triticum aestivum
  Clone ID: PAT_TA_2688
gcggcagcttttccagcggctcacgcatgggcgtggccatctccaccgatcccccctccacgcgctaccgcgatggccgccggcggcagcggcggtggcggagacatcggggctgattccgagcggcgcctcaagaaggctatggacaagctctaccacttccccaagcccaagcctagccccagccccggctccaaaccctcctcctcgtccactcccagctcgtggagggcggggaaggcggcggatgccgggaggaggttcggggttgtgcgggggtcgcggctcccgccgcagatggccgccatgtcagcgatgtctccgcctccgccatgccgcccgtgggaccgccgtgaccttgtgcggcggctctcctcattcaaggccatgacctggttcgcaaagcccaaggttgttagtcctgttaactgtgctaggagagggtggactaatgttgaaccggacattataacgtgcgaggcatgtggggcacgtctcctcttttcctctccttcctcgtggacaccacagcaagttgaaaaggctgcttctgttttcagcttgaagctggacactggacacaaactactctgtccatggattgacaacatatgtgatgaatcacttgccttatttccacccacacct

SEQ ID NO: 2689 - DNA, 648 bp, Triticum aestivum
  Clone ID: PAT_TA_2689
ttcttcgtgcagcttatccaggaaggcagcagcgccttgatccagcaacaaaacccttgcctgcgtaggagaagggaggagaagagagaacctattctccccccactcccactcctcgcctcacttggagagtcgatcgatcgatccgcgggcacaatgttccaagggtgcggcctgttcgcgtgcgtgagccggcgcggcgcggacgtcaggaagcgcggggaggcgggcgcggccagctcgcgggtcgcggcggagccggcggtgtgggaggaggaaggaggccgacggcgccgccaggcagatggcgtgggcggaggtagagtccgccacgggggccttctcgtcccgggtcatcggccacggcggcttcagcaccgtctacctcgcctcgctctcctccgcccgcctcgccgccgtcaaggtgcactgcagcagcgagcgcctccaccgcgccttccgccaggagctcgacgtgctgctctccctccgccacccgcacatcgtccgcctgctcggctactgcgacgagcgggacgaaggcgtgctggtcttcgagtacgcgcccaacggcgacctccaccagaggctccacggcggtgacgacacggcgccgctgccgtggtcgcggcgcgtggcgattgcctt

SEQ ID NO: 2690 - DNA, 282 bp, Triticum aestivum
  Clone ID: PAT_TA_2690
tctgtccgcccacgcgtccgcccgcactcgagccgccgcccgcactctctgctctcttccccgatcccctcccatgaaccctagcatcctggtgcagccacccctgccttcccccgtccatccccacccctcccccgcgccgcgagcccttccctcctcttcgtcgccactgctgtctctcctcttcctccccgctctagcccctccaggtcgtcgctcgcggtggttccagatcctgcgctggtcgtccccatgggtgaggaggggagggatgggtcttca

SEQ ID NO: 2691 - DNA, 371 bp, Triticum aestivum
  Clone ID: PAT_TA_2691
tcctgccgatatgaatagagcttgatcaagaaggggtcatttgcatcactgaattgatttttccatcttccaacgcgtttgattttgcttgacctcgtcgttgacgaatatttattgatgcaagtcattgctcagctttttatgcgtctcaccaagggttatttcatcttcatcttttcatcaatattgttgaaataccgcgtgggtggattttgtatggctctctcacaatttccttctgatgtcccttgatcttccttttgctggtagataattcccatatgaatagagcttgagttttaccatggactttacacgagtttcaaagccacagttccaatcttttttaaaagttttctcataccttaatt

SEQ ID NO: 2692 - DNA, 540 bp, Triticum aestivum
  Clone ID: PAT_TA_2692
cttgcacgagggtgccagtatcaggcgaagacgatgacaatgtggtccaggaaaagggagaagttaaatttgatgcacagaattcaggccaacaatcatttcagtcaatgaatttgagtgaaaaagtagaagaggatcgtaaaactacagaggaaaacaagtctaccaaggagatgctgttctatgaatcgtctgtgccggcatcaggtgatgaagacaatgtggttcaggaaaagagagaagaaggtgatgtttctgtagagaattcaggccaaccaccatttcaatcaaaaatttggaatgaaaaagaagaggatgacaaaagtacagaggaaaacaagtctaccaaggagacgcattcgcgaggttcctattttcccgaatcgagtgtgccagcatcaggtgatgaagacaaaaagggagaagatcaattctctgtacacaatttaggccaacattcacttttatcggacatcggagataagaaagagcatggcataacaatggagaaaaagaagtctgccgaggacatgccaccag

SEQ ID NO: 2693 - DNA, 748 bp, Triticum aestivum
  unsure (1)..(748): unsure at all n locations
  Clone ID: PAT_TA_2693
tcatgccccgnatccagttggcccgggccgtgcctacatgagcagcgccgcggctcgatgcttccccacccgaccgaagacggcaagctaggtgttgacaatggcagccccaggccatctgatctgtcaccggtgccgttcttttggtcgagaccgccgtcgtccacgtgctcctcctcacccccacggctggacgctggcgaggccagcctcccctccaagcgcagtctagatttaatgaagaaaactgcggttcataaaacgccaattatggatatggatccatcttgctgcgctggatgaagggctggatatggatccatcttgctgatttggaagaaaactgcagttcatacaatgctaattatggatatggatccatctaatacagttcttcacaaagcccaggaatcgcaaggtcatgtacatgtaacaatgcaggcctagaattagtcatgtatccaaattgttcagttccagttcagttatgagctaacaagatcaccttaatgtgcagggttcaattgctttcggggtcgtacttttcttggtccttattggttggcctgtcttcggcatgatggcggactcgtatggctttgccctgccattctggttatcctctattgtgcattaatatgaccctccggcggctgtcctgcagtgtgcattaagaaatggtagaaacttttgggtattgtatctgactggtacnaatttcctcacaacagcttcagcccgctgctgc

SEQ ID NO: 2694 - DNA, 563 bp, Triticum aestivum
  unsure (1)..(563): unsure at all n locations
  Clone ID: PAT_TA_2694
tctttataatggcaggaccaacggcatactttcgaagtgctgaaatgtctccccaagaattcatagagattgtacatgcttactggaacactaagctacaaacaacactggttcacgcattggagccatattccaaacaagtaaagagatgcatagaaatagctttaaattgtgtggatgcagatcgacacaaaagaccaagtataggggaaatcattaatgttttgaatgagatggagactgcaatacaagtccctggcgcttcaatgaatcacacagggtcatcgatgaacaagataaatagcgaccaggaaagagagttcctaattagggatgcacaggaaacgctggattatgtacatcgaggacaagggaacacatcattcgaggactgccgacaaactcacatagcagaactagaagaacaagagaggaaagactgagcacggcggtgaatcctttggtgaagtagttgacactacaagttggatcaaatgncagagtcatngggaacctaagagcgggagncgacacgcgagccttgatctgtgtcgagaccgcaa

SEQ ID NO: 2695 - DNA, 1073 bp, Triticum aestivum
  Clone ID: PAT_TA_2695
tgcgttcctctcccgaagtggcctccacggggcaggggcgggccgtcgtccgcggattgggtttagatcggggagagacggccatggacgaggaggagcacgaggtgtacggccaggagatccccgtggacggcgacatggaaggcgccgacgtcgacatgaccgccgccggagacgacgcagcgaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaggtggatgctcgctctgtttatgttggaaatgttgattatgcgtgtacaccagaggaagtgcagcagcatttccaagcttgtggaactgtcaacagagtgacaatcttgaccgacaagtttggacagccaaaaggctttgcttacgtggaatttctagaacaagaagctgttcaggaggctcttaatctgaatgaatctgagttgcatggtcgccagatcaaggtgtcaccaaagaggactaacgtccctgggatgaagcagcgtcctccacgcggattcaatccctatcatgcctacccttatagatcatacggggcaccgtatttcccgccgtatggatatgggagagttcccagattccgccggccgacacgctacaggccgtacttctgaggggacaaggctttcatgaagctcaacgcaatgccagtagccatactgcggaataatctagctgccgctgtttcagttacattgtttgactggtagacataatctgacgacggtcgaatgcccctatcgtgtcatcttaagctctgttgtacctgtgggcttgcagtatgcattcagtcatgtggtgaagttggtttgctgtacttggtagtcgtattgtctgacgtggttattatgttggcccgaatgaagttatgatgccatgttctgatgtcctagaaaaaccacaaagaaaagataaccctctgaatctgaagtatagcatatgtcaggccccaaccgctttgatctctgaag

SEQ ID NO: 2696 - DNA, 472 bp, Triticum aestivum
  Clone ID: PAT_TA_2696
ccacgcgtgcgatgcactccactggggggagttctatctttgaaacttctttatgctttgtaaagcagtacattgtgttattgttagttacttttgggtagttcgaaatattgcacatttgaatgaaataagacattgtgcatgcctaataacataaggtacatgagctgtcttaactccagtttatgcaaaaggaaaaataattagtgcattgcagaaatatcacattgccagcgctaaatggctgaatgtcgataagaactgcctagttcgacgtttcaccacatgagagttgcacaaataaattatattattctacctaccccttttgagttcttgaatgtttcaatgttgaaacatcggagcactacttttttcattccgtagctgcttatattttctctggaagtttgcttcaaatttgatgtcaatttctcgtcgtttttattcataatctgtgcagaaaacggag

SEQ ID NO: 2697 - DNA, 207 bp, Triticum aestivum
  Clone ID: PAT_TA_2697
ttctcacactccaccgagctctcagtcacaagtcacaatggctactagcactaagcttgtagctcttggctttgttggcctcgtgagcattgggttcaccaatgcttgaaggatgctggctagctcaagtgctggaggtggaggcgggggaagcgggggtggtggcagctcgtcgggtggggttgggagtggatgggggcatggagc

SEQ ID NO: 2698 - DNA, 826 bp, Triticum aestivum
  Clone ID: PAT_TA_2698
ggctccggcccgacgaccacgccgacttgccagttccgatcgctgaacaccaaccactttcctaagtagaggggcgccgcggaaatgtcggcgacgtgcgcggcggacctggcgccgctgctgggcgcggcggcgatgaacgccacggactacctgtgcaacaggttcgccgacaccacgtcggcggtggactcgacctacctgctcttctcggcctacctcgtcttcgccatgcagctcggcttcgccatgctctgcgccggctccgtccgggccaagaacaccatgaacatcatgctcacaaacgtgctcgacgccgccgccggccgcgctcttctactacctcttcggttccgccttccccttcggtcacgcccgtccaacgggtttatcgggaagcacttcttcggcctcaaggacatgccgcagaccggcttcgactacagcttcttcctcttcccagtgggccttcgccatcgccgccgccggcatcacctccggctccaccagccgagaggacgcacttctcgtcgcacctcatctactcgccccttcccacccggtacgcgtctcccctcgcgtgtccctcgagctgggctctgggggcgtgggcctccgcggcccccacgtgcgccccgcgccgctcctcgtcccccgtgatcgcctccgcccccgcccccgccgcgcgcacggtcgccgcggcatcgcggggttctggggcgcgctcatcgaggggccccgcatcggccgtttcgaccacgcctgccgctcggtggcgctcaagggccacagcgcgtcgctcgtcgtgctcgggaccttcctgctc

SEQ ID NO: 2699 - DNA, 388 bp, Triticum aestivum
  Clone ID: PAT_TA_2699
tcgagctcctcctactcctctgttttggctgcgcgcgcgcggggacggaggcatcgcagattcctcggttgccgctgcggtccaagaaccgggattcggcccttggttccactccccaaggtgcatttgtgtggaccaagatgacaatataataattgcctagcagaagccacccaacctgtaaattcagtcttctctgcttccagcaaaatgtcagtccggcgacggtcggagagcatggagggtctgttcttattcgatgagcgaaatgaccggaggtcggacgtggagaactcagaggatgagaggagaaggctgtccattggcgggtcactcaagaagaaagcgctgaatgcatcaagcaagctcacacattcgctcaagaagc

SEQ ID NO: 2700 - DNA, 568 bp, Triticum aestivum
  Clone ID: PAT_TA_2700
ttaatctcctccccccacgtcgctcccgcgaggcgaccggggggcaaccctaaatcccgccggtctccgccccctctcccctccccctccctcgccgccgcccgtgggcgcggctgggcaaagcccagccgtcgccggcggcggcggggcctcatcgtcctcctgctcgggcggtgctggcgcgggccggcgcctcgggtcggagcgtggagctgtgccgggcgacacggcggtgcagcgggcagaggcggagctccggtgcctctgctccccctcgacgggcggccaggtgttggtgcgtgctcggctctccgagatcggcgacggcgcggccagatctgacgggcgcggctggatctggggccgggcgacgcgggccgagggcggcacgggctgcagcgtcgcagcagcggcaggtcggtgggcgggctcgccggctccaggtgctccgggggttgggcggcggcgggcagcacggatgggctccccggtgagctttcttggtggtcggccgcggaccttggggttttccttgccggcggccgggtgtgtgttggtggcctcgcgt

SEQ ID NO: 2701 - DNA, 652 bp, Triticum aestivum
  Clone ID: PAT_TA_2701
cggcacgaggcgaaaacaggttcccaaaccgaaagatcgaaggagctcagattattgctctgattttcacacgccgacttggatcgagtgagctcgatcggggatggaaggcggcaagaagcagcaccaccacttcgtcctgatccacggcgcccgtcccggcgcgtggtcctggtacagggtggccaccgccctggaggccgccggccaccgcgtcaccgcgccggacatggccgggtgcggcgccagccccgggcgcggcgaggaggtggcgtccttcgaggactacagccggccgctgctggacgcggtggcggcgctgccggagggcgagcaggcggtcctcgtcgcccacagcttcggcgggcagagcctcgcgctggccatggagaggcacccggaaaaggtctccgtggccgtcttcgtcacggccaccatgcccgccgccgggaagcccatgacctacgccttcaaccagctatcgcaagggaaagggccggatttcttcatggattgcgcgctcggaagcgccggcgatccccggaatccggacaagacgttcctgttcgggccaaagtacatggcgcggagagtgtatcagctcagccctcccgaggacctgaccctgggaatcgcgatggtgaggccgtca

SEQ ID NO: 2702 - DNA, 792 bp, Triticum aestivum
  Clone ID: PAT_TA_2702
gcccgcctcctctcgcaaaggcactcacctcgaccccaagcggatcaagccagccgtccccgccggcgatgggcaacaccggaccagcaggactatggccttcctctccctcctcccctctgtttttcctcgtgctccccggctctctctcacgatctccctctctctctgtttttcatcagctgcaggtcgctgtcgccttggtcaaccctcgccggagctccgtcgacgccccgttggccgctcctgagctgctcttcctcctgctggcatcctccgcgtcgtccaagtccccgcgccgtcatggccctttagccccgtgcccaatccccatcgcgccacgcctgtccagcctctgcttcgtgcagaggaggacgatgcctcgttcaacgctcgttgaccgcgccgcgcctgggctgcctcccttccagcctctccaaggcccaaggcccagtccctctgctgcaccgtgcgctgaggcccagccgatggccagatccggcccagtgcatccccagcccatctcctctgatggcccaaggcccagggtgagaagcccctggccttttccctttgtttgttgggccagccttcagattcggcccgagatgtgttttttttcgcagaacgttttagctaattttccagagaatgcagcttttcagaaaagcccttgcacttcatgcatttcattactcacaaacggtgcatcatatgtaaaaacttaatatatgaaagttgcttagaattttgactagtttcataatataccactttcatctaaaaaaaaaa

SEQ ID NO: 2703 - DNA, 340 bp, Triticum aestivum
  Clone ID: PAT_TA_2703
gccccccctcgcgtccgaaatctcaccgtctccgccccctcccccctcccctcacccccagatcgcaccaaccgccgccgatggccgccgccgccccgccgctcgccgcggcgctcctggccgtcctgctggcgctcgcggccccggcggcggccgagatccgctccacggcgatccgggccgacccgcgcaccatcatcccgctcgacgagttcggcttctccaaccagggcgtgctggagctcaacgtcaccggcatcgccttcgacccgccggcctccccggacctcgacctctcccagttcggcttcttcctttccacgctcgacgcctgggtgca

SEQ ID NO: 2704 - DNA, 1411 bp, Triticum aestivum
  unsure (1)..(1411): unsure at all n locations
  Clone ID: PAT_TA_2704
cccctcccctctcccatgtcgctaccaatcccgcgcgtcgcccgagcccaccagggacccgacccagnatcttgccgttggcagctcaactcccgtgtaggtgagccggctactcccctcccacccccaccacccggagaggacacggcgcctcttcttcaaaagccctccctttttgttttctcggcgctcctcgggggttttggtccgccgaggaggggtttggtgcgcccggtaccggagaatcttggcgagaagtgcctagtttccgctaggctggttggtgggaggcgggtgcctggtgccgcggcttcagccatggaggcagtcgcaatgtcgccgtcctccgtctcgtcccacaacctcgacgccgcctccaccagcgacgacatgccgtcctcgcaagagggcctcctcttctcggacagcctcaaggacttgaggaatctgcggtcgcagctatactcagcggcagaatattttgaagtattctacacaaacaactcgcacagatctacggtggtgacgagtttaaaagactacgcagttgaggcactcgttagtactgttgaccatctgggttttgtgtcgtacaaggtggataatctcgtcaatgaaaaggctgacgaggttaatgaaacagaatttcgagtatcgtcggttgaacagagggtaaagatttgccagcaggcaattgaccaggagggaagatctcaacagtctcttcttatcagggcgccgcagtaccacaggcgttacatattaccaggcgcagatatagtggaatctgctatccatccggtttcagagcccacacggtacagcaggcaacatacgggtcgcaaaatgcgcaagtctcagtctgccatgtccactccagttagtaggcagacaacgatgaggagtgtccgttcacaatctcctacagttcgtgaaacacatcatcgatcacgatccatgtctccgtctcgaaaagcacgagctaaatcaccatcaccccaagtcgtgaacttgaatccaaaagaaacaagagcaggttcgccaataccaaccgctcccaatcccctggcgcgatctgctacagttgcaagaagaccacctctggatccaaagcattttagacaaacctcgatgcaggtgcagtccgactatgaaaaccagaaagagcgggagaaaagatcgagcaaaggcaggggcttcctcaagtccctgctcacaagacgccggtggaggaatgatgagtcgctctacaattacttggacgagtactgatcgctgaaatgtccttggatccttgttcccttgttgaccaaatnctcgttccttcatacgtgtgctgttcgagatctcagaccaaatctcattccttcatacatatagcttgtgtgtcaaaaaaaaaaaaaaaaaaaaa

SEQ ID NO: 2705 - DNA, 618 bp, Triticum aestivum
  Clone ID: PAT_TA_2705
tcgccatcctgggcgtgccccgcgccgccgtctcgcccgcccgcgccttccgccccggccccgcggcgcggatgggcctgcggtacgtcgggtacaagaccacccccgaggactgcgccctgccccccgcgcgccccacgcgccgccccgtccggtccgaccccccccccgtggcgcgcccccgcgcccgcgtggcccccggccggtccctcccccggctgaccgtcccccgccgccgggcgcgctgcccggacgggctccgcgggccgcaccgggtcctgctggccggccgcgacggcggcggacggcggccgccgagagcgcccgagtgatgaggtgatgtgcgtcggcccggcctgaccggtctcgattacaacaagaaccgccaactcaatgaacatctcctctgctctgctatagttttcatttcccaccatttctttttctttggttatactgacttgacctgacaattctttgcattagtttttgtgtcgtcggcatgtacttgtgatccatattccatggtaaaaaaacaaatccgagctcgctgtgcatacatacatactatacactcaataaaagagaattggttaccttaaaaaaaaaaacaaaaaa

SEQ ID NO: 2706 - DNA, 1063 bp, Triticum aestivum
  Clone ID: PAT_TA_2706
cctggtactgctaaacattcatcagacatgaagtgggttgttcgatgtgttagctgtggtcaggaagggcacagggccaggagctgtccaacacgagtgtttatatgctccttatgcaatgaagaaggccacaaagccaagaaatgccctcagaagggccagaaatcatcagaaatgaagcgtaaatcgaatgtccgatgtgtaaggtgtggcttggaagggcacaggcgcaaaacatcaatcatagaccgtccgcaagtctagtcctttggttacagtagacaacacatcaacacaagtggttacatgcttccgttgcaaggaagaaggccactgtgccaagcgttgcccccgctccccccggggcgcgcggtgtcgccgccagcggcagtcataatgactatacatggcattacattttcaatcacgccgatgaagcagcttgggaagagatcttggcactaaagatacaaccaaggggaaagatactcactgagctgagccagacctcctcccttgactaaaaagttactgcacagttaccgtctttttcttgtgatactctagcggctgaaaagttttcaaggaagggcattttatatcatgtgtttttggaatgtctttctctgagatgatgttggtgccaattgatgacctgatgagaagacattcccaagatgggattcacaaccacttgcattgtgcaagtttactggcatattccttggtagtaaatgcttctccatacttcatgcacttgatgaacaagtgtacgggatacatctggggcatcagtagacagcacagaggatggaaagtggaaactcgccgtgtgtaattcgaattatccggcgttcgtattttgctcaccaggtttcatggcttgtctgtataagggctgaaactgtgcgctcttgagggctcatctttgagagtggggtgttttggagcccctttctgtttttttttcttaattacaaatcatatttttttaaagtttacaaaatatatgaaagtatacacaagtacttaaggatgtattctacatgtgtgtaaagtttca

SEQ ID NO: 2707 - DNA, 953 bp, Triticum aestivum
  unsure (1)..(953): unsure at all n locations
  Clone ID: PAT_TA_2707
gcacgaggcactgttcatcagcatcagctcatcgccatcggcgcgtcgctaatggaggcggccaaccccaatcccaccgtggtgctgcacgcctgcctgggcgtcggccacctcatccccatggtggagctcgccaagctcttcctcctccgcggcgtccccgtcgtcatcgccgtcccgaccccgccggcctccaccgccgatttcttctcgtccaccgcctccgccgtcgccggcctcgaggccgccaacccttccatcgccttccaccacctcccgcccccggactaccccgaccccgacccccaccccttcctgcagatgctcgacctgctccgcctcaccgtgccgtccctgctcgccttcctccgctccctcccctccggcgccgcgctcgtcctcggcctcttctgcatcgactccctcgacgcccccgcccagaccggcgtcccggcgtacatctactacacctcctccgctggcgacctcgcggcgttcctccacctgccccaccacttcgccaccacggaggggagcttcagggacatgggcaaggcgcccctccgcttccccggggtcccgccgatcccggcgtccgacatgccgcacaccgtgatggaccgcgcggacccgatctgcaccatcaggatcgggcactacgggcgcatcccggaggccaggggcgtgctggtcaacacctacgantggcttgaggcnagggccgtgggggcgntcanggagggcgtgtgccgtccccggccgcccgaccccaccggttgtactgcatcgggcccgctgatcgtnctccggacttcggcgggcgggcgcaaaggcgaagccggcnacgccgtgcnttgtcantgggcttgggacncccccaaccccnggagccgnnagccggtggctgtttcctcctggctttcggggcaaacaaatggggcgcccgttgtnng

SEQ ID NO: 2708 - DNA, 636 bp, Triticum aestivum
  unsure (1)..(636): unsure at all n locations
  Clone ID: PAT_TA_2708
aacaccacagcgaaatggtgtgtctgaacgtcataacagtacttttttagattgtcgggggactaatccacgagcacctatgggaccggcggaccgagtccctttcggttcggcgggggcgagggtcgcacgaagagcggatcgaggcgaagcacacgagcagtttacccaggttcgggccgcacagatgcgtaaaaccctactcctgctttgtggtttgtattgagttcttgctcgggagcgcggagtgctacagtacaccccagcagctaacgagaccggtttctcgtgttctcttttcccttctacgttgcgcatgagcctccttttatatgctcaaggggtcaccgacaggtggcaacgtagaaaagggtaaaaatggaaaaggagttgtggttggtacagctacctgtaaagtgtatcatacctaaccctgacggcaggggacaaaggcattaaatgcccgtctgcgtcacccaaatagtgcaaaaagggaccgtcagggacgccaccgctcgccatgatggcagtcttgtcagcgtcgcttgcnaccgcgcaccgctggccgnaagcctcttgcaacgcgcgctgaaaaggcccaagggnaaacttggtgatntcctggancgcgnaaaa

SEQ ID NO: 2709 - DNA, 1111 bp, Triticum aestivum
  Clone ID: PAT_TA_2709
cggcaacgtcgtacccggctgggtatgccatggcggccgccgtcgagatgcagcacttgaaacactccggcgaccatttcagcttcgcgcctttcaggaagagcttcgaggaggttggtataggtgctgatcaggtgccgtccgatcagcttgggcgatcagagcatcagcagcatgctggccaggaacagcagcctcaccggccggaccttgcaacgacggccgtgcctgccacggccttcctggtcagcaggccgacgaaccccatctcagctaccgttccgccaccgttgcagcacacttctgtcgtgctggaccatgatcagtttcacgtgccagcaatttttctccaccacgacaaatttcagaacatgcaacaacaacaacagcaccagcaaaagattgaccgcaggtctgctggcttggaagaactggtaatggggtgcacgtctacatgcacaaaaggagagacttcgattcctcactcccaagagacagaatggccttacccatactggcctcctgacaaccaagatcatcatggatagtagcaacaagactggttaataccagattaaacaaaagcaaccacgacctctttctctagctagtatggtctctccctccttgaatatacggtactgctttcttggagaatgcactactgttaattgggagaagaaccgggagatctcatagatcttgctctgtcaatggggggaaaaggatacaatttaactttgcaaaggtgttgaggggaaagaggaggagaacggttggggaaaggcattgttgtgctgacatcagaatggagcctgatagaagcataactaatgaaccttaatccaagtttgattataagcacatcattgtttgtcacaacttttgatgtgcattagatatttttcaattgtaaaaagtaatactgtttgcatgtacattaactttgtttttcgcttagtttgagacgcttctttttctttttagtgacgcaaaattgtttagttttaattgcttactgttactttactttgtaacgagttggattcacattcgagattgtttccaagaaataaagttatgttgatgtcccaaaaaaaaaaaaaaaaaa

SEQ ID NO: 2710 - DNA, 1766 bp, Triticum aestivum
  Clone ID: PAT_TA_2710
agccccacgcggcgacaacttttctcctccatccccttcctcaccgcactcgtccgggacggcggcggcgctgcctagaagctgttccggcggcatgtctaccgatggcgcaagctaaacaggggcgtcgacggagctgcggtgtggaccgctccagtactgccactggagtctcaggattccatgagcgtggtgaatgtcgagggggtcgccgccggcaagccgcgcgccgtgggagaggcagccacagatgacgtttgctctgaagcgacaagtgggtggacgcgaagcttagtcagggaaacaccactgcaaatcattttgtttaggaaaaaatgcacgatgaatgggtcgctcatggaccagtgattagcagcattgcagcaagtgttgatttttggccatactggaccaagacattttgatgggtggttagttgtccttcattggatttttagggaatctgcctgatggatggtttactagtgagatgttattaggagcaagtagtatttcttttagcaaatgggtattttggagagattcgacatgtttgatgactaattaggcacatgtggggggaaaggggtgcaagcacaggtgggattggtttgttttggctgttgtcttgatggcaaattatgtcgattttttggtgtacacatgcttgttattgtagcatggggggcggataacgctgtgggagacataatctgtttgattcccttgtttgatgcactcccgatagcaatatagattaagagtttgggtttatatgagatggttattggatcagtcgtgtgtcggcttggattttagtttaaatgtttcagcgggagtattgttatggagatggatgcacagcataaatgttctgacgtgggtaaatatataggtgaatcctggagttggaattagacgcttcattttagctgtgttcctgaggattttcatagtgcgcatccatggctgtaccaaaatgcactcacttgggctgtagtacatatctttttatgttcatctaagttgtttccgggatagctgagcattttcctccgtcatttttttgccaaatacttcttcttcagggttaggattgggaaggcgcccgaggagagggaaatgaaccctgataggaaaacaacacttgaattgtcagtgcgtgcttatgcagagacgaggcatgggcctgttgtcaatccagaaaccgggaccgcttttgactcgttggacgaagcttatgagttctacaatctatattcgtgggaatgtggtttcgttgtcaggcttgcaaaaagcagaatgaatgttcgtcggaagagatgcatgcaagaaatactgtgcgcttgtgcggacaaaccaatgaggaagaacagtcggtcttcaaggtgtgggtgtgaagccatgatcagactgctccgtccaaacttcacttgaattgtccgtgcgtgcttatgcacagaaaagtcatggtcctgttgtcaatccagcaattggtacaacttttgactcattggacgaagcttatgagttctactatctctattcttgggaatgtagttttggaattaggcgggcaaaaagcagactgaatgtacccgcgggcaaaccaatgagggaaaacagtcgctcgtcaaggtgtggctgcgaagcaatgatcagactgattcattcagggagatgtcccagtatctaaagtttctgtaacggacttttgttcatctattcctctggcaaaaagttaatgactgttcccggacaaaccc

SEQ ID NO: 2711 - DNA, 541 bp, Triticum aestivum
  Clone ID: PAT_TA_2711
ttccctctcttacctctccacaaaaagttcaatggatctgcagcaagtaatggagcatcaactgttcgacgatggcgccgtcccgagctgcatgatctcgccgttagaggcagacaacggtttcaccgacgagctgccgtctttgcagttaccggacctggaccttgacttcgacatccacgagttctccgcaccggcaacggcaccggcgaaagcggcctcctcgggtggctccggattggttggttccggttcgggatcgcacaagaagctcaaccacaacgcgtacgagcgcgaccggcggacgcagctcaatcagctctactcgactctccgttctctcatccccaacgcagatcacacaaagaagctgagcattccgacgaccgtctgtcaggtcctcgactacatacccaagctgcagaagcaggtcgaggatctcaagaagaagaaacaggagctcagtacagccaaatgcagagaaagactgcagcgcgtcaaggacaacacatgccgtattgtttctgccactcctctcgat

SEQ ID NO: 2712 - DNA, 877 bp, Triticum aestivum
  Clone ID: PAT_TA_2712
gccccatgagcgaaggagacttgaaaagaaaaaagggtatcctcattcttttagagctcagactgaaaacattcgaggaaagagcagcaacaaggccatcttagaagacatgggagatgattcaaaaaataggcatactttatcagagcaagtttcagaagatgggaacgggagtagcggtcaacaagatgctgacgggactgggtgtaatagccaggctgaagatttaactgtgagccaaagaagcgcaagcttgtcaatcagtatggatgattctacttgtgaccctaacaaggagaagcttgggtcagatggaatgcagcgatcaagcagcggaactcaggcaaatggccatctcgacgaggatccagtcagcagtgataattccagccaagctatttccaaaaatgctgacaagaagatatcactgctaggacacgggcaccacggtaaacaagtggtcgagcttttgctggccaacggtggggaggaggccgttcaccagttttgccaaagatggaggcatgttttcgtcgaagctgtccaccctcgttatctaccttctggttggaatataaagcacagtggaagaagggattttggcgacttcagtgtgtacaaaccatccaaccaagagcctcagcctgttgactgattaggaggattagtactttctttttatataaagttgtttgcattttatcaagcctatatatgcttgtatcaccggattctttcggtatgtggcatctggcctttttccaactctggaattttacaagatttttgtataaaaatgaatatcgaattttgattcacttggcctagaaaaaaaaaaaaaaaaactcgagactagtctctctcctcgtgccgaatc

SEQ ID NO: 2713 - DNA, 988 bp, Triticum aestivum
  unsure (1)..(988): unsure at all n locations
  Clone ID: PAT_TA_2713
ggaattcggacgaggctgacaggaggttggagnaatctggtgacctgaatgacccgccagtctccctgaggatgaggatgctgtgattagtgacaaggatcttaataaacgtggtagcaaatctccaaacaaggaacttgttgataattctcaagataaacacgaagacaatgcccaaccaagtgacgactccatcgatgctgtagatgaagaagcccatctgcctccctcttcaagccctaccaagaatacagatgatagttcttcagaagatgaagaagaggaagaagataatgacaaggagaacatatatccaggcattaaaaaaaatgacctcgcgtcccatcaacaacctcgacgaactcttgcaagtgattcacgtccagatgctgctgtcctgaaagactttctagacgttgaagctgaggaagaggacgacagtgatgatgacatggcgaggtttaaggacaacgaagaagatgatggcgatgatgaaaatgaagtacttactgctctgattgctgctggatttgaagaagaagaagtagatcatgagaaacgtaatgcactccaccaaaagtggcttcaggatcaagatgccgctgaaacaaataatttcattcaaagattaaaatatggtcatcaggagcagaaagtgttgatggaggaagacgaagatgatatcgaagactgtgaggatgaatcagaaaatgaaaggtcacatgacttgactcccaatattgtgcggcagaattctgagaaggcaaaacaaatgattgccaaaatgttcacagatgagaatgacacttatgagcactctgatgatgaggaaatagaggagcatttggcccgtcaacgtatttcaaagcgagaagttcatagtacttcgttcatatctccattggaagatgacagttcaagggaaatgtttagccttataaagaagctcaatattgctcctcaagcccccannnnnnnnggcaagcnn

SEQ ID NO: 2714 - DNA, 534 bp, Triticum aestivum
  Clone ID: PAT_TA_2714
gatccctgtccaatggaggaaccggcggcggccggccccgactggtccaagctgccgccggacgtcctcaccaccgtcctcggtgacctcgagttcccggatctattccgcaccgccgacgtctgcaccgcctggcgggccaccgcccgcgccctccgccgcctcgggatctacagccgcccccaaaccccctgcctcctctacaccaccgccgccgccggcccccgcgccgccgagctcttcagcctcgccgacaagaaggcctacagggcgcgcctccccgaccctcccatcggggagcgcaacatcatcggctcctcgcacgggtggctcgtcaccgctgacgcccgctccgagctccacctcctcaaccccgccaccggcgagcaggtcgcgctcccctccgtcgccaccatcgagcaggtaagccccgtcctcgaccgcgaaggcaaccttgaaaggtaccatctttctctccatggggatgattcgcaaccctatggggtggacaactccgcggagtctctatctgaa

SEQ ID NO: 2715 - DNA, 632 bp, Triticum aestivum
  Clone ID: PAT_TA_2715
gacaacccagcaggtctactcgctatcgctgaggagacattggcagagttcctgtccaaggcgacggggactgctgtcgattgggtgcaaatggttgggatgaagcctggtccggattccattggaatcattgctgtttcgcacaattgtagtggcgtagcagcccgagcttgcggtcttgtgagccttgagcccacaaaggttgccgagatcctcaaggatcgcccctcttggtatcgtgactgtcggtgtgtggatgtgctccagattatccctacgggtaatggtggaactattgagcttatctacatgcagacttatgcaccgacaactttggcggcaccgcgtgacttctggattctccgctacactagcggtcttgaagacggcagtcttgtgatctgtgagagatcgttgactcaagccactggcggtccatcaggacctaacactccaaattttgtccgagcccgaggtgctacctagtggctatttaatccgcccttgcgaggggggtggctccatgatccacattgtagatcatgttgatttggatgcttggagtgtgcctgaggtccttagaccactttatgagtctccaaagattcttgcgcagaagatgacaattcctg

SEQ ID NO: 2716 - DNA, 910 bp, Triticum aestivum
  unsure (1)..(910): unsure at all n locations
  Clone ID: PAT_TA_2716
aaacttcgccgtggtaggagcgccggctctgaacctgacatacctgcagggactgaacttgaccgtgaaccctcccatcaacagctccctccacgatcagctcgtgtggttccagaaactcaagccttccctctgcaagggacaaggtactgattgctttggaagctccctgtttgtcatgggagagtttggaggaaatgactacataagcttccttctgtccaacagaactgttgaacaagccagaccttatgttcctcaaattgtcgacagcatttccagaggcgtagagagactagtccagcatggcgcaaagtacatcgttgtggcagacatcttcccgattggctgcctaccaggagcgctcacaaaccttgctagcccaaacaaggtggagtatgatcggcacggatgcctgaagagagtgaataggttggcccgctaccacaactctctcctccgtcaacagatcaagatgctccggtacaagtacccacatactaagatcattgccgccgagtactacaaacccttccttgcatttttagatatgccgggacatttcggactgaatagcagcacaaccctcctcacctgttgtggtgcaggaggccctccttataactacgacttgcaacgcaggggtgcggcctgccgggtgtgacagcatgcgcaattccatctcaagcgcttcactgggatgggttccaccttacggatcccgcctaaacggccgttgccgatgggtggctccatggcccctatgcggctcaaccattggcgaatggcgcacgctagcactaccttcctcagggtctgacacgccgaaaacgccatttgtaccaattcgcgggcagcgtaattcgtcaagtagtactaactgagaatcacantnactaaaaaaaaaaaa

SEQ ID NO: 2717 - DNA, 601 bp, Triticum aestivum
  Clone ID: PAT_TA_2717
ccctcccccccggtctctcttctcttccggtctgcctctctgtccagcgtgccgggatcgatccgagcttcggttggggtgggttcgccgattgatgcctgtgaggcaatggcggtctcctcgccttcttcagctccggagaagaagaggaaatggctccaaagcaacaggaaggtgatcgacaggtaccttcgggaggcgcgggcgattctcgcgacggcgccggataccggcggcggggacgctgtggcggcgctcggtctcatcgacgccgcgctggagctttcgccgcggatggaggccgcgctggagctgcgggcgcgggcgctcctcgcgctgcggcggtaccgcgaggtcgcggagatgctccgtgactacatccccagctgcggcaaatcctgctccggcgaggatgcctcctcctcctcctccttgtcctcctgcagctccggtgaccttggcacgatctcccgtgccaagctcctctctcccgagcgccaccgctccgacgcggccgagactgacactgggaccgcccgctccttccgctgcttcgatgtctccgagctcaagcgccgcgtcctagccggcctctctaaga

SEQ ID NO: 2718 - DNA, 422 bp, Triticum aestivum
  Clone ID: PAT_TA_2718
tccacgcgtccgagttgggctaactatatttactttgctgaactccctttgtgatggttcttcttgaagtgaagaattgacctctagactggcataattcagttcctggatgaaaaaatttacatgtccttttagtctgaaaatcatagtgggccttggagcatgatgcagaaaattgtcggtctgccctgcacttcccatacatgaaggcaaatgatttctttttggatgccactgtcgtccggcacatggggtttatcaatgagtaaatggtacaaagttcgaattatcagttcacgttcggcctgatggatcgatagcttcgtcgcggtcatcaggagaaatatcaccaatctagcggacggccaaaccgagcggtcgatacaggaaactagcccctgccattccccatctctgtattt

SEQ ID NO: 2719 - DNA, 820 bp, Triticum aestivum
  Clone ID: PAT_TA_2719
tcgcggccgcgtcgacatcaatggatttgagatggatacattcgagttccttaatatcatgcaagtgcatggattccccaagtaatgggagtgcttacacatcttgatcaatttaaagatgtaaagaaactcaggaaaactaagcagcgccttaagcatcgattctgggctgagataaaggagggagcgaaactgttctacttatctggtctcattcatggaaaatacacaaaaagagaagtccataatcttgcaaggtttatatctgttatcaagcccatccctttgagttggcgaatggcacatccttacttgttagcagatagattcgaagatgtaacttcgtcagaaagtgtgcgcttgaataggaaatgtgacagaaaaataacgctgtatggttaccttcgtggatgtaacatgaaaagagggaccaaggtgcatatcacaggagcaggtgatttcagcttgtctggtgtgacaagtttggctgatccctgccctttgccatcggctgcaaagaagcgaggactacgtgacaaggagaagctgttctatgccccaatgtctggtcttggggatctcctgtatgacaaggatgcggtgtacatcaacatcaatgatcatcttgttcagttttcaaacactgatgacaacaatgcatctaagaaacaagggaaaggtaatgatgtcggtgtggctctagtaaaaactcttcagaacaccaaatactcccttgatgagaagttagatcagagttttataaatttcttcggcagacggcctgctgctcagtccgaagacagtgacatgacaggcaatg

SEQ ID NO: 2720 - DNA, 609 bp, Triticum aestivum
  Clone ID: PAT_TA_2720
gcacgagggttgcaggttgtagttgacgaaactcgagcccaacctgatgatgaatctgtttgcagatcttctaaatctactagtataccttcaattcattgcaacttacataacctacaaattatcttactaggcaattttttataatacagatacatatgcgaaggtgcacgaatctaaggataatccgaagcttttgactagtggcacatcctacaaccgaaaaaactcttgccatccttcttttaatttcatttagctacttggccatatctttgatataggtttttgctcctgcctttactgtggttgcagattttttttagcccagaccatgtgggtaatgactcggaatctgttctaatattttggtttgcgatctagctctccattgtttgatttgttacctttaactcttgatccctgtgttctattggtcttctgcaagtgttgcaggatataatagttaggagtttgtgcccaaacctttgctctgtacatggagtcaggtcagtgtcttgtagatggtctgtttgtttcatttgttagcgccacctccatgagttggcttgcaggactggatctggatctggcctggacatgaagctc

SEQ ID NO: 2721 - DNA, 1648 bp, Triticum aestivum
  unsure (1)..(1648): unsure at all n locations
  Clone ID: PAT_TA_2721
tgcaggnaattcggcacgaagcacaatattccgccgcgcacgcacacaacctccatctcttccccccttccgcagaaccctagctgtccacaagtctcttcgtcggcgatggcggcggcggagaacgccggggacgtggcggcgggggagagccgcaagctgttcgtgggtggcatcccgtcctcagcgcaggagacggagctgcggggtcactttgcccgcttcggtgcggtgcgctcaatcgtcgtgatgcgggacaaggagtcgggccacggccgcgggttcgggttcgtcgagttcgaggacgaagaagcggccgccaaggcgctcggcgatggggagaggcccaagcacttcatctgcggccgactggtggacgttaagagggcgcgtgctagacctcctcggaacttgggcgagcaacctgtgcatcaacatcagcatcagcatcagctggaacagggtccagttcagggtcaccaagacgctggggacagtaccgaggccagtagtgacagtatgagctatgcttcaaagaaggtattcattggtggtttgcgtgacaacatcacagaggaggagttcagagcttactttgaggcgtttggcactgtaacagatgttgttgtgatatacgacagcctgacaagcaggtcaaggggttttggttttgtcacctttgattccgaggaagctgtgagaaaggtgatgaggcaaagctttcatgacttgaaagggacaagggtggaagcaaagatcgctatccccaaggatgctcagtattaccgtaatggccgaggtcgtggctcaagaacctttggcggaaggggtcctgttggctttgatggttcaacataccaaccgtacaataaccgacatggtttctacaatggctatatgccacaacctgttcccacacatccctactatcatggcctctattttggtatgggaggcaatccctatgcaaatgcatatccaaaccatgcagtcatggcaaatgttccaaacatggtggcaaggcgtccagtatatagcccatatcccccaatgtatcctggctatggttttgcatacagaagtggttatgcgggtgctgcaccttctgttcagtatggcgttaatggtggcagggattacatgaatgaccaagactctatggatgtacaagaacttgacagcactgctaccattgctacaaagtttgaatacatgaagctaggttcacaatgacgttctgggcaattatttctacactgatgacagcggaagtcgcaactgtgaagacatgagctgagattctttggttgacaagtacatcattggaaattatcaacttacccccattccttgtttcaactgcatgtagactgaaaacattcaagttccaactggctgttgagctcacatgcctttgtaccaatgcttaaatccttttaatgtatcagaatcagaacatttgatgtcgtgcagtctcggttctgtatgggtgctggcatgtatgtaaccggcgccacgatcaattgttgtgcagtgcctttattgttggttgtcgcgtggctagctggatccacgtggtccatctgctatcttcattcatatccggcagatacattgatgtcccgaatgtgcaaaagaggggtgtttc

SEQ ID NO: 2722 - DNA, 852 bp, Triticum aestivum
  unsure (1)..(852): unsure at all n locations
  Clone ID: PAT_TA_2722
acggaccctcgctctctcgctcctcttgttcctccatgtcttccttcttgctctctcttcggcgctctgagtgtctctcacgggggatacagcgtgggaacggcctgggcgacaggatgggggggggtacatcgagcggctcgaagaagcgcaggaggggcagcggcagcggcggcggcggcgccgccgagccgccgcagcagccgccgcggggcggcgaggtgacgcagcgaaagggaggattacttccagactcttgggggtcagccaccccgcttgatcgacagaacggccaccctcaatttggagcatacacgggcgtcaacgtccttcgctctaaacctccccatcgtcccccttccaggctactcgctgtctcgtcggccttcccggtccatccgaattttgggatgggatacggggagagaggagacgcgcgatatggtgaattccagactcccatcgtaagatcaccaagcagcagcactacctacgggccaccacattacgcgcatcctcgtgtcacattgccactgtttgcaccagaggactctacccgtctgagagggcaccatgaccggagccggtcggctgattcgacgagtatgaattccgacgatccggaagacgtgggtctcgtgctcaagctatgatcctcaaatgttcttctccttcttacgttcatctctcctctgatcttatacgacagttcctttctttagcctgcatggggtttcccttccttgtggtgcaataagtttctctttggcccccacgagctggtcccgccgttttgccagacttgtggagggcgccaatcattatttgnccaggcgaatagcaattcacatt

SEQ ID NO: 2723 - DNA, 941 bp, Triticum aestivum
  Clone ID: PAT_TA_2723
aagatcaccacaacattcatcaacagacacaaaatacataacaatattcgccaccagcatccgctgctaattcgcagcaggcagaagtctgaagcaattttccgacgtttctacagcacaacaagggggacactgtaactgcaacagagactaagctagcctaccaaacaacggaaaaaacacatgggtttttgaatgctggtttctgttgatcctctggaaggacaggaaataaagacagggagaactccgagagcggctcgccgtctcaggcgacatgctgaagctgcacttgctgctgctgctgctgctgccgcttctgctgcttctgtacattggccttgtgcttctgcccggccaggtggaactcgtagaccttctggctgttgacgacgacgttgcacgctgtgcagatcttcatttcgccatgagccgctccagcctcgatcacccgcctcttcttcacctccaagtctgctggggacgcgttggagctcttgttcttctttggctgtacagccggcacaacaccatcagcagtggcggcagcggcggcaggaggtgctgtgtttgctgcaacaccgctgttcggaggctttgctggttgaggcgtgatcgcgtcttgtaacttctgcagattcttcttgtgcttctgacctgttttatggatcaagagaacctccatggtgtcgcactggatcttgcagacttcacagagtaatggctgcacaacctttggagttttcttcctgaaactcctccgaacgtttgtcggcagaggatgtccaaaatgggcattccactgagcatgatgcatgaccgtggctgcagctgttggtgccactccgtttggagctttcgctcctccgacctccgcggcccgggggggatcgaacccgaagtgcttcaccgcctctcttccggccgccgcggccgccgac

SEQ ID NO: 2724 - DNA, 1885 bp, Triticum aestivum
  Clone ID: PAT_TA_2724
gcagcgtatagctcgttgcacaggtgctcagatagttccttccattgatctcttgccatctcagaaacttggttattgtgagttgtttcatgtagacaaacatattgaacattccgtgacttcgggtaataagactaagaaaatgctgaagaacatgatgttttttgaaggatgcgcaaagccattaggttgcactgttctgttgaaaggtggcagcatggatgagctaaagaaaattaagcatgtggtccagtatggcatatttgcagcatatcacttggccttagaaacatctttccttgcagatgaaggtgccactctgccagaacttcccttggggtctccactgactgtaaccttaccacataagcgatctactgtagacaactctatttcaacggtgccaggtttcacaattaatatttccaacagccaacaggcaactgatagttttgagcacctggacacagacattgttatatcaattgacccaggtggaacagctgtggttgaaccaccagtagacagtgattgccttacttctcaaaggccaactctcattcttttggaccattgtgtaccagtggttgtagctttaacagcagtaatggtgataaattggagaaggtgactgcaactgcagattctgtatccatgtcttcaatcactacgcatgatgttcccacggatccttcacatatatattctactgtagaaaagaagtgtgtgtattctggtgattaccatgctgattatccaaccagttcagatggtaaggcagtgagagcagattcaatcaacacaaaccatcatcagagcacgtctgcagtcagcacaaatattactaattattctaatctcaaggagccattagagggttcaaatgctttgcctaatgtgagaatcgtcaatgctaataatttgttggtagtgcaaccaatgtctagtcctgcaatgcaaaatcaagaaaccagtcaaggacatgatgtcacatcaaataagacggaaattgtgccttctgaccatcagagcatcttagtctctttgtccatacgttgtgtatggaaaagatctatttgtgagcgttcccagttgttacgcatcaagtattatggtaactttgacaagcctctaggaaggtttttgcgtgactacctgtttgatcagggctatcagtgccgatcctgtgataagccacctgaagctcatgtccattgctacactcatcgccaggggagtctaacaatatcagttagaaaacttgcagatgttgttttgccaggagaacgggatggaaaaatttggatgtggcacaggtgtctaaagtgcccctgggagtgatggctttccaccagctactccataggattgtcatgtctgatgctgcttgggggtttgtcacttggtaaatttttgggagcttagcttctcaaatcatgcagctgcaagtagggtagccagttgtggccattctctccatagggactgccttcggttctatgggttcggaaaaaggtggcttgcttccgatatcacctattaagtcatcagtcatgtccacccaaaactttatttcacccaccgccctgtcggctgggtactgatacgcgtgggcgaggttattgaccgggcaaaggttctgtttgatgaagtatcacgtactttacacctgatctccgagaaaaaggctcactgcagttctctcaatgtggaatgtaccaattacattgctgaacttgaaagcatgtttcggaaggaaaagttagaatttgaggtgcgctgccttttgataccgcattcttgtaacatatccattaaagtagagcttaattgtaattccaacacatggaaaaaaaaaaaaaaaaataaaaaaaaataataatat

SEQ ID NO: 2725 - DNA, 764 bp, Triticum aestivum
  Clone ID: PAT_TA_2725
gttttttttgcctccttccacagcaaagtctccaagaattcaaagcctccaagaccttaacttgctatcatggctgggcgtggacttttagctgcaggtttggtcctcctcgccgccgtcgccccggcctacgccgcggactacaccgtcggcgactcgtcgggctgggctagcggcgtggactacagtacctgggcaagcgacaaaaccttcaccgtcggtgacacgctccgtgttccaggtacggcgcgtcgcacaacgtgcgcggaggtggggtcagtcggactaccagcgcctgctccgccaccaactccatccagtcgttcaggcgaccagtcaccccaaggtcacgcggaccaagtccggctcccccgttatttcatcggcgggggccagtgctcactgtctcttctcggcatgaagctcgccgcgtttggttcttccccccggagttgcaccccgtccactcctatggctcctccttatcgtggctccgttgacgccctccacgccttctgtgactctctccaagtctccggactccatcacgacccgtgcctgtgccaccactttcaaaaacagaggacccagtcggccgggccagcgacgtcgaggcccgctccgtgatgggctctctggttggagctgcaggccttgtcggcctcgccctgatgggctaggcaagaggcagtgctttgtttccgttctccgaattgttcagttcacgttttcttcttcccttgcctcaaaaaaaaaagagaaaa

SEQ ID NO: 2726 - DNA, 1023 bp, Triticum aestivum
  unsure (1)..(1023): unsure at all n locations
  Clone ID: PAT_TA_2726
gccggcatgggcttgtcggccctgttcaccagggcctgctttcgtgttgagctggcatcagcctagggggccaaacggttcggtgtccggtctcgcttgcccgcaggggcccgaagcccccctctgccggagcctggttgcgtggggggcaggttcatgcccagattcgctgactgcctcagctgcgttctgggccgcacttttgggcagaaacacatgccttattttcgtcagggggcggccgtggcatgttcgtgctcgagggctgggtcttccacagccgcgtcatgggccttacctttgggcaggtgcacacgcctggtttgcgtctgtgctctgccgaggaatgctgctatgcctgccctggagtacccagtgccgcgtcttccgtagcaccagggggcatgcccgtcctcgtgccaggtgtatgcccttagtagagcgcgcctttgtcctcccgggtgggccgcctccgtggatgtccgtggcccagggggccatcccagtcatcctgcaaggatcaagccttaagaatagtttgcaggtgaattggctgccacaatggatgttcttggcgcagaaagccattagctaacggaaagggtgttgcaaacttgcaatcgtcgtgttgtgtccgtctgttagactgcagagtcactgagagttgaaaggagggtatggttggaactcatttaatgggcatgcctatttaatgactggttacagactttgagcagtatgctactccctccgtcccataatataagagcattttttgtagtgtcaaaaccgctgtaaaaaccgctcttatattatgggatggagggagtatataattttagcacgatgtaagttcattgtttgcatcctgcctgtgagcgttatgttttgtgcgatgcaaatcaactcattcttttccacggagcaatgtcagttcagcttgtagagagaagttgaaaatacagcagtacaaaaatggtgttacttttaaatagncctacagttaaaatgctaaaaaaaaaa

SEQ ID NO: 2727 - DNA, 1134 bp, Triticum aestivum
  Clone ID: PAT_TA_2727
gcccggggagagagaaaacaagctcattcccattgcctcgccccggaccgacagcgaaaaaaaacagagagagctcgctcattcccattcccatccccatcccctcccctcccctcgtcggagccgcgccgccgcccggcgatccgccgccgccgcccatgtcaaagacgccggggaagacgccgcggacgcccaggcggatcctggagtcctacaccatcaagggatccgacggcgtcatccgccctggggactctgtgctgatgaaggcgcccgacacatcaaagcctccgtatgtggccaagattgaggaaatcgaggcagcaggacctcggggcgcaaatgtcaaggttaaagtgcgctggtactaccgaccggaggagtccattggtgggcgcaggccattccatggcgagaaggaggtgttcctctctgaccaccaagatgtgcagagtgctgataccatagagtgcaagtgcaacgtctacagcttccgggactacaccaagctttctgctgtcaatcctgaggactatttttgccgcttcgagtacaaatcaatcacaggcagctttgtgcctgatcgcatagctgtgttttgtaagtgtgagatgccatacaaccctgacgatcttatgatccagtgtgaggaatgctctgattggtttcaccctgcttgtattggaaagaccatcaaagaagcaaagaaacttgagaattttacatgtgaaggttgtgttgctgaaaatggaaatggaaatggagtcaagaacgaaaattcccatgaatctacaggcgaatcagatgagaagcaggtgcagtcgaagcggcgacggcggtgaaggcgaaggcgatctgggcgggagtcctccatctcttcacgcatgtgatgcggtggatgtacattgctgtttccagtttgatgtagaacgaacctgtattgagagtctcttctagagtctggcaatcggccagtttgcaactttgcatatccatgtggacctacctgttagatggagtcatttttctctcttcttttttccatcccccttgtgttgacatggacaatggtgtgcttgaacgtcctttcttcattgactagaaaagaggatttcaacttttttgcggccgcga

SEQ ID NO: 2728 - DNA, 1114 bp, Triticum aestivum
  Clone ID: PAT_TA_2728
ggcgactcggtgctcactcaggtgtgcagggaggtcggcaggatcaatgaccgcacgatcgccagctccgtgcgccatttcccggtgcccgtcaacccgatgatgccgcagttgttcccgaggatccacgcgttgagagctggaatctccgacgacgagagctcggtcgcgtcgtcgccctgaccaccactagtctgccaatagaatttttcttggattatcaacggggagacatgccagagagggcgggaactacagaaggacaactcaacagggtggcagccggggccagagcacccctggcaccggagcttcaaccaactagcagcggcatctatccaacatgccatatggccatggcgtcgccgcgctctcgcgcgtgggggggagctccgcgcccccccaacgccgcgctccgcgacgcgcggcaccccctcgcaggatctccgtgggcggcgggcctgtcctctccgtgctccctcacgtgtgctgcctggtcggcagggtctgtgcccgctcgtgcgcctgctccgtgcgccatttccgggtgcccgtcaacccgatgatgccgcagttgttcccgaggattcacgcgttgagagctggaatctccgacgtacgagagctcggtcgcgtcgtcgccctgaccaccagtaatctcccaatagaatttttcatggaccatcaatgaggaaaccgccagagagcgggaactacacaaggacaactcaacagggtggcagcctgggcctgaacacccctggcaccggaacttcaacaaactagcaccggcatctatccaacatgccatatggcaatggcgcggtaaagctcaggtgagttggaggtagctgagcaccccctaacactgtgcccgacgctcgacacccgcacgcacgaacaccgatggcggcggtcctgttcatccctttctttcctgactttttgtacctgtagaatatagaatgtacaagttttttgcaaatatttattccgatatataagaagggacaaaaggctttaggtcagacatcagaggagggaaaataagcagttcatgtatgtatgtatgtatgcggtctcagattctgtacattaacatggaccagtgggt

SEQ ID NO: 2729 - DNA, 1142 bp, Triticum aestivum
  Clone ID: PAT_TA_2729
ggcgtgctgttcctgccgtccggcgggttgcttgccacggccggaggcaccacggtcaagatttgggatgtgattggtggtggccggctcgtgcactcggtggtgcgcccggtcaagacaatcttcgcgctcgcgctcgggaagatgggcgccactggggaaactcggctgcttagcgcagggagtgatggttatgtgaagtgctttgattatggggagctcaagatgacacactcgatgcggtatcccaaggaattgctgtccgtggcttgctcgccgtgtgggacggtgcttgttgccgggtcttcaaagggtgacatctttgtgcgcagaaggaagaagaatgcaacagaggaggtggaagaggaggttgtaagcagcgagttcgcctggacaatgcccaagccagagaagcaggcgctcaagccgagctactacagatacttcctccgcggccagaatgaaaaggccaagcagggcgacttcgtgatctcaaggcccaagaaggcgaagttcgcagagcacgacaagctgctgaggaagttcaggcacaaggatgctctggtttcagcattagccaagaacaatccgaggagcgtcgtggcggtgatggaggagctggtcgcgaggaggaagctggtgagatgcatcgggaatctggacgtggccgagctcgggcttctcctcgacttcctgcatcgcaacgcgaccctgccgaggtacgcaaggctgttgcttggggtggcgaacaaggtgctggagatgcgcgcggaggatatcataagcgaggatggggggaagctgagggggtgcatcaggaaccttaagcggatggtcgtggaggagattaagatacagcacacgctgcaggagatccaggggatgatatctcccatgctcgcgctttctgcgagtagattaaagtgaatttttgttacctgtttgggctgccataagtgctcgtgtatgttcatttacgcttcatagaccatgcttgcttgttggtgaaattttggcttgtttctactgagtgagatcctagtgcctagagacttttcatcagattgttcttctagtatgtccccttattttgatgatgttcagtatcgattcaagtgatgtggtcgcttaaaaaaaaaaaa

SEQ ID NO: 2730 - DNA, 1214 bp, Triticum aestivum
  Clone ID: PAT_TA_2730
gcacactgctgcctctttcggcgaatgcgtcgagcaaactctacatagtgtacatgggggagaagaaacatgacgatccatctgttgtgaccgcgtggcaccatgacatactaacctccgtacttgggagcaaggatgaatccttgaagtcgatggtttacagttacaagcacggattctctgggttcgcggcaatgctcaccaaaacccaagcaaggactttggcaaactttcctgaagttataagtgtgaaacctaacacctaccacatggcgcacacaactcggagctgggacttccttggccttgggcacaacaaatcaccacaacagactgccccccgacgaaaagcgaattacggtgaagatatcattgtcggggtgatcgattcaggcatatggcctgaatcacaaagctttgacgacaacagatacggccctgtgccggcacggtggaaaggcatatgccagaccggaacagcgttcaatgcatcgagttgcaatagaaagatcatcggcgcacggtggtactctgagggaattgacgccatgcacctcaagggtgagtacatgtcgcctcgggatttcagcggccatggcactcatgttgcctcgacgattgccggaggagaagtgcacggtgtgagctatgccggcctagccaccggcatggcacgtggcggggcaccgcgtgcacggctagcaatttacaaggtgttatggggcccgaacacagcagccagtgacgcgagcatcctcgcagccattgacgatgccatacacgatggcgtggatgtcctgtcgctctcactgggacggggtgccggtcacgagttccccgggacacttcatgctgtcttgagagggatctcagttgtcttctctgccgggaatgatggcccggcaccacaaacggtgacgaatgtcgcgccatgggtcacgacagtggccgctagcacgatggaccgggccttcccaaccttcatatctctcggaaacaaagaaaagcttgtgggacaatctctttactacaactctactctgaacaacgacgtctttaaggagcttgttcatgcgggaagttgcacggaggagtggttagcgtcaagcaatgtgaccggcaagatcgtgttgtgctatgcaccgagggaggctccgagcatgttgcctcgggtagagctaccccgcaccatcaaccgtaccgtgagtgccgga

SEQ ID NO: 2731 - DNA, 793 bp, Triticum aestivum
  unsure (1)..(793): unsure at all n locations
  Clone ID: PAT_TA_2731
gnncgncgtgttttcccccctgccccgaacnaaccctactaaagggaacaaaagctggagctccaccgcggtggcggcccgctctagaactagtggatcccccgggctgcaggaattcggcaccagcggacgctcacaacgtagccgacggtggcgacccactcccaacccgcgttgttctccgtcagcagctgacagacttagtttgtttttcagtgtgcgcactaggtctgtgaatagtttaaatctgaacgcaacaacaaggctgccatcctgagcattgacgaatagtacatcaaagcattttccgaacttgctaaaagcaaacgtggaagctctccctaattcatcctttaaaggtggctcacagagatcgcagggaggcaggggagttcgaatttgtgaggacaatggcgccatggttgactgaatggcaataggaagaaggcacatctcatgtaattgttttatttaagacaagtctgcactggggagttccaatttgtgaggactatggtgccatggttgactgaatggcaataggaagaaggcacgtctcatgtaattgttgtatttaagacaagtctgcactctcttatgtcaaatttgcagattgccctgccctaggctatttctaagggggacgagaagtgtgttattttttgttgggattacaaagaatggtagcggtgagcatatggtatattctttaccctatttttctttaacatatttacgtttggctgaactgaatattgctttttctccttttcagataagttagtttacatta

SEQ ID NO: 2732 - DNA, 889 bp, Triticum aestivum
  Clone ID: PAT_TA_2732
gcgggggctgttgtacctccaccgggactcgaggctccgcgtggtgcaccgcgacctcaaggccagcaacatcctcctggaccacgagatgaaccccaagatatccgacttcggcatggccaggatcttcggcggcgacaagaaccaggagaacaccaaccgcgtcgtcggcacactaggctacatgtcgccggagtacgcgatggagggcctgttctcggtgaggtccgacgtgtacagcttcggcatcctgatcctggagatcatcaccggccagaagaacagcagcttccacaacatggagggctcgctcaacatcgtaggctacgcgtggcagatgtggaactcggacaagggggagcagctgatcgacccgttgatccgggcgtcgagctcggcgtcggcgtcgcgcgaggcgctgcggtgcgtccacatggcgctgctgtgcgtgcaggaccacgccggagaccggccggacatcccgtacgtggtgctggcgctgggcagcgacagctccgtgctgccgatgccgaggccgcccaccttcacgctgcagtgcacgtcctcggacagggacgggttcagggggaaggccggcgacgagtcctactccgcctgcgacctcaccgtcaccatgcttcaagggaggtagtcgtcgatgctgggtagggatgtgtgaaacttgtgccgggcgattctgctgcttgtagagattgtttccgtttgctctctgtacatggcgcaaattttgtaacactgtgttctttggcaggctttaaactagtctagtcgatcggcatggcaacagccaactgtacatatcacaggcttagggagtcatcagtctgttaatctgtttgcattttctttaaaaaaaaaaaaaaaaaaa

SEQ ID NO: 2733 - DNA, 928 bp, Triticum aestivum
  Clone ID: PAT_TA_2733
tcgccactctgctccgctccgctcaagcaagcagacccaagcagcagcagagcgccggagggacgccaggatgcacgccaagacggactcggaggtgacgagcctggcgccctcctccccggcgcgctccccgccgcgcgcggccaacaacaacgccggctcgggcgggggcggcgggggggtgatgcgcggctcggtgtactacgtgcagagcccgtcgcgggactcgcacgacggggagaccaccaccaagggggccacgtcggtgcactccacgcccgcgctcagccccatggcctcgccccgccactcccactcctccgtcggccgcgactcctcctccagccgcttctcccgcggcggcgcccaccacaaggacaagtcggctggccgcaagggcgcgccgccgggcaaggggtggcaggagatcggggtcatcgaggaggagggcctgctcgacgaggaggaccagcgccgccccatgcccaagcgctgcaagtactgcctcatcttcgtcggcggcttcgcggtcctcttcaccttcttcgcgctcgtgctctggggcgccagccgctcccgcgagacgaacggaatgaaacagagcatcacgttcgagaacttcatcatccaggccggcacggacgcgtcgctggtgccgacggacatggccaccaccaacgccaccgtcaagttcacctacaagaacaccggcaccttcttcggcatccacgtcaccgccgaccccttcacgctctcctactcccagctcaacctcgccgccggagacctcaagaagttctaccaggggcggagcgggcggcggacggcgagcgtgaacgtcaaggggaacaaggtgccgctgtacggcagcgggccgacgctgatggcgcagcccgcggggggcaagggcggcgccggcaaggtgatc

SEQ ID NO: 2734 - DNA, 1659 bp, Triticum aestivum
  Clone ID: PAT_TA_2734
accgccggcggccctctcctcctccctccctcctccactgctcgccactctgctccgctccgctcaagcaagcagacccaagcagcagccgagcgccggagggacgccaggatgcacgccaagacggactcggaggtaacgagcctggcgccctcctcccccccgcgctccccgccgcgcgcgcccgaccacacggccacggcgcgcgccggcgcgtgggtcaagttccctgcaacgacgcccggcacatggagccgcacccccgctcctctccaccctcgcacctcccccgatcgccaccctgctcaaccaagcagatccaagcagcagcagagcgccggagggacgccaggatgcacgccaagacggactcggaggtgacgcgcctggctccatcctccccagcgcgctccccgccgcgcgcggccaacaagaaccccaactccggcgggggaggtggggtgatgggcggctctgtgtacgacgtgcagagcccgtcacgggaatggcacgacggcgcgactaccaccaagggggccacatcggtgcacttcccgcccgcgcttagccccatgctcgtccccccgcccctcccacttctccggtggccgccgattcctcctccagccgcttctcccgcggaggatgccgtccacaaggacaagtagccggggcgcaagggcgcgccgccgggggaggaggggcaggagatcgacgtcatcgaggaggaggggctgctggacgaacgacgaccaccgccgccccatgcccatccgctgccacgtactgccgtcctccttgtgggatggatatgtggtgctcttcaacttcttggcgctcgtcctcgtggggacgccacgccgctcccagaacggccgcatgatcgccatgaagagcatcactttcgagaaccttcatcgatccaggggcgggcagcgggcaaggtcgccgcgggccgaatggtcatggccaccaccaagccgacggtgacgttcacgtagaaggagaccgtgacgtgcgtggtcatccaggtcaccgccgacccggtggcgctgtcctactcccagctcaacctcgccgccggagacctcaagaagttctaccagggggcggagcgggcggcggacggcgagcgtgaacgtcaaggggaacaaggtgccgctgtacggcagcgggccgacgctgatggcgcagccggcggggggcaagggcggcgccggcaaggtgatcccggtgccgatggtgctgcggacgacggtgcggtcgcaggcctacgtgctgggggcgctggtgaagccccgcttcaccaaggaggtggagtgcaaggtggtgatgaaccccgccaagctcaacaagcccgtctcgctggagaaggcctgcaaatactcatgatctctactcatcatccatccatcaattggttggttgattgatcaattgattgagtaatcgaatcaattggttgatcggttgatgagtgaattggtcttcttcttttttctctgtgcattttgctcacgtatgcctcttctttttgtgtatctatatatatatgttgccactataaattattaagttttgtatcgccgtggtggctgtgacagtgatggaccaacagcagtggagtgattcttttcggcgttgcattgatccttattt

SEQ ID NO: 2735 - DNA, 431 bp, Triticum aestivum
  Clone ID: PAT_TA_2735
tcctctcctgggcatcgtgttcacctcagtcagtcagagttgccagtcaattggtcagtcagttgggcattcagtcagtcagtcaattcgcgcagtgcggtcagtctcagtctcagttcaaaggcgagttgcgcgtgcgtcggatcgtcgacctagtgcttcacctcctggtgccaatcgcgcatcctttcgagctcgagccctcggacagccgtttgagcggcggcttgacgaggtgctaggtgccagtcccatctgcctgcagcagcaccagcatcgcgccttccctcacaagccgcttcttagtgagctccacgtgcctcgactgccgcctggtccctttgcgcgatagcgtgccggcgcatgtgatcacgcctctcaactgagcaatctatcttcttcgcgtctttcaccacattgctgacggacgt

SEQ ID NO: 2736 - DNA, 974 bp, Triticum aestivum
  unsure (1)..(974): unsure at all n locations
  Clone ID: PAT_TA_2736
cgacaattgatgtcgttggagatgcctaggttaccggcaatggagtggaagtaggtgcctcgctggagtcggaggagcggggcaagagcgccgccacatttgagtgcaacatatgctttgagatggccggcgagccggtggtcacttcttgtggccatctcttctgctggccctgcttataccaatggcttaatgtttactccaaccacaaggaatgcccagtctgcaagggcgaggtgacggaggcgaatatcactcctatctatggtagagggaattcttgttcagatgcagagaaggctgtggatgaaggcaagcagccaggtcttacaatcccaccaaggccacatgggaatcgtcttgaaagtttccggcagcagttccagcacttacgtccaatgtcaagaaggcttggtgacgcacatgggatactgtcatcgtggaggcgccttcttgatcaacaaatcatgagtagtgtgagtagattcgaaggcccgtctgaaccagctgtgcatgaaacaggtgacattgctccacacactggccgcctaagtagattgaccacaaggatgagagcaagacggttgctgagcgaggtagataactctcctgatgctgcttttgttgcccctgatagtggtctacctggaaatagtgcgccagatgcacctagagatgcttcaggcccggttttaccagaaggatttgatttgttgcaacggcttactcttattggcattgcaaatacagaaagattggcaactgccatgagtgaccttagaaggatagctacacctggccaacacggagcatctccctcactccttggtgcgctcgcccctccgggcctgctccgagcgtccccttcatccgcggacccgttgcgtcccgtgggtaccgctgtccggccccatgtcggncccagccccttccacgggtccgttttaacgtggaacnacacnagtctcagacct

SEQ ID NO: 2737 - DNA, 825 bp, Triticum aestivum
  Clone ID: PAT_TA_2737
gtttcgggagaaggtatgataactcagcccacgcgtccggaagccagggaagatacaggagagagaacaaaaacaacagaagaacatcaggttcgagcaggttggatgatgatactgaggcatcaggcgaggactgggacactgatgatggcagggatagtatggtttgcttcgacaaggagaggcatatacctgatgaacatcctcggcgatttgacagcatgcgacatgacaggagtagttccagtcacaggcagaattacatgcctggggcctccagaagccccagccggaccccaaagaatgcagttagtgtttctgatgacagcgaggatgacgtttcagacagtgaagatgatgaggtgtggggagcagattacaaggaagagacgagctcgagtgccccgaaggtgaatttttctaattacaagagcagcagcgaggaggataccggcgacaactggatgcgtggtggcagaaccagccgaacgaagaagaataccgacgaggactgggacagtgactgacaaattgaaaaagaacagtcaagcctgcatcatgttgtcacatttctgcaggaaagagttcgttgagcttgtttttcgtgggagcatctgtctcagtgtcgcagacggtgctgcttgattccaacctgacatcatgctgggttgggtgctcataaataattgttcgaattgcgtctccaaatatgtagttggcgcatccccgaaggccgaagcagtctgccagttgccagctgccgcgggaccataatagcaagatgtcatggtgttgaatgttgtccttggctgaacgtgtttcctc

SEQ ID NO: 2738 - DNA, 567 bp, Triticum aestivum
  Clone ID: PAT_TA_2738
tctttcccgacgaatcacgcgcgcacattcacactgggcttggactcaccgctgctgctgccgcttccggagctaacaaacagcaacggaagctggttccggtggatcctcgccgccgccgccgtagccgcagctagcaagccgagcggaactggatccggcgcgggagcaggaaccgcgcgcgcgccggggctatctcgagggagaagaaatgtaagccgcagataccgtcgatcagctgaattacaggccatcttgagagctggatagtactgaaaatgggtgtatggagcttcaagaggaaagctctgatgtcggggctctggtctcagcaccatcaaggaacctgtcatcctcttcctccacatttgtttctgccaaccagtcacctttcttcacaccacggtcactgtctgcttgtcgcccggagcatgctcatgtcgagcacaataactccccgactggcatcgcgctgaaaatcggtgatattctttccagtgacactctggtacagcgggggcagttaccatcatcagccaacataaggttattgctagacgatgcttc

SEQ ID NO: 2739 - DNA, 1015 bp, Triticum aestivum
  Clone ID: PAT_TA_2739
cccgcccgccgacgtcgccacccggcaaccccgcccccgcccgccgacgattcgatccccctccccggttcaccccaaccgctccgccgccgtcgccgccgccggagagggggaggaagggccggaggggaggggctgcccgtcgacgagatgaaggaggtggtgctccacgtgtacgacgtgaccaacagcgactccgaaaagaccaacaacaccatcctccagatcaaccgcatcttcaaggaccgcatcggcctcggcggcatcttccacagcgccgtccaggtctatggcgaggaggagtggtcgttcgggttctgcgagaacggcagcggggtgttcagctgccccgtgagcaagaaccccatgtacacataccgcgagcgcatcgtcctcggggagacggagtgcaccatagccaccgtgaacaggatcctgcgcgagctcagccgcgactggccagggcactcctacgacctcctttccaggaactgcaaccacttctgcgacgtgctctgcgacaggctcggcgtccccaagcttccaggctgggttaatcgttttgccaatgccggcgatacagctgtggtggttgctgagaatacagcagttaagttcaggcaggctaaaacagaaattgtcaatgctagtagagtagcatatagatttatggcaggcctgacttcgaaaaaccaggcttcacaagagtctcctggtgaacaaaatagaggcagccctactttccaaggaacatggttcaagaatgttgtttcagctggcgcgaagccatctacaagcgggtcaactccctcacaagaagctgatgatgcacctcccttgcagcgccaacaatcagcagagcaaccaataaggttgtagtcgctgtcacagcaggcctaccgaccgttgtattgaaatctgtagtgtaacagtagcaaacatttgttcaaacttgtttattcatacatgaatctatgtgtctctgcattgcaactaaagcatcaaatgtaaacat

SEQ ID NO: 2740 - DNA, 433 bp, Triticum aestivum
  Clone ID: PAT_TA_2740
attcccgcagccgcattcgccgccctcgcgccaaccacctccccccgaaggacctcgatccgccgccaatggcgctcccagacccgcgacggccacggcctcggcgggcgaatctgctcgacttcggcgccgggagaggagaggagccgcccctcccctcccctctgcgtggttccgctcgatggccgagcggttccgcgtgaggcgagggctcgactgctccgacgcctcaaggtgcacgaaggccctaggtgctggcgtggtgcaggggatctcacgaattccaccacacacaccttgccgccgttcatgctccgtccggcttcagcagggccagcaagacgcgacttccgcttctttctgtcccacgacgccttctccaagccgctcaaggaatctggagttcatgtatcattatcaaacacaagcttgt

SEQ ID NO: 2741 - DNA, 749 bp, Triticum aestivum
  Clone ID: PAT_TA_2741
cccttctccccgacgggatgccagcaccggggcgatcgcccacggcattcgtttatggttgaggtattgtcaggcaggggtatttgctgctagttgacccggcttaaaatcacagcaaaccattgttggtcatcggtccacacttggagtggctctaggccatggtccgccaattgccggggaatggcgttgggattgttagcatggagggaaaatttgcgggatatttccgtcagaatggtttctccagcttgcagatccaccgttaaatcaagattttccaaccgcaccgtttgcttcgtgccactgcgtaaatacatttcaatttgggatttttgctgattaaatacagcccgatgggaaaagttatccaacgcaaaattaccttgaaaacgccaatttaaatggcgcaacatatttaaattaaattccgccgttaccccttgggcatcgttataggcggctcctacaacatcagcagggttgcatcaatccccccctaatacagagtagtcccctgggtctaacgcttcgcctacttgttcgcagtacccttgacaatcttcaggggaaaaattaccgagagaactgcctaaaaatgccatcaaacgatggggataattatgatcgggcaatgatgccaacgccaactgataagtacttactaaaccttgcaccgttaagtggagataggtagctaaaatagcctccgcattttctcttaaaatcgcttcactgatatcaacggg

SEQ ID NO: 2742 - DNA, 838 bp, Triticum aestivum
  Clone ID: PAT_TA_2742
agtggtttatgtttttctgaaatagagatttaaattttgtctaaatccaagttatgtcaatgaaaaaataaaggatttcagacagttcttagttagcttttttggcactctcggtttaaagtgtaatcaagctatcattcggtgtgaattatgattcaaactaagagtattgaccatcatcaacaagtgggaggtagcagtcatcattaggggcaaaatattcttgcccttgattagattctctataatcagcatataatcgagcgtcttcttcttgatagtctgacattaagtatttttcatatagaccatcgaatactttgggtgaaatataaatattggtctttcttaactctctaaggcgttctcggcatacattgaattcactttctatggtcaccattagtttgttttcacagagctccttgatatattcatcactttttttctttacatacaaaaattttatgctttctccgattgaatgcatttggtgaaataaacttgccatgctattcattatatacatttcacctaccttactgtatttatagttgtatttgtacctctgctcattctgctcattagagtcatacctgggtgatgaaaattctttataaactttctctgaatactcttcatcactcattaatgaatcattgatagactcaaattttggcatgaacattctgcaaaaatcctcaatcgtgtttatgtatttttctaactgattatgttgttcttcagttattttttgcgcggtaagaatactacgaaatatattatctatactatctacgctaacaaagcattttgtgtaatagattcttcagatcct

SEQ ID NO: 2743 - DNA, 478 bp, Triticum aestivum
  Clone ID: PAT_TA_2743
cgccaatggcaatgcagttagtctgggggccccgccgatgaaaccggggacagctactaaacccattgccagtggtggtggtagctctggccctagtctgggctccggccaacccagagcagaacggcccggtgccggcaatgcaggggcaaatgttggtcccattgcggccaatcccgttgctagtagtgctccccctaaaccgaaaccaactcccagttcccccgctaagccagaccccttaaagtgcgttagccaatgtaaacccagttatccctccatcctccagggggaagaaggtagtgctacagtattaatttcagtaaatgatagtggtggtgtgaccagcgtaaccatcaccaatgcccacggcaacagcgaggtcaaccgccaggccctattggcagccagaaaaatgcagtttacggcccccgccagtggtcaatccaaatcagtccctgtggtgattcacttcacc

SEQ ID NO: 2744 - DNA, 714 bp, Triticum aestivum
  Clone ID: PAT_TA_2744
agcccagaacccgttagtgatagcttcccaatggattacgaaggcgaaggcttaccagagcaaccagaaccatggtccactggcggcctaggggatagggatgaatgggagctggccccaccggccggggaagcttgttatcggcaaccggagctggaagggctactccattccctttattccgctcggtcagtgttggtgacatcgggggaaggcatgggcaaaacctatctggtgcggcaggtgtgggaacgactgttatccgatggggtgacgtgccaatactttgaaccagctacccccaaaaccctcctgatggcgatggcttagtattagcaacggaaaaaatttggtcgttaaggctgaaagctttatccagtaatgcttccagacatcaaattttataatttatctgaatcattactgtcccattcatgactataagtaggacaacttcaccgcctaattaccggaaaaccttgatttcttgttagacagactcgtaaagccaaaaatcgtaaatgggactgtttagatgagcgaccaaaaattttccactactaaaactaagcctattttagatatatgtgaaggtttttacacgtatctcggcatgacccctggtattgtgctcagctataagtgattttgcattatgtgcgaaacgtgagttttaatgagacagaacccaaaatctcgatgattgcggatcct

SEQ ID NO: 2745 - DNA, 216 bp, Triticum aestivum
  Clone ID: PAT_TA_2745
cgagctcggtacccggggatcgccgtttcgatgggggcatggtcgagggtgacaaatcctccggcattgcggatgggggcaaaggcaatggcggactgttccaggcggagcatagtggggtcatcaatggtgagctggccactgataaaagtcatggggttgatgtaaccctccaggcgatcgggcggttcatcgtcgaggtaaatggtttcggta

SEQ ID NO: 2746 - DNA, 596 bp, Triticum aestivum
  Clone ID: PAT_TA_2746
gttttctaaatggttaaccaattgggttccggtggttaaactgttgtagtcgttaaaatcctctgtgagagcctgccgttgtaattttttttgctgttgcaatgcttgcactaatagttgcaaacggttagtgttaggaatgcgtcttttgcctagcaccatttgtcctaaatctaagcaaacttcccccagagcattaaacgcatcttccattaggatttccactgtttgtaattggggtagattgtggaaattaacaatttcattgagcaacattaggcatttatttaatctttccgtatgctcgattaaaactaataataattcccttaatttactttgtccccataatcctcgctggctggccaccagagtttgccgagatttaagcaagttttgacgcagtttgaccaccaattgctgagcttgggggtcatcgggactaaagttagcggcggccatggcccggagataattgcctaaaatgctgtaattgttggcaaccatttgccgcaaaggttgattgggacggaagggccaaatgaaaatagctaatatcaagctccacattcccccgatcctctagagtcgacctg

SEQ ID NO: 2747 - DNA, 184 bp, Triticum aestivum
  Clone ID: PAT_TA_2747
cgagctcggtacccggggatctggccgaaaaagttggggagctaaaaaactggaagcaaatcggtctaactcttggaggtgcaatcatcgggggaataatcacctacctagcaaggaatgccaacccttaagaataggttttatttcattggccttgattgctaaatatgttcacacaacagcg

SEQ ID NO: 2748 - DNA, 500 bp, Triticum aestivum
  Clone ID: PAT_TA_2748
gggcactttttgcgcccccaatcggaggcggtgaaccaagcatcgtggttaccaaataccgttgccttgggaatgggtaaggaggcaatcaagctgaccaccggcaatgattcgttgccaaaatcccccacaaatagtgccaagtctacgccgatcgcctggagagcttggtggtccgccaattcccattgttcatggatatcccccacaacggccagggtagtggttgcggtaggttggggggccatcagctctcttcgctttccgacatttctgccaattcttcttccccagaaggaggcactagggccacagcggcgatcgcatcatcggcatctaacctttgtacccgcaccccagtggcactacgggattggggggaaatatcgttcacggactggcggataataatgccccggttggtgacaatcatcaactcgtcatcggcgttgaccacatggagggccactagctggtcatctttggatttaacgcatcct

SEQ ID NO: 2749 - DNA, 341 bp, Triticum aestivum
  Clone ID: PAT_TA_2749
cgagctcggtacccggggatcaagttcctggccacggaggacattcaacagttggctagtttaccccgggctacttccgccgacctggcccgtgcccaaacccataatctcaatccccgcctgaggcaaaacttacaagctttaatcactagggcctacagccagatttaccaaggcgatcgccgacaggaatggggcaaagtaaaagaattttacctgtggcagttgccgttagtgttgcgacaaacggggatttacaccatggcggcctttggtattttttgcttcgccagtgccattgcctggtggtatagctggcgggatcctcagagtcgacctgc

SEQ ID NO: 2750 - DNA, 920 bp, Triticum aestivum
  Clone ID: PAT_TA_2750
taactacgggtgaaatgaaaaagcgtgcaacttccgtgtcaaagtcccggaaatttccccccccctcataagccgcatttaatcgataaagagctgttcgttgtgagtttaacggccctgacaagtcaatggttggacgcaccagaccaaaattacctgcctgcatagcaacttcataaaaaggttctgaaaggggctgtttggtaatgtaattaataacgccgccaggatctaaattgccgtagagtacggaagccggccctttgaggacttctatccgttgtagatttgccgtgtccggaatagaaaaattatctctgaacttaaagccgtcccggagagttccgccaaattgttgaaaaccgcgaatattaaatatttcggatgtaccaccaacagtatttcctctctgcacaccactgacattttgcagtgcttccgaagcacgaattatttgcctgtcctccaacacctgttggggtaccacttgaatcgattggggaatgtcccgtaagggagtatcggttagagtcgccgttgtggcatcgtccaccgcatagccttcatcctgttcaccggtcaccactacctggatagcatcattgccatcctcttcatctgccacccctttccctggacttaaccccagtaccagggattggtctgtggcattaacttcaaccgtcggcggcacattgaccccggtaatggcaatgcgaacaatattatcaggtaatgctgtaacgctcactagggcaatttcttcggtggggttttcctgttgcagtccgtcactatccggcaaggctaggatggcattgggaatatctacaattagtgcattgcccacaacggaagtggttggtgttgataagcggcccgtggtagccagggtcagttccagtccagcttcggtcaaa

SEQ ID NO: 2751 - DNA, 643 bp, Triticum aestivum
  Clone ID: PAT_TA_2751
tgccaacatggaatcggtttctgcattcacggcaacccgattaatgcctccctcggcttgaaactcgtcaccgtgacccacatgggctgttacgagattgggagttcctagggtcaaacccagtgccagaaaggaacttgctaattgaattgttttcatcacaccacctcaaattgggaatttgtccaagattttcccagtctgccaaagggggtatgaaattcaggtgaaaatctccttcccccgctaagatcagaccgttataaaaaaggcagaggcgatgcgaattttgctggtggaagatgagacggatttgggaatggctattaagaaagtgctagttagtgaaaagtatgtggtggattgggtgacggatggctcccaagcttgggattatttggaaaatcaatggacggaatacacccttgccattgtggattggttactgccgggattatcgggtttggaactctgtcaaaaactgagaacccagggtaattccttgccggtgttgatgttaacagcgttaggagaaccggaaaaccgtgtcgaaggactagatgccggggcagatgactatctaacaaaaccgtttgtgatggcagagctattagcaagactgcgggcactacaacggcgatcc

SEQ ID NO: 2752 - DNA, 665 bp, Triticum aestivum
  Clone ID: PAT_TA_2752
ggtgatggcgttgggtcattccttcagctttctggccttctggccacctaagctctggtgagagaaacagcaaaggcgctacgctgtgcagctgctctgacaccagatgcatcaagaactatgacatggctgaatttctgaagctggagttgctgaaggaaacaggatttgtgcacatgaggatctgtgacggcgtcgggtcattccttcagctttctggccttctggccaagtttgctctggtgagagaaacagcaaaggcctaacgctgtgcagctgctctgacatcagttaacagtgttgtcatgcatagcctgttttatcgctactctgtcgtggtatctcagtgtgtaagatagttcttcgctgaagtgaactatttatgcttgtttagcgtcggagatgtagttgtagcctgtagtgactagtgaggagactgagtcctcgtagttcgagtgcttttggcccagccatccgtgcttcacgcgctgctgtatttcggaactaatctgggtatttttcgggtcattttgtagtctattgagctgtcgtgccagcatcatgaaggaaccgtcagttatccaagtcaactgcatatcaattatggattggcagaaaatcgattcatcatttccttgcatttttatttttggtctgaattttac

SEQ ID NO: 2753 - DNA, 550 bp, Triticum aestivum
  Clone ID: PAT_TA_2753
tgcctactgtgatttgagcagcgtcgtattgccccagggttgccaaaccaagcactgttgctcctagtccaaggatgctgttaacgctcagatggcgaaccgcaggagagaagaaaccgttgttggtgggggcagattgaaccaagaacttatcttcaccacgagtgaaatcggtaatcacgtcaaccttggacaaattaacgttgaaccaggagaggccgagctgggaatccttaagattggtgtagtcaaataggtcattacccataccaccagtcaaaatatccttatcggcaccaccgataatcagatcattgccagcacggccattcaaagtgtcattgccgtgaccgcccatcaaagtgtcatttttttggaagccaactatgctgtcatcgcctttaccgccatcaagaatgttctcttgatcatcaccaataatgatgtcattcccaatggtaccgataacgttgtcaaagttgaccaccttgaccaaactttgaggagagcatgcaccagaaatcaagatactttgcatgcctaggtctac

SEQ ID NO: 2754 - DNA, 617 bp, Triticum aestivum
  Clone ID: PAT_TA_2754
ctggggcttgttgttgaggagattgagaattttatcgccccgttccaaagagcggtcttctaaaaaggaaacttctggggtgcgccgtaaacgcatccgttgccccagttctcgacggacaaagggagcggcggagtgcagtccagccatggtggaggctttggcttcaggggagccgtaaatgctaacgaaaattttggcgtgctgtaggtcgccggaaacttccacttccgtgacgctaaccatgcctgtgcccacccggtcatctttgatttcgtggagaagcatttgactgacctcccgcttaattagggacgacacccgggaaactcgacgactggtagccatagacctgctcctcggcaacaaaaaagtccgagcctggacagattagcccaaactccctctacacggtcaatcctaacatggcccgcagagtgaaatagagaaaaatgaatccactgaccagcagtcccatcagggcgatcgccccgacacgattttttaataggggctggagccaagtgaaaacggagaaaaagatgcccagggtaaaactgatcagataccggggataacgggaaacgtagagctaaaaaatcacccatggttattgg

SEQ ID NO: 2755 - DNA, 800 bp, Triticum aestivum
  Clone ID: PAT_TA_2755
cctccggttatcacttggacgtcggagaccgcggtgattcatggtatgccccccgattactccccccccgatgtgggcacggcagttcagttttatgcgcccgaatttcgtgaattcatcatggaagtttttgaacgttgtgttcagcagggcgagccttttgatgttatctgccaacttcaagtgcctgacggacgcagaccttggatacgggccattggcgaggccgaacgggacgcccaaggtaaggtaattgttgtccagggggcgtttcaggatatttcaaccctacgggaggcccaagagcgtttccagttaatatccaaagccgccaatgatgtgatctgggactggaattttgctaccaatcaagtctggtggaatgactccataacagatctgtttggctatgctttgttagatatggagccgggactagaatcctggacgctacgcattcacccggatgacaaagagcgtgttctccacagtatttatcaagttatcgacggtgaagaaaattactgggaatgcgattatcgatttatgaaaagcgatggccagtacgcgaatgtcatagaccgtggttttgtgactcgcgatggacaaggcaaagccacccgtatggttgggagtatgctggacataactgagcgtatggcaatggaacaaaggctacgggaatctcaaaaaatggaagcggtggggcacctgaccggcggtgtggcccatgatttcaacaatttattagcggttatcctgggtaacgctgaaatgttggcagaactggtgactgatcc

SEQ ID NO: 2756 - DNA, 335 bp, Triticum aestivum
  Clone ID: PAT_TA_2756
cgagctcggtacccggggatccttttgaccgtatgattattgcccaggctcagcaacataatttttccgtcattagcaaagacgaaaatttcaaaaaatacaacgttaatttaatctgggaatgagaacaataacctgtttgtatgagtcattttcattccttgaaccttattgcttagaacgtgtttagcagttttgttcagccccctaaatctcttcactaaagctccggcaatactgggggactttcactcagtttccccccaaattggaggccaggaggacatttaaaacaggctcttaaatgcctttaacaattgccccgaagtctccga

SEQ ID NO: 2757 - DNA, 813 bp, Triticum aestivum
  Clone ID: PAT_TA_2757
ctttaaataagagccgtccgtaaatctgagttaatttttggtgcacatttggacacattactccaagaagtgaatgacatttaccaaaatgatgccgagctaacaaagttgctgggttctctgtatcaacaaacccaagattatgcgacagagtttggtgctttatctggtggtaagaagaaggcaaagtcttaggttgttgaatgtttgttgagggttatggctagtacttgatggcgtaagttcatcaattatttagaggttttaagatatcagatatcaataactgggtaatgaatttatgccaagctctactagtgcgtagctctctttttttttctttttaggtaaacttatgacaaaaatttatcgctgtaaattaactctccatgacaatgttttttttgccagtcgagagatgggaattctctatgaaacagaaaagtatttccataattgggcattaagttatgctttttttaaaggaacaattattccccatccttatggcttagtcggacagaatgcccaaacacctgcttatttagaccgagatcgtgagcaaaatttactccaccttaatgattcaggaatttatgtttttcctgctcaacctatccattggtcttatcaaattaatacctttaaagctgctcaatctgcctattatggtcgttctgttcaatttggtgggaaaggtgcaaccaaaaactatccgattaactatggtcgtgccaaagaattagcagtaggtagtgagtttctgacttatatcgtgagtcaaaaagagctagatcctctaaagtcaacctg

SEQ ID NO: 2758 - DNA, 712 bp, Triticum aestivum
  Clone ID: PAT_TA_2758
tttactccactggtcatgctccttgtgatgacgtttatgtctattatttggatgctccattgaccaaaaaagtctctgctaatgaatgcggtattgtgcaaatttcccttggctcaataccccatactggttcaacagaagtaacgttgataggggtggggccagcaacggtgagctcctttcctttaatggctaaagcagatgcaccaaaatgttccaatggtgtggcgaccaacattcctgcggagggaaaagcacgatatgttcccaatgcggaaacgggtaatcaatctttagtgtggacggggcaaacccctttcacccagtacgacatcacgtttcccataccaaaggaaagaaagctgaaatccaatgcttgcggtgttgccaccatatcatccagtagttcttatccttccaccggaacctttcgcatgggagcgagcccaactgttcataactttgccacggtgactggagttaatgcacctcctggttgcaaaaacaatacgttgcttttgcctgttggttttcccaactaaggttggggtagataatcaattggcaaagataagagaaggacagggtaaaggttagatataagcaaaccaattattcagcgtcctgaccaccgagcaccagcaatttaaccgtaatcacatgactcctcagccgtgaccattcccgaaaagttgcggcttttgacgatcct

SEQ ID NO: 2759 - DNA, 580 bp, Triticum aestivum
  Clone ID: PAT_TA_2759
aatcccatcgcccatgcggaaatgttagccatccaaactgcttgccgtcggctaggccattggcgattgaatgaatgcaccctttacgttacgttggaaccttgtcccatgtgtaccggcgccattatccaagcccgtttaggtttattagtttatggcacccccgacccgaaaaccggcaccatcgacagcgtgttcgatttggccgccagcgctgcctctaaccatcacttacaaagcttaggaggagtgtgccaagaacagtgccgtgaacagttacaggattggtttgcccaacatcgggctaggaaaaaacaacaatcccttgtttcctgaaggttggtattaccccgttgggactttgcaactacagcctttgatgggtatgggaatgttgcttaacgttatcttcagctttaaccactttgctgtcgttgagaatgcgttttttctccaaagaaaagttaaatttgtcccatttttccccaatggctaaatgttccttagcttgaggccgaacttggtaagtacgggccgccgctgtaaaccgttccgcaaaatcgtcacagaattgggcact

SEQ ID NO: 2760 - DNA, 859 bp, Triticum aestivum
  Clone ID: PAT_TA_2760
cccggtgcggaaatccctattgccaaaccacttcccggctttggggtttgcccctcctacgcctggatatggggcgggtctacgacggttccatggtggggcgatcggaagctaatctccgcaacgccttgaaaaccgccgagtccatttctccagctattttgttcattgatgaattggacaaagcctttgccgggggagccggttccggggattccgacggcggtacctccagccgcatctttggtagtttcctcacctggatgcaggaaaaaacttcccctgtattcgttatggctacggccaaccgggtcgatcgcctgccaggggaatttctccgcaagggacggtttgatgagatttttttcgttgacctaccttcttccgaagagcgggaagccattttccgcattcacctccataaacggcgcaaagacacttcccgttttgacctgggggaattggcccgcacctccgacggtttttccggagcagagattgagcaggcgatcgtagcggctatgtacgaagcctttgcccaagaaagagaatttaaccagctcgacattatcgcagcgatcaaatcgacgttgcccctgtcgcgcactatggtagagcaggtcaccgcgcttcgtgactgggcccgacaaagggctcggcctgcctccgcttctgtggctgaatatcagcgactggagttctaacaagctttctcctgttcccgcaggagcaaagactaaccgttgggttagtagtttaagataagccgttttgatggcggcatttcccacttctcaattgttgttgttgacatttttctctggaggaaatccaccatgtctcatttcagcactctccg

SEQ ID NO: 2761 - DNA, 542 bp, Triticum aestivum
  Clone ID: PAT_TA_2761
caatgctcccagcatctgtcttgggcaggacttttccataggttgcatggaatttaatcaatggtaagtgattatactcacaattattccagtgatttttgatatttattctgaacagataatgctaacttaatagttgagaattatttgcagttttgggaaaaccatgacgttattggatttatcggtgggtcagttggcttttgtggagaaaattttactaggaaaccacggtcaggggttagttaatcgcctagaagcaatgggaataattcctgataagccaattcaattgctccgcaaggctggtttggggggaccactccacctccgcattggtagcaccaccgaagtggccatgcgccgtagtgaagcccaattggtgcagattaccttaggagagtagggcggagatggtgagtcattgccaaagggggtcagtccagtccagtcgtccagatgtgcaaggaaagaaagcttttattggtcagcccaatacaggtaaatccactttcttcaaccggatcctcagagtcgacctg

SEQ ID NO: 2762 - DNA, 667 bp, Triticum aestivum
  Clone ID: PAT_TA_2762
tttcttaatctctggtcgggctggggtatcaacgacgatgtgctcataattacgggccgcttttaatccttcccgctcatcaacaactgggaaatctagcttttcatgggatgcccaaagcagtgccgaacggttcaagtccccatcaatcaggattgttggagctttgttattgaggtaggcggccaggtgaatagagcttgtggttttacctaccccacctttaaaagcagtatcggtgataatcattacatggttcaatatttaaaagtttagacgtttaactgtgtaaactttcgaatggctaaaagggcagacgcttggaagtttaaaatgttgctaagatttttggcagcaatgtgcaataaaaattactaggggttaatgagtctgattgtcaggagcttgtcgaagttcgattcagacagagtgccaaagtttttattaggggtttcaagtgatgactaaaaaaatactaggggtttgggatgaaagatacccgttattctcctgactggcctcagttggccctacaaaaaaagcaagctgttggttgggtctgtgaacggtgaggggtgcaatgcctcaagcctggcgaggggaaggggtaattaaaggaggaacggtatcggctcaggatggcggttcatcactgcgattatgatcc

SEQ ID NO: 2763 - DNA, 515 bp, Triticum aestivum
  Clone ID: PAT_TA_2763
tgtagtaaatttaaccgcattagctagaatgttaaccaatacctgtcgcacccgtgttaaatcccccaatatcgccataggtacctggggctcgatttgataaaccaaatccaatttttttgcaaaggcttggggcgcaactaaatccaggcattcttcgacacattgctgaatttcaaagggatggatttctaacttaaattgtcccgactcaattttagaaaagtcaagaatatcgttaattaaactaagtaaggcttcgccactactgcggatggtttcggtaaattgttgctgttgggtatttagatgcgtatctagcaataacccggtcatgccaatcactgcattcatgggggtgcgaatttcgtgactcatggtggccagaaaatcacttttggctcggttggcatcttctgcggcttttgtggccgtcattaaagctttattttgctctattaattgttgacgaatttccctttcttgttctaataatttggcttgagctagggcaa

SEQ ID NO: 2764 - DNA, 500 bp, Triticum aestivum
  Clone ID: PAT_TA_2764
ccggtattgggagatttagggggcaaattaaaacttggcaaacaggctctaggaaaaggcaataggtatggtggaaggtttttcacgtcgttcagaattcactctggcccggggaggggatattacccaagggaattccctcaccaatggtttggactggggctttaaacagttgacccgtctctgttccctcgcagtagtggtgattctcggctggatcgcctgggtggtttttaccgatgcccgaccggcgatcgccaagtttggttgggaattcatcgtcagtcaacaatgggacagcagtgggcaactgtttggcggcttaccctatattttcggctcggtggttagttccttcatcgccctaatttttgccctgcccttggggctggccgtggcggttatgaccagcgaaaaccttctacctgcaccggagcgggtgcccattgcctttctggtggaactgattgcttccattcccagcgtgatcctctagagtc

SEQ ID NO: 2765 - DNA, 897 bp, Triticum aestivum
  Clone ID: PAT_TA_2765
cctccacacccccaaggatgctgccattattcaggccatgctgctgttgggcaatggttttaatttaaacattattgctgaaggtatagaggaggagccccaagctcgttgtctctacgatttaggttgccgagaaatgcaaggttattggtttagtcatcccctttcagaagcagaaattacggctttcctagcagaaggcaatttccaaagattttgcctcggttagggagctttttcgacgaatttagtatagctaagttcattgattgcattccaactaaacatttgactgcggaatgtttgccattgttgataaatttccttaaattgggcatctttactggcaaattctgctagcaatgctcgggaagtttcctgggccactgttaaaatttctggagaaaaggatttcagaattgtgcctccatccagtaatgttttcagggcaatgctattaaaagtttcataacgggatagcatcaatagattggcactacgggccgcttcctggaaaatagcttggtattccggcggcaatttcgcccattggctttggtttaccaatacgtccaagctggggcctggctcccaccaaccgggatagtaatagtatttggccgccttatttagccctaacttttcgtcgtcgtagggccctacccattccgctgcgtcaatggtgccccggtctagagctaggaatagttctcccccaggaatcacctggacgttgacccctagttgagccattacctgccctcccaagccgggaatccgcatttttaaaccccgcaaatccgctagggattccactggctttttaaaccaaccagccatctgagcaacggtgttaccggcggtgaagttaatgatattaaagtcgctgtaaacttg

SEQ ID NO: 2766 - DNA, 504 bp, Triticum aestivum
  Clone ID: PAT_TA_2766
gcgtaattatttcgggtcttgaaaagcccgttcatagacataataaactaccgttttggaagcgttgtgggggccgccctgggtcatgatatacacctcttcaaaaactttgagggcggaaatggaagataaaactcctactaagaaacaatagggccgcatgaggggaatggtaatatcccaatgttgtcgccaaccgtccgctccgtcgatcgccccggcttcatagagttcctggggaatggcttggagtccggccaggtaaatgaccatgtaataacccaaccctttccacactgtcaccaccatcacactccacagggctaaattgggactggtgagccaaggaataccatcgctaaatcccagtagggcaagaatttgattcaggatgccattggaagcgtagagggctttccaggcaatgcctgccaccacaatagaggtaattaccggagtgtaataggccatgcgaaaccagatgatgccccgcagtttttggtt

SEQ ID NO: 2767 - DNA, 637 bp, Triticum aestivum
  Clone ID: PAT_TA_2767
cggtaattagttccggcaacaccttaccgaccgctgcgaatattaccctgcccactgccggttccaccgagagtcaggggggaacgccccagcccgatctggaagcttttgaagggatgttggtgaaattcactgataccctgacgattacggaaatgtttaatctcgatcgctttaatgaaatcaaactcagccaaggcggtcgtccccaacaattcacccagtttaatgatgctaatgtggcaggctatggggcataccgagaggaaatcggtgctcgcaccattacctacgatgatggcctgagtgtgcagaacgcagaaattagcaatctggatggttttggttccagcttcagcaccgctagtgatattcgcatgggcgacacaatcaataacctcactggcgttctcagctaccagtgggcaggtaacgcttccagtggagctacttggcgggtgcgctctgctgtagatgggacaaatcagtttactaaggtgaacgatcgccctgtcacaccagaaaatgttggcggttccctgaaggtaacgggcttcaatgtcctcaactacttcaagaccatcgacctgtaaagtgaaagcacggccattggtcaagatccccgtggggcagacac

SEQ ID NO: 2768 - DNA, 491 bp, Triticum aestivum
  Clone ID: PAT_TA_2768
attttcattcccaccgctgacattttgcgagaattggcccagtttgccccctgggaggtggatgtaattaccctaagcggcagcggagagccgacgttagccaaaaatttaggggaaattctcgaaggcattaaaaagttgactgggaaattaaccctggtactcaccaatgcgactttgttaaatgatgctcaggtaagagaagagctctccttagcagacaagatttctgtcaaattagacggattgtggccagaccagttacaaagaattaaccgaccgatcgccggcattgagttggagcaaattttgactggtattcaaacctttcagcaggagtttacaggggaattatcagtgcaaaccatggtgctgcagccctgggaccagacggctgagagccgttatttggagcttttatccctaattaagcccaccgaagtgcaactcaacaggcccaccaggcccaaacccctccagcgggaattgga

SEQ ID NO: 2769 - DNA, 612 bp, Triticum aestivum
  Clone ID: PAT_TA_2769
tgatgacctccgttatttttgtcggttgaggtttgtgaccttggttcccattctagtttgcatccccaatatagacaatatagtattttaagcacagattgcatccaaaatagggacaataggaatatcaatggacaaacttgaaagtatttacgcctttacccaagttgtgcgggagggcagttttgcggcggcggcgcggaaaatgaatctggggcgatcaacggtgaataagatggtgattgccctagaaaatgagcttaaagtacagcttctccaccgcagtacccgtaaagtgacccccacccccacagggatagccttttatgaaaaatcggtgcaaattttggcagatttagaggaagcagaattgtcagtgtcccaactccatggggaaccgaagggtctgttgcgagttaatgcacccatgacctttggcaccatgtacattgcgccgctggtggcgaagtttatggctttacattcccaagtggaagtgcagttaactctgcaggatcgatttgtggacgcgatcgccgagggttacgatttattgattcgcattgcccaaccgctggaatcggctagtttgatcctctagagtcgacctgc

SEQ ID NO: 2770 - DNA, 505 bp, Triticum aestivum
  Clone ID: PAT_TA_2770
cgagctcggtacccggggatcaatgctttcctgcccccagggaagaatttttacgaacatggtgtcatcaatcggggcaccaggcgatcgcctaccaagaagatgggattttacggggttatggcgttctacgcccctgccgagtaggttacaaaattggccctctgtttgctgatactccagaggtagcggaaattatctttttagctctaaaagcaattcctacagcggaaaataccatttacctagatgtgccagaacccaaccaagcggcgatcactctagcaacgaaatatagcctgcaggtagtttttgaaactgctcgaatgtacactgggcaagccccctccatcgccctagataaaatttacggagttacatcctttgagttaggttaacttttaagtccgggtaaaatccaagttttagaaaaagattgtgacaaaatcccgcaaaactgcaaaaattcgtggggaaaagtggtcctctagagtcgacctgcagg

SEQ ID NO: 2771 - DNA, 899 bp, Triticum aestivum
  Clone ID: PAT_TA_2771
ctcttcgatcgccagttccgccgcttcaccacggtggtttcactgatggccatggtgccactgagggagtggtgcaaaccaactttaatcggttccccggtgggagcagtaccggtggtgggggactcagtcggttcagcagtgggttcggtggtaggttccgtgccgccgccacaggctttgagcaatagactggcgcctagggttgctgatccatacagcaaaaatttacgtcttccaaaagggttagtcatacgcgaaaaattattacctcgtaaggattctaaatatgcttgttggctggtggggaggagtttattgggcggaaacagtgctcttaaaaagtttttatccgcagtttattttggtcaacaaggcagtggatttccagggtaaatccgccggaaacaaataagaccccatactacgagtaggttaagaaaaaattatgtagcataggataccgttttgtccgactaagccccttttgcgcctgttttgtccccattgtcaggcaggcttagcattggaaccgttcagcaagaacaatcttggggctagttattggggaattatcggcgatcgccagagttttctaaacgataaagggcgaggaaagtcgtttcccacactagccgaggttgaacgtaggcggccaggtatttacgggctttttccagaatttctaaccatggccgttggtggtggccatgccaatagtgatactggagatagtccactaaccagagttgggcactgttatccaagttgccatccaccatcttggccaaatcaaaggctgctagaggactagttggtggttgcattaacttttgccgcagttccgctgtaaagctaagcatttgctcccgagcatgaaataacagaccgggactccc

SEQ ID NO: 2772 - DNA, 535 bp, Triticum aestivum
  Clone ID: PAT_TA_2772
cgccattcggaaaagcaaaaaagcagaaaccgggtggaagaaaaatccgcagaatacgcttcccagtctagcggaaaattacctcggctccatcccaactgacctaatattgaccctcccctctatcgacatatcgacagtgcatccattaaccatggacgaaaatatcggcctaagcctaggcatcgaacaatttaaccggcaagatttttacgcctgccataacaccctcgaagcagtgtggctagaggctaacccgtcggagaaaaatttctaccaaggtattttgcaaattgccgtagcccactatcatcttggcaatcacaattggcggggagcagtgactttactggggcagggtatccgccgcttgaagggttttcgccctgaccatcgggaagtggatatagagagtttatttcggtccagcgttttgctgttagagaatctacaaactattacgccagaaaatctcccccaatggttagaatccgctgcagcggaacaactaaccccccaaattgagattaagtcg

SEQ ID NO: 2773 - DNA, 496 bp, Triticum aestivum
  Clone ID: PAT_TA_2773
cttttgtggagaccacgggggaaacccctgggcaactgcgcctggcctatgctttttccctacctccctttatcagttcttctgagattcaaggggctgtggccaaggtgatcgccgtttgcgaaaatctagggcatcaattggaggaagcctgttttgatgtcactagtttaattgaaccctttgcccaaatttggaaagctggggtgggggcttccggcattcctttacccctgttggaatcggttaatcagtggttaggggaaaccagtggcactgcgggggactatctgcggggggtaaggaatatgcaggtgatttcccgccaaattgtcggctttatggaacagtatgacgccctaattttgcccgtttttaatcatcggcccccaaaaatcggggaatggacccatctatcgccccccgacgtggtgcaaaaaaatattgaatggattgccccctgcccccccgccaatgcggccggcctaccggcgat

SEQ ID NO: 2774 - DNA, 677 bp, Triticum aestivum
  Clone ID: PAT_TA_2774
ggaattgggagcgttttctaaccatgggagtgtaaaagccgaaaaacgacgcaacggaaatagttaattgactcaggtgaacaagatggccgagaaaagccagcaaggaaggtaatctaaggttattgtatccactagttcagggattgatgggcgcacaattcttaatatttttgaccattgttgctgatttccaggctgattgactgtggatttgtgtggccagttccagaacaggtggagtagttcaagggatagtggtcggttaactggggggcactatggggacatttacctatgaaaggcaagtttacctggcggacacgcacggagctggggtggtttatttcaaccaatttttgcaaatgtgccatgaagcctatgaaagttggctgtcatcagaacatttatccctacaaaatatcattagtgtcggggattttgccttgcccttagtccatgccagcattgattttttcgcccctgcccactgcggcgatcgcctgttggtgaacttgaccattacccaggctagtgcccatcgtttttgctgtgattatgagattagccaagccgagtctgcccaactgctggcccgggcccaaacccaccatgtctgcattgccctaccggaaaggaaaaaagcgcccttaccccaaccctggcaaacggcgatt

SEQ ID NO: 2775 - DNA, 631 bp, Triticum aestivum
  Clone ID: PAT_TA_2775
aagctcccttagctccttctgattaagcacttggtagtattcatcaagttctcgtccaacaaatattattcgtccccagtaatccttagaattgtgccagcgtttccagtactctgacactaatgccaggcgagtttggcggttttgtgaggtcaagatgccgatttgggcaatcccgaccacgactagtagtcctgtagcaattgcagtgattgtcgcgttgtccatttaaaattgggatagttagaaaatttgagccagacttaaggactacacagaaaatcttcagtctccccaatacagtgattgtgtctatgctttggagaagctttgtttcaagacgaaataaaatcctttcctggtaataaaatattctgcttcggtgatgataaggggtgaattaaatgaatagtcaaaattaaggtgagccataaaaggcccaccataattttacggcttacttagctcccactggcattcccaaaatatcctcaatcttgggcatttggtctaggggaatgactcggccgaagtcctcgaaattatcaatctcattgaaattaaggtagcggtaaagttcgccttcaaacggagcaactttttggagacgatcctctagagtcgacctgca

SEQ ID NO: 2776 - DNA, 593 bp, Triticum aestivum
  Clone ID: PAT_TA_2776
tgggggctccgggggggaaaactcccaggcttggggacggatttccctctagccttgggtttagccagtagtttctcttttgagcgctgacattgccccccagtcggcaataatgtatctgtcgttaaccttgtctttgccaggcccatgctgatttcccgtgcccctgtccgcattagtttttttggtgggggaaccgattatcctgagtattttctccagcatggtggtgcggttctagctacggcaatcgacaaattttcctacgttactgctagtccttttctgagtcatttatttgactattccattcgcgtttcctaccgcaaagtggaattggttaaaaatcctagcgaaatggagcacgtggtttttcgggaatgcttgaaattctgtggtttagaaaaagatattgagcttcataacgtggcggatttaccagcttttaccggtctggggtcttcctctgcttttacggtttccttgctccaggctctgcactcttttaaaggggaatttatccgtcctttggatttagcctatgaagccatttatgtcgaaaggcatttggtcaaagacaaggtgggttgtca

SEQ ID NO: 2777 - DNA, 630 bp, Triticum aestivum
  Clone ID: PAT_TA_2777
taataatcctagggacttagccaagttggcctcttgggaagattacctactttattacgaggcggaattgtcaccagcttgtgaacatatcttggttgataatactcttaataaagaaatcaagaaataaagaattctgatatgggcacaaatagcttaatctagggtcatagcaataaataacgaaaacaagaaaacacgaaatgaagataatcgccgtgactggctacaaggggggagttgggaaaaccatcacctcgattcacattgcccgttacttagccgacaagggaaaagtgttgctaatcgactctgaccctaaccgttcggtggagaaatgggccgcccgtggggaaaaacaacccttatttaaggtcaaaaatgaaaagtctgctccagcccatattgccgggaatgattttttggttttggacacccccgcccggcccgatagtaatgaactcaaagaaattagccaagaggcccatctaacaattctgccctgcgtgccggatgccattagtcttgaccccatgctccagatgtttcatgatttgttccccggtaccgtttaccgagttttgattacgattgcccctccttaccctagtaaatcagcagatgagttac

SEQ ID NO: 2778 - DNA, 437 bp, Triticum aestivum
  Clone ID: PAT_TA_2778
aaattgattagcctgtcgtgcttgagcgtagttgccaactccagttcttgggtttgttctttttcccttttgctatcccagaccattaatttcaccgcaaccttggcgatcgccccatcgtggccgactgtttttgacagaaacactgcgccgaacccaccaatcccaagcaaggtttcaagtaagtacttgtccttcaaatgggttccctctaagcttttccaggactgtaaaaacataaactctataatcaagttgggatcttggtaaaacaatgatagttccaccaactcaggaaaactgtaaagattaataaagttgtttagtattgaaattttattttgagtttggacctgtctgtcgtcattgactgtggcgatcgcctttttttgctgtagcctaagcaaaattacgacgtgggaagttataaagaagat

SEQ ID NO: 2779 - DNA, 581 bp, Triticum aestivum
  Clone ID: PAT_TA_2779
aatttagcagcatatgaaatcacagtaagtaatctggctgtaacagaccctgaaaatcccaacttctccattccatccggagagcaaagaagtaagggggttgaattcgatatcgcgggggaaatcctaccgggctggaatattattgcttcctatgcttataccgatgccagggtcaccaaggatgacaatctggagcctggtaatttgcttgagggggttccctttaactcggccagtttgtggtcaacttacgaaattcaagccggtgatttacagggtttgggatttggcctgggattgttttatgtgggggaacgccaaggtgatttaaataattcttttcaaataccgagctatctacgtactgatataagcgtattttaccgccgcaataactggagggccgccattaacgttaacaatcttttcaatatagattacatcgaagcgacccaacgccggactcgcgttgatcctgcggcgcccctaacggtaaggggaacaatttcggtggaattttaaacttttccgtaattttgtcaaaatcaaaacaacattttagaatgcacagatcctct

SEQ ID NO: 2780 - DNA, 679 bp, Triticum aestivum
  Clone ID: PAT_TA_2780
cggaaagggaagttggctttatggtgctagcgggagcaggggcagaaatcgataccagtaccgccaatggaagactattcttcgccgtgttcgccgccctagcggaatacgaggcagagttaatctcagaacggaccagagcaggactacaggcagcgagggcgaggggaaggatgggaggtagaccaaggaagatggatagggtaatgctccagatgttaatggaagcgatgaagaacccagaagcctgtgccaaggcagtagcccagaagctcaatatcagcaccgccaccctctactcctacgtcaatggggacggcaccccgaaagaagccggactaaggttattgagaaaagcccatggggaacagcaagaatcagagggaccccgataatctcattgtctgctccccttccccccgactgcaaagtagggatagggaaacatcgccctctgctctgaaagggagcattagcatttcacagggtatgggggaatagtgccagcatgatgagattaccctgtggagtatattcctctgctcaccccctcaaggctcaatctcgatgcgagggaagagagccctcatcaccttagcaaaggaactagttcctcttaagcttctgcgaagcttattctagtgtagtacaaacatggaaacggtggtaattttagtta

SEQ ID NO: 2781 - DNA, 642 bp, Triticum aestivum
  Clone ID: PAT_TA_2781
cccacgacattgatgaagccctcttcctggccgatcgccttgtgatgatgaccaatggcccccacgccaacattggcgaaattatgaccatacccttttctcgcccccgggaccgggacaggattatggaagaccccacctattaccagctacgtaactacgccctcgacttcctctataaccgctttgcccatgacgacgtggcttagaaagttatagccaagatactactcccaaattgtttaggctaattccctgctttttgggagaaattgattccaacagtgcgctaggagtagttcttgagacgaatagttgctcgtactacatccaagaactttccgggggaacatggggaacatatagttcatttaagggtatgctaatcggcgtaacacacttttgcggatgatatacggaaaagctctggcgatcagggaattattgctcttctatcattgtgggttaaactcacttcggtttgctggagccctacacttcccccaattccttgacttcaatttcgatgcggggcggggctggcacactgactaaatctgggtgccctgtcaacaaaaccgccgtttggggctcactccactgggttaaccaatggggttgaatgcccaaagcaatgatgac

SEQ ID NO: 2782 - DNA, 508 bp, Triticum aestivum
  Clone ID: PAT_TA_2782
tcattgctctgcgccaggatagtttgggggaagaccaactgcgaattttaagtttgtttaaacggagccaacaacgatggattactttgtttgggggaataattagtctgggtctattgtggctggtgtattactacgctccgatcgcctatccttgggtgacggatttgccccagattcgtttggcaggggttgggctagcggcgatcgcctatttgatggccaatttatttttgcaggtgcccctgagtgtgttgggggtgttatccacaagccagtccaagtttactgagacgattcccctagagccaaatcagatcgaacaacagttcaccattcccggcattaagttgcggcagattcccctggtgccaaggattagctcttgataacaaaggatttgcgctctctgctggggtagaatcggtaacgggcgatttttcctaggtttagccgatgttggccttgaccatggccgaggaaagaccaattatcccctgttgatcct

SEQ ID NO: 2783 - DNA, 474 bp, Triticum aestivum
  Clone ID: PAT_TA_2783
tacccggggatcagctatgatcaacagacaaaatcacaaaaagcgacgtttgagcaaaggttggattaataacaatactaaaccatcaaacaaaactaacacccccaatacctgggcgaaattcaaactgaaccaaggggcagtcaaaaccgtactatccaaaccccagttgccattcaggtaaatgtaacggattggttcgatggcataggttaatggatttaaactggccaccacctgcaaccaatgggccatgaagtccaaaggagcaagggcagtactggcgaagagtaggggtaaattagtgacaaaaattaccgcaatcaattcaatgtggcccggcagggcaaaggctaaacctaaacttagggccgttacccccaacacgattaggaaaaccctcagggcaatcattcccaaaccaaagctattgggtaaaccagctcccagcagagcactggccccgacaatcac

SEQ ID NO: 2784 - DNA, 743 bp, Triticum aestivum
  Clone ID: PAT_TA_2784
ttttgggacagaatcaagtctttactcaactttgccaaaacaagcctgcagataagattaatcaactgttacaagaccgctaccatggcattattcccccagaagaattacaagataaaatcactgctggagaaagggaggcattggcacaacaactaagtgaaggcggggaaatgaatttggatgccatccgaaccgaagggtcaggggcagaactagatgctaaacttaaccagattgtcgccattggtggggaaaatttagacggaagtggtagtggtactttaaatttcagtagtccctatgtttttggcggtggattagtcggcttgctggtgttggtatggtgcctgcaatctctgaatacttggtcaaatttacgggaaaaattgatggggcaagagggagtctattatcaaattttagaaaagtttggcaaagctaaacctaaggtttctgaaagtgatttatttctctataacaaagctttggtggagttagaaaagcaggctaaaaaagctatcagtattgacaacgacaaatttagcagtaatgaatttcttgtttttgctaaaatccgctattcattcaacaatgatgtaggggattaccaaggcttaaaaacttacttacaaactttacaatccgctattaaagctcaggctagcaatttaactttggggcaggtggaaagcagttgtaggggaaagaaacagcaacagttttatgatttttgccatcaa

SEQ ID NO: 2785 - DNA, 1440 bp, Triticum aestivum
  Clone ID: PAT_TA_2785
gttcgaacaaccatcttggaaaggaggccagtaactttggttgcaaaggcaatggatatcattcttgattcatactctcgttcgatgaaaatggtaggcggtgctgctggggttaggaggacgtctgagcaaaaccaacagtcaagttttcagcctgttgaggactcccgtgtggtttctcaggaacctccggacgcgtgggttggacctgttattaacactgattcagcaagtggggttgagagtagacagtcacagtcaaattcaggagttgagcatggaattgctaacctggcagcacatgtagataggtcatctttaaacacatcctctgattctgacggtattaccaatacatcgagagcggtaagtcaggcaacatcaagttcccagatatctgacgccactggcaaaagaccgcaggttgtaggagaggatagccaaccattggcttctggtacatcaatgcagcatggaacacatgttgctagtgtggcaatttcaccaattgaaatggtccagtccgtctttgtgcttgttgaagatgaaatgatgggtgatcctgcataccttattgctgtcatcatggagtttttacgaagcctgtcaaaagctgggctgaaggctcctcctgacctttatgtcatgatgactgctttgctggcctgcagcaaccgttatgctgaaatagcactgtttgtatcgaacaagattctagagccgtccagggaactcgcaatgcagctcattgatctgggtcgacatcattcgctgacaaggaagctgggagtggacatgctccgggagaggtgcctgcaccatgactacgtggctgcattactccaagacgggtactacctggaggctctacgctatgctcgaaaatacaaggttatcaccgtgcagccttccctgttcttggaggaagccgtggccaagaacatcacgccgaaccttgccgctgtgctgagcttttttgctgagctcacgccgagtttcaagacgacgtcggactatagcagatatcggcacatactgtcggaaatggtctgaactatgcatcgttattccgcgggacggttctctttttgatgctcttgaggtttggaggaagcgtgtaataattgatgactttgttcaccctgtttaaaagatttctatgcttgtactccgaagtcatcgttaatggtctcggttgctttgagtggatttgctgatttggcttggctttggtagctcgcctaaaaattggttataaaatacaagagctgacaacgagtcaatttcgagcagacctgaaaagtttggtataaaatacataatatatcacgatgcatattttcatattgtatatagttggtattgtagatataaataattttctttagactttgtcaaagtttgtaagtttgatttctcaaaaaatctaggtgtttggct

SEQ ID NO: 2786 - DNA, 500 bp, Triticum aestivum
  unsure (1)..(500): unsure at all n locations
  Clone ID: PAT_TA_2786
ttgcgtgtcgcgtggggcctcctccctggcctggttctggttgaacaagctccttccttgttcgagtctcaagcacattagttcaaggaggaattatgaagctcagctaccaccaacaccgacaccatcaattcatctcctttccttgacctgatcgcctcctaccacatgcacattgtagacctacatattccggtcctgggagaggtggcgacaccagtctgagctgggggaagccagccacgcctcactggcgtgttctgaccagcgctagcaccaggcttgaccagtccgctcagaaatcaacaagaacagcctaccttcttcatcttcttcttcttcttcttagcaggattttgctatttgtttttggctttggtccanaagaatggagcgggccgagtgaagcgggcatcgattctactgaattagaaatcagctggatcgagggagggaattaagagcttcaacttgtcaccaatggaggccatgactgcaaa

SEQ ID NO: 2787 - DNA, 1010 bp, Triticum aestivum
  Clone ID: PAT_TA_2787
acacgaaccgacgaagagggaggggcgggcggagaagagagaaagtcgccggctcgccgccgccgtcgtcgtcggcgagtcggtggtcgccgccctccgctcccgatcgagggcctgcttcgttcgtaccgccgcactttggttcgttggcctcttcagtctacaagaactcagacagctcgccgcccacccacctaccatgtggtgcgagttccttggcggcgtaattgaaacctccaggcggcaggtggtgtgagaggtccttcctcaatgcagcctccgcatctgctggtgagtcctgcttggtggacttcgtcgtgctgagattgggcgcttgtttcttggtttcaagaactaggttgaagttgaaccctgcgtggccgtggctagtccgggctggatcatggagcaaccagggcagatcgcttttgctcaagcctgatcagtagtgattgttctccagtgagcatgtcctcgcctagcaagactttgatgatgagagggaagaaagcaaaggtagtggaggggaatgctcagctgctctgcagtgatgcgctcaccgaggtcttccacaggctgcctgcccgcaccctcgcttcttgcaggatggtatgcaaatcctggatgtcattgctttccgatgtgcattttgttcacgagcacctgaaccgaagccagcagaagttgctgctctttgcaaatgacagagcaaatgataggtctcttgccatggtgctcgcagacgccaatggatacatgtaccagctgtctaggcccttggttgctcagaccctgtttgtgcacaactcttgcaacggcctgctctgcctaggtgacagtaaaggagcagtggagttgctcaacccgacaaccggtgaatctcttgtgttgccgaagccaatgtacactgcaggaagcagccaattctcatcatgcaactggcactgcttggggttttgcccgtcaactaagcaacacaagattgcacatttttacccgggagctcatgc

SEQ ID NO: 2788 - DNA, 416 bp, Triticum aestivum
  Clone ID: PAT_TA_2788
tctcgttcgcacccatcgtcacctctcttgcagcttcaaactttcagcgccagtaccaacctgctgcacattcttatacctttgagttagcttacaggaggttgcactgcgggcaggcggtcagggtgatcgatgatgatgaaggttagcccaagggtcagcgttcacgtttgcttgtgcagcactagacatgggaaggagtgcccccattacaacaataaaagaggggacagcgccacagccgattcaccagagaaaatgaagccggagcaggccgcccacaacaagatgaccacggcgacgtcctccccgtcccctgtcgtcggcctgcggggcgtggtgagctccctcgtcgccttcttcatcgtcgtcagcaccgtctccctgctcttcgaccgcggccacgagtcgcaggt

SEQ ID NO: 2789 - DNA, 657 bp, Triticum aestivum
  Clone ID: PAT_TA_2789
ttgcccacgcgtccgtttcactgcaaagaccaaaggatcttatggtgttgacactggcaacctattctttgctgaagtcgcatatacgcgaggagaggttggattaacggtgaacagttgctgtatacttgaaccttcttctgatcatggcctctgctatggttgttgtggtgatgtgaagcaccccaacgatggtaatgcatatgcttgtggtcggcggaacatatcgtattgttttcagaacggtgcacctgatctacctctggactatttcgtggaccgctattacgaggactctgatgaagaggtggaaagactgagatctcagttcaaggaggttgttaaggaggaactcaagccactgccgatgcccctcgtggtttaactgctcgaagccaaacttagaagggttctggcaaataaaagaaaatattgttgccatgagctgcagaaattatctcctccatgggttgaagagaaggcggctttgcatgagggagctagctgcaacgttaaattattagatgatgaaactgcaaacttgttgttttatcgcagtggagaacttttttggtgttttatcatttgtgccactgacctagtgcatatctctctctaataatcacagtcgtcggttgcgtgctaacaaaaaaaaaa

SEQ ID NO: 2790 - DNA, 1562 bp, Triticum aestivum
  unsure (1)..(1562): unsure at all n locations
  Clone ID: PAT_TA_2790
tagcgtggtcgcggccgaggtggcaaacaacagaactggagtgagacatgatggcaacattctcaccactggtggtgatgacggagtagttgcagtatggagatttgtgaaggatggcattcgtcgtctcctgaggatggagaaagccctgtgtgcccacactgccaaaataacatgcatctatgtcagccagccttactcgttaatagtctcaggctctgacgattgttccgtcatattgtgggacctgacaggcctggtctttgtgaagcagctgcctaggttcccagcgtcagtgtctgcattacatgtgaacaacctcaatggtgagattctgactggtgctggtgttctttttgccgtttggagcgtcaacggagactgtcttgctgtggtgaacacctctcagcttccttctgatctcatcttatctgtggcaagcacgacacactcagactggcaggatacaaactggtatgtgacaggccatcaaagtggtgctgtgaaggtatggaagatggtgcactgcacgtctgatgaggcagcaaacaacaaaaacaaatccccaacaaccacctatggagggccgggtctggatgtccagacgctggaatacaggctaattcttcaaaaggttctcaaatcacacaagcacccggtgactgccctttgtataccgcccgacctgaagcagcttctgagcggggatgccgttggtcgggtgccttcttggtcactgaaagatgacagcttcaagggctcatagcgatagagaaatcaggattcacctgcacatatcaaagacattgatttaaagtatatctggtaatctgacaagcatctgcccgtgttgacaaccaagagcacagggttgaccttggctcgcagaaacgtgctgcatgaggacccgtcttgacgcccaggccattcggcatcggaggacaggcaaacaacagaaacacatttgaaatggggaagaagtggatgagacaatggaggcgtcgttgtgctgacaatagaatcttctatactgtgcattatgtgctggctccacctcctgctcttggttttgttttggtcaggagaaagagtttcatgtgaggtagagaggccagtgttttgtaaagtgtgtatagatgctttggtggtggtggtagtggttgtggtggaacgatggtgtgatgttgtactgtctatggttttgtttcgggggatggatgtaagggaaaggaaagggggtgttaggttcctttttgctgtttcaacttgacccctcagaagtggtgttgttcattcatttagtgggtgtaatttgagcacccttctgttcactccgccagagttgagttcattgcacatactccctcccttccagttcactcgtcgtggttttagttcaaaaaaaaaaaaaaaaaactcgagactagttcctggtgccgaattcctgcagcccgggggatccactagttctagagcggccgccaccgcggtggagctccagcttttgttccctttagtagggttggntcaatcnanagatctntnnnctnncttnnnnnnnc

SEQ ID NO: 2791 - DNA, 1001 bp, Triticum aestivum
  Clone ID: PAT_TA_2791
ccgctctctccacacgacccgcgacccgcaccgcacagcgtccatcccgcccgatccccaccgccgcgcgcgccacacaccacaccaccgccccgaccgatggcccccgccgccgcctcgcagacaccagggcgaccaccgtggcgccgacgagcggccgtaaggtggtcggacgaggtgtccggctggctggcgcgtgatggcacgaccgcagcatccaccgcacctccacgggcccgccgacgggccctgccgctcatgcagccggtgcagccctaccccgtcccccggcgacggccacccgcgccaccacctgccccggggcccgccgcccagcctccgggtgtacctcccggaggtcgacccgcgtcgcccccccgccccccggtcagcgtcaagccccctacgcgcgccttgcccgtgccctccccgccgtgggcgctgtaccaccacttctacgcgcgcctcgcgtccgccttcccggccgtcgtggtccccgcgtcgccgtgctccgcccgctgcggtccaccgccttgtccgacgaaggctctctcggcggtcccgcggccgagctcctccgcgacgccgcccgcatatccctcgcgtgccgcccccgcggccgctccggcgccgccctgcaccccctcgtggccccgcgggtccgcgtcgggcacacccccggcgcctgcccccccctccgcgtcgccgcgcgccgtcccgaggccgccccgggcgcctgggcgcccctccccggagcaagtcggagctgcaggacacccgcggacccggtgttcttcacgctgggacatgctggacaagtcactggccatggcgctgcccgaagggcgccaccaatggacaacccgtacacctgcccgatgggcccgaacgcgccgccgctggaccccttccctcccccgatggggccggccgccctcgcggagaaggacctcatccgcgacaccaacctcgagtactgcgaagcactgcgcgccgccggc

SEQ ID NO: 2792 - DNA, 1561 bp, Triticum aestivum
  unsure (1)..(1561): unsure at all n locations
  Clone ID: PAT_TA_2792
caacatccaaaaagttactgcaaatgttaaagaaaaaatgtctgctgctacagaagaggtgaaggaaagctttggactangaaaggaagaaacttcaagcttcagagatggttcacatggaacttcaaatcacgggaaaactgaggcgtcctcacactcagatgacaagtcccaagatgtcacaagtgcctatatgttgtttgataaattaaggtcaacattttcatcagcttcaccagttgtgtctggtgcatttgcaaaattgaaggacacaagagtctcaactttagctaagcagggatatgaaattgtcaaagatgaactaagctctagctctagcagaaaaaagaaaaaccatattaggcaagcttattctgcagctgtagagaagagtacaagaactgatatagttattgtaccaacaaagaagtcagtggtgggtgaaaaatgggaagcaatcaagaataagatgcgaggtcatccagtctataagagggtgaacgagtacaccaaacctgtcgtaacaaaggtgaacgagtacaccaaacctgtcgtaacaaagggacaagaggtagctgaggatgtccgagaacgatgggagacaagtgaccatccagtagttcagaaaattcaagatattaatgaaactatttttgaagagaccgctactgcagcatctttcagggaaattcggcgacgtgacccatccttttcattatccgattttattggtgatgttcaagaaatgatcaagcctgttcttaccgcatattcaaagggtgatctgaagactttaaaaaagtactgcaccaaggaaatacttgaacgatgcgaaggagagaggaaaggatatgcatcacaaggcatgttttttgatcacaagattcttcacatatctgatgctgacgtaagggaaacaaagatgttgggatcagcacccatcattctcgtgatgttccgaacacaggagattcattgtattcgtgataaagaaggacaagtaacagaaggaggacaggattccattcgcaccgtctactatcaatgggcaatgcaactcatggacagcgatgagttgccagaagaagaatcatactatgcagtttggcggttgcgtgagatgcatcagcttggtgtcaaggcccttatatagagtagctcttcgctctttcttcgttcagattagccactgccactggtgcgttgccgttcggaatggaagaacctaaatgttccaaggctcaccgctcgacaaactatgcaggcaattttccataagttgtttctctagttttaaatactaatgacagccagtctccctgcttcctgccccattttgttttgtgatgtgtatctaatgtgtacgacattcgtaaaatcagctcccccttttagcaagttggccgagaacggctgtagtgctcagattgttcttgttctgagttggagaagctcgaggcaccaaacaaaaatgctgtttactcttttcgctggcaaacaatgttgccggtgagcaataatttttgaagggagggaaccaaaaaaaaaaaaaaaaaaaaaa

SEQ ID NO: 2793 - DNA, 1029 bp, Triticum aestivum
  unsure (1)..(1029): unsure at all n locations
  Clone ID: PAT_TA_2793
tgtcggcgccccgcgccccgccacccccccctccctccggctgtggctcaagcccgacggggcctgtcccctacgcacgggcccgtcggccgcctgggccgcatcctccggtgccgctcgtcgcccggcccgcaggcccgcccggccctcgtgcgccacccggcccccccgacgctgtccgtcacctcctacacctgcttcttcggcgtcatccagttcctcatcatcgccgccttcttcgagagggatgccggccgcatgggtgcttccactccggcttccgaacgtcttctaccaatcctctgacgccgggtttcatcgcgtccggcgtggcgttcgcagtgcagatctggtgcatcgaccgcgggggcccggtgttcgtggccgtgtaccagcccgtgcagacgctcgtcgtcgccatcatggcctccctcaccctcggcgagaagttctacctcggcgggatcatcggcgccgcgctcatcatcaccggcctctacctcgtgctctggggcaagagcgaggagaggtcgcgcatcggcaaggaggccgcggtcatggccgccgcgtccgcaggttcctccggcggcggcgagcgcgaggtccggagcgccaagctcgcctcctccatcacccagcctctcctgccgccttcctccaccacctccgacaatgtctgaaacttaattgctactgtaccttgctactgtcgcttctcaacgatcgactgagaggaattttcttgtttaaatttcaggcgggcatgcattgcatgcacgcctatggtgtggtgagcgagtatgcagacggatttgattgtgaaaactagctaggattgtttgggtcgtgcttgattatggtgtgtgcattaaggcttgtcaattactgtagtactagatcagaaagcttgtgtttgatgtattggtaccctatctaattattactatcacaaaagaaagacgactaattgaatatggatacccttaagttcaaacgttttggcatcaattattaattatttncaaccaa

SEQ ID NO: 2794 - DNA, 904 bp, Triticum aestivum
  Clone ID: PAT_TA_2794
gacccacgcgtgcgcgtatagaactcataattgatgaagtgcaagacgtgcagctatggagctgcatactatagactcagcagttcctgaggagcctgaacgacagggatctaaaccagaatcatgatattcaccccggcaggacaacacactagtgaggcccgaaagtttagatcaaccgcatggtaagccgcacgataccagtgccggagccgctccctatgaattgcctgctcctgatcagcctgagatgaaagagagagagagagaagcagaaccgccagtttcatcccgccaggacaacacagaagcaagccccgaaagtttagatgaaccgcattgtcagttagaggacacctgttctggagccgctaccccccaactgcctgttcctgagctgggacgcatggatatagactcgtgcgaagcagaagcaaccattatacctgacattaacataccacttgaattgcctgctccttatcagcctgagatgaaaccagatgagtgtgaagcagaactgccggtttcatcccgccaggacaacacagaggcaagccccaaaagtttagatgaaccgcattgtcagtcagaggacacctgtactggagccgctaccccccaaccgcctgtgcctgagctgggacgcatggacatagactcgtgcgaagcagacgcaaccgttatacctgacattaacataccactggagagcgtagaaccagataactagatagactctgaagtttgatatatgctgcctgtcctatattttttgctgtgtataggctagtcatatcttcttcccttctcatctacggagtatatcgccaaaaggataactagtataaatgcagcgttattatttgtgtagataggtagatattttgatggctgtggtggg

SEQ ID NO: 2795 - DNA, 955 bp, Triticum aestivum
  Clone ID: PAT_TA_2795
gcattggtcgaatccacggtcatatttatcttcctccttgcctacacttttgttttaccacacgctctttttctgcacgagttatcaggtgttgctcctttgaagatggctaatttctgcagcagtcgaaatgaaacataatctttcagttgttaggtctcgcattcgtcagctccgggccggggccccccgccttggccgccccccccgcatccgggcggcgcggggtcaaaagtcagtaacttcaaggaatcaggaagaacccatcagagcctgtatgaactatgtgggtaatcattctctatgttccgccacggaagctaaagtcagtgacaggagcgaacagccgaaagctaagatatctgtgacatttgttgataaggatggcgatgaaacggttatcaatgttcctattgggatgtcaatgctggaagctgctcatgagaatgacatagaacttgaaggagcatgtgagggctctcttgcatgttctacctgtcatgtgattgtaacggacgtagactactataacaaattggaagatcctgaagatgaggaaaacgatatgctggaccttgcttttggccttacagaaacatctcgccttggttgccaagtaattgcaagccctgaacttgatggcataagattagcactgccagcagctaccagaaattttgctgttgatgggcatgtcccaaaaccacactgactaagcactgggtatgttgcatacctgctcagttttgcagaatatgagatgtagttacttttatttttcatcttgttgtatctgtatcctcaacatttaaattctgtagtccttggcaagatagcgattaatgtcaacttgcttcgtcaaataacacttgtaaaatccattggaaaatgcattgtcattgcaatgctagcaaccttgcacttgcaaaatctacaaaaaaaaaaaaaaaaaaaa

SEQ ID NO: 2796 - DNA, 441 bp, Triticum aestivum
  Clone ID: PAT_TA_2796
cacacaaacacatacacacagagagagtatggcgccgaggcaggtagggatagtgaagtcgttcaacgatgaaaagggcttcggtctcatcacccccgctggcggcggcgcggatctgtttgtgcacttccgcaacatccaagcctccggcttcaaatccctcaaggagggccagcaggtcacgttcgtcgccgtccaaggccagaaaggcatgcaagccaatgaagtcatcactgaggagtaattaagtaatcttccggcgcccgcttctatctcgtttattctggatctcacactctgtaacacgtactacgtccggtctgcttgttgtccaataattgtgtggggctgaacaaccatgtatgcacttttgtcatgttgactttcaactttgggtcatcaactattgtgttacaatactaaaagggggggaaaaaaaaa

SEQ ID NO: 2797 - DNA, 652 bp, Triticum aestivum
  Clone ID: PAT_TA_2797
gagcaccacgaggtggtcttgcactgtgacttgaagccaagcaatgtgttgtttgatgaggacatgaccgcgcatgtagcagatttcggcattgcaaggttgctactaggtgatgaaacctctgtgatctctgcgaccatgcctgggacagttgggtacatggcaccagaggttggatcgcttcggaaagcatcacgaaagacggatgtgttcagctacggcatcatactccttgaagtcttcactagaaggagacccacagatgcaatttttgttgggaatctaacattgagacaatgggtttttgagacattccccgctgaccttgttcatgctgtggatggcgatctactgcgaggaccttcttctagccgccatttggaagtctttctggtgccaatattcgagttgggtttgctctgctcctgtgactctccagaccaaaggataacgatgacggatgtggtcgtgaagctgaagaagatcaaagtggagtataccaaatggagtgcaacccaatgattgatctttttcttttctatatgtggctgtctttttcttcttcagtgccgagaacaacatcagctgttacacagtacctgccccggcggcccgttgaatgcctcttatgaaagacttctatccataaacc

SEQ ID NO: 2798 - DNA, 666 bp, Triticum aestivum
  unsure (1)..(666): unsure at all n locations
  Clone ID: PAT_TA_2798
ntacaagatcaacgcctaaaagggtgcctgcatcggagttgagttggatacctgaagctcgaggattagggtgccgacacaacgtcgccagccgcaggcaggagctcagccccacatccttgctcaagtgcttccgagcgagaaagactgcgaggagttggacgtgcaatggcctagcggagtcgtccgcgccgcgacgccgccggtatggaggcccaggctcgggtttaactcaccaagctttagtgcttatttggtaataatcctgggttctgaccacgtcagtagcgtcccctcgtcgtcgacggcggctcagggaaatcgaggaaggaggcgagtccgtcccacggcgtcgctgtcggggagcactaagggagctccctgtcttggcttgcagcaagtatgttcagcacgccgcctccagccacaagcatcgccgggaggaggacaaatcaatctcattccccccttcttcgcgacgcagatagatcacacttattcaacaagtatgtccgatttgttgttcacaaattaaacattaaggcaattaggatctggatctttgagatgtttagctttacatgttcattagggatttgttgttgctgaaagggagcaaaatagagggaatatctnccnccaaaaaaagtttacatactgagctgt

SEQ ID NO: 2799 - DNA, 630 bp, Triticum aestivum
  unsure (1)..(630): unsure at all n locations
  Clone ID: PAT_TA_2799
ctgcggcggcagcgtactcgtggcctgagctccgcttcgatctcccgccgcgccgccggtaccacttcgccgaccagttccgctccccttgctcctcctcctccgccggtaacttcctcaagggcgcccgggggtcgcccgacggctcctccttcctcaccagctccgacgacaactccctccgcatgtcctacctgccggaggacgcgtacagtgctgcggcggagcacaccgcagaggccgccgtcggaggccaagactcctatggcgcaagcctccaaggtgaacgagggcgagcccgtgtacgacttctgctggtacccctacatgtccgtgtctgatccggccacctgtgtgtttgctagcaccagtcgcgatcatccgatacacctctgggacgccaccaccggcgagcttcgatgcacttacagagcatacgacgccatggatgagataacggctgcactttcaatatcgttaaattctacaggttccaagcttttggctggatacaacaaagcatccagtgtggttgctgcgctgcggcctggtggggatttcgtgctatacgcgttgcgcaacgggggtgacgggccccctcgcccnaaanggatcccattggcctaacaa

SEQ ID NO: 2800 - DNA, 965 bp, Triticum aestivum
  Clone ID: PAT_TA_2800
cggcacgagggcccctcgccctcgcgctctcgccccacggcgccctcacccgcccccacccccagcccccgggccccgcctccgcgccgcgcgttcccgagtgcgctcgccgcattccgatcccgccggccaattggttccgcgccggcgcgggggcgatggtgtcgggcgggtgcgtggggacggaagggggcgcggagccggaggagtccgcggcggtagcggcggaggagcaggtgatgccggcgacggcgcccgcgcgcgccagggagctggtggtcgggtacgcgctcacgtccaagaaggccaagagcttcctccagcccaagctccggggtctcgccaggaagaaaggcattcaatttgttgcaattgatcaaaagcttccactgtcagatcaaggcccttttgatgttattctgcataagttgactggaaaggagtggcaacgacggttggaggaatatagagagacacacccagaaattactgttcttgacccaccaggtgccatagaacatttgctgaaccgccaatctatgcttcaagaagtttctaaactggaccttgcggattgtcatggtaaagttggtgttccgaagcagctttttgttaacacagacccattgtcaataccagctgcggttatgagggctgggctatcgcttccattagtggcgaagcctctggtggcgaagtctcatgagttgtctcttgcttatgacgcagcttccttgacgaagcttgagcctccgttggttcttcaggaatttgttaaccatggcggcgtcctatttaaggcctacattgttggggatgcaattagggtaggccggtcctctcctctcccgttcggggttgggcgtgtcctcccggtgtacgccggagtgttccggtttccgagggtctcttgtgctgcagccactgcggaggatgcagatcttgacccccatgttgctgaactg

SEQ ID NO: 2801 - DNA, 1931 bp, Triticum aestivum
  Clone ID: PAT_TA_2801
cggacgcgtgggaaacaaggggtatttgtaaaccttattggaagaaaggtgagtagatatatccagtaccctgtggttttttctctggctgtgtagtatactcaaaagaagcggcaagaatacctacgcgcggtacggaagagctgtcgcccccccccctccgaagccccccgagtgcgccccaccggcacccgaacaatggcggcgtgcaacggcctgtttgtgtaccacatcctcggcctggcctccctggtggccgtgttctacttctccctcctcggtgaggtggacctccgcttccccggcctcctcccgtcccccggcgcgtcccagttctcccacgacgcgtccgtgccggtcgtggagcggggcggcgcgcagctcttcctggggggccggccattctacatcaacgggtggaactcgccctccctcgtggaccagggggaggacgcggccatccttcaccacgtgccgccccggctccatccgcacctccggaagggccgcccggtgttccgcatccgggcaccttcacccggccacctggacgctgcacgcgattctgccagagaacctcgagttccggacgtagtgggcgcggtcccaggtcgtggtcggcgccagggagctcggcggccggctcgtggtgctcccggcgatcagcctgtagcctttcggcgagaagacgcagagcgggcgctgcgcgtgggctgcaagaagtcggtgtacggcctcgtccacgactcggccaagaggggcggcgccggcgccggcgcgatagtgtggcagctcgccgccgaggacatggaggagtacctcggccgcgtcgccgccatgcccagcgagacgccgtccatgcagaagctgctgacggagcagtcgtgcaggctggccgcgctgaggcacggggagcaggaggccaagaggatcctcaaggcggtgtgcggctgacccgtgatctctcctgcgaggtgtggttttttgcgggtgcctgtcaaggacgaccctaccatcttggcgtgggagctgatgaacgagcccagatgcatcaccgatccgtccggtaacactctgcagcgctggatcgaagagatggccgggtacgtgaagtcgatcgacggtgggcatctgctgaccgtcggcaccgaggggttctacggcccgacgagcccaccggagaagctcagcgtgaatccggggcactggttcaacaactacggcctcgacttcatccgcaactccaagatctctgacatcgacttcgcctccgtccacctttacccggacacctggctgctgcacgcgaatttggaagagaagctcaagttcgtgacgcagtgggtgagctcccacttcgaggacggcgacacggagctcggcggcaagcccgtggtgctcacggagttcgggctgtcgcatttggtcaagggcttcgagcagtcgcagcgcgacgccttctacaagtcggtgtacgacatcgtccacgcgtcggccaagaggggcggcgccggcgccggcgcgatagtgtggcagctcgccgccgaggacatggaggagtaccacgacggcttcgccatcgtgcccagcgagacgccgtcgatgcagaagctgctgacggagcagtcgtgccggctggccgcgctgaggcacggggaggaggaggccaagaggatcctcaaggcggtgtgcggctgacccgtgatctgtcttgcgaggtgtggcttttttgcgtgctcatgtcatgtactgttactgtgtgtccgtaggaaatcgacacgaaatggaccgaagggatccatgaaaggtggcgtgctcggcgccgacgtcggcagatctgcctctgtattttccttgctgtgttgttgtactcgtacgtgcccttgacctttggtgtttaagtcattgtcgagtggcagcggaggctagtt

SEQ ID NO: 2802 - DNA, 744 bp, Triticum aestivum
  Clone ID: PAT_TA_2802
tcgaccccgcgtccgaaaccccattctccacccccagagcgaaacccgccgagccctgcgatccgtcgggacagcccccgctcccggcggcctctcccccccagacgatctttgcgttgccaccataggcaacctttcctcctccggccgccaggccgccgccgccgccgccgcgatggccgacccggcgcctcccgccccggcgcgcggcgacttcacgcggtcggtgaagctcaagtacgtgaagctcgggtaccactacctgatcacgcacggcgcgtacctggcggtggcgccgctgccggggctcgtggcggcgcacctctccaccttcacgctgcacgacctggccgacctctggcaaggcgtcctccaccacagcctcggctccctgctcgcctgcctcgccttcctcgtggccgcctgcaccgcctacctcgtcacccgcccgcgccccgtctacctcgtcgacttcgcctgctacaagcccgacgacgcgcgcaagtgcagccgcgcccgcttcatggactgcaccgagaagctcggcaccttcaccgacgacaacgtcgagttccagcgccgcatcgtggagcgctccgggctgggcgaggagacgtacctccccgaggccgtgctcaacctcccgcctaacccctccatggccaacgcgcgcaaagaggccgagctggtcatgttcggcgcgctggaccagctgttcgccaagacgggcgtcaagcccaagga

SEQ ID NO: 2803 - DNA, 1664 bp, Triticum aestivum
  unsure (1)..(1664): unsure at all n locations
  Clone ID: PAT_TA_2803
ttcgggcaagacattcccctcctcgaaatcgaaaagaaaagagaacggcggcggcgggtggcggcggaaagacgaggagcagagagccgtctcctgagatggaaggagaggcggagctggaagcggaggcgaagggaaagagaggcggcggaaaggtgaggatcatcgaggcaccacccaggatctccatggaggctgtgaatggagccatggggagcgacgagttgccggagaggatttccacttcagaagatacagaattagagattgagcaagccaaggagatgggagaggaagccgaggagagggatgaggtggcaaaattggagattgaggaagctgaggggatggaggagaagatgcagactgggatgttctttaatatctactgtcgcgccttggaatcgaatttgtccaggttggtcagcagtccctgcaaagatgcgacttcattgagtcctatgcacttcacacacagtacaacgaaccgcacctcttatgctgaattcgccaccagcactctgcaaatatactccattaaagtcacagaaataaagggcactcctgagttgaagtggccactgcgtgtgtatggcatggttgctgcccgagnataccgtggatcacaatcgcaacattctcttcttgcgtcaaaggaatgactgccagatactcactccagagaatccttttttgcaattgactggcccgtctcgtgcaattgcggctatagatcctgttgactttgacattaaactcaaagtaaagggcaggatgaagtcaaaagatagagtgctcatgcatcagacctccaagtacagctgtaatgaggccattctgttggatgactcatgcagaattgtgttacggtgtgcgaaactggagaagacagtgcaagcaactatagtcggtgtccgtgttattaattggagaaagaagaaatggccttttagacatggtggtctagttattgccaaggcacattctaagcccgtaaaacctgagaatgaggccctgctacaagatcaagtgatggatgacatttcagatggttactttgaaggtgaagttagttgtgttggcgacagatcttcagcgctgaaacatgaagatgaggttgtgcttcaagatcaagtgacagctaacaattgggatggttgccttgatctgtcaaggcatgttgtttccgtagagttagatggaaagctcgaagtcatcatccgtgccctgtcttcaaatggttttattactaaacatggccatgtcttcttcccagcccaggaaagcaaaataagtcggggcatatgtgatcttgcctcctataaggtggaagtcactgttgcttggtcccttcttgttcgagacaagcagtttatctcgagggagggatgtatggatgatgactaggcgtgaactttatataaattaaatacagttagccatttaaagctgtcaactctatccattgtcttaacggctttatatctaatgctatgttaaactattagtgtatttgctgtcagtgatttcactgagattgtctactacacccttcgtttttaaatataagagttttggcattctaatttatactgccaaaatgtcttacattcatgaacggaggtaatgttttgtattgactgcaaaatgtaggtttgactttt

SEQ ID NO: 2804 - DNA, 1188 bp, Triticum aestivum
  Clone ID: PAT_TA_2804
ctctcccgcctgctcctcctcaaccccctcctgtcggaccagccgctggcgcccccccgccgcggccgcccccgcggccgcggggggtccccccggccgcccggcctccggcgacaggccgtccggggtgcgcgcgctcggcgctcgcttctccctcctcaagcgccggcgaaacacgaccgccgccgcggccggggggattcaggcgagcggcgcatcgtacgtcgttaggtggtcttgggagcacgcagacggcgacggacgcgcacctccccgacgcctccacttccctggccccgtcgtcctgtctaagtcgccggcggcgtggacgcagcgatgctgcggacggtgctgcgccggggagaggcggctatgaggcaggccgcgctggccgagggatctacggggaaccttctacggctgagcgtggcggagcgggagcgctcccggcggcgtcggcgcgacccggggcgcgacgagttcttcgtgccgacgccggagtcgcttaaatggctcgactccgtcaccctgcccatgatcctcaccgccgccgccgtcgccctcttcaccaagctcctcatgatggaacatgaagacacagaccaagaaaggagagaacgcaagataaagaatagtcaccctgagcaaggaacagtaaggatgctttcacgtgaagagtgggatgaaatccaagaagtcaggccaaggaccccttttgaatcaaagttagctcgtccacatgcccgcttaagaactggggaaagagtgcggctggaggatgccaaggattgggctgttgatgtgctcactgatgcttttactagagcggaagagagtgctaagcggaaatgattcagaagaaaggcacagcagccaacacatccagtttgaagtttttctttagaggaaacactttgggggttttcttgaatgcgcatttcatggtttcttttgaagtttgagttgccgactcctcataaatgctaacttgcgcggtgaactatggtagccgcatagaataaattttccttgctactgtgtatatacatactcctacatacggttccttgctatgctcgtatcgtttgtttgaatgcaaactacagcagtcgtggattataagtgaagggagggaggggctgtatactttcaacagttacgtttaaaaaaaagtcgacgcggccgcga

SEQ ID NO: 2805 - DNA, 666 bp, Triticum aestivum
  Clone ID: PAT_TA_2805
tcagcttattagcactaccacagccagcagcgcccccaccatcctccagttcattcctctttccagacctgctgcaggtagtttgccaagaacaaggcaagcaaagcctaccgatcgatcgatcgatcggaaccgatctcatgcggcagctctgcccatccatctgagatcgattgatcgatcgccaggtgtgtatacccgttaattttcatggggagcgacggcaagttgggttcgggctccgccgccgtctgctgcatgtgcggcgaccatggcctgctgccggagctgttccgctgcgacgcctgctccgtccgctcccagcacacgtactgcacggattggtaccccaaggcggaggcgtacggcacatgcaactggtgcctgagggcagggcaaaggaagcggcgacggcggcgggcgccgttcctagcccggtgataatccaccttcaaagtgccccgggccggcctgtgccggccgctgaccccatgggggtcccgcctggctgcggcgccggcgcatcgatgccgggggccggcgcggcgcgccgcgacttcaccgcggagctgaacaagcctatcaagaagcagcaacagcggcggcggctcctgctgcagcggtcggcgtctgacctgagcagtggcgtccgtgccaaccgcggcg

SEQ ID NO: 2806 - DNA, 1169 bp, Triticum aestivum
  Clone ID: PAT_TA_2806
ggcccccggtcgctcgaatcgcccgtccagcacagcgagtgggcgcccagtccatcgcccgcgccgtggccccctccaccttccaaccgctctccgccgccggccccctcgccacagaggcctccgccgccgcggcccccccccccacccccctcctcgccctgccgcccctgcccaccaccacccgccgcctcccgctcccactgccccgccccgcccgccccctcttctctcccccgcccctccgacccgcgctgtcggcggctcgtgccgcgccgtgctccgctcctggcgtgtttgctgcgtgaccggtgcggcggggggtggcgccgccgcccccctcgcggcgtcggcgctgctcagcccgctctggccgcccaaatcgacggtcaagacagcgagtggagccaagtccggcgtcctctccgacgccgcctccgccgtgctgacgcgcctcggcgcccgcaagccggcggtcgagccggccgccggggcggtctccctgggcgacgacctgcgcggcttcgccgccgtgaccgtcttcgtcggccgcatcccgcggcccctgccctgctccggggaggtccccctgggtggcgggccgctcggctcggtctcctggaacggcttcgtcccccgggccgcccggccgcgctcccgttcgcgcagcccaaagcttgttgctggttcaccagaaggaattcctggtcatgttgatgggaggctgcgagaggcgaagatgaaccatccaaagggatttacggtggacggcaggggcaacatatacgtggctgatgctatgaacatggctgttagaaagatcagtgatacaggagttacaactattgctggtgggttttcaagcagaggagggcatgttgatggaccaagtgacgatgcaaaattttctactgattttgaagtccgttacattgccagtagctgctcccttttggtgattgacagaggaaatcaagctattcgggagattcagctcaactttgatgactgtgtgtaccagtatgaagctggttttcctctaggagtagcactgcttcttgctgctgctttcttcggctacatgcttgcattgctccaacgccgggttttagggatggtatcaacagaagatgaactccagactcccatgaaagccagcatcgcaagca

SEQ ID NO: 2807 - DNA, 974 bp, Triticum aestivum
  unsure (1)..(974): unsure at all n locations
  Clone ID: PAT_TA_2807
cttcctcatcttattactttccccatcacgccgtttcgatcttctgactctccctccctagggtcaaccggcggggccgcctgaaccctagccccgccgcgccgcaccccgccccgctgcaggcagctgagagatggagaagggggcgtcggagtcgtcgccgctcgactgcgctcgctgcggcaagcccgcgtctctccaatgccccaagtgcgcgcaactgaagctcccccgtgaagctgctgctttctgttcgcaggattgtttcaaggcagcatgggcctctcacaagtctgttcacacaaaggtatattcactgacatcccagctgtctcaagaaggctggaaatattgtttgaaaaaggggcggacccggacaatggagcttcctcgttttgactggacaggtccattgagaccatttcctatatcaaagatgcgtttggtgccagacggaatcgagaaacctgattgggcgcttgatggaatccccaagatcgagcctgacagtgatttgcagaaaagagtagagatcaagacccctgagcaaattgaaaggatgagggaaacatgccgaattgcaagagaagttttagatgcaggtgctcgtataatcaagccaggaattacaacagatgaaattgatagagtgattcatgaggagacaattgccagaggtggatacccgtccccattgaattaccatttcttcccgaagtcatgctgcacgtcattaatgaatcatttgccatgggaatccagatgccagaaaactgaagatggtgacatgtaaacattgacntactgtatactataaagtttcatggtgattgaatgatacatatttgttggaaacttgatgaacttcgaaacactgtccttgtacctatgatgctggagaaantacgcatagtaaactggagttagttcggaagtgggaatcataagtcacatcatcgattcaggttatcgtg

SEQ ID NO: 2808 - DNA, 1000 bp, Triticum aestivum
  Clone ID: PAT_TA_2808
aggtacaatcagttcgttacatgaaaaatggacaattggacatagacttttccactcactttgtttgaaaagaaatgcaaactgaactggcagaccaaagacaataaaagtaaatacacaatatgtagggttcaactagttacacatctcagaaaaaactagttacagccttacagaagctaaaaaagaaaagctacttacacccccaaatttatcatatagctcctgaaagacgaaaagaatgatggcacacaagtatatctgctcttgcctcttaagacgattcctgaaaggccacagagcgctcggaactgaagaacctaatcctctcttgggttgtttcacatatgatgaaactggaatttaggcagccccatactcaggcaccgacaaaagtttgaaggaaagcctcgcaggcaccaatacaatctctttgggatcctagggatcctacagatggattctattcttccttcttctccttccctttcctctctttaatccatgatgagcaaaatagcggcagcactgtgcatgcagcctcaatcaacaagcaaaccggcagtgcagagaaatcatctccagatactcccatgaattcagcaagcgcaaccccaagatatccgctgatgataatagacagggcaagtgcagacatgacaaaggccataaccgatccctcgcacccagaggggcaaaggcttgcgataagaacactgaagggtagcaccttgaagaacatgaggccctctagcagccctgagaacacaatggtgtacaaggagtctgatattcccaccttcctgtatactccctggacaaataacacgtctgacaacattacgaccgctgtgatgaactgcagagctgataagatcttgcgtgcagacgttgtcttgaagcacttgttgtatgccatgctccaagccaagagagccacttgcccaaaaaccttggataaaccgatgatggatgagtcaagtcttaacacttcagcctc

SEQ ID NO: 2809 - DNA, 1276 bp, Triticum aestivum
  Clone ID: PAT_TA_2809
gaattcggcacgagagcgagccaagcgaacaaaagcggagcgagcgcccccccacggacctcgccgtcctcctccatgccctagcgcgcacaccacggcacggcacaccgcggcgcccgccccgaggtctttggtttgctgccctccgacacgctgtgacatagcctcttgatagcacaccaaatcaagagctcagcatggctgattccatggcggattcgatggtggcaagcttctgggggccggttacatcaaccaccgagctgtgcgaggagaactatgcgcgctcgtcatacatcgcagagttctacaatactctctctaatgccccttgcattcttttggcgcttattgggctcgtgaatgctctccgccagcgtttcgagaagcgcttcagcgtcctgcacatatccaatatgatactttctattgggagtatcatcttccatgcaaccttgcaacatgtcttacagcagagtgacgagactccaatggtgtgggaaatcctcctatatctgtatgtcctttattcaccagactggcattacaggagcaccatgcctactttccttgttctatacggtgctgcatttgctgtagttcacttcttcgtgcgattccaagtagtattcaagttgcactacattggcctctgccttctctgcatcccgcggatgtacaagtactacattcagacgaaagacttggctgccaagaggctcgcgaagctgtgggttcttaccatattcctggcgacagtttgctggctagttgatcgcatcttctgtaagaagctctcgctctgggtcatcaacccgcagggacacgcatggtggcatgtgcttatgggcttcaactcttactttgcaaacacattcttgatgttctgccgagctcagcagcgtgggtgggagccgcgcattatccacctctttggatttttgccttatgtcaagattcagaaatccagaaagagggagtaagtcatctgtcgagtcgatcagcggtgttctccaggaccagaagaaatctaatgtccaccaagcgcgcaaaaaaacaagcggtggcattttttgtaaatgggcttccaagtgattacggactacaaatgaatgtcagtcagtgatgtctcgattgattttggtaacttttaactaacgccctgttttgtaccatactcgatttcaaccagagattagctggagtgcccgtctcttactttcaatctgcagcagtttgtctttgcgaacttataggacttcttatttttattctt

SEQ ID NO: 2810 - DNA, 915 bp, Triticum aestivum
  unsure (1)..(915): unsure at all n locations
  Clone ID: PAT_TA_2810
ttcggcacgaggcttctttccggnacttgtccctgctcgctgtccgctttcgctgttcctaccacggcgaacgctgccctaaatctacaacggcggggaagctcgctcggcagcagtaaatccccccttgccgcccgccattatcggaaggaagcgcaaaggggaccaaaccaccggtctcctcttcttcccgctgataatcagccagatgaagaaacagaaaatggcgaatggaccatcacacgacaagaacaaggtgttcgccagtttgactcgcaaagatgtttcagacattgatccgtcttacaagattttcttggaaaatctaattgaagatggaagtgcgtatgtgtttcatatgccaaatggggaccatggcttgcctgcttctgtcaggtatgaagaggatgatatgtcatatggaggcgtgaatgtcagagacggcacaaatgtcccccaaaaattgccacacacaagtcggggtggtgcaagggtcaagcgactagatcaaacatcaggcagcgctgtcaatgtaaatgcgggccattcctttctcccaaggacatcgtctgtgaagaagaacacctcagatgttgatgaatcttacgcagaatttctgagcctcatgaagatcaaggatggtttcatggttcttgagctggaaccaggtgttactgtggtatatgagcaagaggaggagacaccccctggatatgatgaattgagaactgtggttatgtctgaacgtggaattgacaggcctgctccagacaatttgcatggtcgggattcaatctgcacagatgagcatggagttgtaccttgtactgaatcttctgattttgaggcatgtgaagattgtgaagaagaaccgcttgctcttaattgtggtgctccttctacatttgatgaaaa

SEQ ID NO: 2811 - DNA, 634 bp, Triticum aestivum
  Clone ID: PAT_TA_2811
gcctaagttagtttattagcaccagcatggcagcaatgagcgacactaccaggaaccggacgttcccgcatggtaacgacaatgacgacgcgacggcgccgccctccccctcgccgccggagacggtgtactacgaggggtgcccggggtgcgccatggagcgtaagaaggagaacaacacgggaacgccctacaaggagttcttctacgtcggggtcaccaccctcgcctcagctctaccaatatcatcactcttcccattcttgtacttcatgatacaagatatgcatgtggcaaaaaacgaacaagacatcggtgtgtatgctggtcttcttggtgcatcgtacatgatcggcagatgttttgcctcgctcttctggggtgtggtggcagatcgtattgggagaaaacctatcattgcattctccatgttctcagtggtcatctttaacactctatttggactaagtgtaaagtattggatggcgattgccacaagaatgctccttggttctatgaatggcatgcttgccccaataaaggcttattcagttgaagtttgtcgacctgaacatcatgctctaggattatcagttgtaagcacgggttggggcataggtcttgttgtcggtcc

SEQ ID NO: 2812 - DNA, 573 bp, Triticum aestivum
  Clone ID: PAT_TA_2812
tatgcttgtctcaaagattaagcctgcatgtgcaagtatgaaccaatttgaacgtgccaccgcgccgaagacatcgtgagggagaccgtgcgcggtgccaatgccggcatcatgtgcggggctcgtccgcctcttcttctcacgactgcttcatcaggggttgcgacgcctccgtgctactcgacctggccgaccctagcagcgccacggagaagttcggccccccgaacctaagcctgcgcggcttcgaggtgatcgacgcggcaaaggctaggatcgagaaggagtgcgggaacgtcgtctcgtgcgccgatgtcttggccttcgctggtcgtgacgccacctacttcctcagcaacaagaaggtctacttcgagatgccagccggccgctatgacggtcgcgtctccctgatcaacgagacactcatccacctgcccccgccctttgccactgtggagcagctcaaggccaactttgcctccaaggggctctccgccgacgagatggtcaccctctctggtgcacacaccatcggggtgtcccactgctcgtcctttgacgatgacttct

SEQ ID NO: 2813 - DNA, 474 bp, Triticum aestivum
  Clone ID: PAT_TA_2813
tcgacccacgcgtccgccctctttgtattccccatccaccgccgcctcctctctcgcctcaccgccggcctcctctatgccccttcctctccctctcggacgaggcctagctatggccacccgtgccgcatcctgcatctggcgcgggagcgtgtggtggtgactagccgagccgtctcgctggtggctcgagcacggacccttgcgacggcgtccgggcgaggccgggcacaaggcggagctgcggccggcgacccggcacccgcgcttgcccggcggcgggaccgtcttcgtcgtggccggtgggagagttgggcggcagcaagcggtgcggcgaggggaggcgcatgggcgagagggtggggctcttgctagccgctctcccgtcccgttggtttcttgcggccacggtggcgtttctcagatcgagctggatggcgcgacgggggcgtggcacagggccgtgatgtgatt

SEQ ID NO: 2814 - DNA, 632 bp, Triticum aestivum
  Clone ID: PAT_TA_2814
gcctgattgggtgaaggaccttgctgctgtgggtgctgaatttgtgatggacatactgatatttcattgcccaagaccctatgtgctactaagattgcgagtttgtttgatggtaaagagaagattgaatcagacagacaacttggtagcctttgcaggaagacaacatatggtaggaagtaacataggattcctactgcctgttgcttatgccttcttcatgtaggaacttttctttaactttaaatggaggattagctaaataatgcccaacaaggtgactagccttatatggagggtcttggaagagaaacccctgtgttacttcccaagataccattggcgaactgctgctctgtactgcttggcgcatatgcattggcatgatgaatggttgagagttcctgactttgcatgaagtatggggctgttactggctcacatggaaataagcttttcttagcagaatctgatttcaatatctgaatgtgtagtcatgaacagatagttgtgtttcgggttgagcagcagtttcaacggtatttccttctcagagctttcttaagaaacgttggcctttgcaattactacctcattcggtatgtggagagtaattttgttggaagtggttc

SEQ ID NO: 2815 - DNA, 1409 bp, Triticum aestivum
  unsure (1)..(1409): unsure at all n locations
  Clone ID: PAT_TA_2815
ccacgcgtccgcccacgcgtccgaaaggtacttaggaaggcagacatgattcgaaaaaatgccgtcgaaagtatattggctgaacgtgatatattgatcacggtcaggaatccttttgtggttcgtttcttctattcgtttacctcccgggaaaatttgtatctggtcatggagtacttaaatggaggcgacctgtattctttactgagaaatttagggtgcttggatgaagatgttgctcgtgtatatcttgcagaagttgtgctagctttggaatatttgcactccatgcagattgttcatagagatctaaaacctgacaacctattgattgctcatgatgggcatgtaaagttgacagattttgggttgtccaaggttggtctgatcaatagcacagatgatctatctggccctgctgttagtggggcttcattgtatggagatgatgaacctcagatgaatgaattagaggaaatggatcaccgagcacggcgacaaaagcgttctgctgttggaacccctgattatttagcaccagaaatccttttggggacagggcatggtactagtgcagattggtggtctgtaggtgtaattctttttgagttacttgttggaatacctccatttaatgcagagcaccctcagacaatttttgacaatattcttaatcgcaaaataccttggccacatgtcccagaagagatgagttttgaagcgaaagatctaattgacaaatttttgacagaagaccctcatcaacgtctaggatcagatggtgcctctgaggtcaaacaacatccattctttaaggacgttagctgggataccattgctagacagaaggctgccttcgttccttcctcagatagtgcatgtgataccagctacttcaccagccgttactcttggaatccatcagatgaaaacatatacgaagcctatgaatttgaggattccagtgagaatggaagccttagtggcagcagtagttgtgtgagcaatcaccaagatgacatgggggatgagcatggaggtggccccactgacttttgancccggccaaatgtcaataccctttcaacactccccctttnaaatccttcaacacttgcacccaccaactatgatctgctaacgaaagatngaaggacacctcccaatggaactgaaacgtactnccnnttatacngagttgattattnnnggaacaaaacattttaaaggctccggtgnttgttctngtcatataaatgcgnatggcnccacggatgaatttccggggaanattggggncacnccgngaaanctnacanattgnagatcccagagcccgttttcttcnttcttttgccacacgcntgngccanttgcaggttaggtaaaaancctaataanggcaaatt

SEQ ID NO: 2816 - DNA, 1713 bp, Triticum aestivum
  unsure (1)..(1713): unsure at all n locations
  Clone ID: PAT_TA_2816
ctgcccgcagttcggctcggggcacgcctcctccgccccggctccgatctgctaagcccccaccggcatcgggttgcgggtcccctccccgcgacccatcaccgccgctcgccgccggccgccgcagacgagtgtgtaagcctacacgcgataccatgctggcaccggcagcgatggaggtgacgattgatggcacatgtgagcaccacgctcgcgtctgtgaacgcggtgcacaatccacggggcacgcaagttgcggtctgctgtttggcagggacttcatccaagggagcgccgtgctgatcggcaattgcgttgctatcctgtaaccatctgcaagaagcagctcacagcaaccagccgttcaggcaccacacacctacgcaaccaccttgcgatatgcaccaccacctctacacgccgtgctggtaagcgtcggaagctgattgtgcgccgtattctccacaacaaaacatccactgggcagcctggcgatggacatgcctctggtgaggacaatgacaatgatagcacacactttgatcaagaactcagccggcatgaccttgcccgtatgattgtccagcatggctaccggttttcaatagtggatgatctggggtttcgaaagttcgtcaagaatctccagccacagtttagcatggtgtcatatgacatagtgagagctgatagcatggcaatttatgaaagtgagaagctgaagctccaggatgtgctcctcaagaccccttgccgggttagcatgtcagttgatatgtggcgatcgagtacacagatggactacttgtgtttgacctgccactacattgatcattccggcgatgaatggaaacttaggaaaaaaaattcttaactttgtgcatgtcgaggaacattttacagccaatcagattgccaatctcattctggagaagttgcagcagtggggtattgaaaggaagctagctgctgttgtgctagacaactgcaccgctggtgacattgttgccgcagaacttctcagagttatgcagcctaggagacttctcctgttaaacggaaatttgttccatgtgcgctcttgtgcacatattctgaatctcacagttgaagaaagcttggaacagacatctgacataattatttagagtccgtgagatgattcagaatgtcaagttctcacaaagaaaggtttaaaaagtttctagataccgcaaagcttgttgcagattgaccaaaaactgttagttcttgattttncgaacaactgggcttncacttacttaatggttgagtctgcatgctattattacgaagtgcttgtgcgcctctgcacaacacagaagttaatacccttcttttttgaccggttacgagggggctgatgtgaaagccctccttgaatacttgacgcgctcataatacgatggagagtttccgttgaaatccccaccgctaaccctattttaatgacatgtgtggatccaggtctttttacacccgcgccctatacctttcctgttgttgacaaaggctggcccatgctgaaaaaattgggggacctgggatttctttgccgaatggggttgcgttccaccgggaacccggccagaagaaaaaaaagaggattttttcccgggttttggatggccaatttccccaggcccctttaaacccttacccaacttttccccccctggccgaaaatagaag

SEQ ID NO: 2817 - DNA, 867 bp, Triticum aestivum
  Clone ID: PAT_TA_2817
tcgctacgcggctattcgtcccacgccacagaaccagaacttagcttaccatcttgacttcaatcagttctcttcccctcccggtcccggtcgatcatgccttgcgatggcgatgccgaggagtcgaaaggccgcctgaaagcggtcaacatcgccagcccgcgtcgtcgccatggggctcgccgtggcgtcggcggctctcatggtcacggccaggccagtgcaccatcgtcctcccgaacggcgccgaggcacacaccgtcacttacagcgacttcgggcccctttgtgtacctggtggtggcgaacgccattgcggcggtcatggtgggggtggccatcttcctgagcgtgtggaagaagggcagcggcaagtgctccaaggtgctcgtgccgctcctcgacgtcgccgcgccggcgctgctctactcggcgaccggcgccgccttcgccaccaccgagtacatgtcctactgctcaccgcgcgggcgcgggcgcgtcagcgtctgcgatggcaccgtccggggcacaaataacttctgcagccaggtgcacatggccatgtacatctcgctggccgccgccggcgccgtgtcggccgcggagctggtgaagaacttgaagctgtccttctgcagctccgggtcggactgcgactcggacgccggctgcgagcatgggtgccaccacaagcattagccagagtattagttacgtacaataatgctaattgactgcttcgattttttaccacattccaattgtgcagctgttagttggtcactactatattttgtatctacgttatgaagggagcaacttgttcgttgtgctgcaaatgtctgcattaatttccgccgttctagt

SEQ ID NO: 2818 - DNA, 1216 bp, Triticum aestivum
  unsure (1)..(1216): unsure at all n locations
  Clone ID: PAT_TA_2818
ggaggggnngnnnttnaaaannttaangnnaaaaacccncctttttggtaanaaaaaanntttnanacctcccacttttaaaggggggaaaccaaaaaaaggcctgggggaaggccttcccaaccccggcggggtnggggccggggccccggcnttcnttaaaaaaaacttaagggngggggaatccccccccccnggggccttgggcaangggaaaattttccgggggnaccccaaggccccttanaaccccccccaagtnggggaattttcnttncccaaaatccccccccccgccaaanaaaaaaaanggggccggccccaagcccccccagtaaccgcgcccccgcttcccctcccgccccgcccagcaatccgttaccaccaaggcggaagatttagtactcctcctcgtctacttcttgctcagctccacccacaccgaatctagcatcgcggcggcttcgtgttgactcgtctgtcctcctccccggctcgggagcgctcgtgggcttctcggatcggcggcgcgtccgctttccgtgctcggatccaagaaaccagctgggagttaggttcttggatttggatctcccacccgcaatggcggcgctcgtggagctcttcacgagatcctactcgtcctccacgccggtggactgggaggcggaggcctacccggcgtacggccgctacgccgggcctcccgcccggtggcctttcccaattccnttggtcggccnttctttttcccggcccttggcggcntttccnttccttcgggaacccggggtttccggtcntttccggaagaaataatttaaagnccaaaaggaaaaaggggcctttnaatanttttngggnaaaaaaaggggggaattanttggaaaccaaaagggccttttggccttggaaaaancaagggaaccgnaaaaaangggggaagnaaaaaagggaaaaaaaattcaaaanttaaaaaaatttttaaaangggaaaggttnccccggnccctnggggaaaaaaattttnggggtttaaatttttttcnttttttcttggcnaaanaaagggtccccnttttcnaantttaatcctngggnaaaaccaanttaccaaaatnggnaaaacccaatgggggttttaaccnaaaaanccaaccccaaagnaattacctttttcttgggggttaaagggggnccccttggggtngnaang

SEQ ID NO: 2819 - DNA, 662 bp, Triticum aestivum
  unsure (1)..(662): unsure at all n locations
  Clone ID: PAT_TA_2819
cgcccaggcgtnccgcacctttttgccagggtgagagcttcttctttcttgcgagggagaaagggtagcgagcaaccagggagctaggcgtcaatggcgaccatagccacgatgaccatgctcaagcccgccggcctggccgccgtgccggagccggcctccgctgccgtgcaggagctggccgcgctggcggcggtcgcgccggccgacgacaaccggggcctgctgctgctcttcgtggtggcgcccgccctcggctgggtgctctacaacatcctgcagccggcgctgaaccagctcaacaaaatgcgatccaactgagcgcgcgtacgtcgtcgtcgtggcatcgcatgcggtccggccgagtgggttcgtatgtgtgtgttcgtctattaagagtcgtggtagtagcgtggaacgtggtgtgagtgcccgcttgcattctctctaatcttgttccttccattgatcaaatgcagtacagctcttcttgttttctcttctgctacgttcagtgcaatgttctcttctgctacgttccatgctggattgggtttttagggcaactctaaccaatcctgtaaaaataaaggacgatccttagcanatgtttttacttcagatttgaccggtgctagccgatccacaatatataacgagta

SEQ ID NO: 2820 - DNA, 655 bp, Triticum aestivum
  Clone ID: PAT_TA_2820
cgacgaccacaaccacgaccaacaccttcaccctctccttcgccgccgcgggcaacccgcccccgtccaacccggacaacctcaccgccgccgcgctcgaggaggccgcggggagcacgcagagccacgtggtggtcggccgccacgggattcggatccgcccctggccgcaccccgaccccgtcgaggtcatgcgcgcgcaccggatcatggagcgcgtgcaggaggagcagcgccgctggtacggcgtcagggaggcgcgcccggtgctcgtcgtcaccccgacctactcgcgcgccttccaggcgctccacctcaccggcctcctccactcgctccgcaacgtgccctacccgctcacctggatcgtcgtcgaggccggcggcgtcaccaacgccaccgcgtccatgcttgcgcgctccagtctcaccttcgtccacgttcccttcccggaaaaaatgcccctcgaatgggccgaccgccacgccactgagaaccgcatgcggccagcctccacgccctacgggtgatccgggagaggaagatggacggtgtagttgtgtttgccgatgacagcaacgtgcatagcatggagctgttcgatgaggtgcagaaggtccagtggatggccgcagtgtctgtgggtatccttgcg

SEQ ID NO: 2821 - DNA, 764 bp, Triticum aestivum
  Clone ID: PAT_TA_2821
gcgtgagagcttcttctttcttgcgagggagagagggtagcgagcaaccagggagctaggcgtcaatggcgaccatagccacgatgaccatgctcaagcccgccaagatcacggccaggtcggcgccttcgtcgccgtcgtccagcgccaaggtggcgtcgccgagcatctcgctgcgcagcctgcagaagaacgcggccaagaagggagccctggccggcctggccgccgtgccggagccggcctccgctgccgtgcaggagctggccgcgctggcggcggtcgcgccggccgacgacaaccggggcctgctgctgctcttcgtggtggcgcccgccctcggctgggtgctctacaacatcctgcagccggcgctgaaccagctcaacaaaatgcgatccaactgagcgcgcgtacgtcgtcgtcgtggcatcgcatgcggtccggccgagtgggttcgtatgtgtgtgttcgtctattaagagtcgtggtagtagcgtggaacgtggtgtgagtgcccgcttgcatactctctaatcttgttccttccattgatcaaatgcagtacagctcttcttgttttctcttctgctacgttcagtgcaatgttctcttctgctacgttccatgctggattgggtttttagggcaactctaaccaatcctgtaaaaataaaggacgatccttagcaaatgtttttacttcagatttgaccggtgctagccgatccacaatatataacgagtaaagttactttttgttt

SEQ ID NO: 2822 - DNA, 1556 bp, Triticum aestivum
  unsure (1)..(1556): unsure at all n locations
  Clone ID: PAT_TA_2822
ggcacgcccaccccccccactaccccctccacctttttgccagcgcgagagcttcttcttccttgcgaggagagagagggcagcgaccttcttgcgaggtgagagagggtggcgagcaaccacgggggactaggcgtcaaaggcccgaccatagccacgatgggcatgctcaagcccgccaagctcacggccgccgtcggcgccttcgtcgtcatcgtcggtcccagcgccagcggtggcgtccccgaggcatctcgctgcgcagcctgcagcacaagccggccaggaagggggcgctggagcgtgtcgccggtggccccggctatgccgacgggcctccttcacgtcgctggcctcgtcggccgcggcgatggcgtcgccagcggctggcggaacctggccggcggcggcgcccgcgggacgacagccgggggcctgctgctggctcttcgtggtgggcgcccgcgctcgggttgggggatctacaacatcctccagccggcgctgaaccaagctcaacaagatgcggtccggacgaaggcgctcgtcagccggggctcggcatcggcgcccgccgcacgccgcgggccgtggccgccgtgccggagcggggccttccgccgaccgtgacaggagctcgccggcactggcggcggtagcgcccagccggacgacaaccggggccctgctgctagctcttcgtggtggcgcccgcgctcgggtgggtgctggtacaacgatcctgcaggccggcgctggaaccacgcttcaacaaaaatgcgggtccatactggagcgtcgtcctcggacgtcgtcggtggcgtcgcatgcggtccgggcgggtgggtttggatggtgggattgggtctattaagagtcgtggtatgatggtgtcgaacgtggtgtgatggccccctgtctgttcctggtcctattgttgttccttcgatttgatgccagtgcaactacaagtctcctcaatgttggatgaaaaaaacaccgttggaagttgttgttcccgccaagcgcacaccatggccagaaaccaccatggatgtctcatcggagatgttagacgccaagcaagagcaagaggacaggcagctgccaaggaccaacaacaggtcagcccggccccgaagcaccaccacgaagcggaagggcgacgtccacaactgaggcaggataaacagaccatgtaatgtacatctcacaccaccttacacccgcggtatctgcaataggaggcatgtccagtcgatctagtgggtattgtgtttatttttttgtttcctgatgttttgctctggtggtaacgacgacggcctcgtgctggggatatgtcttctgtagaagaccgtttcgttatctgtagctctacctgttgtgctgtaatataacaccgcagttgatgtctcaagaaaatggcgtctgaacttggatgatctaaaaaaaaaaaaaaaaaaaactcgggggcgggggatgaatgttttcaaagccccgtttccccttttattgcttttcttcttgttttcnnnnnnnnnnnnnnnnnnnnn

SEQ ID NO: 2823 - DNA, 538 bp, Triticum aestivum
  unsure (1)..(538): unsure at all n locations
  Clone ID: PAT_TA_2823
cacgagctagccagtgtctgatacaggccgccggggacaggtgcagcttcacgccagccagccagccaccggagcttgcgctcagaccgattgccgaccggagccatggaggaggactacgtgttcaaggtggtggtgatcggcgactcgggggtggggaagacgcagctgctggggcgcttcacgcggggcgacttctgcctcgactccaagtccaccatcggcatcgagttccagacgcgcaccgtcgacatcgccggccgccgcgtcaaggcccagatatgggacaccgccggccaggagcgctaccgggccgtcaccagcgcctactaccggggcgcgctgggcgccatgctcgtctacgacgtcacgcgccgggacaagcttcagccacgccgccaggtgggtcgccgagctccgcgcccacgccgacaagtcatcgtcgtcgcgctcgtcggcaacaaggccganctcacgccgccgcgccggggcgccgccaagttggggccgaagaggcgaggccttcgcnangaacaag

SEQ ID NO: 2824 - DNA, 1572 bp, Triticum aestivum
  unsure (1)..(1572): unsure at all n locations
  Clone ID: PAT_TA_2824
cgtccgcggacgcgtgggcgcgcgcgcgctccacaccgtcatcctccctcctccctcgcaagcaggctcgtcgccacccaccactcctccccccacctatagctacctccctcccgtacccctccggcgcgtgtctctggctgcggcgcgtcggcgagtcggctgctgactggttcttttttcagttcgcgaggcgggcggaggttctttagcgtcggccgagatggcggcggcggcggcgatctgcggggaggacgagccggcgccgcgcgatccggagagcgcggcggcggcgggcggcggggtcgagcggctggatctcggggacggccgggcggcgctcgtggcggggggcaagaggagcgtctacctcatggactgcgagccggtgtggggctgcgtcgccacgccggggcgcggcggggagatggaggacgcctgcgccgccgtgccccgcttcgccgacgtgcccgtgcgcctgctcgcccggcgccgcgacctcgaagtgctcgggctcgacgccgacgcgctccgcctgccctcccacctcttcgccgtcttcgacggccacggcggctccgaggtgtccaactactgccgggagaggctccacgtcgtgctgagcaaggagctgaggaagccccccagcgatctgggcgagatgagcgatgtggacatgaaggagcactgggacgacctcttcaccaggtgtttccagacagtggacgacgaggtgtcagggcttgcaagcaggctcgtcgacggagagccccggtcagacccgatcgccgcggagaacgtaggctccacggcggttgcagtggtagtgtgctcctctcatgtagtggtcgccaattgcggcgattctcgcatcgtgctctcgcgcgggaaggagcctgttgctctctcaattgatcagaagcctgacaggaaggatgagcgcgccaggattgaggctgcgggaggcaaggtcatccaatggaatggacaccgagtgtccggcatacttgctatgtcacgatccattggtgaccgatacttgaagccatacatcatctcaaaaccagaagttacggttgttcctcgggctaaagatgacgactgcctcattctggccagcgacgggctttgggacgtcgtgtcgaacgaagaggcgtgcaaggtcgcgcgccggcaaatccagcagtggcacaagaacaacagcgtcacaacatcgtcgtcagatggaggtgatggatccaccgaccctgccgcgcaggcagctgcggactatctgacgaggcttgcactgaagaaaggaagccaggacaatataaccgtaatcgtggtcgacttgaaaccccggaggaaacccaagaataattcctaacatgacttgaattcatactagcagttggtcttctaatgagacttgacccacctttttcgttgggtttcaagaattgtacatgtatatgatagatggattttcgacctagtgggttataaagattaattaatttttccaacatagagcaagcacggggcggcccgataccaccgccccgggccgggncctattccccaccaggg

SEQ ID NO: 2825 - DNA, 589 bp, Triticum aestivum
  Clone ID: PAT_TA_2825
gaaacccggggcgacccacgcgtccgcccacgcgtccgagacctcgccccctccccctctcacctaatccgcggcagccaaatggcgctcacctcccagagcctcttcttcaccccgtcgcccgccgggccttcccggcgaggccgggggcgccccgtcaccatgtccgccgccgcatcgcacaactcgcaaccccgaaacaaccccttcgccgtctcatcctccgcccccaaatccgaatccaatacctccaaaaccgacctcgcccttggctccgccatcgccgccgccgcctccggcgctttcctcctcgcctcctctggcggctttgggggcggccccgggggccccctcggcgggggaggcggatggggcggtggcggcggtggtgccggtggtggtggcggcggcgggggcttctggtcgcggatcttctcccgccggcgcggcgaatgccgacgaaaagccgccgccggtcgggcccccgcctccccgcccggccaactgccccctcccgctctcggggctgagcgggctgaagagatacaagttgtcggagctcaagttcttcgaccgtgccgcgcctggc

SEQ ID NO: 2826 - DNA, 655 bp, Triticum aestivum
  unsure (1)..(655): unsure at all n locations
  Clone ID: PAT_TA_2826
gcacgcggctcgcccccgctcccgcctcccgtcccgctctccccccccaaaacctcgattcttgttggcttctcgcctcgccccgccgcccccccccggcccccctccccgccgcgcctcgccccatcttgcccccgccaggcagtagccacccacccagccgcggcaatgaacatcttgaaccagcccatcggccccggcggcgcccacgcggtggccttcccggccggcgccgccgccaaggacggcatgccggcgtcgctgcgcttcgacgtcggccccagcaccgcccaccgcgccccaacgcggcgcgcgcggacgcggccgcgggccagcgcccggcgctgcggcggcgccccgcccgcccgccgtgccgcccgcccgcgcgcggcggcccgcccgcgcggcgccacagggccgccgtgccatccggcgccgctcaacttcccgcgcgcgctgctggacagggacagcatgacctccatcgcggaggagggccgccagggcccgccgtcggccccccccgccccccgctgcacccctgcgctngtgggtgtctccgccgtggcgctcnaccgcgccagaccgantatcgcgccaagatccccggataacggttctcaactcgcatcgaaaactggtggancgtccnanc

SEQ ID NO: 2827 - DNA, 1361 bp, Triticum aestivum
  unsure (1)..(1361): unsure at all n locations
  Clone ID: PAT_TA_2827
gccggccgggttccgccctcgctcggttgcggactccgcgccgaccgcttgctgctacttgccgccagccggggaaaaggcagccgcagccagcgacgcctcacctcacctgacctccctcctcacccccgcccccagccgcagcgcccgccggaaggttctagagatggcggaggagaaggagtcgacgtcggtcccgctcagccaggcggcggaggccgtcgaccccgaggacccggccaagtcgccgccgcgccccagctcgcccaccacctccacccgcaaggcatgctgcgctgttcttcagagttgggtgtcgagaaaatttatgactggatgtgtggttctttttcctgtggctttcacgttcttcatcacatggtggttcgttcagtttgttgatgggtttttcagcccactatacgcaaaactcggagtcaacatatttggtcttggttttctgacttctctggcattcatatttctggctggaatatttgtttcttcgtggttgggttcaactgtcttctgggttggagaatggtttataaagaaaatgccatttgtgaagcacatatattcggcatcaaagcaagtcagcactgccatttcaccagatcaaaatacgacagcatttaaagaagttgcaataattcggcatccacgtgttggtgaatacgcattcggatttataacatcaactgttgtccttcagacagacaaaggtgatgaggaattgtgtagtgtttatgtgccaacaaatcatctatatattggtgatatatttctgctgaactctgaagagatcatcagaccaaacttatccattcgagaaggaattgaaattatcgtttctggaggaatgaccatgccacaagtaattgcatcgctagatcccatcccaagaaagagccagagcatccgcctaaatagaataatgacatgaggatgtgtgagtcatcaaagcaagggtcgcaaatgggtggatgggactccagtgctggtctgtttgtgctgttcgtttcttacgtgtaaaatgtcaaggttggatacgggaacgtgatgaccaagctggacggaagcatcgtaccgatggcctggaatgctgttatgtgacgcatgttgtttttctctgtttgctgactggtccaaagtgttaacttcgatgcaccggtggtgtacaactagtgtgcctgattacattcatttgtaagagtgtgtcgtgtaataccatgtcgacttcgttactatagtatacataccatgctgactggtttctttgtgaacatctcttagtttcagggtctcctgtcttatactccctcctgtccataataagtgtcgggnaactaaagccagga

SEQ ID NO: 2828 - DNA, 717 bp, Triticum aestivum
  unsure (1)..(717): unsure at all n locations
  Clone ID: PAT_TA_2828
actagcgctgctgccaagttctgcttctcatggaggaaacaacacaaaagtataatgcgtatggtatctctcaactcctagagttgaagagtctactccatttccatgtgtgtaaggaatacttacctaccctgcactattatcaccttgattaatgtaattgctttggctattttgttttcttcgccacaaaggttgaacaaattataagcaacaacggtgagggcaacttgttatagtatttagtctctgcagtacattttttccctttattaagcaagttccctggtaagggggtgtgggatgtattttccaacatgtgcgaatcggcgagacttcatgttcatgtgtgctggatttcaatccttatgcggaagctctacatatgcaaggttagcacggctagttaggctagtgccttcctgtcgtgcaacaatgaaatatgtttttagccaaacaaactagtgtatgtattgatagccagtagtatttcttaagttgaatgcaggtttatttctaaaaaatctttaattactgtttttgagctttgcaggtacggctcataactgacaaggtaacaaataaacctagaggatatgcattcgtagagtatgcacacactcgggacatgaaaagtgcttataagcaagctgatgggagaaaagtggataacaaaagggtgcttggtgatgtaaagcgtggnaaaactgttccaaa

SEQ ID NO: 2829 - DNA, 1931 bp, Triticum aestivum
  Clone ID: PAT_TA_2829
ctctcgaacatctcctccgagctcgcgaccgccgccgccgccgccgccaagggggcactacgggaacgcgatgatgaggaaccaggatgcgggcgtgcagtcccgcgtgaacggcgcagagccgtgccaacctcctccagctcaagctcatcgggcagagccatccgacggggctgacgacgaacctgctgaagctgttcgagccacgccccccgctcgagcacaagccgccgctcgagaagagcaagttgccggcttactcagggatgtcgcagtttgtatcgcggttcgcagagcctggggacccggagtatgctccgcccgtccccacgtgcgaggactagggctgaaaagaaggatggaattcgtcaacttaagcttgaggaagttgcagctaaggttgctgaagagctccagaagtatgacccacaaaatgaccccaatgtcactggagatccatacaaaacactctttgttgcacgacttggctacgagacatccgagcagaaggttaaaagggactttgaagcttatgggcatatttatagggtacggctcataactgacaaggtaacaaataaacctagaggatatgcattcgtagagtatgcacacactcgggacatgaaaagtgcttataagcaagctgatgggagaaaagtggataacaaaagggtgcttgttgatgtagagcgtggtagaactgttccaaattggcgtcctaggagattgggtggtggacttggatcaagcaggattggtggtgaagatgctgcccagaagcattctgctagagagcaacagaatgctgctggacgacccagatcagaagagcctaggagggatgatcgtcctgcagatcgggatcgtgagaaatctcgtgatagggtacgggaaagagatcgtgacgaaaaaactcgtgaacgctcgcatgacaggacccgtgatcgtgatccaacggaagatagacaccaccatagagatcgtgagagaactcgtgatagggaccgagaacgggaccaggagagagaccgtgggcgtgaccggcgtgatagggataggcacaaggatcatggccgggatagagaccaggatagagacaggaaacgtgagcgctctcatggcaggggcagagaccgtgacagagattacgagcgtgcaagtcatgaacaggaccctggcagggaccgagattacaagcgtgcgcgccatgaacatgatcgtggtcacttgcaggagagtgatgctgattatggcaatggtgagcttggctataaccagcatgagcaccacagaagtcacgaacagtatggttatggcctagatggacatgagcgctcaaagcgacatgagcattaccgggatgatccacacagtaaaatggcaaccaaccatcaggggcaacctgaaaatgcagaacctgcagtccccgaggaaggggaggcatatgaagaaggggactaccagcatatccaagcgagtgaatacaggaactaaaacttgatagctgtggtaaggctttgttaacacagtaatattcgcatcatttcagctgttcccagtggttctctcgcctttttcttgtcggcacttccagtcttatcccacttattttgtgtgtgtttgtttgttgtatgctatttgtaataatttgctggataatgcttgtggtttgtgttcacttgttagtgatgttctatgtaattttgaagccaatggccaatcaatgtgaacttgttacttgcctaaaaaaaaaaaagtttatgcatttttgtgggtttcgacagttcctgtagatgcaagcgtaacatgggcgtggttgctggttataaagtggactgtggatcaagttaatcatttcttttactttgtttttcatttccttgtaaatgattttgttgatcatttgaggaatgaagtttttgctgttg

SEQ ID NO: 2830 - DNA, 1276 bp, Triticum aestivum
  unsure (1)..(1276): unsure at all n locations
  Clone ID: PAT_TA_2830
tcggcacgagggcatttgctctgatgcctctacaagcttcgccatctcctgttcttgaaaacttagattatgccttggaagacagcgtcacagcaaatttctcaaatccgggctctgcatttggagggcttctatctctggagcagagaaataaatcttttgacattaccaattcgatgactgtccactgtggatttgttagaggaaagaaacctggccaaggtaccggatttgacatcagtgatgatgatctgctagaaatggagcaatgccgtgagcttgttgtagcttctgccattttcgggaactatgatatgattcaacatccaaggaatgtcagtgaactgtcaaaggcatatgcgtgtttttatatgtttgtagacgaagaaacaatggcttatgtcaagaattccagctcactgtacaaagataataaagttggcttatggaggctagtggttgtccggaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaagaattctagttttgcgatatctcggcactacagacgttttgatgtgtatgaagaagcagaagctaataaagctgctggaaagtatgacaatgcatcaatcgatgaacaaatagatttctacagaaatgagggcctaacacattattctcccgccaagcttcctatcacaagtgacgtcccggaaggctgtgtgatcatcagagaacacgtccctatctcgaacctcttcacatgtctttggttcaatgaagttgaccgtttcaccgccagggatcaaattagcttcagcaccgtccgggacaaaataagggctaaagtcggctggatgccccagatgttcctggactgcgaaaggcgcaactttgttgtccaggcataccacagggagctgctagagcagatgattgcgtccggcaggaacacgcctccgatcgcggtcgaaccatctcggaaaatcagaccaggtagcagcaggagagctcccccgtcgaagaagcctgtcngtgagacggaaaaaggagaagaaatcgagctcgcggaagcgggtcgcgaagccggttactgggcgatggatgcgtggtaacggaggtcaacgggatggncggacggactctgtcactcnanaattggggtgaccgtattttgganctggtn

SEQ ID NO: 2831 - DNA, 1781 bp, Triticum aestivum
  unsure (1)..(1781): unsure at all n locations
  Clone ID: PAT_TA_2831
agctcggctgcacggcctgtgtccgcttcctcgatgctgtgggtggtggggcgtcgccgtgcgcccttggtgccccctgctgcctgggtgactccggttgcggtcgagcccgctccctcctagctcgcgatgcggggcctgccctccgcggcgtccctctgcgcggcacttccgccgttgaggcggccgaagttcaaggcatcaaactgccccggctccggttccccccttccccgtcccgcttcctgcaagctgggcaattttcctctagcagagatatcgtccactgatcttccgtctctatcgttccctgcatggctggtgctcagtgggaatgcatctgcgatgagtgaacttacgaccattccagctagtatcggagcactttcaaaattagttcgaatggacctgcaccagaacaagataacttcgattccttcttccataaagggatgctcttctctagctgagttctacatgggaaataatatattgtcgacaataccagatgatattggcatgctatcaaaattaggaacacttgatcttcactccaatcagctgaaggagtatcctgtgggagcttgcaaactcaagctcagttttcttgatctgtcaaacaacgcattatccggcctgccagccgaactaggtacaatgacaaccctaagaaagcttctgcttagcggaaatcctatgagggcacttcgtagttctttggtttctggaccaacatcaacattgatgaagtatctgcgaagccgcctttcgtctgaggaggaagcatcagggtctagaaccaccccaacaaaagatgaccagatttctgcagcaagacgattatctgtatcttcaaaggagttgaatttgagtggtcttggtgtgcccaatgtaccccctgcagcttgggagacaagtgatgtggtgaaacttgatctttctaagaacttgatagaagatctgccaaatgagttgtccctgtgctcatcacttcaagctttgattccgtctaataacaagataaaaaagtggcctggcatggttgtttcctcccttcccagtctcacttccttgaagctggacaataatcctctagcagagatatcgcccactgatctcgaacctctaggaaaacttgaaattctggacttaagtggcaatgcctcctcattgagtgaaccttctgtggtttcttcattaccacaactgcaggaactatatcttaggcgaatgaaacttcaggaatttcctattgggcttgtacaattaaaacatctacgaattcttaacctcagtcaaaataatctctcaaccataccagagggtatcaaggattttagtgctctcatcgagctagatctttcagacaacaatataacaaggcttccagctgagctgggtctgcttgagcctagcctgcaagtgctcaaacttgatggaaatcccctcaggagcataaggcggactgttctggagcgaggaacgaaagctgttctcagctacctcaaagaaaagcttccatccaactgaataataccatcatcaagtgcaaattctggctggagttattcgctcggtttttctccctctgtgttgaacaagtttcctgtggttgaattgtactgaattgaccgtgtgtggttgaaatgtactgaattgaccgtgtgtgcgcgcgcacccgaacgctgatggtttgccacatgcacattcctatatttataagttggacacaagnattatgtgatttgtgttgtataattcgatggtgtttgttggctgaa

SEQ ID NO: 2832 - DNA, 1373 bp, Triticum aestivum
  Clone ID: PAT_TA_2832
gtcgctataaacttagccaaaacttctctgatgttgttcccttttatgctcctcggcagatcttctgtggactgtcatgggcgcatcaaacatgcctaaccaggccgcctcccagttattaacccgtgtcagaatcatcctccggttccaaaaagaattatcagcctcggctgaccacgaccctgcaatcctggaggacagcgaagtaccacatggcgagaagcttctgctggcgctgcagggaagtcttgacgcctcaaagcaggaggaggtgctggccgcggtgctcgccgccctcagagtctcgatgcacaagatctggtgaagaagaactagcttttgccttggcgggacagaattcgtttctgcaggaactataagaagatcaacaggaggccctgcctttctattatacggaggcggtgattcatctgttcgggtatgggactacataaatggctgcctccttgatacatatgaagtcaaagacaaggtgggagaacagccaaatgaaactgaagatagcaatctagccattgcagacttgtgtttgacaaatgatgactcactggttgctgtagctattcaaagtttgaatggcataatgctcttagcatgtgatctcgtagcgaagaagttgtcttttctgaaggtgattacgacggaaaagagctacattcccactagcttagcctacagctcatccgcagatcttctgtggactgtcatgggcgcatcaaacatgcctaaccaggccgcctcccagttactaacccgtgtcagaatcatcccccgctcccagaaggatctatcagcctcgaccacgaccctgcggtcctggaggacagcgaagtaccacatggcgagaagcttctgctggcgctgcagggaagccttgacgcctcaagcaggaggaggtgctggcggcggtgcttgccgccctcagagtctcgatgcacaagatgctggtgaagaagaactactcggaggagaggcgggagcagcggaagaggggccggaatgataagaagatcaagaagtagctctgctcggcctgcaaaacaccgtcaaattagaggtcctctatgttgtaccatgaaaagctcagagcacaaggaaggaatgcacaagtaggttcagcaaccattttcttgtgacccatggcatggagactgcttatgctatagcggcttcagtcgaaatgccacaatttttttttgtttctttttttgtgatttgtgagctgtggcttcgaatgataattctgtcttacacgaaattggagttggtcctacaccaagtggtgtgaattgggtttaatctatcgctgctccaaaaaaaaaaaaaaaaaaaaaaaaaaaaaaaaaaaaact

SEQ ID NO: 2833 - DNA, 1906 bp, Triticum aestivum
  unsure (1)..(1906): unsure at all n locations
  Clone ID: PAT_TA_2833
ggcacctggcccccgccccgccctcatcgctgccgcagcctccccctcaccctcaccctcgccgccggcccccagcccctctccccaacccctgcccgatgacgtccccggcgccggcgccgcccacggcctccgccgcggagtcggcgccgaggcgcgtcgcacgccgggggctcgcgacccgggccgtagaggccggcatcagcactccagggatgtctgcgagcctttcatattttgatacctacaggtgcaaccggttgccagcgaatctgatccaagcacagagggacttgtttggggcacacacctatgagcgcattgaccgcccaggttctttccacactgagtggactaagctggcgagggagggcaagtgaatgactttgcagccacctgaggaattcggtggtaccatatgtggtcttggtgactcggggtgatatctcttcgtggttctctttaatttatctattgctgtttttgcaatacgagatctgaattgtgtaccttgaataatgcagtgtcttgtgctgtatgcacctgaagaacatttgtgtagcttcaggttttctatggtttagatacacccagttttatccactcataagttcggaactcatggttttaatacctcacatcccaatgttgccttggaattgtgatttcaaagatgtcaatatggtggtaagagtggtgactgatgtttctctacttccatgaatctatttgaggttgtctagtgttgtaagatatttcatttcacctgctgtgctgtcatcctactgtggattgtggaagatagctctggtcctggggagaatatcatcttgttatgggcgtggccatgccatacggcatgtattcaaaaatatattaaagatggaagttctgtttgattgtattcttgacaagaccgggatgaaggggaccgggaagtggacggtgcagcaggcggcggagcttgcagtcgctgcacccaccattgcagcatcactggatgggaggtacttgtcggggctcaaggatgagcgagttgcagccgcaagtgtgctagaggaagaggggatgccagttgggcttctggagaagattaatgtcgataagaaggtgctggtggacagggtgaggcaggcactttattcgtccaaggtttgcagctacgcacaggggatgaatctgctaagagccaagagtgtggagcagggctggaatcttaaccttgccgagctttcaaggatttggaagggtggatgcattattcgggcaaggtttcttgataggattaagaaggcttatgacaggaaccctgagctggccaatttgattgtcgacagggagttcgccagggagatggtgcagaggcagggcgcatggcggtgggttgtggcccgggcagtagaggctgggattagcaccccagggatgtctgcgagcctttcatactttgatacctacaggtgcaaccggttgccagcgaatctgatccaagcacagagggacttgtttggagcacacacctatgagcgcattgaccgcccaggttctttccacaccgagtggactaagctggcaagggagggcaagtgaatgactttgcagccacctgaggaatttggtggtaccatatgtggtctcggtgattcggggtgatgtctcttcgtggttctctttaatttatctattgctgtttttgcaatacgagatctgaattgtgtaccttgaataatgtagtgtcttgtgctgtatgcacgtgaagaacatttgtgtagcttcaggttctatggtttagatacacccagttttatccacttataaatttggagcaacggttttaatgcctcacatcccaatgttgcccttgaagtgtgatttcgaatatgtcaatatggtggtaactggnnnn

SEQ ID NO: 2834 - DNA, 2529 bp, Triticum aestivum
  Clone ID: PAT_TA_2834
atttgcttcgtgaaagcaacatacagcttagagaggagaaccggcacaattttgaagaatgccagaaattccgtgaggaaggtaacaaagctaaaatagaggctgaaagattgaataaaattctactggagaaacaggtatatgctgaagtgtgtacaaaagatctagacatgaagaagactgaaatagcaaatctcaaccaaaggatttctgagttggttgaaaacagtagaggtgtcgatttgaacacatatgagaccatgaagggtgaacttcaaaatatcaaatcaaccttgagagagaattcagttgagcttgagcgtgcaaagaatcttctttccgagagggacgttgccataagaaatttagatgagaagcttgctggctgtcagtctgaattgggagctagggaaaagaagctgaatgatgttgaggctagcctgaaatctgaaattgataaacagaagaagattaccttcacctacaagaaaaaagttgaactgtaaatgcgagagaaggctgggcagataaaacaacatgaaagagagatgaagccaaaagagaacaataagtcaaaatagaaaatgccgatggaacaattcacagcctacgccgtacaggggcagttctcgagaatacgggcgcggacaaggacgtggccggcgaggtggtcagccatagcgaggtagaaaaaaattggtgtcgtcgctggaaacttgtagttgcatcttttgcccaactacgtaggctatgaactactgaactagctgtgctgccggactcgtttacaaatggtatgctactaagcggctgtgttatggcgcgcctattgatgatgcgcttgaattgctctgtgaggttacatcactaattgatactgcccctgggctaaaaaaatggaggagtctcctagcctgttccaagatggttcaactagccagacaccacctattgaaactcccactgtcgatgcagctgcgacagggcggcaggtagctactccgccaaggcctgctcaagttaaagtgatggaggagaaagcagtttcttctttgcccaagccaagtactgaacaacgcagatcaagaagggtgctcgttcggcctagtcttgaacgaattgaagagccccaggctgatgcggctacaccagttgtcgatggttctgcagtacaagagaaaggtggcacgtcgacagaacgaggttccacagtagttcaggaaaaaggtggcccatcactggagcgtgaaacttctggcagtgtgtctgtattgccttctggtcgcaaacgtctcatgccatcatcgcagatgagagatgatgcatcacatggagaggctaatgatgccaatcctccatcaaagaaacctaaagaggattctgttcagagttccagtgagttaaaaactgatcaatcggcccctgaagatgtaacgactgaggctcctgtggttatttcgatagacaaccaagatgtgcaacaacagcctggagaagagatgacacggatcaggcttccatgccagttgaagaggttgaggacatcaaggatgacgaagcgggtaacaatgatgacatggaagaatatacaggtgcatcaatggacctcgaagcccaggatgcttgaagttaatatggacagtgatgcagctgctgtggaagatgtgccgcttaagtcagaggcagtagtggaatcgtttgatgaagaccagaaacacgaagatgcgaaggaagagggccagattactacagccaccgatgccgaggatgagagggaggagggggagttgccggatgaacctgaacaacaatcagatagcagtcccttggatattggtgagcaagcaagtgatgctttcagggcagcatctccaagtggggcagcagcaaagagcgatgcagacatgtcagaggagattgtagaaggtgatggtactgctgaacttgccgaggtggagccagaccaaagccctctagcacagtcaggcggagcggatgcatcaccaagcagaaccactgatgcatcccctgtacgtgaaccttccccttcaaacccagccattgctggcgcatcttctgaacaacagaatcccggtaccgcagcagagaatgtgggaagaacaatcaacttgacggagagggcaatacaaaacagaacaaacagacaaaacagacttgtacggacgagcactccacagccttcctcttccaggggtcgttctcgagaagccgggcgcggacgtggacgttcccggcgaggtggtcagccatagtgaggtggaaaaaaattggtgtcgtcgctggaaacttgtagttgcatcttttgcccaactacgtagactactttttgccatgaactactgaacaagctttgctgccggagtaaagcattgcatgactagtagccgtcgagtaagcaaatatacgctgcccgactcgtttacaaatggtatgatactaagcggctgtgttatggcgcgctcatgtgcgcttgaattgctgtgaggtcacatcactaattgctacgtg

SEQ ID NO: 2835 - DNA, 862 bp, Triticum aestivum
  unsure (1)..(862): unsure at all n locations
  Clone ID: PAT_TA_2835
gggctgaggctgccggcgcctcgccccagggagaagatgtccaggacgccgaggaaatccgaggacggcggcccgctggacaccatcaagaagctgaacaagcatgtcgccgacaccccgaccccgctcaggcaggccttcaccaagacgacggcgctcaacaacaagcgcacgctcgcggtcaaaagctccgcccccagctcggccagcaagaagaagctcatccacggcatcatggaggcgatgccgcacctcgcggcctcatcgccaaagacccggtccccaccgagcatgctcccgaggtcctccatgtcctccgcgccgacatccaccaagctcaaggacatctgcttcgaagaagaggagagcacgatggtgacgccgccgttcggcaagctcaaggacatcatcctggacaacgacgacggggcggacgatccgtcgtgctcgaactcgtccttggccgacgagggggtcggcgtggccgcccggaggaaccacggctgcgggaacgggaggctcatcaacatctgcttcggcgcgcaggggctcacggtggaagactctgccagcgggcagcagacgagcaagatgttcaagcagcagtgcctccgggtgtcctgacctggcctgcgttcggctttgcggttcagcgatatatgtgtgtgtgtgttgaactcccccggctcggtttggtttggtttggtttggcgtgctgctccgcgtacaagagcaaatgtttgttgatttgctgagataaattccgtgtatgtatcatagtaaggcgtgcttgacttttgcaagggcttgagcttgctatcatcaagttatcgacgnattcccctatacatatacacgaaat

SEQ ID NO: 2836 - DNA, 1655 bp, Triticum aestivum
  Clone ID: PAT_TA_2836
cgttcgtggtcgctttcaggctggggaggtttttcttccgaaatctcagcggcctgcgacgcgttcgttctatgctgactttttgtcgtatttcaggacccttctcttacgatgattcaggatgctgtccaggagggactgaaatctgatgctctgaagctcgtggtccaagctgcagtcgatgagggtctcaaatcggatgctctaaagcataccattgaactggcagttcaaaaggcattgaaatttgacgtggaaggacccacgaaagctcaggccatgggggtttacagtgcgtccagttcggcagatccccttcccaagagcgacgcagcctacagcacttcaggatactggccggccgatccccttcccaagagcactagcgcctactgcctttctggatccagggtttccaggtctgcggatctccttatcaagagctctgctgcatactgcccttgtctctccagggtgtccaggtcgctggttcttattcccaagacctctgcagggtacttctcttctgtctccaggacgtgctttctacccctgtctggtccccgtttcttcagcacccagaagggttgtgctgacattgacaagtttgataaattcgagaagctgtatcaaaaggctagagttcatgtctcgacgggactccatcgcatagttggcctattgtatgaactgaaggaggatgtcgatcaaaccgactttattcagaagtggcttactaacattggcaaggagactcttttactatcagacagccagattgaaggtattggtaaaggttggacttgtctcaactacggcggtggtttttttgcctggggtacactggtttactttggcgtgatgacaatcagagagaataacatcccctacacggattactttcatttattgaatgctgtccgtgtccaagccttgaataggggtatcgcccaatacaaagctgagaaacaggagctggaggatgcggtgaatgctaaagcggtgatggctgcactcgcaaagaaggcggcagaggatgctgccgctgagaagaaggcaaaggatgtcgaggctgccgcctccaggaaggccaaggcggagcagacaggtgcgaagtggaggtccaagtcagaacaggctgctgcccttagaaaggctaaggcgagagaggtccgtgacgccaatttgaccaagtggaagcagtccaacgccgagaggaaggaggcggacacagcaaggaaggcaaaggcagctcaggccgccgcggaaatcaaggcaaagctgaaggaggccgctgagaagaggatggccaaggctaaaagctggctgctgccgtggcggctgcgaggaaggccaaggcggtgtaagtctggtcccaagaagtagaagtagacagtgtgtaacttgtctcctgtgtccttgatcatgtgggggatttttgtgcagagaactactttgaatcatcattcagtgttggtggatatccagtacttcatagtgggtttgttagttcctctggtactgtcttaccgctggcaagagtgatttgtttgagatgagaaccaaagctttgaaagaacgtttggatgtcaaacgcaccattatcgcagagcctttgttaatcgttacaatgccgttatcaaatccagcaaaaa

SEQ ID NO: 2837 - DNA, 690 bp, Triticum aestivum
  unsure (1)..(690): unsure at all n locations
  Clone ID: PAT_TA_2837
gaattcggcacgagggccagacgaccgttgatccgggaacaagggcggcgcaccctgcagcagctgcccctcgtcgcgccgcacgtggagttgcttcgcccgcgtcgtacgcgcgagcaggagcaccaggagccgccccggacgcacttcgacgggcacctctccgtcgcggttgtctccgtcgcgccgcgcgtggaggtgctccgtcggcccgcataggccgcgcaagcaggagcaccttgccaggggccgcccgggccgtgcatcgatgggcagctcgtcgtcgtggctgccccgtcgcgtcgtgcgtggacggcgatccgtgtcgtcacacgagaaggagcaccaggcgccgccccagccgcacacatcgacgggcacctcgccgtcgcggtgtcctccgtcgcgccgtgcgtggaggtcacccgttcggcccgcatcattcgcgcaatcaggagcaccaagggtcccccaccgtttaatggatgggcactcgccttctggtgcccgtcgcgtcgcgccntggactggtccctgcgaacaagacgcaactgccaatggtttggcganaantnacgcgtcnctgaaggaaccnacggtatagaagnatcnactccgtgaagtatcccgttctctcgaatgnataacgacttancgggacctcancggtgnaatcaagtcaagnnacat

SEQ ID NO: 2838 - DNA, 956 bp, Triticum aestivum
  Clone ID: PAT_TA_2838
ggagacgatgagcatccagttctgcacctcggggatgtcgcactctttgatggaaagctgtatgggctgtgcgggtctggtcaccttttcatctttgaaattagacaaggatcttttcattgcatccatggagtgcgtaattcactctctgggtgacttgggtggaacacctcaatccttgcctagagagggggcgtgtatggtaagggactatctagtcgaatgtggcggtagactgttgatggtgatacggtggtttcgctctacggccccgtccaacaagtgatgactgtttagagcatgaccgtactgttgcacttggggtttttgaggccgacctgcatgccgaacccgttggatggagaacagtaagtgatttggatggccatgcgctctttcttggccaacatagctccaagtccctgcgtgctggagaatgcactggataccaagaggactgcatctacttcatgtgtgactatccctggcccgaagtattctgcaaatcctcttcgcgacgcccggtgtttacaacgtcaggaatgagacgttcctgccgctaatgtcagggaccacccgcagtaccaccacgtcacgctggccagtggcggccgacatggtatttccctcctgaagctgtatgatcaagccttgtaatctactgatcctgagagtaactgttgggtaatgtatcgtctgagacgggagttggaagggcgtcttcctcacagcgacaggtgagttgttgatggacggcagagattcgtagtattggattctgtgttggtaggctggtaggttcagtttgatgagtgatgtgttctacacttctaccctgtggttgttgttctgttctgtggtggctgaacttagtgttcttggcctagtgtagtgttgtaactgttctcagctgaactttaaaatgttgggcgctgtatcatcagtttcatttcaat

SEQ ID NO: 2839 - DNA, 940 bp, Triticum aestivum
  unsure (1)..(940): unsure at all n locations
  Clone ID: PAT_TA_2839
gatancccttgctcgaantnaaccctactaaagggaacaaaagctggagctcaccgcggtggcggccgctctagaactangtggatcccccaacacatctcccgtaacacaaagaccatgaagaccatactcctcctcattctcgcattccctttcttgggcgccgccggcgagcgttgccccggcgtcccgtcactgccagtggaggccgcctgccgaaaggcgtgcggcacgaagctcatgcacgacatgtgcatggacacgctccgcgggggattcgatcctagcccgtccgtccacatcgaggtcaccgagtatgcgctcctcgccgcgcaccgcgccctcgagtcctacggcgccacggctgccgccgcggccgagctgctccgcagcgggtcgctctctggcgacgagagggcggcctacaacacatgcttgacggagtactcctacgctgtgcagtgcatggagcacgtcgccggcgacatggtagcgcgttgccggttcgcggggctcggggaggagtacgtgcgctgcgtgacgtacgtggagggctgtagggatcgcttggtgcggctcaagtcatcgccgctctacgccatgaatcttgtcgaccggaacaaggcccttctggcttactccctcggtcaattgctccggagcatatgagccttacacacttccagttaggttgtttgctttgtcctaatctgctggcaaggtcaattcaacctaataagcaccttgtaaaggcatcttcacaaaaaataacaaaataaactcgagggggggccccgggacccaattcgcccctatagtgagtccgtattacaattcaactggccggccgttttacaaccgtcctcgactggggaaaacccttggcggtaaaccaaaccttaatcgcccttggagtatcaaccccccttttcggcaggcc

SEQ ID NO: 2840 - DNA, 374 bp, Triticum aestivum
  Clone ID: PAT_TA_2840
ttaatgtgactgccggacatgataaactctctcccggaagtttgctgtacggatgctatatcctttcaccccgggtccatgattgcaggctaacgaggaacgaggcagcttctggaccggtgctgtgatgtccccccggctccagaattcgcaagcttgcctggttttatttatttatcccagtagtgttagtatcatgtaaaccaaatcgccagtctgaaggtgataaaattactgtattacctatcaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaaaaaggggcgcccttttgggggtcccctttt

SEQ ID NO: 2841 - DNA, 962 bp, Triticum aestivum
  Clone ID: PAT_TA_2841
ctggggcaagtgtgtggatcagtggccttcaggagatcatgaccgggtactcggactcgggcaaggacgccggccggctgtcggcggcgtggtatctctacaaggcccaggaggagatcgtggacgtggcggagcagcacggcgtgaagctcaccatcttccacggccggggcggcaccgtggggcgcggtggcgggccgagccacctcgccatcctggcgcagctgcggaacacggacgacgggtggcccttggtgcccgtcaccgtcgacctcctcgagatggtcttcgccaagggcgaccccggcatcgccgcgctctacgacaagctcctcgtcccccaagacctctggcccttcggcgagcagctcagagccaactacgccgagacacagagcctcctcctgaaggttgctgggcacgaagacctgctggagagcgacccgtacctgaggcagcggctgttgctgcgggactcgtacatcacggcgctgaacgtgtgccaggcgtacactctgaagaggatcagggacggcgagttcaggccggcgacgcggccgccgctgtccaaggagttcatcgacgagacggcagagagcttgatggagctcaaccccagcagcgagtacgaccccgggctggaggacacgctcatcctcaccatgaagggaatcgccgcgggcatgcagaacacgggctgattctggattttggggtggactttccgtggacttgtgcccggttttgtccttctgaatagtagatgtcgatcggcgaaagtgaaaagtgtaaggttggttagggagcgttgttcccttggctcgggccgcatgtgtatttatagacggattgccgtgacttataaggtttggaatatcgctaggattctgccagacgtccgcgggggttctgggacttgaagaggaagactagaacagaagaagagatagaatcagaaaaca

SEQ ID NO: 2842 - DNA, 662 bp, Triticum aestivum
  unsure (1)..(662): unsure at all n locations
  Clone ID: PAT_TA_2842
agcccagccaaggcacgcccccgcctcccctcgcctcctccgctcgccgcggataccacctgagcgatcggaggcgccatggacccgtgcccgttcgtgcgggtgctggtcggcaacctcgccctcagaatgccggtcgcgccgcccgccgccggcgcgggcgccggcgtccacccctccacctccccctgctacatcaagatccgcctcggcaagatggcctgccagaccgccgccgccccgctcgtgctctccgacgccgccgccgccgccgccgagcagcccccctccggcgccctggccgcggccttccacctcttcaaggccgacctggagtggttcgcccgccagcccctcgcctttctccccctccccgcggggggcgggctgctcaagggtgtccgtttcggccgcaaggggactggggattacatgtggtgtcaactcctgggccggagtgctccgggaaagggcgccctctcgcttggatntcaaagggngccgaagggcnaaccccgcggtgcttgnanagcgggctggattttccttncgggaaagncgcggnctttggnggaaaagggggggggggcccnncgggcgngggaggncaaaccccaacnntctncgcggggggnccgaacccgnggttcntgttncanttg

SEQ ID NO: 2843 - DNA, 974 bp, Triticum aestivum
  Clone ID: PAT_TA_2843
ccaccccgcccccccgcgtcgtccgcccggggcccccgcggcgcctgcaccgccacgacctcggcccgctggggcgccgccggggcgccgccgccgccgccgcccccgccgcggcgccgctcgaccggctggccccgcccccgcgccccgcggcgcgggccctcccggtcggccggccgccgcggcgccccgtcgcggacaaccccggggtgtgggcgttccactgccacatcgagccgcacctccacatgggcatgggggtcatcttcgccgaggccatcgaccgcgtcggacggctgcccccggccgccggcgcacgccgccccccggccaccgctcagcgaaccggctgtacgagctgccgcacggcgccgtggtggacgtggtgctccagaacgcggacatgcggagggacaacgacagcgagacgcacccgtggcacctgcacggccacgacttccgggtgctggggtacggcgaggggcggtacggcggcggcggcctctacgagcgcctcaacacggaggacccgccgctgcggaacacggtggtgttgttcccgcacgggtggacggcgatccggttcgtcgccgacaacgtgggcgcgtgggcgttccactgccacatcgagccgcacctccacatgggcatgggcgccgtctttgtcgaaggggcccacatgatacgcgagctcgacgtgccaagggagaccatgatgtgcggggtgatcaggacgacggccgcagccctgactcccgctaagccaggctcgtcggcgccggcgccatcggctcatcgataagctcctcctcagcatgcctgttccagtgtatccgtggtcatttgtcagtgcgcagcgcaaaacaaaggccttccagtcagaactccaaatatcagtagttggcaaacgtaaaatgtttttcactgcacattctcactgaataaattttattgataaaaaaaaaaaaaaaaaa

SEQ ID NO: 2844 - DNA, 1022 bp, Triticum aestivum
  Clone ID: PAT_TA_2844
cctatctccccggtgccgttcatgggctcctttccaatcccgtcgcctccggccgcgcgacccggcagcggcagagccctcgccgccgtcgcgccctgcaactcctcggcgtcgccgtcgccgtcgacgtcgacgtcttcggttgcgccggcgagcggcggcaggaggggcgtgctcgcgctgggcgcggggttcctggcctccgcggcgctgctgtgcccggccggggacgccggcgcgacgcgcatcgagtacttcgcgacggtcggggacaagctctgcgacatggacttcgccaagtccgggctcggctactgcgacgtcgaagtcggcaccggcgtgcagcccaagcgcggcgagctcatcaatatacactacacggcgaggttccccgacgggacagtgttcgacagcagctacaagcgcgggaggccactgacgatgcgcatcggcgcaggcaagatcctccgagggcttcaacaggggatcgccggcggcggcggcgtgacgcccatgctcgtcggtgggaggcgcaagctgatgatacctccgattttggcatacgggcccgaaccagcaggctgcttctcaggggactgcaacattcctgggaactccacgatactatacgacatcctcctccgtcggcatctacaagtgagcgtctgacggcagcgaatacacaagccttgagcataggtccagtacaagccatttttcaaagcacgacgtcgcacgggatactgaactatacaggcgggcagacgaagaaaaagatttattagtctctatcattcaggtggcggaatcggatgctctccggcttccgacccgcgacgcgcgggaggcggcttgcaatctgtacgatttgcattggtcattatgatctgaggagcatgtaaagcgtcactctgtcatctgtaaagtcgagtcgcgttatatatgctgctgattctcctgaaaaaaaaaaaaaaaaaactcgagggggggcccggtacccaattcgccctatagtggctcgt

SEQ ID NO: 2845 - DNA, 1225 bp, Triticum aestivum
  Clone ID: PAT_TA_2845
ccaccccccgacacggcgaaggtgctcaactcatgcatgtttgctggttcgagatccgcgggaagatacatagcaatatgctctcccaggacacaacgtatgccgcctacatggtcttcaagacgaccgataatttctacgggctggattctccggtccaggaggcatcgatcagcgccggagcgaccaactcaacccgcaaggtttgcctccaaggtaacgatgacgacgacgccgagggcggggtgcccgacaactacccgcgcatggttccctttccgcggctaaggctcaggaggaggaaccgccgcgtagtatcccacgaagagaacgtcgcgctccctcagcagagggccgacgggtggatggagctggagctgggcgagttcctcaacgaggggggcgacgacggcgaggtgtccatcagcctggtggagacgaaaggcgggaactggaagagcggcctcatcgtgcagggcatcgagatcagacgtaagaaatcaggctgagcgaggagcccctgggattcaagccgcccgggtcagtgtaaatgaataagggaaagcatatcttctgtggtgtgtggttttgaacacttctccttttgctgctaaagcatactatgtgtacagaccatgctacctggatgactgatgggttgcgggttaagcagactatggttatgggttaagcagatttgctgtctggttatgtgaaaaaaaacggcgagggtggggtgcccgagaactaccggccgatggttccctttccgcggctaagactcaggagaaggaaccgccgcgtagtatcccacgaagagaatgtcgcgctcccacagcaaagggccgacgggtggatggagctggagctgggcgagttcctcaatgaggggggcgatgacggcgaggtgtccatcagcctggtggagacgaaaggcgggaactggaagagcggcctcatcgtgcagggcatcgagatcagacgtaagaaatcgggctgagtgaggagcccctgggattcgactcgcccgggtcgatgtaaatgaataagggaaaacatatcttctgtagtgtgtggttttgaacacttctcttttgctgctaaagcatactatgtgtacagcctatgctacctactatgactgatgaattacgggttaagcagatttgcgtcgggcaatttaaaatccttgtgtcttgtgtctaaaagaaaaacagcggactcc

SEQ ID NO: 2846 - DNA, 1259 bp, Triticum aestivum
  Clone ID: PAT_TA_2846
cactgggtgaacttgttactcttccaatgaggagaccggagcttttctcgcgtgggaacttgctaaggccttgcaaaggaatattgctttttgggcctcctggaactggaaaaactcttttggcaaaggcacttgcgacagaagctggagcaaattttatcagcataactggttctagtctcacgtcgaagtggtttggagacgctgagaagctcaccaaagcccttttctcgtttgcaagtcggctagctcctgttatcatatttgtggatgaggttgacagcttacttggtgcaaggggtggtgcaatggagcatgaagcaacgagaaggatgcgcaatgaatttatggcagcttgggatggtctaaggtccaaagacagtcaaaggatccttattcttggtgcaacaaaccgtccatttgatctagatgacgctgtaatacgtcgtttgcctaggaggatatacgtggaccttccagatgcgcagaataggatgaaaattctcaagatattacttgccaaagaaaacatagaatctgaatttggatttgacgaactagccgatgcaacagaaggttactctgggagtgacttgaagaacctatgcgtagctgcagcatacaggccagttcatgaactgctagaagaagaaaagaagggggctgtgggcagtacgaaaacttctttgaggtccttaaagttggatgactttgtccaagcgaaagccaaggtgagcccatctgttgccttcgatgccacaagcatgaacgagctaagaaaatggaacgagcagtacggagaaggcggcagcaggagcaaatcgccattcgggttcggcagctaacatgattccggtagcaattttgccacactgtatcacttgtagtaccaatgtgctccgatttagccatagggagtcagatcagcgatagcgctattcctttgaaactctgatgtccaccttttgcggttttgcctgtagcgtccactctgctcctttctccacttttcggtactcacctagagccctatttgagcggtactacggtggccctgtttcgttgagaaacacgcctgacgaacacggaagtttcctgagcctgtgatggtagtgatacacggggtcgcccatttatttgtgttgtacaccgttgccgccgaggcctgatcaaaatgtaaatagatccagaaatttttgcacccagaacagctgacggtgtacgtctgtaaattaccccacttctgtgctcgtttcaac

SEQ ID NO: 2847 - DNA, 1134 bp, Triticum aestivum
  unsure (1)..(1134): unsure at all n locations
  Clone ID: PAT_TA_2847
caggaacagaggcccgccgtnnaagccgtgcacaacggggccactaccaccaccacaacctccaccctactctgctccaccgcatccggcagcggcgcgcggcggcggcagcggggaagccggcccgggggaaggcaggcaagcgacaggggccggcagcgccgccacgcgccgccggcgccctgctccggccgccatgcagcaacatcaaggagttcctaaatttgggaactgggaggacgaaggccaaggctacacgcagtacttcgaaaacgcccgcatgggcaaatctccggggaggcctgtcaaccaaaacgatcgcaatgaaggcgctgcacaggcaccctcgaacgacccgccgtcggtcaaggcctctcccttgaggccggggtccgagccggggctgcggaagaaccgggacgaaaggcgtgccacccgagaagacgacctccgtcggcacgaggccgctgcccggaaaacgcatgccgagtcacctaaccacagatatggtgaccagaccaactacgacggtgctgcgaggaaagcaagcaatgagaggtcacccatccatcctcggcagcaggcaaggcttgcagacaaaggtggggtttcatctcctgttgcggatcgtaggggttctgctcccaccacacctggaaggtccaagatgaggccaactgggcgcggcgatgaaacgcccgagagaggatcagctgttccgaagtttggagactgggatgagaaagacccttcgactggtgaaggtttcactgacatatttgagaaggtgagggaggagaagcagtccggcgcggatactgtcggcaccagccatgcatataaggaccgctacaaccaaggggacagatatgaatcttcgggctgctcatgcttcagctggttcaagaagtgacacccaccctgcctgtaacatacctgtggcgattgtatctttgtgaaatgagtagccaaatctgttgttattttgttgagatgttatgttatagcgagacatgtatcggagcatgaattattcgcaaggctgtgattcagcattttttttgagcatttgtaatcagtggttggtttcctgaattttgcaacaattgtctcattcctggattaaaaaaaaaa

SEQ ID NO: 2848 - DNA, 1409 bp, Triticum aestivum
  Clone ID: PAT_TA_2848
aaatcaagagcgtattattgaaaaaattaaagatgccatcgaggaaaaactgatgaactgtaataacacaaggatattccaaactcaggcactaaactcttcagcacttcgtccagctaacacacgaaaggacaagggtactgaagtcagcacgcctactggagaaaaatctcaaaagattcctgtgagccaaatggtcagaacagatccacgcgatccatctggaaggttgcacacctattggcaaggtcaaacttcaaatcttgaaaagaaatctggccttgttgccgtaagaaatattgtaagatcaagaagaaatccaaaagatgctggtgatttgtccagtcgccatgagcttgttacagaaatagattataacttacatcctggccttttcgatattgttaagaattgcacatatgttggagttgccgatgaagttttcgctttgatacaacacaataccctcttataccttgtcaatgtggtaaatgttagcaaagaactcatgtaccaacaagccttgtgccgttttgggaacttcaatgctatacagctcagtgaaccagctccgcttctggagttgctgacaatggcactgaaagatgacgagtcaatgagtgatgtaaatgagaaggagaaactagaaattgcagaagtgaacactgagatactgaaagaaaatgctgagatgattaatgagtacttctctattcacattgatcaaggtggcaaccttaccagacttcctgttgtacttgatcagtacacccctgatatggatcgccttccagagttcatgttgactctaggaaatgatattgcctgggacgttgagaaagagtgcttcagaacggcagcagctgctattggaaacttctatgcgcttcatcctcccatccttccaaatccatctggcaaagggattcgattatacaagaaaaataaagattccatggaaagcgctggacaggctgataacgatttaacaagtacagatgaagatgacatcgaccaagagctgcttgcggaagcagaggcggcatgggctcaacgcgagtggaccatccagcacgtcttgttcccgtccatgcgacttttcctcaagccccctaagtcgatggcaacagacggaacattcgtccagattgcttctctagacaagctttacaagatcttcgagagatgctagccgacacaaaggcagccggtcgcacgatatgtagagaaggaagggagagcgcgaccgaccgacgcctttgcttgttccctctgggacggacttgcgtacataacggtgccactgttttcttgttgttggtccttgcgcggctgcttgttcacgttcgtgctttttcccggactcctgcgcccggttgtgtccccgtcaggtggcttgctacgcagtg

SEQ ID NO: 2849 - DNA, 460 bp, Triticum aestivum
  Clone ID: PAT_TA_2849
agagagagagagagagagagagagagagagagagagagagagagagagagagaggcagagagaagaaggtttgggcgaggggtttactgttcaaaccatgcgagattctggagcagatagtctgccctgcgacgaagcacacgaggcaattcattgcacagatgattcggctgcgcaaggatgcgctgaaccaagtcccagatgagcacaaaattcgatcggaccggctctgacgagaactatgttagtactacatgctaagcttagatgcatgtattgtttcagaaggaatggtgtgccagtgatcagatcatgtgctaaggcctgtgtaacctctattcagcgcctccgttatgccggatttctcttgaattgtcgtagtttcatacagtatatccttctgttggggaattatgtgttaagtatactacttaagattacttttcggatttgtgtgatt

SEQ ID NO: 2850 - DNA, 1119 bp, Triticum aestivum
  Clone ID: PAT_TA_2850
ggaccagctgtgctgctgctatgccccagcacagcagtcagctattggagctcagccatccagaagtgccagagcgctagctttggtagctgttcgtcgactaacgagccccctcctgcttcccaccccccacctagagcaactctctgctcgctgcctcccgttccgctgtacctcccggcaccgcatgccaaagattttcaccgatccggcgtttctttccctctagcgccagaagcacttcgtcttcttctttttttttcttctgatttgtgttcgcagactggggcttagacgccaactctatggcagatttgtagcatagttttagcagaattatagcagcacaatctgtctctgtaaaaccctcaagatacagtaagctaactgataaacagaagcatccacttaagcagctgctccatccatagcccaatccatgctactgctgctggcgcttgcgctgagctacccaaacaaagggagagggggagacgcagacgcagggggaagacggcggattgcgaggagccataaggacaaaggagaaaccgcggaaaaggtggtgcccgcgaggaaagaggagagggaaggccccaaaagcacttcgccgataaaatcgaacaggttgatgttgagaatttcgtagaagacgtcgatggcggcgatgaagatggcaaagatgttaaactgaatgcaagtgctggtgtgaagagaggcaggccactgaaggagagccccaacatcgtcctggaagagaacagcaattccagcgttcgatcaagcagcgatgaatcggccaggaccaatggattcaggcagattgggaaccggaggaagagcacgccacggcgagcagcggaagcgggcctagaatgcaagtgatcgctgagcaatgccatgccaatccatacaattttcggcaccaggtagccttcataatttgtttcaaatgtaaacatgacatgcactgagtgctgaaattcgtgtgtttatgtggacgcaaaatgtatgaactggtgatagaacacctacggaatcttggtcagctgttgtaggctgattgctactagtattttggtctgcttgtttgtagcagagctttccttaaggacgact

SEQ ID NO: 2851 - DNA, 724 bp, Triticum aestivum
  Clone ID: PAT_TA_2851
gatttcaggctgcgctgcacaaggttgtcaatgagatgctcactgtggacgagtttgaagcagcttgggctgagctgctagacaaatacaagctccacaacaacacgttcctcatccagattttcgaggttcgccacaagtgggcgaagccttattttagtggcaagttctgtgcgaagcaaaccagtacgcaaagaagcgagagtgcaaaccatttgttgaaaggctacatcccgcctgcatgccccatgaacctttttgtgaagcaatatagcaaattgcagttcgatcgtgaagctgaggaaggattccaagagaagagaatgaggctgggcgggatagttctccgatacaattaccctttggaggagcatgcaagtaaagtctatacccggacaatgtacgagatgtttggccaggctttgtatcggtctggtaggtatgatgttgaggaagttgagcggggcatcacctaccacgtgcgacatgttgaagctgagaagcgagagaagtggtgccgtgaaatgcatgtggtcagtgtccatgatggcggcgctaggttctcgtgcgaatgtgggctcttcgagcacatggggatgctttgttgccatgctatcaaggttttaattcatttgggagtgagaaaaatacccagattccatgtcatgaaaaggtggacagtagatgcccgcgacaattcgccacttcaccttctccattacca

SEQ ID NO: 2852 - DNA, 442 bp, Triticum aestivum
  Clone ID: PAT_TA_2852
cgaggactccttcacctggggtctgctcctcccaggtatataccccccaacaatggcttgatgctagccactgccggcatgcagctcgtgctgcccattgccgctcgcggtcaccggcggcgatggcggtgcgcggcggaggtatctagctagctaggcgggtgttaggccgtgtagggcaactatacatctttggcaatgtcttcttcttcctcctccatgggaggattgtaatggagtgtgtaaactgtgcgtgcatcccctgggctgggctctcgttcgtggaaactcaccgtcttgcatttctacgaccaatactggttgctctgtttcctaaatgaaaagaaatactatactagtgctctagaaaaggaggctgctgtttgtggcgagctggcgagcttgtcaaaaaaaaataacaactttttaccgttgatctttt

SEQ ID NO: 2853 - DNA, 731 bp, Triticum aestivum
  Clone ID: PAT_TA_2853
gccggccgggtcctggatcttctaaccctagccgcctgcgcgccgccacacgaacccccccacccaacccgagcgagcaccggccgaggaggaagaggaaggtgagatggctcgcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctccaagaggtacctcaagtacttgacaaagaagtacttgaagaagcacaacgtgcgggactggcttcgtgtgatcgcagccaacaaggagcgcaacgtgtacgagctccggtacttcaacatcgctgagaacgagggcgaggaggaggattagagtgcattgttatattgtagtgcttgttgagttttgatacttgatctgagtacctcctagttatccacctatcttatgttgtgctctgttgaacatgaatggtttaatttgaagaatccttatattttgcctccccttgactgtgggtccatatgtctgaacctatagacaaatattatggagatttgttccagttttcaaatggaaaaaaaggccccaaacaaatagcctt

SEQ ID NO: 2854 - DNA, 751 bp, Triticum aestivum
  Clone ID: PAT_TA_2854
ctgtgcggcgctcgagccggccaggaaaactctagacaccctatcgactcggcgcagccaccaccgaagcagactccggagagcaggcaaggcggagaccgagatggcgcgcggcgtgccggcggctaccaagggcggcgcgggcgccgggaagaagaaggggtcggtcaccttcgtgatcgactgcaccaagcccgtcgacgacaagatcatggagatcgcgtcgctcgagaagttcctgcaggagcgcatcaaggtcgccggcggcaaggccggcaacctcggggactccgtcaccgtcgcccgcgacaagagcaaggtcaccgtcacctccgacggggccttctccaagaggtacttgaagtacttgacaaagaagtacctgaagaagcacaatgtgcgtgactggctccgggtgatttcatccaacaaggaccgcagtgtctatgagctccggtacttcaacattgccgagaacgagggcgaggaggaggattagatatgcactgccttgtttctgtgtcgtgtgaaactttgaacttgttgagcacttttgcggtagagttttgatgtttattttttcaccgctgttttgaattgtggccaggacgccatgtgatggatgcttagataaccaacctaaagaattgtccgttctcgttcttgtgttatgttggtgaggctatgcgtggcctagaaatgttgcagcactcaaattcctatatcattcatcacggtttccttcaatgcc

(The sequence listing continues in the following parts.)

What is claimed is:

1. A recombinant polynucleotide of SEQ ID NO: 28,864.

2. A recombinant polypeptide of SEQ ID NO: 134,446.

* * * * *